United States Patent 9,328,346 (POLYCOMB-ASSOCIATED NON-CODING RNAS) - sequence listing, part 153

SEQ ID NO: 192627 - RNA, 36388 nt, Homo sapiens
agagccgcuucccccuccucccugugcugucugcaccgaggagagcggccugccgggugaguagguccggugccucugggcccucgggguccccucuccugcaggcucgaggugggcggggagaagggggacgggcgcggacccgggucccagggccaggccucccuugugaguagacuaugcaaagaaaguaaguuucuccuguguuucuuauucuuuguaacucuuacugcuguuaccacuauuauuugauccuaaaaaguaauucacauucugaauccauguuaaacuuacccauuuuugaaaauuugaauguguucaucugguaauugugaccuguuaccccuucccucccuccaacucuacccuuuagacgggcuucugcgggcuuuucuccuccauugcuugauuuaaccaacagcacugaauuguuucuugcugcccaaagagcagagcaaggcccugaugucaagggcuggugaggggaggcggaccugugaaccaaggagcaaaacuucuccaaggccuccaaggggaaguuucaagcagaaucuuaauaaauugaguguggcggcgagauggggaggacaggauuggggggaaaagcaccugaggcuuagggaccacuguggucugaagcacagagugggccuggggccugggaggagaggagaugggugaggggaugaaggagggagagccuaccuagaugggcacuguccagcagaaauacaaugggagccaguagguucauucuaaaauuuuugcagccauauuuuuuaaaggauaaagaaacagaugaaauuaauuuuaaugauuuuuaggaaauuuuuaaaggauaaagaaacagaugaaauuaacuguaaugauguuauuuagcuugacauauccaaaacuuaaucauuucagcauguaaugagauuuuuacauucuuuuuaucauaccacgucuuugcaacccaguguuuuucuuauacuuacaucacaucucgauucagacuggccacauguagccucaguagcuaugugaggcugauaguccacccuggacaggacauauuuagauggugaaaagccuugaagagcagugaagaugaccugaagggcuuuaagcagggaaagcaagaaaaugacuugccagauuugcauuuuagaaauauggugcugacaaccguguggaggacacauuuacaagcagggaugaguggcggcagagaggccugagauaagguuuuugcacauggcugguaagacuggaaaugggcccgucuuuacugugaacaauuuggcaauacugucagaauuacaacugcauauacuuuuugguucuggaguuccauuucuaggaauuugucccauugauauauuagccccugugugaagugaccuguguacaaagauguucuuuacagccuuguuuacaauagcaaaagauagggaacucuuuaaugcccauaaauagggggacuagcaguuuaauaauaauaguauaucuauacaauggaauacaaugggcaguaggaaaaaugaaaaagcucucuaugugcuaacaugaaaagaucucuaggauacauuaugugggaaaaauaagaugcagaaguguguguauaagcuacuaccuuucguguaaaaaaugccacuggaagaauacaggagaagcgcugauugacucuggacagggaauuuagcagcggagacaggaggaaaccuuuuacauuuucuaaauuugaaccauguaaauguaauaccuauucaaacaauaaaaugucaaacuagguacauuuaaaucuuugaaaagaguauauugauggcugggcgcgguggcucacgccuguaaucccagcacuuugggaggccaaggcaggcggaucaugaggucaggagaucgagaccauccuggcuaacauggugaaaccccgucucuacuaaaaaaaauacaaaaaaaaaaaaaauuagccaggcgugguggugggcgccuguagucccagcuacuagggaggcugaggcagcagaauggcgugaacccgggaggcggagcuuccaaugagccaagaucgcgccacagccugggcgacagaguaagacuccgucucaaaaagaaaagaaaagaaaagaaaagaaaagaaaagaaaagaaaagaaaagaguauauugccacagcucaggcaaaaguugcugagacucugaagugaggcagugucagugggcgaggaaggaaggggcauauuugaaagugauuuaguuugucaggucccagauaugagacaaaaaagacucagggaaaguuccuagauuucugauuugaguacguaaaugguauuaucauuuacugagcuguagaauccaggagauaaaguauggauuuggugggggugggauggaggauuggggaccaggagauaagaggucuacuuuugcagaggcuaauuugaggggacugugagaccuccagguggaguugaaaaauggggcucaggagagccauggccuagaacugcagauauaagagucauauuugcaauuggugaguugaagccauggaaauggaugagaucacuccuggggaguaugcagaaugagaugaaaaacgccuuagacagaauccuggggcaaacaauuaagagggagaugguggaagugaacgcagggaaaaggccuguaaaggcaaagugaaggguaauagaagaaccaagggaagauggcauaggagaagccaggaaagcagaauuucaggaaucaaagagugaaauacuauagaaagugguccaguaaagauggauagaagauaauccauuggcauuaaccacaugagggauucugaugagcaguuucucuucuuuuuuuugagacagggucucauuccucuugcccaggcuggagugcaguggcacaaucacagcucacuacagccugaacuucccaccaagugauccucccaucucagccucccaaguagcugggacuauaggcaugcaccaacauggccagcuaacuuuuuguauuuuuaguagagaugaggucuugccauguugcccagguuggucucgaacuccugagcucaagcaaucugccugccucugccucccaaagugcugugguuacaggugugagccgccaugccuggccacuggcaguuucaaaagggugcugggaaugaggcagggagccagguuauaguaggcugagugggcagguggacagaaggagaguccacuacucauuccagaaguuuggcugcuuaugaagagaaggaaacacaguaggaaccagugauggaaaguugggaaggcuuuucuguuuuuaaaauggaagaaauggaaugcuuagggcacuaugcuccuuguuuggcuauccauaggccuguaaaacuuggccugaagacagaaacaggugcaacauuuaaagcaaaagcccauggccaaagcagaugaagucauccuucuuuuuugaaaacagcagugcccucuggaggcaaaaaaugcaucuugucuuugcauuuuagaaugcaaaggauuguacuagaccugcugcuuucccuugaugaguaagaauagugcucugaugcuguagaugguuguacaaaauguuucuauugcaaagacauuagaaaucauuucgaccaggcgcggucgcucacgccuguaaucccagcacuuugggaggccgagacggguagaucacgaggucaggagauugagaccgugcuggcuaacacggugaagccucaucucuacuaaaaauacaaaaaauuagcugggcgugguggcgggcgccuguagucccagcuacucaggaggcugaggcaggagaauggcgugaacccaggaggcggagcuugcagugagccaagaucgagccacugcauuccugggggacagagugagacuccaacucaaaaaacaaaaaaacaaacaaaaaaacaaacaaagaaaucauuucgaggccuaaauauagcaacaagugugggcaacuguaucuuuaagcauuuucaucaucagucuucuaaaaauucauaaucuuuaauuccuaccuauuagauggaaaaucauaacaaaguauuuuucccagauuuucugacuuuuaaccagauauaccccuaucauuaggucaaggauguuuaucacaaauucaauaauacaccccccucacaggcucuaguggcauuuccucuuucuucaaacgcucuccagggggcuucacucacucauaagcucggucuucuuuacuguucuuugaaugcuguucucagucucaccacuuuguuaucacccucuucuucuaaauauguaaaaaccuccugcauccuucaugaccaggcucuagucucaacuccuccauauagcuuuuccuguuccaggucguagagcauuuucccuucucugaacugccauuaugauuuccacuggaaccucucuuggaaaggguagaaggcaaacaguaacaacaacagcaaaacaauguguacaucguuaucaaggaaauuaagaacucaucaagaucagaaaucauguucaguccuccuacaguauauucuuaccgaauuuccuaagauucuggcuaauguuuauugcaucuuuucuaauucauuccuagaagugggccaccauaucuggaaacuacagucuaugcuuugaagcgcaaaagggaauaaacauuuaaagacucccccggggaccuggaggauggacuuuuccaugguaaaaagcauaaauguguauacgucaugaaccuugaucagcacaugaauacuucuuuauauaacagcaagaaaucugggguguucaccaacaguugacauccucaucugcuuuuaauagcucaauaaaguuuucuccuuucucccuucuugagaaauggggaaucaagaauaugcuaaucuaauaaauagugucaacuugaagcuggaugauuuuucagaaucauuuuaauucucagcucauuuagugauucugcuuuuucggguugggguaaggagaguaauagaggaugaaugaaaagaagggaauagagaaagaucagauuagaagucacuuacuaaacuugaaaauuccacauuaagguuuguaccaugacaaaggcaauuaaaaguggauccuugcugguggaugagagacagagcugaugaggcucauguccccaggucuucugucuagagaaaccccaugagcuuuuggagauuggagucuaucugagaguuuggggucauuuuggucugugacuuuugggccuuuuaaaguguugaucucuaaaccucaucucauucugaauuagaaugagaugcacugagaugcauuggcgguggcuggcgccuauaaucccaguuacuacagaggcugaagccaggaggaucacuugaaaucaguaguucgagaccagccuggucaacauagcaagacuccgcucaucucuaaaaaaguaaaaacaauuagcugggcaugguggugcaugccuguagucccagcuauucaggagacugagaugggaggauugcuucagcccaggaguucaaggcugcagugaacugugauugcaccacugcacuccagccugggugacagagugaaaccuugucucgaaaaacaauaaaauuaaauuuaaaaaaagaaaugcaucggccccuagggaaaugacauagggccaauguuugcuggcacauuuaguauuuuaaguguuucgggcaugcagauuuaaaaaaacacaugcuuccugcccucccaaacacagugcuuugagcaggauuuccauugcauuguguuuacuaggguguauugguuaucaguaagcuguagucauuccacuuccauuuuuuaagaaagccauucucauuuuucacagguggccggagcagcagcuuacaaugaaaaaucagguaggauuaccucgcucucacucuuguuucagaaagucuuugcucagaucuuuccucaguggagaaaggggaauacagaagaaugucuccccuacaagugcucaggugcgugacugcagacccuuguggggacccccgcacaugcuucagaguugguguggcaccgaccagcaggcauauucucucaaggccuacaccauuccucuccuuugcccguaaaugugagacucuuuuaacgacagccuauggcugaauugaccagaugggguggccaacugauugucuccuugcucaacgaguacuauacaagcuaaauaguucuggccuaauuccaggggucccccauuaaagauuuucaaccaaagcucaggccaauagggccugacuacccaauuccggcuucguuuggguaauugaggccacaagaggucuuucuaggagacucagauuagaaaugggaguugaagcaaaauaaaaguaaugaucacauuuuaucuauuuuaggaugcacauuuuuuuuucacauuuuaacaauacugaaauaagguaguguaccuguuaucaauugaugguaugccccaguuuaguuggcauuuuuuucccuuucucagaggcauuguaacaacaauaucuuagacaccaugaaauacagugucccaagcuggguccuccaggaagcagaauuugagauggaauuaggagugcaaaaaauucacugugaaagguaaagagaggaagccggacugggcagacuagccaucagacuguaauaaaaacccgacagucucugcaagccugagauugacuguuagaggugucccacguugggcaugaauggccuugcucagcuacugauggaggcugcccugagaauagcaugaccuuggcugaaagcugagaugaacccugaggggcuaacagcuggaggcugucagcuaacuguauuucccacuucauagccaaucgcagggagaucugaguagcacaucuucuugucugccacauacgguaaauaauuuuuagucaauuaguuuuaauuucaccaaaauugugccagacuagaauaucauaaagaauuauuuacugaacugaagcagacaguaucagugcucauuggcugguccaaugucuccccuacuccuccucaccagggaacugccucaaucaaugaccaauagaaguuggguaggccaggcaugguggccuuuuugaagccacccaggugggcagauugcuugaaucuuuuggagcacucugggaaaugccucugagaaaggggaaaaaaugccagcuaaacuggggcuuaccaucaauugauaacagguauacuaccuuauuucaaucggcccaggugggcagauugcuugaaaucaggaguuugagaccagccuaggcaauauggugaaaccccaucucuacagaaaaaaauacggaaauuagcuggacacgaugguguggguguagugcugugagccuguagcccuggcuacucaggaggcugaggugggaggauggcuugagcauaggaggcagaaguugcagugagccaagacugcaucacuacacugcagccugagcaacacagugagacccugucucaaaagaaaaagaaguuggauaaauacuccagcuccugugguuacuaccccuccagugguauaacccugaggcacaagaucuacacuguuucccaguagaguuaaguuccaucugccuaguuacacgugcuuuguucauuugucuuacuuucccagccugcccuccccaccccaaggcccuaguauuuccuaggaucaccucccaaauaaacuacuuacauucacaucuuugucucagggucuacucuuaagaaaacauaaacuuagaugcugacaaaggcaaaaaaguuauaaaaccuccgccuauuuuggcucauaauuaagucccuuccaauaccugugcccuaagcauuggucuuucuaagcucgccacuuuuauauauauuuuuaaaaauucacaagcccccauauacaugguuuuccuaccaucaucacugcaucauaguaacuaccacuuauggaguacuuaauauaugccaggcacaagacuaugcacuuuaugggugaccuaccacugaaaacucuuagauguccguggucuaauuauauguguaguugagaagaagaaucaugaagagcacuacaugaaguucaucucucuuuugcacauaggaaacacagucuccugguaugaagugggauuacaaccuuucaaacugugcuuuuuuuuuuuuuuuuuuuuuuuuuuuuuuuuaaucuucucuucuuuuccagagacuggugcucuuggagaaaacuauaguuggcaaauucccauuaaccacaaugacuucaaaauuuuaaaaaauaaugagcgucagcugugugaaguccuccagaauaaguuuggcuguaucucuacccuggucucuccaguucaggaaggcaacagcaaaucucugcaaguguucagaaaaaugcugacuccuaggauagaguuaucagucuggaaagaugaccucaccacacaugcuguugaugcuguggugaaugcagccaaugaagaucuucugcaugggggaggccuggcccuggcccugguaaaagcugguggauuugaaauccaagaagagagcaaacaguuuguugccagauaugguaaagugucagcuggugagauagcugucacgggagcagggaggcuucccugcaaacagaucauccaugcuguugggccucgguggauggaaugggauaaacagggauguacuggaaagcugcagagggccauuguaaguauucugaauuaugucaucuauaaaaauacucacauuaagacaguagcaauuccagccuugagcucugggauuuuucaguucccucugaauuuguguacaaagacuauuguagagacuauccggguuaguuugcaagggaagccaaugaugaguaauuugaaagaaauucaccuggugagcaaugaggacccuacuguugcugccuuuaaagcugcuucagaauucauccuagggaagagugagcugggacaagaaaccaccccuucuuucaaugcaauggucgugaacaaccugacccuccagauuguccagggccacauugaauggcagacgguaagucuuuguuucuauucucuugcacuggcacaggugaucccugaaaauuaaauaauuuuugaguguacacuaugcaacacuauguagaaaccaucuuguuuggauuaagaauaugagccagaugcagugguacaugccuguaacccagcuacuugagagccugagguuggaggaccauuugagcccaggaguuggaggccagccuaggcaacauacccagaccccaucucuuuaaaaaauuuuaauuuaaguuuuuuuuuaaaauaggcuggucaugguggcucaugccuauaaucccagcacuuugggagguugagacaggaggaucacuugagcccagguguucaagaccagccugaggaacauagcaagacccugucucaaaaaaaaaaaaaaauuaucagggcauggugaugcacaucuguagucccaacuacuuugggagacuaaggcaggaggcgcacuugagcccaugaguucaaggcugcagugauuccugccagggcaacagagcaagacuuugacuuugacucuaaaaauaauaauaauaauaauauagcauucagugccaggccaucuggauuugaauaccagcuuugcuauuuauuaacuggguaacccaaagcaaguuacuuuaucuuuuguucuucaguuuccucauuuguacauugaggauaauaauagcauuuauaucuuagagcugggaucaauauacauaaaaugcuuagaguagugcuuggcacauaauaaguauuuaucauuauuauggcuguugcuauuaucuuaggcacccggaggaauuagaacaaucuuugaucccaaggaaccuaaaaucaauuauauucuuuauuauaaaaauauucuuuauuugaaaaaucucucuggggagaaaaaccaucucaacauuucugaagcaaccuaucaauaguaaacaaaaauaauacuuaagaguauguaaauuugugacaagaguggaguauaguggaccaagaaagauugcuucagaagguaugaguuuugaaugugaucucaaguuucgauggguaugauuggcaggaggggaagcuuucuggguggucagagugacuugaucagagagaugcagaggaauugacagaaaauaaugggcuugacuacagucaggagacacagguggagcucuaagucauagucuguguguuuauacacagaauauaacucugccaggggcuguggagaaugcaaggugcaacuaagcauuuagcugggggucacugggcacaaaggugaggaugcuggcagggaaggggaaggagucaggguagcggugaaccuagguauuucugagucagugcagcuccccugcuagacggagagcaccuuaaagauggagaucuuggcuuauucaucccuauagccucaaggccuggucugggcaugcaucuaaggguucagcaaauuaaagauaaauaaguggagggggcaggagggagaaggcaccacaacagagggugagaaugaauauaaggcuuuauucuuuuuuuuucuucuggaucagugaugucacacuuaagacucucgugaccacaaucaaauagucuuagacacugguaaaacaaacaaaccaauaacacuuauugccuauaagacaauuagagggaagacugaggggaguucaugaaaugaaauauuugagaagucauuaacacacaaauuuaaaacuaaaauggaagcauccuaguugaguaacuuaucccuuuaacugaauuuuuuaagguauauuuauugccagcaacguuaggaacauuacaauuuuuaaagggugucggugcccccaaauugcaaauucuaauugugcuuucaaaaugaagcauucauuaacaucagugaagaaauaccugaguuacccugaaagggagccaaagucaauagaaugauuaggggaaucugggcaugggggaaggaaggacacuaucauuuuuagcacagcucugaggguuaacuaggagacgauguuaucuaaaguacagcucauguauauguacagucuauuucugaagagagagaugaagaacuugguugcacauaagaugggugggugagugggggggucugggaaccugaccaagaaggggaccuacuuuucauugaagaccuuuuugucccauuuggaguuucuuuaaccuuguuaaguuucuuauaccuuaaaccauaaaaacauuagaagguggaaauucuccaagaaauuuuauuuccuauuuaaaacgagacaaaacaaaaacccacgacgaaauagcaaaaagucaugguggucgggcagagaugaaaccauuuaucgacagaacuuaaaacaaaucacagggaauacucagaaucuagccaucugguaagguaauacagcaaggggcaaacagauguuugcaaugaaaauuauaucauccguacauuuacauaauuucugaauuauguaauucagcuucguucauggcaaucaaauaaucacucuuuggaaauacgaguuucuauucauuauuaaugaaauuuuuuagaauuuaggaucuucaaagaguauuuuucaaagcucuucagggaaguaaagauuuaaauuagucauuuaagaagaaggaauuuaacaaugaauccuacccuuucuucccuuuucaggcagauguaauuguuaauucuguaaacccacaugauauuacaguuggaccuguggcaaagucaauucuacaacaagcaggaguugaaaugaaaucggaauuucuugccacaaaggcuaaacaguuucaacggucccaguugguacuggucacaaaaggauuuaacuuguucuguaaauauauauaccauguacuguggcauucagaauuuccuaaaccucagguaaguuuaaaauaaauguggcuuuauuuagcuccauagucuauacagucuuuuuuuuuuaaacaaauuuccaucauuucauuacauucaugaaauauuuugucaagugguauaguucucaauuuuuagcacaccugcgaguaccagaaauacugaacagguacaguugccauaaguuaucuuaagaaguuugauuuaggucugucgcaguggcucaugccugugaguccagcgcuuugggaggccaaggugggaggaucacuugagcccaggagucugagaccagccuaagcaacauagcaagacccccaucucuaccaaaaagaaaaaaaaaauuagccaggugugguggugcacaccuguagucccagcuacucgggaggcugagguaggaggaucacuugagcccaggagauugaggcugcagugagcugugaucacacugcugcacucuagccugggugacagagacugucucaaaaaacaaacaaaacaacaaagaaguuuaaaauguuaccuaacccaugucuaaauuuuaaguaggcauacugcagauagacacugaaacuaguauucccucagucugaacacugguucaccccaacauacccagugaccucguuggccuuuuccuaaguaggcaagggauucagccucuuaugucccuccauguguuauauuccuggagcagcugggguucccccuccagcaucauuccaaucaaaucuauuaccugaggucucuucccacccaugccugcaguggagccuggcugucuagcccacucuccacugaggcacauaaaauacaagcauuaacgaacucaggaggcaaagguugcagugagccgagaucgcgccacugcccucuagccuggaugacagagugagacucugucucaaaaaauaaaauauaaaauaaaauaaaauaaaagcauuaaagaauaggaggaacccacucagauggugaaaagagggaaacuuaauccccuucucugccuuugucuaucuuucuucuucaccauuucuggucccuucuugagagcucucuaaucccaaacugguccucuagucucccucuaucccucaguuuuccaaaguccuuccaugggcaacauuccuguauuacuuugauguuaacaguugguagaaauuuaaaucugccaaaaauauuagcauuucuccaagagaaauuacaugauagaucuuaaugauguugaauaagugcugcuuucuuauuuuaaucucgaucuccuuuaugaaaauucaagggcucuugacguugaccuggaaggggcaggugaaugggguaaacagaugguuggcucucugaccuggggggauggguaaggcuauauaaacugggagaaauucuagugcccucauguccugaauagcacaagauggccacucuauugcuucaguuucucaccaucuaaccuuauaccauaauggguucccucuggagugggaccuuuccugucaucugaggaggcagggacacgaacccugagggagggugaagguggacauuguaaaauaugggcaggaucaagggguaaguggagucuuguucuugacucaaaugcugaucuuaaauuuguguuuuccugcagauauuaaaacaugcaaugaaggaguguuuggaaaaaugcauugagcaaaauauaacuuccauuuccuuuccugcccuugggacuggaaacauggaaauaaagaaggaaacagcagcagagauuuuguuugaugaaguuuuaacauuugccaaagaccauguaaaacaccaguuaacuguaaaauuugugaucuuuccaacagauuuggagauauauaagguaaguuaauaucuuagaaauguccuacuguucauucauucauucauucauucagcaacaucuguuuaguaucuacaauguaagaugcaggggaugcagggcuaggugcuguacaguguggugguguucuaacuuggugaaguuuaauuuuuacagauuguccaccucugaccuaguaaaacaugucauuauagaagccauguuuggcaagacacgguggcucacaccuguaaucccagcacucugggaggcggaggcaggcggaucaccugaggucgggaguucuagaccaaccugaccaacauggagaaacccugucucuacuaaaaauacaaaauuagcugggcgugguggcacaugccuuuaaucccagcuacuagggaggcugaggcaagagaauagcuugaaccugggaggcggagauuguggugagccgagaucacgccauuguacuccagccugagcaacaagagugaaacuccaucucaaaaacaaaacaaaacaaaacaaaaaacaaagaagccauguuuacccacuaccuagcuucugucuuuucuuuuaauggcacuuauucuucccucugcuccuuaaagguaagcaaccuucuaguuucagugugggguccuugccccucucucaucucucucccuucaagaacacaacuguucuuacaacuucugugaaguccugucuucuuagccaauccucucucauuuccacuuggaucucugaccgucaucucaaauccaguguauuuaaggcaaauucuuugucuucucucucucucucuuuuuuuuuuuaaacagaugugaucuugcucuguugcucaggcuggagugcaguggcacaaucauagcucacugcagucuugaacuccugggcucaagugauccucccacuccagccucuugaguagcaggcacuacaggcacaugcuaccaugccuggcuaauuuuuaaauuuuuuguagaaaagcagucuuacuauguugcccaaucuggucuugagcuccugggcucaagugaucuucccaucucagccucccaaagcucugggauaauaggugugagccaauaugccuggccugucuucuccuccucaaucaguuuucccucuaaaauccccaucagucucagcuuugccucucgcuggcuauauaaccuugggcaaguuaguuuacuuaucugugccucaguuuccucauccuuaaaagagggauacugauuaccaucuuauggagcuguugugaagaugaaaugaguuaauacaggugggugagguggcucacgccuguaaucccagcacuuugggaggcugaggcaggcggaucaucugaggucacgaguuugagaccaguguagcuaacaugaugaaaucccguuucuacuaaaaauacaaaaaauuagccaggcgugguggcacacaccuguaaucccagcuacucgggaggcugaggcaggagaauugcuugaacccaggaggcggagguuggagugagcugagaucgcaccauugcacccgggcuugggcaacaagagugaaacuccaucucaaaaaaaaaaaaaaugaguuaauaccuguaaaacacuuagaauaguaccuagcacagaguagaagguuagcuguuacaucaacuguaaugagcuguaguucacugagugcugaauuguuacuaaauucagugaauuguuuaucuuuucuuuccaauuucuuuaacagcagugguaugccuggcuaguuuugccaugucuccaguacugcccucaaauucaacccauucuuuuuuagcucaucuguaggugaccucggaaggaaaucagcuguggucuaacacauuugggguccauguguuggaggggagcuugucuuaugugucugagugcacuucaucucagcuuuuuguuuggguggacagaucaagcugaguuccuagcaugugaauaaacugugauauuuucagcauaauuaguauauauugcagugcuguucugccuuuaaaguaccgaccaucucugcuuuauucucacuuagcuggcauuuucgagaaagacuuuaaugauguuagggaagaauaaaaaggaaaggaaauaagauacagcaaccuaaaauagguuuucaagauauagguuucugauucugccaacagcaacauccgaguuuuagagagacuucucggcaugugucuggauuuuggauauagagggccuugcaagguuugccuugcagagaguggcugcaaacauuaguucucugacugcucauauucccaccucuuggccugcucuaugugcaugguugccauuuuaucucugccuauauggaagugaauuuauacuuguuccagcuugcucuuucuuggagcaaguauaaaaguucuuauuccuucugcugcccaauuaaacacggggagauuuguagcauuugcugauuucuguggcugcuuucaagcuguugauaugacaucacugaaaacagauuuagaagagauggucacagcaagcugucuugagucauuguaugccagcuccaguaucccacugcgccucacccacagcuaacuggugagaugguggugcaugacccaaggaaguagcucaccuucugauaaaaugaauaauccuguccuucagaugaaguucaucaguuucccaugcagaggauuaucucuaagcccagauaggugcccugaucaccucccugaacuauuucuuuuuuuaauuuccuuuuuuuugagacaggaugucgcucugcugccucggcuggagugcaguggugugaucauaacucccugaagccucagccucccaggcucaagcaauccucccaucucagccuccugaguaguuagaccuacaggcaugcgccaccaugccuggcuaauacuuuuauuuuuuguggaaguggggucucacuauguugcccaggccaaucucaaacuccuggacucaaguaauccucccaccucagccucccaaaauucugggauuacagacgugagccaccgugcccagccccugaacuuuaugaagcaccauuuucauacaagaggaauuaaccacaucuagaaaagaagguucauucucuccaacauacaaacaaaaauaugcaugacaguuuaagaaaaauggaaagaucaaccacggucugagcgcucccccagggacuaauaauaaaaauagugccguagggggccgggcuugguggcucaugccuguaaucccagcccuuugggaggcugagcugggcggaucaccugaggucaggaauucgagaccagucuggccaacauggugaaaccccagcucuacuaaaaauacaaaacuuagaagggcauggugguacgugccuguaaucccagcuccuugggaggcugaggcaggagaaucacuugaaccagggagacggagguugcagugacccgagauugcaccacugcacgccagccagggccaucucaaaaaaaaaaaaaaagaaaaaaaaauacguguauauauauauguguguguguguguauauauguauguguauauauauguguguauguauauguguguguauguguguguguguauauauauauauauauauauauauauauauauauauauauauauagugccauguauugugucugucaggcacugugcugagaaggugucuuaucuccuucuccccuuaaucuuuugaugaagccacuguugucgucuccauuuuacaaauccaaaaacauaacccagagguuaauaugcacacagcuaguuacauggccaaaccaagaucaaccuuggugucugucugcccucaaagccuuguucugaaccauuaaacagaaacacagagaaugauacaucuuucaguuuuguaacucaaacaagaggauuauuuuacacaguaauuuacauuaaaagugaauguugaccauuccuucaggcucuuuucagcauuaacacuacauuauauccacauggagguaugugugcagacauaauguauacaucuucuaauaagccuuuuaauaagcauguauuuucuuccuaaauaaguuguagugagauaaaugcauuuaauacaccuaaccuaccaaacauuauagcuuagccuauccuaccuuaaacauguucagaacacuuauauuugccuauaguugggaaaaaucaucuaacgcaagccuacuuuauaaaguguugcguaucucauguaacuuauugaauacaguguuuacucuugugaucacguggcugacugagagcuuggcuugcugccgccgcccagcaucaugaaagagcaucuuacuacaugucaacagccugggaaaagcucaagauuaaaaauuccaaguacaguuuccacugaauguauaucacuucugcaccaucaauaaagccuaaaaguccuaaaucaaaccauuguaagucaggaccaucuauauugccaauuguaucuacuuugaacaaggaagacagugaauaccauggcuccaaaagcuaagugagauguguuauuucuaauagacauuauguuaauggaucuguguugcaauaugcacaaaucuuugucuauagacuuucauauaauaacaauuacaauagcuaccauguacuuaauguuuacuacaagccaggaacaauuuuaagcacucuauaggaauuaacuuacauaaaacagauuauuuuauuauucaauuuacagaccaaguuugguguguauaccauuuuuaaaugaauuuguguuuuauuaguuaccuauaguuuucuucuucagugacauauccacagcuuuaguuuagcacaagcagggcauuaaaaucuguugaaugaaugcacgguuauauuuugucucggaauguauagucuucuuuauuuauaccagauuuugauuucaucuccauuuuuccuaugcuuauucuuuccguguucuaauagacugagguccucuucucugggacuuuccuaaaggcugcuuuagauuugugguaguaggaaugggacugacagaguggaugaagucaagugcugugugugcagagagggagacuuugaugacaauggcuaucagcccugcuuaugacucucugcucuguuuugcuucuuguaggcuuucaguucugaaauggcaaagagguccaagaugcugaguuugaacaauuacaguggugaguaagaaauucacaggccaauaaguagggucgcccaccauuggcucauucuauucuugaucaucugaacuaacggaggggagaagaagaauaaauaagccaaagguauugcauugugguccugcuuggauaccugccuacucucuacccugaucaugauucuuuucuugcuugguccaguuucaugauaugaacagaggaagguugaguugcaguggauaauccaagaugugggugguugauucauaaauagauaucuauaauuuuuucccaaggaaaaguucuggcuuccauaaacuggcauucagucacucuuucugcucugaacaucuaaauaggguuacuuauuguaauuauggaaaacacaucucaguaaugccagauaaauggguuaacucaguguuacucaaacccaaguaaucacugggaucaugauggaaacuuuaaaaaacaaacaaacgcaaaacccccaaaauauguauuugucccaacucuacagaugcugauucagggacucugggucugggccaagcauaucuauuuugaaugcucccuagucaauuuugaugccgagcauauuuucuuuucuuuuugagacaaguucugacucugucacucugguuggagugcaguggcgugaucucagcucacugcauccucugcuucacaggcucaagccauccucccaccuaagucucccaaguagcuuggacuacaggcacaugccaccacacccagcuaauuuauuuuauuauuuuauuuaauuuuuuuuuugguagagacgggguuucgccauguugcccagacuggucuuaaacuccugggcucaagugaucugccugccuccaccuccgaaaauguugggauuacaggcauauaacaucauucuuuuaguggaguuuggguggacugagauggaauguucaguggccuggcagugcuguaaguaaggaaggagagcauuaacaguucuggccuggaacugugccuuuuaugauccuguuuauuuaucuguauaaugaugauaauaacagacauugugaggauaauagauuauguauguaaaaguguucuauaaauugaaagcauuaaacaaaugccaggcaauaaauaaugacugggaagauagacaaacuccccaguuagcuaaggggagaaagggauuccuuuugacuggaaaagaucaagaauggcuucaugaaugagaugguucuaagcugggcuuugagcauggcaagauuuccaauguccagagaggguaggguggggcauccaagguagagaaaacccacaggagcaaagaaauccagugcauguuuggggaaccacagggaauccaugguggguacauaagaggaguuuuaggugaggauaacauaaaaaaggaacauaaaaaggucuguaugucauuaaucugaauaauggcggcaaaugucaccauuuaauucaguaauucuugcggacaucuguaaaggaauuauauagcacaggacaauaauuaacauggagaugauuaaucaagggacauggcggcucaagccuguaaucccagcacuuugggaggccagggcagguggaucacuugaggucaggaguucgagaccagccugggcaagauguuaaaacccaucucuacaaaaaauacaaaaauuagccaggugugguggugcauaccuauagucccagcuacuugggaggcugagaugggaggaucaccuaagcccggggaggucaaggcugcagugagccaugauugugccacugcacuccaaccugggugacaaauaaacaaaaugauuaaugaugaugaucucagauuaucaaggaaagguuaaauaaacuauuuaggaagggccgggcaccguggcuuacgccuguaaucccagcacuuugggaggcugaggcaggcggaucaccugaggucgggaguucgagaccagccugacuaacauggagaaaucccaucucugcuaaaaauacaaaauuagccgggcaugguggcacaugucuguaaucccagcuacucgggaggcugaggcaggagaaucgcuuaaacgugggagguggagauugcagugagccaagauugcgccauugcacuccagccugagcaacaagagggaaacugucucaaaaaaaaacaaaaaacaaacaaacaaacaaaaaacuauuuaggaaggcagagaggugguacguuaucauuagaaauauuuaauucagccgggcacgguggcucaugccuguaaucccagcacuuugggaggccgaggcaaguggaucaccugaggucaggaguucgagaccaguuuggccaacauggugaaaccuuaucucuacuaaaaauacaaaaaagaauuagccaggcaugguggcgugugccuguaaucccaacuacucaggaggcugaggcaggagaaucgcuugaacccaggaggcggagguugcagugagcugagauugugccacugcacuccagcuugggcaacggagggagacuuggucucaaaaaaauaaauagauaacucagaguuaaaauucaguguauuuuggugcuagaagaguuauccuuuagugauccgaacaauuuacuuaucuagaagaauagugcucgcuuugccaacacauauacuaaaguuagaauaauaauuauuggccgggugcaguggcucacgccuguaaucccagcacuuugggaggccaaggcgagcagaucaugaggucaggaguucaagaccagccuggccaacauggugaaaccccaucucuacuaaaaguacaaaaauuagccgggugugguggugggcgccuguaaucccagcuacucgggaggcugcagcaggagaaucgucugaacccaggaggcggaggcugcagugagccgagauugcgccacuacacuccagccugggcgacagccuggugugaacccgggaggcggagcuugcagugagccaagauugcaccacugcacuccagccugggcaacagagcgagacucugucucaaaaaaaaaauuaguauuauuauuauuaugauuauuggccaggcaugcugacucaugccuguagucccagugcuuugggaggccaagguggguguauugcuugaggccaggaggucaagaccagcauagugacacccugucucuaaaaaaaaaaaaaaaaaaaaaaaguaguaguagaaggaggaggaggagaagaaagggguagggggagggagaggagaaaggaagaagaggaagaagaagaagaaaaagaaguuucucuugauaauaauggauaaaugcaauaucacuaugcauuguuuuuauuuucuccuaaaaaauaauauaaucuccuagacagaacaaggguuuuaaaaaaaguaugccuccaauauaaaaccuggguuacuucuuacuguugucuaaaaccuuggcuuuugucuuuuuuaucuuuacucagaggaaggccauccuccccaucuuacuucuaggucuguccuuauacuucuuuuguagcuccuguaccacacaacugagaucucaggagaaagaugagaauuuccacugcuauucagauauuacucacugggaggcauaugugggagcacuggagucagaugcccauaccuacuagcuucauggccaccacuaacuaguccuauagccaugggcaaguuacuuaaugacucugugaaucaguuuccuuguuggugagaugggacaacuacuaguaucuuucucauaagguugugaggaauccugaguaguggaauuacagguauuucuucuuuccauuauaugucgauaauuucccaauuuuuaaauaauaaacauguauuauucuuaaaaucagagauucauguuuguuuuuuaaaaaauaauuuugacucuucaagcucugugucuuucagagauguuugauuuuaaaacuaguagcaagagguuaaggaaaauccuauucagcaggaaauaauacuuaguuaacauccagggugagaucacaaggugaacucaucugugaacugccaaaugcaacauagcagaggcaagagacgauaaagcuaauccauuacaagcuaaacucuguguucccaaggaggcuguaaacgauacagguugauuuccuucauacccaaugcagcuuucagagauagguacuuaauugaagcugcuacugcugacaguggugacaauaucauagggguaaaacacuggccaugguguuuuguucugcacuguuuuaaaacccacuagucggccgggcacguuggcucacgccuguaauccuggcacugugggaggccgaggcaggcagaucacgaggucgggagauugagaccaucccggcuaacacggugaaaccccgucucgacuaaaaauacaaaaaauuagccgggcuugguggcgggcgccuguagucccagcuacucgggaggcugaggcaggagaauggcgugaacccgggaggcggagcuugcagugagcugagaucgcagcacugcacuccagcuugugagacagagcgagacuccaucucaaaaaaaaaacaaaaaacugcuagucuuccaugguugcuuauuauagucauuucagucccccagucaaccagagaggagaaaagagaaaaugggcuugaagcuagaucuccugccaucaaucugaugggauucaacguggaagagauguaugaggcccacgcauggauccaaagaauccugagucuccagaaccaccacaucauugagaauaaucauauucuguaccuugggagaaaggaacaugacauuuugucucagcuucagaaaacuucaagugucuccaucacagaaauuaucagcccaggaaggacagaguuagagauugaaggagcccgggcugaccucauugaggugguuaugaacauugaagauaugcuuuguaaaguacaggaggaaauggcaaggaaaaaggagcgaggccuuuggcgcucguuaggugaguaacuuucuaucaaauuagaaaguaaauucuccccauuguuucuucuuuugggugugagcguguauguauggauguggguaagagacagaaggagagaggagggaucaaacauucugguucuuuguuagaucauaagccuuugugagcuauuuuuuugcucucuuuugacaaucaggguuauuugugaacacauacacaaacacaauuuuauuuacuuguaauaaccuugauugucuaagaggcaauuacauggaauuuuggcagugguaaaacucaagcccaagccauggggaaaaguauacauuucuaauucuucagaugcagcacucaaguguagacacauuccaucugauuaacuuauuucuuuuaucaaguuuuauuguauuuauuugucacugacagcauuaggaacgcuaaaauuacuuaccuugagcccucucgccaaugaaguuauacauugguaaugugagguacacucaaguaucucccauucagcgggacuaaacucaucaggauacacgugggaauuuggaucuggagagauccuuuuaacagagcccuagagcuaacuaggaaauuauacuauugaaaugccaucucggggcugggcacgguggcucacgccuguaaucccggcacuuugggaggccgaggugggcgcaucaccugagguugggaguucaagaccaaucugaccaacauggagaaacucugucucuacuaaaaauacaaaaaaaauuagccaggcaugguggcccaugcuuguaaucccagcuacucaggaggcugaggcaggagaaucacuugaacccaggaggcagagguugcagugaaccaagaucgaaccauugcacuccagccugggcaacaaaagcgaaacucugucucaaaaaaaaaagaaagaaagaaagaaagaaagaaagaaagaaagaaagaaagaaagaaagaaagaaagaaaugccaucuugggagauagagauagagauagauauagauaucauucaacuaaugcauauugcacccaugacgugccaagcauugugcuaggugcaaggacuacagcaauaaacaagauagacauuguuccugcucaaagucuaaugggggaccuugacgagcacacagauuagugaugauagaggagagcgaaaagugcucugggagcacugcggagaggcaccuaacccagacuugggaagucagggaagggcuuaucacaggugucauaaauggagaacuggauaauagguagaagucaggcaaagaaagaaaacgucaagaaauaagauugucgcaaggccuggauuaugcaagaccuuauaaaucacgugaaagaguacagagaguuucuugaaacaaauagggaaccuuaaagaauuuuaagcaaaguuaacaucagacuuguguuuuuagaaagaucauugguuauaauguggagaauggauuuaguaagagguacaaaaauucagaggcaaaauuucaaaggacaccuuauuuucaccauguguuuguaaaaauaaugcaggaauaaaugauuagagugagcgagaguucgccauaaauguuguauuuacaucccacagaaaacacaguggcaaaaaaaaaaacauggauaaaaagaauacacaagcauaagaaccaagauuaugauuuucgcuuaguuuuugaaacagugaauguagguauugaaacugacaccagugccagcuuaggggaacaggauacaaagaaacauggaucuccuauaaaacuuguggcauuauuuuguuagaguguguguguguguguguguguguguguguguguggcauugcuuuaaauuaacugaaaucauaaggugggccaaugcucccagcuauugacaauuuugagucauauaagucucuugcucugccgcacgauggcacuuuugguaguugaggacuaagcauauuauuccauagaagccuuagagguucaggcaaaccugcccugucuuaaucagauuaagaucuucauuaacaaaauggauaauuuugagaugaguuaucauuauaaggaauaucaaauauccaucagaacaauaauuuuauuuuuuaaaucaaaguuaggcauggccucucuuuuaugccacucuuaauccuuccugguaggcauuuccaacggcagaaguuugugaucuuuggguccccagugcccagcccagugccugacauguaggaggagcuuggcaaauguuuguugaacucaaguaaacugaacucuaauauuacaccuuauaaauaugagcuauugcuccccaaaguuaauuuacagucuucuguuguaguuucugggcuuugcaacuccucugcuauggaguuuugucccuccuacuuucucagauuuacaacuuggcucucuagugaguuccccucaauucgucaccugcuuuuugugguuaaauugagcccauucaauuagauaaugaaccagggauuaggucauuuuaguauacuuggucuuaagucaaacuaaaaguaaaccaagagaaaacaagucuuuuuugguuuucauuuguccaccuguauauuuaguccaguaaggagcucccuuggacaaaaacagguugaaaacaaggaugggaggaaaaaaaggaaggaaggaggaaggaaggaaggaaagaaggaaguaaggaaggaaggagagggagggagggaaaugggaggaggagaaaggaggaagggaggaaaaacaagacaucauagacucuuaaucuccaaauuuugcucuucuucauugggugguauaugagugauacauguuccaaguauuuugccuugucacuuacaaaaagcauuggugaaagccagguuuguaaucuuaguucuuuacuuacuaggugugugauauggggcaaguuacuuauuugaacuucaauuucuuuauuuguaaaauuguguuaauuauuacgugguggugcuauaaugaucaaauaaggaaggaaacugaaaauuuugaaguguuuuacaaaugucaugucauuucccaucauuccuuacuuaauauuuucuaaugccugucuguuuuugcugauaggcauuggggcuagaaauaaaaacauuuccuaugagcaacacaauuauuucucaucauuacagcauugauuguggagaagcaaguauauauuaugcuccuuuuacucacauccccuuagccucaugauucaaaucauccaaagacaaauuuauuaccccuuuauuuuauccugaccgcucguaguauuauagcucuccucgcauguccuaaacacaugaggcacacaauuuaaacuggcuaaucccuuccucuaaauuucuagaauuuguuucauuaaauuucuuuucuccucucucagagcauugaaguaaaguuuuuguguuacucauuuuuaggacaguggacuauucagcaacaaaaaacccaagacgaaaugaaagaaaauaucauauuucugaaauguccugugccuccaacucaagagcuucuagaucaaaagaaacaguuugaaaaaugugguuugcagguucuaaagguauaccuaacaaaggggaagauuuggcucauuuuguuguuaauuaacuuguuucuguagccaaaggaaaagcucaccugcugaugauucuaagcuggcugcucauggacuuggaauccuaggucaguaagacugaaaagagagcagggcagggcaggcacgagggauauaguuggaaucgggagguaggaaugacaucaggacacacagaagcaaggauuccagauccaggaagcccgucuuugagcaaaauaaaagaaguggaauagcauuuaucacacuguguuauaauuguuuaccuauuuuucuaucucacuaaacuaugagcuuaagagggcagagacuaugucuaggucagugaauuuuuguuaaaggaauuuauuagagaaggggcagggaauuuugaagaacgaaucaaaauaggagaggauuagagggaggagagacucuuuugcaacuuucuaugaaaagcgaauugcaugcaaaguaguauuaugcacauaagcuccuuuauuuuugaagcaguauagcaggcaauuuaaagagcgguucucuagccucuuuuucagucuuucuuuucuaugguucuagguggagaagauagacaaugagguccuuauggcugccuuucaaagaaagaagaaaaugauggaagaaaaacugcacaggcaaccugugagccauaggcuguuucagcaagucccauaccaguucugcaaugugguaugcagaguuggcuuucaaagaauguacucgacaccuugcgguaggugucaaugccucaucauuggggcuacucuguggaauuuggugagcugacaucaguagauucuuccacugauagcauuuguuguuguggggaagggaucauuugugacugugauuuagaggucacaaaugaugacccaggucacaaaguauuuuggaaagagugguauuuuuuacuuuuccuucguaucuuuuguugcugaugcauuuuacauugaugaaaagugugagcaguaagaacuacgguucacuguuuuucuccuuuauguguuucuguguccuauccgcagagaacacguugaggcuuuuuuuuuuuuuuuuugccuuacuuaucucaacaaaauuauuaccaacagcacugaaccguccucaucccuuaauuaaaagggcauuuucccaaauuuaagaaaguuggucuuuucucuuucaucccuuuguuuccuauagccugcuagugaaugaauuagguaucauuuggcaggugaagugcauaacaucuuaagauccucuucauccauaggaguucuauguguaacucccaugucucuuuucagauguacaaaaacauugcauauauaauucuuauauugcccccucuacuccucagucacuaaugaagauuucuggcuuuaguucucuccaaaagaggaaaagaaauuuaguaaaaauuauggagagauacuuagcgggguggcuugauuuugcuuggucuauuaaauauguggcucuugaucuuuaucuuucaacauauguagcaugauccuugcugaggagucaauuccaauagacuugguuucuaggaugcaaaggcucuagaaaucaucuuuucuuuguucuggagagaacauaggcaaaacuugggguaaauguugaacauagacaauuacuggggauaaaaauagagaaaugaaucccuaccaagaagccuuuuggggcaaucaggaaagugaugaucaguauagucccuucauuagcaaagucuuaaaaaaucuauaauuuccauuugcuccuaaagcuggcuucucugcaauccccacccacuacuucuacuuaaauuacuuucauuaagaucaucgcugugcucuuacuuuccaaaucuagugaguauucucuuuucaguccugugacagacucugcuacuugccuacccaacaucuauacacaucuuucuuacuaaaacaucuaagacacccacuauccucccaaggaauauggucccaaggucuuagccagacucaucaucagcucaaguucaggcaguucucucuuuauuuauuuauuuauuuuucugagacggagucuugcucugucacucaggcuggagugcaguggcaccaucuuggcucacugcaaccuccgccuccgagauucaaacaguucuccugccucagccucccagguagcugggauuacaggcaugugccaccacgugcaguuaauuuuuguauuuuuuuuaguagagacgagguuucaucauguuggccaggcugaucuccagcuacucgugauccguccaccucagccucccaaaguguugggcuuacagguaugagccaccaugcccagcaggcaguucucucuuaaagcuuaaaggcaagauacugcccccaacauacucauuauauagugauauaaaaaggagcgggaaaacugcaaugaaaacucucauguugaaaggggagaagcaaaacacacaacagccacuggcucacaccacuuaucuacaugcugccgaacagguauagagaggacucccuauuccauguuguaaaaccuuuauuuugcacucugggaaaaucuuccuuauauauuguggcccuuggcuauuuccagguucauugccuaucagggagccauggauuuucucacaggcuagaaugugcucaggcuguugcaaccaggcuugugguuucuucagcaauacaguuccuuuaaaaauucagugggcacgaggccuaauuucuucugguuaaguuuaugucuuuauaaccuaaccacagaucuugucuccauauagucuuucaacucaagauuuuggucucuuaccugcugucugugugcucugcccuucucccuaucccuuagcuuaacagccacugccuugaggcaauucagacaugacucauaaugugaccugcaccaauugacucaucucuguaggcuagagagaacucuuaacagaaggugccagacaagcccaggagacaccaaucuugcuaccacugaagcuguuguuauuuggaguacaaaagcucuuagcuuuuucagccgugcaauauuccaaauuauaggacucucagucaauuuagauggccacccacaggcaaaggagacagaacuucuguuaacaaaccuuuauuuucuuuuuucuauuuauguuugcauuccaaccaguucugaauaaaucucuugcuuguaggacuugguugagugcagcaagaaggcaucuacacaugcaguuucuuacuggguugauucauuuguuccacagguauuuauuaagcacauucuaugaaucaggcccugugcuagggguacuagaaauagaguguaaauaaaaaaccauagaguucuugcccuuacaauuuauaaucucacgaguucaccuguugcccauucuuuaucuucucucuuuuuuccucuacgaugucccccuuggugauggcaccuguucccauggccucaacuccuaccucaaugaugacgacuuaggaauuucuaacucuuaacucccuaccucucuccugaccugcagguucauaugucucacucucuuuuugacaucuuuacccagaugucccauagguaacucaaauugaucccuuuucuuggucaugauuuucccuaagaaauaugcccuuuguuugcugauucucccuaaccugguuaguaucaucaccaucuaccuaccagguuuccuaaggcugaaacauuaucauccuccauuccuccuuuucccucacccuuauacccaggcauucacccaguccuagugauucacucucaugaagaucucagcccaguuucaccucucuauuccuacugccuuaguuaaucuuccuucagaccuagacuauuacuagguccucuccuugccacaaaacacaccccuaccuaaucuauccuuuaccaccagaauuaucacgcuaaaaauuacauucuugcuuaauaucuguauucccaguugccuacgggauaaaagcccaaacuccuuagcagagaauauaaggcccuagcucccacauuauuucagcagucaucacccacuauguuccucaagacugcagccauuaacuuuuuagaguucccuaaacaugcuguuuacuuucaugccucuaucccguugucuguggaaugacuucccuccuugcccuuuucagugcuacaaaccccuauucuuuaagacauaguacaaauggcaucuccugguuggcaucuuuccugcaggccuacaggccuaguaaguaucuuccuccucugugcuccugcauaccuccauuccuuuguuaugacaucuauaacuuuaauaaguacuaaaaucuguaguccuacaaaacucaggcauagaacucauuuccuuuauggcucuauaauggaacuuuacccaacucucacguuccccaugaccacagauguggaaaauuugaaucuugacaguucaaggugaacucagucauuuucagaguuuucauagucccuucaagauugaaacucaguuccugcaauguuugccccuuuucuccucuuuugucuaugcugggagaggcauuguggggaggguugucuggcuuauggcucccauuguccucugcuugauaaaccaccugagcuuuggucauuagcagucuccugugccuuucacacucagguagugucugcacaggccacucuaugucuuuuccaugcugaagaaauuccuuuccaggccaugucuguguuccuccugccacacaggaaauuuuugagcauguucauccuccaagcugaaugcagggucuuggguagugguccucaccugcuccagagacuucuccagccauugccacucuccacucaggugaugaagcuggaugagggacugcacccaccagagucaggccaggguccugucugcucugugagucccuccaauuguucuuauuccgagauuuccauuguucugcccccucuugacucccagggcucucaagggaguggggguagugaagggagcccuuucccaagcucccccaagagcucuagucacaucacuucugauacuucuuuucccaccagcuggaagaaagaacuuucauuugucuugaaaugagaaaaauguucuuagaauauuuuguauuacucucugcucugucauuuaugguaaacaaaauaaaauaauaaaaaaaaacaacccaugcucugaauccuucugguuuuuagcuuuugguucaaaaagcccuuuuccucucagaaaagcuaacucugaaagccagaauuucaagaccauacucucuucugugaauuaaaaauaauuacauauauauauauguacuuguaaacacaaacauauagauacauacaauuauauacauacaguuauacgggguuucaccauguuggccaggcuggucucgaacuccugaccucgugauccacccgccucggccucccgaagugcugggauuacagaugugagccacugcacccagcaggcaguucucaaaaaacuauacauauauuuauauauagacuuuguucucaucuuuauccuuuucgcccuuaauaagaaguagcaaggacucaauagguggaagaacaaagagcaagaagaaacucccgggaaagaaaaucuuugauuuuuaucucaaaauauuaccuugccacauaaauuguacuauauuuuaucuguuuacaugaugagacuucccuuugugaaauguugagaauagggaucauaucuuacucacuuuuaaauuuccagagcugcacuguucaauauuguagccgcuagcuacaugcggcuauugagcacuugaaauguggccggucuaaauugaaagaugcuguaaguauaaaauacacaccggauuucaaagaccuacuacaaaagaauguaaaauaucuaauacuuuucaaaauauagauuacauguuaaaauaacaucuugaauggcuuaaauaaaaauguuaauuucaccuuuuuuaaaaaaauguuuuaaaauguggcuacuagaguagcugggaauccaggugaguggcacaauaccugacuaauuuuuuuauuuuugguagagauugggucucacuguguugcccaggcuagucucaaacuccugaccuccaccaauccuccugccuuggccucccaaagugcugggauuacagacaugagccacucagccuggaaguuuuaaacgacaugugugacucauaguacguuucuguuguuuaguucugcucuugagccuaaaaguguuugguuacaucccacauaaagaaagagagggaagaaaugaaaaaaggaaaggaaggaaggauaauauggcaucaaagaagguauaauuuuuuucccucuaagugaggucagaaagggcagugaacagggauuacuucgagauccagaauuuggcccucagccuccugaguguuuuuaauaccccaaagaagauaauacagaucacaggcaaugugucagaauggagaguacucauuucuaguggugggaauagggcauaucuuccuuaguaucacaguccccagagugcuugauggguggaaaguugcccggugagcauggaccuagauaacaugcacguggagauucuucaugagguauugugccaacccauggagaguacacaauacccuccuggugacuagaaugccucuguccuuccaaauccaggagugcuuuuccuaaacaaugaaguaugcacacugucauuuuauauacuccacauuccccuugacauauuuuucuuuuucuuuccuuuuuuuuuuuuuuuuuuuuugagacagggccuugcuuugucacccagguuggagugcaguggcacgaucacagcucacugcaaccucaaccuccugaguucaaucaguccucccaccucagccuccugaguagcuaugauuacaggugugcaccaccaugccugguuaauuuuuguauucuuuguggggauaggguuuugccauguugcccauacugggcuuaagcgauccacccacuuuggccucccaaagugcugggauuacagguguguaccaccgggcccagaugacauauuuuucuuguaaugcuguucaugagguuaggaggcacuccgucuucucuuauuagaugcuauuuucaaaccaucuucuugagaguucuggaaauaucccuauuuguagcauguagaagucagacaauguucuuuuuuuuuuuuuuuuuugggacggagucucgcuguguugcccaggcuggagugcaguggcgcaaccucggcucacugcaagcuccgccucccggguucaugccauucuccugccucagcccccggaguagcugggacuacaggcgcccccaacugcgcccggcuaauuuuuuuguauuuuuuuuaguagagacgggguuucaccguguuagccaggaugguguccaucuccugaccucgugaucagcccgccucggccuaccaaagugcugggauuacaggcgugagccaccgcgcccggccgaagucagacaauguucuaagggaaacagaaccuuccuuuuguuaugcucugucagcuacuuaguugauaauacugacuugaaucuaaguucuuugaaucucagaucuuugucuuuuacguggaguuacuacccaaaucacagauaauuuaaucuaaucaaugugcaauacuuugaaaaccauuaacuucucuaugaacacuaaugguucuuuuuuuuuuuuuuuuuuuuuuuuaagaguuucgcucuuauugcccagguuggagugcaguggugcgaucuuggcucacuacaaccuccgacuccuggguucaagugauucuccugccucagccuccugaguagcugggauugcaggugccugccaccacaccuggcuaaauuuuuguauuuuuaguagagacgggguaucaucauguuggccaggcuucugaccucagguguuccacccgccucagccucccaaagugcagggauuacaggugugagccacugugcccagcccuaaugguauauuugaauguaaguuauuaugauguugauggugucagugauaauuuguuucaaggaacaauuuugagugucuuugcuauagacacaggaacucagaaucaggaggaagugauuauuuggaagacuaaagaaagaauagauauuaguacccaaaucggcaauaucauuuaccagauuauaauaaucuuuuuauuuuauuuuuuccuuuaucagauccaaaauacggagcuggcauauacuucaccaagaaccucaaaaaccuggcagagaaggccaagaaaaucucugcugcagauaagcugaucuauguguuugaggcugaaguacucacaggcuucuucugccagggacauccguuaaauauuguucccccaccacugaguccuggagcuauagauggucaugacagugugguugacaaugucuccagcccugaaaccuuuguuauuuuuaguggcaugcaggcuauaccucaguauuuguggacaugcacccaggaauauguacagucacaagauuacucaucaggaccaaugagacccuuugcacagcauccuuggaggggauucgcaaguggcagcccuguugauuaaucucuacaucauuuuaacagcugguauggccuuaccuugggugaacuaaccaaauaaugaccaucgauggcucaaagaguggcuugaauauaucccauggguuaucuguauggacugacuggguuauugaaaggacuagccacauacuagcaucuuagugccuuuaucugucuuuaugucuugggguugggguagguagauaccaaaugaaacacuuucaggaccuuccuuccucuugcaguuguucuuuaaucuccuuuacuagaggagauaaauauuuugcauauaaugaagaaauuuuucuaguauauaacgcaggccuuuuauuuucuaaaaugaugauaguauaaaaauguuaggauaacagaaugauuuuagauuuuccagagaauauuauaaagugcuuuagguaugaaaauaaaucaucuuugucugauuaacuggcucugaa

SEQ ID NO: 192628 - RNA, 36388 nt, Homo sapiens
uucagagccaguuaaucagacaaagaugauuuauuuucauaccuaaagcacuuuauaauauucucuggaaaaucuaaaaucauucuguuauccuaacauuuuuauacuaucaucauuuuagaaaauaaaaggccugcguuauauacuagaaaaauuucuucauuauaugcaaaauauuuaucuccucuaguaaaggagauuaaagaacaacugcaagaggaaggaagguccugaaaguguuucauuugguaucuaccuaccccaaccccaagacauaaagacagauaaaggcacuaagaugcuaguauguggcuaguccuuucaauaacccagucaguccauacagauaacccaugggauauauucaagccacucuuugagccaucgauggucauuauuugguuaguucacccaagguaaggccauaccagcuguuaaaaugauguagagauuaaucaacagggcugccacuugcgaauccccuccaaggaugcugugcaaagggucucauugguccugaugaguaaucuugugacuguacauauuccugggugcauguccacaaauacugagguauagccugcaugccacuaaaaauaacaaagguuucagggcuggagacauugucaaccacacugucaugaccaucuauagcuccaggacucaguggugggggaacaauauuuaacggaugucccuggcagaagaagccugugaguacuucagccucaaacacauagaucagcuuaucugcagcagagauuuucuuggccuucucugccagguuuuugagguucuuggugaaguauaugccagcuccguauuuuggaucugauaaaggaaaaaauaaaauaaaaagauuauuauaaucugguaaaugauauugccgauuuggguacuaauaucuauucuuucuuuagucuuccaaauaaucacuuccuccugauucugaguuccugugucuauagcaaagacacucaaaauuguuccuugaaacaaauuaucacugacaccaucaacaucauaauaacuuacauucaaauauaccauuagggcugggcacaguggcucacaccuguaaucccugcacuuugggaggcugaggcggguggaacaccugaggucagaagccuggccaacaugaugauaccccgucucuacuaaaaauacaaaaauuuagccaggugugguggcaggcaccugcaaucccagcuacucaggaggcugaggcaggagaaucacuugaacccaggagucggagguuguagugagccaagaucgcaccacugcacuccaaccugggcaauaagagcgaaacucuuaaaaaaaaaaaaaaaaaaaaaaaagaaccauuaguguucauagagaaguuaaugguuuucaaaguauugcacauugauuagauuaaauuaucugugauuuggguaguaacuccacguaaaagacaaagaucugagauucaaagaacuuagauucaagucaguauuaucaacuaaguagcugacagagcauaacaaaaggaagguucuguuucccuuagaacauugucugacuucggccgggcgcgguggcucacgccuguaaucccagcacuuugguaggccgaggcgggcugaucacgaggucaggagauggacaccauccuggcuaacacggugaaaccccgucucuacuaaaaaaaauacaaaaaaauuagccgggcgcaguugggggcgccuguagucccagcuacuccgggggcugaggcaggagaauggcaugaacccgggaggcggagcuugcagugagccgagguugcgccacugcacuccagccugggcaacacagcgagacuccgucccaaaaaaaaaaaaaaaaaagaacauugucugacuucuacaugcuacaaauagggauauuuccagaacucucaagaagaugguuugaaaauagcaucuaauaagagaagacggagugccuccuaaccucaugaacagcauuacaagaaaaauaugucaucugggcccggugguacacaccuguaaucccagcacuuugggaggccaaaguggguggaucgcuuaagcccaguaugggcaacauggcaaaacccuauccccacaaagaauacaaaaauuaaccaggcaugguggugcacaccuguaaucauagcuacucaggaggcugaggugggaggacugauugaacucaggagguugagguugcagugagcugugaucgugccacugcacuccaaccugggugacaaagcaaggcccugucucaaaaaaaaaaaaaaaaaaaaaggaaagaaaaagaaaaauaugucaaggggaauguggaguauauaaaaugacagugugcauacuucauuguuuaggaaaagcacuccuggauuuggaaggacagaggcauucuagucaccaggaggguauuguguacucuccauggguuggcacaauaccucaugaagaaucuccacgugcauguuaucuagguccaugcucaccgggcaacuuuccacccaucaagcacucuggggacugugauacuaaggaagauaugcccuauucccaccacuagaaaugaguacucuccauucugacacauugccugugaucuguauuaucuucuuugggguauuaaaaacacucaggaggcugagggccaaauucuggaucucgaaguaaucccuguucacugcccuuucugaccucacuuagagggaaaaaaauuauaccuucuuugaugccauauuauccuuccuuccuuuccuuuuuucauuucuucccucucuuucuuuaugugggauguaaccaaacacuuuuaggcucaagagcagaacuaaacaacagaaacguacuaugagucacacaugucguuuaaaacuuccaggcugaguggcucaugucuguaaucccagcacuuugggaggccaaggcaggaggauugguggaggucaggaguuugagacuagccugggcaacacagugagacccaaucucuaccaaaaauaaaaaaauuagucagguauugugccacucaccuggauucccagcuacucuaguagccacauuuuaaaacauuuuuuuaaaaaaggugaaauuaacauuuuuauuuaagccauucaagauguuauuuuaacauguaaucuauauuuugaaaaguauuagauauuuuacauucuuuuguaguaggucuuugaaauccgguguguauuuuauacuuacagcaucuuucaauuuagaccggccacauuucaagugcucaauagccgcauguagcuagcggcuacaauauugaacagugcagcucuggaaauuuaaaagugaguaagauaugaucccuauucucaacauuucacaaagggaagucucaucauguaaacagauaaaauauaguacaauuuauguggcaagguaauauuuugagauaaaaaucaaagauuuucuuucccgggaguuucuucuugcucuuuguucuuccaccuauugaguccuugcuacuucuuauuaagggcgaaaaggauaaagaugagaacaaagucuauauauaaauauauguauaguuuuuugagaacugccugcugggugcaguggcucacaucuguaaucccagcacuucgggaggccgaggcggguggaucacgaggucaggaguucgagaccagccuggccaacauggugaaaccccguauaacuguauguauauaauuguauguaucuauauguuuguguuuacaaguacauauauauauauguaauuauuuuuaauucacagaagagaguauggucuugaaauucuggcuuucagaguuagcuuuucugagaggaaaagggcuuuuugaaccaaaagcuaaaaaccagaaggauucagagcauggguuguuuuuuuuuauuauuuuauuuuguuuaccauaaaugacagagcagagaguaauacaaaauauucuaagaacauuuuucucauuucaagacaaaugaaaguucuuucuuccagcuggugggaaaagaaguaucagaagugaugugacuagagcucuugggggagcuugggaaagggcucccuucacuacccccacucccuugagagcccugggagucaagagggggcagaacaauggaaaucucggaauaagaacaauuggagggacucacagagcagacaggacccuggccugacucuggugggugcagucccucauccagcuucaucaccugaguggagaguggcaauggcuggagaagucucuggagcaggugaggaccacuacccaagacccugcauucagcuuggaggaugaacaugcucaaaaauuuccuguguggcaggaggaacacagacauggccuggaaaggaauuucuucagcauggaaaagacauagaguggccugugcagacacuaccugagugugaaaggcacaggagacugcuaaugaccaaagcucaggugguuuaucaagcagaggacaaugggagccauaagccagacaacccuccccacaaugccucucccagcauagacaaaagaggagaaaaggggcaaacauugcaggaacugaguuucaaucuugaagggacuaugaaaacucugaaaaugacugaguucaccuugaacugucaagauucaaauuuuccacaucuguggucauggggaacgugagaguuggguaaaguuccauuauagagccauaaaggaaaugaguucuaugccugaguuuuguaggacuacagauuuuaguacuuauuaaaguuauagaugucauaacaaaggaauggagguaugcaggagcacagaggaggaagauacuuacuaggccuguaggccugcaggaaagaugccaaccaggagaugccauuuguacuaugucuuaaagaauagggguuuguagcacugaaaagggcaaggagggaagucauuccacagacaacgggauagaggcaugaaaguaaacagcauguuuagggaacucuaaaaaguuaauggcugcagucuugaggaacauagugggugaugacugcugaaauaaugugggagcuagggccuuauauucucugcuaaggaguuugggcuuuuaucccguaggcaacugggaauacagauauuaagcaagaauguaauuuuuagcgugauaauucuggugguaaaggauagauuagguagggguguguuuuguggcaaggagaggaccuaguaauagucuaggucugaaggaagauuaacuaaggcaguaggaauagagaggugaaacugggcugagaucuucaugagagugaaucacuaggacugggugaaugccuggguauaagggugagggaaaaggaggaauggaggaugauaauguuucagccuuaggaaaccugguagguagauggugaugauacuaaccagguuagggagaaucagcaaacaaagggcauauuucuuagggaaaaucaugaccaagaaaagggaucaauuugaguuaccuaugggacaucuggguaaagaugucaaaaagagagugagacauaugaaccugcaggucaggagagagguagggaguuaagaguuagaaauuccuaagucgucaucauugagguaggaguugaggccaugggaacaggugccaucaccaagggggacaucguagaggaaaaaagagagaagauaaagaaugggcaacaggugaacucgugagauuauaaauuguaagggcaagaacucuaugguuuuuuauuuacacucuauuucuaguaccccuagcacagggccugauucauagaaugugcuuaauaaauaccuguggaacaaaugaaucaacccaguaagaaacugcauguguagaugccuucuugcugcacucaaccaaguccuacaagcaagagauuuauucagaacugguuggaaugcaaacauaaauagaaaaaagaaaauaaagguuuguuaacagaaguucugucuccuuugccuguggguggccaucuaaauugacugagaguccuauaauuuggaauauugcacggcugaaaaagcuaagagcuuuuguacuccaaauaacaacagcuucagugguagcaagauuggugucuccugggcuugucuggcaccuucuguuaagaguucucucuagccuacagagaugagucaauuggugcaggucacauuaugagucaugucugaauugccucaaggcaguggcuguuaagcuaagggauagggagaagggcagagcacacagacagcagguaagagaccaaaaucuugaguugaaagacuauauggagacaagaucugugguuagguuauaaagacauaaacuuaaccagaagaaauuaggccucgugcccacugaauuuuuaaaggaacuguauugcugaagaaaccacaagccugguugcaacagccugagcacauucuagccugugagaaaauccauggcucccugauaggcaaugaaccuggaaauagccaagggccacaauauauaaggaagauuuucccagagugcaaaauaaagguuuuacaacauggaauagggaguccucucuauaccuguucggcagcauguagauaaguggugugagccaguggcuguuguguguuuugcuucuccccuuucaacaugagaguuuucauugcaguuuucccgcuccuuuuuauaucacuauauaaugaguauguugggggcaguaucuugccuuuaagcuuuaagagagaacugccugcugggcaugguggcucauaccuguaagcccaacacuuugggaggcugagguggacggaucacgaguagcuggagaucagccuggccaacaugaugaaaccucgucucuacuaaaaaaaauacaaaaauuaacugcacgugguggcacaugccuguaaucccagcuaccugggaggcugaggcaggagaacuguuugaaucucggaggcggagguugcagugagccaagauggugccacugcacuccagccugagugacagagcaagacuccgucucagaaaaauaaauaaauaaauaaagagagaacugccugaacuugagcugaugaugagucuggcuaagaccuugggaccauauuccuugggaggauagugggugucuuagauguuuuaguaagaaagauguguauagauguuggguaggcaaguagcagagucugucacaggacugaaaagagaauacucacuagauuuggaaaguaagagcacagcgaugaucuuaaugaaaguaauuuaaguagaaguaguggguggggauugcagagaagccagcuuuaggagcaaauggaaauuauagauuuuuuaagacuuugcuaaugaagggacuauacugaucaucacuuuccugauugccccaaaaggcuucuugguagggauucauuucucuauuuuuauccccaguaauugucuauguucaacauuuaccccaaguuuugccuauguucucuccagaacaaagaaaagaugauuucuagagccuuugcauccuagaaaccaagucuauuggaauugacuccucagcaaggaucaugcuacauauguugaaagauaaagaucaagagccacauauuuaauagaccaagcaaaaucaagccaccccgcuaaguaucucuccauaauuuuuacuaaauuucuuuuccucuuuuggagagaacuaaagccagaaaucuucauuagugacugaggaguagagggggcaauauaagaauuauauaugcaauguuuuuguacaucugaaaagagacaugggaguuacacauagaacuccuauggaugaagaggaucuuaagauguuaugcacuucaccugccaaaugauaccuaauucauucacuagcaggcuauaggaaacaaagggaugaaagagaaaagaccaacuuucuuaaauuugggaaaaugcccuuuuaauuaagggaugaggacgguucagugcuguugguaauaauuuuguugagauaaguaaggcaaaaaaaaaaaaaaaaagccucaacguguucucugcggauaggacacagaaacacauaaaggagaaaaacagugaaccguaguucuuacugcucacacuuuucaucaauguaaaaugcaucagcaacaaaagauacgaaggaaaaguaaaaaauaccacucuuuccaaaauacuuugugaccugggucaucauuugugaccucuaaaucacagucacaaaugaucccuuccccacaacaacaaaugcuaucaguggaagaaucuacugaugucagcucaccaaauuccacagaguagccccaaugaugaggcauugacaccuaccgcaaggugucgaguacauucuuugaaagccaacucugcauaccacauugcagaacugguaugggacuugcugaaacagccuauggcucacagguugccugugcaguuuuucuuccaucauuuucuucuuucuuugaaaggcagccauaaggaccucauugucuaucuucuccaccuagaaccauagaaaagaaagacugaaaaagaggcuagagaaccgcucuuuaaauugccugcuauacugcuucaaaaauaaaggagcuuaugugcauaauacuacuuugcaugcaauucgcuuuucauagaaaguugcaaaagagucucuccucccucuaauccucuccuauuuugauucguucuucaaaauucccugccccuucucuaauaaauuccuuuaacaaaaauucacugaccuagacauagucucugcccucuuaagcucauaguuuagugagauagaaaaauagguaaacaauuauaacacagugugauaaaugcuauuccacuucuuuuauuuugcucaaagacgggcuuccuggaucuggaauccuugcuucuguguguccugaugucauuccuaccucccgauuccaacuauaucccucgugccugcccugcccugcucucuuuucagucuuacugaccuaggauuccaaguccaugagcagccagcuuagaaucaucagcaggugagcuuuuccuuuggcuacagaaacaaguuaauuaacaacaaaaugagccaaaucuuccccuuuguuagguauaccuuuagaaccugcaaaccacauuuuucaaacuguuucuuuugaucuagaagcucuugaguuggaggcacaggacauuucagaaauaugauauuuucuuucauuucgucuuggguuuuuuguugcugaauaguccacuguccuaaaaaugaguaacacaaaaacuuuacuucaaugcucugagagaggagaaaagaaauuuaaugaaacaaauucuagaaauuuagaggaagggauuagccaguuuaaauugugugccucauguguuuaggacaugcgaggagagcuauaauacuacgagcggucaggauaaaauaaagggguaauaaauuugucuuuggaugauuugaaucaugaggcuaaggggaugugaguaaaaggagcauaauauauacuugcuucuccacaaucaaugcuguaaugaugagaaauaauuguguugcucauaggaaauguuuuuauuucuagccccaaugccuaucagcaaaaacagacaggcauuagaaaauauuaaguaaggaaugaugggaaaugacaugacauuuguaaaacacuucaaaauuuucaguuuccuuccuuauuugaucauuauagcaccaccacguaauaauuaacacaauuuuacaaauaaagaaauugaaguucaaauaaguaacuugccccauaucacacaccuaguaaguaaagaacuaagauuacaaaccuggcuuucaccaaugcuuuuuguaagugacaaggcaaaauacuuggaacauguaucacucauauaccacccaaugaagaagagcaaaauuuggagauuaagagucuaugaugucuuguuuuuccucccuuccuccuuucuccuccucccauuucccucccucccucuccuuccuuccuuacuuccuucuuuccuuccuuccuuccuccuuccuuccuuuuuuuccucccauccuuguuuucaaccuguuuuuguccaagggagcuccuuacuggacuaaauauacagguggacaaaugaaaaccaaaaaagacuuguuuucucuugguuuacuuuuaguuugacuuaagaccaaguauacuaaaaugaccuaaucccugguucauuaucuaauugaaugggcucaauuuaaccacaaaaagcaggugacgaauugaggggaacucacuagagagccaaguuguaaaucugagaaaguaggagggacaaaacuccauagcagaggaguugcaaagcccagaaacuacaacagaagacuguaaauuaacuuuggggagcaauagcucauauuuauaagguguaauauuagaguucaguuuacuugaguucaacaaacauuugccaagcuccuccuacaugucaggcacugggcugggcacuggggacccaaagaucacaaacuucugccguuggaaaugccuaccaggaaggauuaagaguggcauaaaagagaggccaugccuaacuuugauuuaaaaaauaaaauuauuguucugauggauauuugauauuccuuauaaugauaacucaucucaaaauuauccauuuuguuaaugaagaucuuaaucugauuaagacagggcagguuugccugaaccucuaaggcuucuauggaauaauaugcuuaguccucaacuaccaaaagugccaucgugcggcagagcaagagacuuauaugacucaaaauugucaauagcugggagcauuggcccaccuuaugauuucaguuaauuuaaagcaaugccacacacacacacacacacacacacacacacacacucuaacaaaauaaugccacaaguuuuauaggagauccauguuucuuuguauccuguuccccuaagcuggcacuggugucaguuucaauaccuacauucacuguuucaaaaacuaagcgaaaaucauaaucuugguucuuaugcuuguguauucuuuuuauccauguuuuuuuuuuugccacuguguuuucugugggauguaaauacaacauuuauggcgaacucucgcucacucuaaucauuuauuccugcauuauuuuuacaaacacauggugaaaauaagguguccuuugaaauuuugccucugaauuuuuguaccucuuacuaaauccauucuccacauuauaaccaaugaucuuucuaaaaacacaagucugauguuaacuuugcuuaaaauucuuuaagguucccuauuuguuucaagaaacucucuguacucuuucacgugauuuauaaggucuugcauaauccaggccuugcgacaaucuuauuucuugacguuuucuuucuuugccugacuucuaccuauuauccaguucuccauuuaugacaccugugauaagcccuucccugacuucccaagucuggguuaggugccucuccgcagugcucccagagcacuuuucgcucuccucuaucaucacuaaucugugugcucgucaaggucccccauuagacuuugagcaggaacaaugucuaucuuguuuauugcuguaguccuugcaccuagcacaaugcuuggcacgucaugggugcaauaugcauuaguugaaugauaucuauaucuaucucuaucucuaucucccaagauggcauuucuuucuuucuuucuuucuuucuuucuuucuuucuuucuuucuuucuuucuuucuuucuuuuuuuuuugagacagaguuucgcuuuuguugcccaggcuggagugcaaugguucgaucuugguucacugcaaccucugccuccuggguucaagugauucuccugccucagccuccugaguagcugggauuacaagcaugggccaccaugccuggcuaauuuuuuuuguauuuuuaguagagacagaguuucuccauguuggucagauuggucuugaacucccaaccucaggugaugcgcccaccucggccucccaaagugccgggauuacaggcgugagccaccgugcccagccccgagauggcauuucaauaguauaauuuccuaguuagcucuagggcucuguuaaaaggaucucuccagauccaaauucccacguguauccugaugaguuuagucccgcugaaugggagauacuugaguguaccucacauuaccaauguauaacuucauuggcgagagggcucaagguaaguaauuuuagcguuccuaaugcugucagugacaaauaaauacaauaaaacuugauaaaagaaauaaguuaaucagauggaaugugucuacacuugagugcugcaucugaagaauuagaaauguauacuuuuccccauggcuugggcuugaguuuuaccacugccaaaauuccauguaauugccucuuagacaaucaagguuauuacaaguaaauaaaauuguguuuguguauguguucacaaauaacccugauugucaaaagagagcaaaaaaauagcucacaaaggcuuaugaucuaacaaagaaccagaauguuugaucccuccucucuccuucugucucuuacccacauccauacauacacgcucacacccaaaagaagaaacaauggggagaauuuacuuucuaauuugauagaaaguuacucaccuaacgagcgccaaaggccucgcuccuuuuuccuugccauuuccuccuguacuuuacaaagcauaucuucaauguucauaaccaccucaaugaggucagcccgggcuccuucaaucucuaacucuguccuuccugggcugauaauuucugugauggagacacuugaaguuuucugaagcugagacaaaaugucauguuccuuucucccaagguacagaauaugauuauucucaaugauguggugguucuggagacucaggauucuuuggauccaugcgugggccucauacaucucuuccacguugaaucccaucagauugauggcaggagaucuagcuucaagcccauuuucucuuuucuccucucugguugacugggggacugaaaugacuauaauaagcaaccauggaagacuagcaguuuuuuguuuuuuuuuugagauggagucucgcucugucucacaagcuggagugcagugcugcgaucucagcucacugcaagcuccgccucccggguucacgccauucuccugccucagccucccgaguagcugggacuacaggcgcccgccaccaagcccggcuaauuuuuuguauuuuuagucgagacgggguuucaccguguuagccgggauggucucaaucucccgaccucgugaucugccugccucggccucccacagugccaggauuacaggcgugagccaacgugcccggccgacuaguggguuuuaaaacagugcagaacaaaacaccauggccaguguuuuaccccuaugauauugucaccacugucagcaguagcagcuucaauuaaguaccuaucucugaaagcugcauuggguaugaaggaaaucaaccuguaucguuuacagccuccuugggaacacagaguuuagcuuguaauggauuagcuuuaucgucucuugccucugcuauguugcauuuggcaguucacagaugaguucaccuugugaucucacccuggauguuaacuaaguauuauuuccugcugaauaggauuuuccuuaaccucuugcuacuaguuuuaaaaucaaacaucucugaaagacacagagcuugaagagucaaaauuauuuuuuaaaaaacaaacaugaaucucugauuuuaagaauaauacauguuuauuauuuaaaaauugggaaauuaucgacauauaauggaaagaagaaauaccuguaauuccacuacucaggauuccucacaaccuuaugagaaagauacuaguaguugucccaucucaccaacaaggaaacugauucacagagucauuaaguaacuugcccauggcuauaggacuaguuagugguggccaugaagcuaguagguaugggcaucugacuccagugcucccacauaugccucccagugaguaauaucugaauagcaguggaaauucucaucuuucuccugagaucucaguugugugguacaggagcuacaaaagaaguauaaggacagaccuagaaguaagauggggaggauggccuuccucugaguaaagauaaaaaagacaaaagccaagguuuuagacaacaguaagaaguaacccagguuuuauauuggaggcauacuuuuuuuaaaacccuuguucugucuaggagauuauauuauuuuuuaggagaaaauaaaaacaaugcauagugauauugcauuuauccauuauuaucaagagaaacuucuuuuucuucuucuucuuccucuucuuccuuucuccucucccucccccuaccccuuucuucuccuccuccuccuucuacuacuacuuuuuuuuuuuuuuuuuuuuuuuagagacagggugucacuaugcuggucuugaccuccuggccucaagcaauacacccaccuuggccucccaaagcacugggacuacaggcaugagucagcaugccuggccaauaaucauaauaauaauaauacuaauuuuuuuuuugagacagagucucgcucuguugcccaggcuggagugcaguggugcaaucuuggcucacugcaagcuccgccucccggguucacaccaggcugucgcccaggcuggaguguaguggcgcaaucucggcucacugcagccuccgccuccuggguucagacgauucuccugcugcagccucccgaguagcugggauuacaggcgcccaccaccacacccggcuaauuuuuguacuuuuaguagagaugggguuucaccauguuggccaggcuggucuugaacuccugaccucaugaucugcucgccuuggccucccaaagugcugggauuacaggcgugagccacugcacccggccaauaauuauuauucuaacuuuaguauauguguuggcaaagcgagcacuauucuucuagauaaguaaauuguucggaucacuaaaggauaacucuucuagcaccaaaauacacugaauuuuaacucugaguuaucuauuuauuuuuuugagaccaagucucccuccguugcccaagcuggagugcaguggcacaaucucagcucacugcaaccuccgccuccuggguucaagcgauucuccugccucagccuccugaguaguugggauuacaggcacacgccaccaugccuggcuaauucuuuuuuguauuuuuaguagagauaagguuucaccauguuggccaaacuggucucgaacuccugaccucaggugauccacuugccucggccucccaaagugcugggauuacaggcaugagccaccgugcccggcugaauuaaauauuucuaaugauaacguaccaccucucugccuuccuaaauaguuuuuuguuuguuuguuuguuuuuuguuuuuuuuugagacaguuucccucuuguugcucaggcuggagugcaauggcgcaaucuuggcucacugcaaucuccaccucccacguuuaagcgauucuccugccucagccucccgaguagcugggauuacagacaugugccaccaugcccggcuaauuuuguauuuuuagcagagaugggauuucuccauguuagucaggcuggucucgaacucccgaccucaggugauccgccugccucagccucccaaagugcugggauuacaggcguaagccacggugcccggcccuuccuaaauaguuuauuuaaccuuuccuugauaaucugagaucaucaucauuaaucauuuuguuuauuugucacccagguuggagugcaguggcacaaucauggcucacugcagccuugaccuccccgggcuuaggugauccucccaucucagccucccaaguagcugggacuauagguaugcaccaccacaccuggcuaauuuuuguauuuuuuguagagauggguuuuaacaucuugcccaggcuggucucgaacuccugaccucaagugauccaccugcccuggccucccaaagugcugggauuacaggcuugagccgccaugucccuugauuaaucaucuccauguuaauuauuguccugugcuauauaauuccuuuacagauguccgcaagaauuacugaauuaaauggugacauuugccgccauuauucagauuaaugacauacagaccuuuuuauguuccuuuuuuauguuauccucaccuaaaacuccucuuauguacccaccauggauucccugugguuccccaaacaugcacuggauuucuuugcuccuguggguuuucucuaccuuggaugccccacccuacccucucuggacauuggaaaucuugccaugcucaaagcccagcuuagaaccaucucauucaugaagccauucuugaucuuuuccagucaaaaggaaucccuuucuccccuuagcuaacuggggaguuugucuaucuucccagucauuauuuauugccuggcauuuguuuaaugcuuucaauuuauagaacacuuuuacauacauaaucuauuauccucacaaugucuguuauuaucaucauuauacagauaaauaaacaggaucauaaaaggcacaguuccaggccagaacuguuaaugcucuccuuccuuacuuacagcacugccaggccacugaacauuccaucucaguccacccaaacuccacuaaaagaaugauguuauaugccuguaaucccaacauuuucggagguggaggcaggcagaucacuugagcccaggaguuuaagaccagucugggcaacauggcgaaaccccgucucuaccaaaaaaaaaauuaaauaaaauaauaaaauaaauuagcugggugugguggcaugugccuguaguccaagcuacuugggagacuuaggugggaggauggcuugagccugugaagcagaggaugcagugagcugagaucacgccacugcacuccaaccagagugacagagucagaacuugucucaaaaagaaaagaaaauaugcucggcaucaaaauugacuagggagcauucaaaauagauaugcuuggcccagacccagagucccugaaucagcaucuguagaguugggacaaauacauauuuuggggguuuugcguuuguuuguuuuuuaaaguuuccaucaugaucccagugauuacuuggguuugaguaacacugaguuaacccauuuaucuggcauuacugagauguguuuuccauaauuacaauaaguaacccuauuuagauguucagagcagaaagagugacugaaugccaguuuauggaagccagaacuuuuccuugggaaaaaauuauagauaucuauuuaugaaucaaccacccacaucuuggauuauccacugcaacucaaccuuccucuguucauaucaugaaacuggaccaagcaagaaaagaaucaugaucaggguagagaguaggcagguauccaagcaggaccacaaugcaauaccuuuggcuuauuuauucuucuucuccccuccguuaguucagaugaucaagaauagaaugagccaauggugggcgacccuacuuauuggccugugaauuucuuacucaccacuguaauuguucaaacucagcaucuuggaccucuuugccauuucagaacugaaagccuacaagaagcaaaacagagcagagagucauaagcagggcugauagccauugucaucaaagucucccucucugcacacacagcacuugacuucauccacucugucagucccauuccuacuaccacaaaucuaaagcagccuuuaggaaagucccagagaagaggaccucagucuauuagaacacggaaagaauaagcauaggaaaaauggagaugaaaucaaaaucugguauaaauaaagaagacuauacauuccgagacaaaauauaaccgugcauucauucaacagauuuuaaugcccugcuugugcuaaacuaaagcuguggauaugucacugaagaagaaaacuauagguaacuaauaaaacacaaauucauuuaaaaaugguauacacaccaaacuuggucuguaaauugaauaauaaaauaaucuguuuuauguaaguuaauuccuauagagugcuuaaaauuguuccuggcuuguaguaaacauuaaguacaugguagcuauuguaauuguuauuauaugaaagucuauagacaaagauuugugcauauugcaacacagauccauuaacauaaugucuauuagaaauaacacaucucacuuagcuuuuggagccaugguauucacugucuuccuuguucaaaguagauacaauuggcaauauagaugguccugacuuacaaugguuugauuuaggacuuuuaggcuuuauugauggugcagaagugauauacauucaguggaaacuguacuuggaauuuuuaaucuugagcuuuucccaggcuguugacauguaguaagaugcucuuucaugaugcugggcggcggcagcaagccaagcucucagucagccacgugaucacaagaguaaacacuguauucaauaaguuacaugagauacgcaacacuuuauaaaguaggcuugcguuagaugauuuuucccaacuauaggcaaauauaaguguucugaacauguuuaagguaggauaggcuaagcuauaauguuugguagguuagguguauuaaaugcauuuaucucacuacaacuuauuuaggaagaaaauacaugcuuauuaaaaggcuuauuagaagauguauacauuaugucugcacacauaccuccauguggauauaauguaguguuaaugcugaaaagagccugaaggaauggucaacauucacuuuuaauguaaauuacuguguaaaauaauccucuuguuugaguuacaaaacugaaagauguaucauucucuguguuucuguuuaaugguucagaacaaggcuuugagggcagacagacaccaagguugaucuugguuuggccauguaacuagcugugugcauauuaaccucuggguuauguuuuuggauuuguaaaauggagacgacaacaguggcuucaucaaaagauuaaggggagaaggagauaagacaccuucucagcacagugccugacagacacaauacauggcacuauauauauauauauauauauauauauauauauauauauauauauacacacacacacauacacacacauauacauacacacauauauauacacauacauauauacacacacacacacauauauauauacacguauuuuuuuuucuuuuuuuuuuuuuuugagauggcccuggcuggcgugcaguggugcaaucucgggucacugcaaccuccgucucccugguucaagugauucuccugccucagccucccaaggagcugggauuacaggcacguaccaccaugcccuucuaaguuuuguauuuuuaguagagcugggguuucaccauguuggccagacuggucucgaauuccugaccucaggugauccgcccagcucagccucccaaagggcugggauuacaggcaugagccaccaagcccggcccccuacggcacuauuuuuauuauuagucccugggggagcgcucagaccgugguugaucuuuccauuuuucuuaaacugucaugcauauuuuuguuuguauguuggagagaaugaaccuucuuuucuagaugugguuaauuccucuuguaugaaaauggugcuucauaaaguucaggggcugggcacgguggcucacgucuguaaucccagaauuuugggaggcugaggugggaggauuacuugaguccaggaguuugagauuggccugggcaacauagugagaccccacuuccacaaaaaauaaaaguauuagccaggcaugguggcgcaugccuguaggucuaacuacucaggaggcugagaugggaggauugcuugagccugggaggcugaggcuucagggaguuaugaucacaccacugcacuccagccgaggcagcagagcgacauccugucucaaaaaaaaggaaauuaaaaaaagaaauaguucagggaggugaucagggcaccuaucugggcuuagagauaauccucugcaugggaaacugaugaacuucaucugaaggacaggauuauucauuuuaucagaaggugagcuacuuccuugggucaugcaccaccaucucaccaguuagcugugggugaggcgcagugggauacuggagcuggcauacaaugacucaagacagcuugcugugaccaucucuucuaaaucuguuuucagugaugucauaucaacagcuugaaagcagccacagaaaucagcaaaugcuacaaaucuccccguguuuaauugggcagcagaaggaauaagaacuuuuauacuugcuccaagaaagagcaagcuggaacaaguauaaauucacuuccauauaggcagagauaaaauggcaaccaugcacauagagcaggccaagaggugggaauaugagcagucagagaacuaauguuugcagccacucucugcaaggcaaaccuugcaaggcccucuauauccaaaauccagacacaugccgagaagucucucuaaaacucggauguugcuguuggcagaaucagaaaccuauaucuugaaaaccuauuuuagguugcuguaucuuauuuccuuuccuuuuuauucuucccuaacaucauuaaagucuuucucgaaaaugccagcuaagugagaauaaagcagagauggucgguacuuuaaaggcagaacagcacugcaauauauacuaauuaugcugaaaauaucacaguuuauucacaugcuaggaacucagcuugaucuguccacccaaacaaaaagcugagaugaagugcacucagacacauaagacaagcuccccuccaacacauggaccccaaauguguuagaccacagcugauuuccuuccgaggucaccuacagaugagcuaaaaaagaauggguugaauuugagggcaguacuggagacauggcaaaacuagccaggcauaccacugcuguuaaagaaauuggaaagaaaagauaaacaauucacugaauuuaguaacaauucagcacucagugaacuacagcucauuacaguugauguaacagcuaaccuucuacucugugcuagguacuauucuaaguguuuuacagguauuaacucauuuuuuuuuuuuuugagauggaguuucacucuuguugcccaagcccgggugcaauggugcgaucucagcucacuccaaccuccgccuccuggguucaagcaauucuccugccucagccucccgaguagcugggauuacaggugugugccaccacgccuggcuaauuuuuuguauuuuuaguagaaacgggauuucaucauguuagcuacacuggucucaaacucgugaccucagaugauccgccugccucagccucccaaagugcugggauuacaggcgugagccaccucacccaccuguauuaacucauuucaucuucacaacagcuccauaagaugguaaucaguaucccucuuuuaaggaugaggaaacugaggcacagauaaguaaacuaacuugcccaagguuauauagccagcgagaggcaaagcugagacugauggggauuuuagagggaaaacugauugaggaggagaagacaggccaggcauauuggcucacaccuauuaucccagagcuuugggaggcugagaugggaagaucacuugagcccaggagcucaagaccagauugggcaacauaguaagacugcuuuucuacaaaaaauuuaaaaauuagccaggcaugguagcaugugccuguagugccugcuacucaagaggcuggagugggaggaucacuugagcccaggaguucaagacugcagugagcuaugauugugccacugcacuccagccugagcaacagagcaagaucacaucuguuuaaaaaaaaaaagagagagagagagaagacaaagaauuugccuuaaauacacuggauuugagaugacggucagagauccaaguggaaaugagagaggauuggcuaagaagacaggacuucacagaaguuguaagaacaguuguguucuugaagggagagagaugagagaggggcaaggaccccacacugaaacuagaagguugcuuaccuuuaaggagcagagggaagaauaagugccauuaaaagaaaagacagaagcuagguaguggguaaacauggcuucuuuguuuuuuguuuuguuuuguuuuguuuuugagauggaguuucacucuuguugcucaggcuggaguacaauggcgugaucucggcucaccacaaucuccgccucccagguucaagcuauucucuugccucagccucccuaguagcugggauuaaaggcaugugccaccacgcccagcuaauuuuguauuuuuaguagagacaggguuucuccauguuggucagguuggucuagaacucccgaccucaggugauccgccugccuccgccucccagagugcugggauuacaggugugagccaccgugucuugccaaacauggcuucuauaaugacauguuuuacuaggucagagguggacaaucuguaaaaauuaaacuucaccaaguuagaacaccaccacacuguacagcaccuagcccugcauccccugcaucuuacauuguagauacuaaacagauguugcugaaugaaugaaugaaugaaugaacaguaggacauuucuaagauauuaacuuaccuuauauaucuccaaaucuguuggaaagaucacaaauuuuacaguuaacugguguuuuacauggucuuuggcaaauguuaaaacuucaucaaacaaaaucucugcugcuguuuccuucuuuauuuccauguuuccagucccaagggcaggaaaggaaauggaaguuauauuuugcucaaugcauuuuuccaaacacuccuucauugcauguuuuaauaucugcaggaaaacacaaauuuaagaucagcauuugagucaagaacaagacuccacuuaccccuugauccugcccauauuuuacaauguccaccuucacccucccucaggguucgugucccugccuccucagaugacaggaaaggucccacuccagagggaacccauuaugguauaagguuagauggugagaaacugaagcaauagaguggccaucuugugcuauucaggacaugagggcacuagaauuucucccaguuuauauagccuuacccauccccccaggucagagagccaaccaucuguuuaccccauucaccugccccuuccaggucaacgucaagagcccuugaauuuucauaaaggagaucgagauuaaaauaagaaagcagcacuuauucaacaucauuaagaucuaucauguaauuucucuuggagaaaugcuaauauuuuuggcagauuuaaauuucuaccaacuguuaacaucaaaguaauacaggaauguugcccauggaaggacuuuggaaaacugagggauagagggagacuagaggaccaguuugggauuagagagcucucaagaagggaccagaaauggugaagaagaaagauagacaaaggcagagaaggggauuaaguuucccucuuuucaccaucugaguggguuccuccuauucuuuaaugcuuuuauuuuauuuuauuuuauauuuuauuuuuugagacagagucucacucugucauccaggcuagagggcaguggcgcgaucucggcucacugcaaccuuugccuccugaguucguuaaugcuuguauuuuaugugccucaguggagagugggcuagacagccaggcuccacugcaggcaugggugggaagagaccucagguaauagauuugauuggaaugaugcuggagggggaaccccagcugcuccaggaauauaacacauggagggacauaagaggcugaaucccuugccuacuuaggaaaaggccaacgaggucacuggguauguuggggugaaccaguguucagacugagggaauacuaguuucagugucuaucugcaguaugccuacuuaaaauuuagacauggguuagguaacauuuuaaacuucuuuguuguuuuguuuguuuuuugagacagucucugucacccaggcuagagugcagcagugugaucacagcucacugcagccucaaucuccugggcucaagugauccuccuaccucagccucccgaguagcugggacuacaggugugcaccaccacaccuggcuaauuuuuuuuuucuuuuugguagagaugggggucuugcuauguugcuuaggcuggucucagacuccugggcucaagugauccucccaccuuggccucccaaagcgcuggacucacaggcaugagccacugcgacagaccuaaaucaaacuucuuaagauaacuuauggcaacuguaccuguucaguauuucugguacucgcaggugugcuaaaaauugagaacuauaccacuugacaaaauauuucaugaauguaaugaaaugauggaaauuuguuuaaaaaaaaaagacuguauagacuauggagcuaaauaaagccacauuuauuuuaaacuuaccugagguuuaggaaauucugaaugccacaguacaugguauauauauuuacagaacaaguuaaauccuuuugugaccaguaccaacugggaccguugaaacuguuuagccuuuguggcaagaaauuccgauuucauuucaacuccugcuuguuguagaauugacuuugccacagguccaacuguaauaucauguggguuuacagaauuaacaauuacaucugccugaaaagggaagaaaggguaggauucauuguuaaauuccuucuucuuaaaugacuaauuuaaaucuuuacuucccugaagagcuuugaaaaauacucuuugaagauccuaaauucuaaaaaauuucauuaauaaugaauagaaacucguauuuccaaagagugauuauuugauugccaugaacgaagcugaauuacauaauucagaaauuauguaaauguacggaugauauaauuuucauugcaaacaucuguuugccccuugcuguauuaccuuaccagauggcuagauucugaguauucccugugauuuguuuuaaguucugucgauaaaugguuucaucucugcccgaccaccaugacuuuuugcuauuucgucguggguuuuuguuuugucucguuuuaaauaggaaauaaaauuucuuggagaauuuccaccuucuaauguuuuuaugguuuaagguauaagaaacuuaacaagguuaaagaaacuccaaaugggacaaaaaggucuucaaugaaaaguagguccccuucuuggucagguucccagacccccccacucacccacccaucuuaugugcaaccaaguucuucaucucucucuucagaaauagacuguacauauacaugagcuguacuuuagauaacaucgucuccuaguuaacccucagagcugugcuaaaaaugauaguguccuuccuucccccaugcccagauuccccuaaucauucuauugacuuuggcucccuuucaggguaacucagguauuucuucacugauguuaaugaaugcuucauuuugaaagcacaauuagaauuugcaauuugggggcaccgacacccuuuaaaaauuguaauguuccuaacguugcuggcaauaaauauaccuuaaaaaauucaguuaaagggauaaguuacucaacuaggaugcuuccauuuuaguuuuaaauuuguguguuaaugacuucucaaauauuucauuucaugaacuccccucagucuucccucuaauugucuuauaggcaauaaguguuauugguuuguuuguuuuaccagugucuaagacuauuugauuguggucacgagagucuuaagugugacaucacugauccagaagaaaaaaaaagaauaaagccuuauauucauucucacccucuguuguggugccuucucccuccugcccccuccacuuauuuaucuuuaauuugcugaacccuuagaugcaugcccagaccaggccuugaggcuauagggaugaauaagccaagaucuccaucuuuaaggugcucuccgucuagcaggggagcugcacugacucagaaauaccuagguucaccgcuacccugacuccuuccccuucccugccagcauccucaccuuugugcccagugacccccagcuaaaugcuuaguugcaccuugcauucuccacagccccuggcagaguuauauucuguguauaaacacacagacuaugacuuagagcuccaccugugucuccugacuguagucaagcccauuauuuucugucaauuccucugcaucucucugaucaagucacucugaccacccagaaagcuuccccuccugccaaucauacccaucgaaacuugagaucacauucaaaacucauaccuucugaagcaaucuuucuugguccacuauacuccacucuugucacaaauuuacauacucuuaaguauuauuuuuguuuacuauugauagguugcuucagaaauguugagaugguuuuucuccccagagagauuuuucaaauaaagaauauuuuuauaauaaagaauauaauugauuuuagguuccuugggaucaaagauuguucuaauuccuccgggugccuaagauaauagcaacagccauaauaaugauaaauacuuauuaugugccaagcacuacucuaagcauuuuauguauauugaucccagcucuaagauauaaaugcuauuauuauccucaauguacaaaugaggaaacugaagaacaaaagauaaaguaacuugcuuuggguuacccaguuaauaaauagcaaagcugguauucaaauccagauggccuggcacugaaugcuauauuauuauuauuauuauuuuuagagucaaagucaaagucuugcucuguugcccuggcaggaaucacugcagccuugaacucaugggcucaagugcgccuccugccuuagucucccaaaguaguugggacuacagaugugcaucaccaugcccugauaauuuuuuuuuuuuuuugagacagggucuugcuauguuccucaggcuggucuugaacaccugggcucaagugauccuccugucucaaccucccaaagugcugggauuauaggcaugagccaccaugaccagccuauuuuaaaaaaaaacuuaaauuaaaauuuuuuaaagagauggggucuggguauguugccuaggcuggccuccaacuccugggcucaaaugguccuccaaccucaggcucucaaguagcuggguuacaggcauguaccacugcaucuggcucauauucuuaauccaaacaagaugguuucuacauaguguugcauaguguacacucaaaaauuauuuaauuuucagggaucaccugugccagugcaagagaauagaaacaaagacuuaccgucugccauucaauguggcccuggacaaucuggagggucagguuguucacgaccauugcauugaaagaaggggugguuucuugucccagcucacucuucccuaggaugaauucugaagcagcuuuaaaggcagcaacaguaggguccucauugcucaccaggugaauuucuuucaaauuacucaucauuggcuucccuugcaaacuaacccggauagucucuacaauagucuuuguacacaaauucagagggaacugaaaaaucccagagcucaaggcuggaauugcuacugucuuaaugugaguauuuuuauagaugacauaauucagaauacuuacaauggcccucugcagcuuuccaguacaucccuguuuaucccauuccauccaccgaggcccaacagcauggaugaucuguuugcagggaagccucccugcucccgugacagcuaucucaccagcugacacuuuaccauaucuggcaacaaacuguuugcucucuucuuggauuucaaauccaccagcuuuuaccagggccagggccaggccucccccaugcagaagaucuucauuggcugcauucaccacagcaucaacagcauguguggugaggucaucuuuccagacugauaacucuauccuaggagucagcauuuuucugaacacuugcagagauuugcuguugccuuccugaacuggagagaccaggguagagauacagccaaacuuauucuggaggacuucacacagcugacgcucauuauuuuuuaaaauuuugaagucauugugguuaaugggaauuugccaacuauaguuuucuccaagagcaccagucucuggaaaagaagagaagauuaaaaaaaaaaaaaaaaaaaaaaaaaaaaaaaagcacaguuugaaagguuguaaucccacuucauaccaggagacuguguuuccuaugugcaaaagagagaugaacuucauguagugcucuucaugauucuucuucucaacuacacauauaauuagaccacggacaucuaagaguuuucagugguaggucacccauaaagugcauagucuugugccuggcauauauuaaguacuccauaagugguaguuacuaugaugcagugaugaugguaggaaaaccauguauaugggggcuugugaauuuuuaaaaauauauauaaaaguggcgagcuuagaaagaccaaugcuuagggcacagguauuggaagggacuuaauuaugagccaaaauaggcggagguuuuauaacuuuuuugccuuugucagcaucuaaguuuauguuuucuuaagaguagacccugagacaaagaugugaauguaaguaguuuauuugggaggugauccuaggaaauacuagggccuugggguggggagggcaggcugggaaaguaagacaaaugaacaaagcacguguaacuaggcagauggaacuuaacucuacugggaaacaguguagaucuugugccucaggguuauaccacuggagggguaguaaccacaggagcuggaguauuuauccaacuucuuuuucuuuugagacagggucucacuguguugcucaggcugcaguguagugaugcagucuuggcucacugcaacuucugccuccuaugcucaagccauccucccaccucagccuccugaguagccagggcuacaggcucacagcacuacacccacaccaucguguccagcuaauuuccguauuuuuuucuguagagaugggguuucaccauauugccuaggcuggucucaaacuccugauuucaagcaaucugcccaccugggccgauugaaauaagguaguauaccuguuaucaauugaugguaagccccaguuuagcuggcauuuuuuccccuuucucagaggcauuucccagagugcuccaaaagauucaagcaaucugcccaccuggguggcuucaaaaaggccaccaugccuggccuacccaacuucuauuggucauugauugaggcaguucccuggugaggaggaguaggggagacauuggaccagccaaugagcacugauacugucugcuucaguucaguaaauaauucuuuaugauauucuagucuggcacaauuuuggugaaauuaaaacuaauugacuaaaaauuauuuaccguauguggcagacaagaagaugugcuacucagaucucccugcgauuggcuaugaagugggaaauacaguuagcugacagccuccagcuguuagccccucaggguucaucucagcuuucagccaaggucaugcuauucucagggcagccuccaucaguagcugagcaaggccauucaugcccaacgugggacaccucuaacagucaaucucaggcuugcagagacugucggguuuuuauuacagucugauggcuagucugcccaguccggcuuccucucuuuaccuuucacagugaauuuuuugcacuccuaauuccaucucaaauucugcuuccuggaggacccagcuugggacacuguauuucauggugucuaagauauuguuguuacaaugccucugagaaagggaaaaaaaugccaacuaaacuggggcauaccaucaauugauaacagguacacuaccuuauuucaguauuguuaaaaugugaaaaaaaaaugugcauccuaaaauagauaaaaugugaucauuacuuuuauuuugcuucaacucccauuucuaaucugagucuccuagaaagaccucuuguggccucaauuacccaaacgaagccggaauuggguagucaggcccuauuggccugagcuuugguugaaaaucuuuaaugggggaccccuggaauuaggccagaacuauuuagcuuguauaguacucguugagcaaggagacaaucaguuggccaccccaucuggucaauucagccauaggcugucguuaaaagagucucacauuuacgggcaaaggagaggaaugguguaggccuugagagaauaugccugcuggucggugccacaccaacucugaagcaugugcggggguccccacaagggucugcagucacgcaccugagcacuuguaggggagacauucuucuguauuccccuuucuccacugaggaaagaucugagcaaagacuuucugaaacaagagugagagcgagguaauccuaccugauuuuucauuguaagcugcugcuccggccaccugugaaaaaugagaauggcuuucuuaaaaaauggaaguggaaugacuacagcuuacugauaaccaauacacccuaguaaacacaaugcaauggaaauccugcucaaagcacuguguuugggagggcaggaagcauguguuuuuuuaaaucugcaugcccgaaacacuuaaaauacuaaaugugccagcaaacauuggcccuaugucauuucccuaggggccgaugcauuucuuuuuuuaaauuuaauuuuauuguuuuucgagacaagguuucacucugucacccaggcuggagugcaguggugcaaucacaguucacugcagccuugaacuccugggcugaagcaauccucccaucucagucuccugaauagcugggacuacaggcaugcaccaccaugcccagcuaauuguuuuuacuuuuuuagagaugagcggagucuugcuauguugaccaggcuggucucgaacuacugauuucaagugauccuccuggcuucagccucuguaguaacugggauuauaggcgccagccaccgccaaugcaucucagugcaucucauucuaauucagaaugagaugagguuuagagaucaacacuuuaaaaggcccaaaagucacagaccaaaaugaccccaaacucucagauagacuccaaucuccaaaagcucaugggguuucucuagacagaagaccuggggacaugagccucaucagcucugucucucauccaccagcaaggauccacuuuuaauugccuuugucaugguacaaaccuuaauguggaauuuucaaguuuaguaagugacuucuaaucugaucuuucucuauucccuucuuuucauucauccucuauuacucuccuuaccccaacccgaaaaagcagaaucacuaaaugagcugagaauuaaaaugauucugaaaaaucauccagcuucaaguugacacuauuuauuagauuagcauauucuugauuccccauuucucaagaagggagaaaggagaaaacuuuauugagcuauuaaaagcagaugaggaugucaacuguuggugaacaccccagauuucuugcuguuauauaaagaaguauucaugugcugaucaagguucaugacguauacacauuuaugcuuuuuaccauggaaaaguccauccuccagguccccgggggagucuuuaaauguuuauucccuuuugcgcuucaaagcauagacuguaguuuccagauaugguggcccacuucuaggaaugaauuagaaaagaugcaauaaacauuagccagaaucuuaggaaauucgguaagaauauacuguaggaggacugaacaugauuucugaucuugaugaguucuuaauuuccuugauaacgauguacacauuguuuugcuguuguuguuacuguuugccuucuacccuuuccaagagagguuccaguggaaaucauaauggcaguucagagaagggaaaaugcucuacgaccuggaacaggaaaagcuauauggaggaguugagacuagagccuggucaugaaggaugcaggagguuuuuacauauuuagaagaagagggugauaacaaaguggugagacugagaacagcauucaaagaacaguaaagaagaccgagcuuaugagugagugaagcccccuggagagcguuugaagaaagaggaaaugccacuagagccugugagggggguguauuauugaauuugugauaaacauccuugaccuaaugauagggguauaucugguuaaaagucagaaaaucugggaaaaauacuuuguuaugauuuuccaucuaauagguaggaauuaaagauuaugaauuuuuagaagacugaugaugaaaaugcuuaaagauacaguugcccacacuuguugcuauauuuaggccucgaaaugauuucuuuguuuguuuuuuuguuuguuuuuuuguuuuuugaguuggagucucacucugucccccaggaaugcaguggcucgaucuuggcucacugcaagcuccgccuccuggguucacgccauucuccugccucagccuccugaguagcugggacuacaggcgcccgccaccacgcccagcuaauuuuuuguauuuuuaguagagaugaggcuucaccguguuagccagcacggucucaaucuccugaccucgugaucuacccgucucggccucccaaagugcugggauuacaggcgugagcgaccgcgccuggucgaaaugauuucuaaugucuuugcaauagaaacauuuuguacaaccaucuacagcaucagagcacuauucuuacucaucaagggaaagcagcaggucuaguacaauccuuugcauucuaaaaugcaaagacaagaugcauuuuuugccuccagagggcacugcuguuuucaaaaaagaaggaugacuucaucugcuuuggccaugggcuuuugcuuuaaauguugcaccuguuucugucuucaggccaaguuuuacaggccuauggauagccaaacaaggagcauagugcccuaagcauuccauuucuuccauuuuaaaaacagaaaagccuucccaacuuuccaucacugguuccuacuguguuuccuucucuucauaagcagccaaacuucuggaaugaguaguggacucuccuucuguccaccugcccacucagccuacuauaaccuggcucccugccucauucccagcacccuuuugaaacugccaguggccaggcauggcggcucacaccuguaaccacagcacuuugggaggcagaggcaggcagauugcuugagcucaggaguucgagaccaaccugggcaacauggcaagaccucaucucuacuaaaaauacaaaaaguuagcuggccauguuggugcaugccuauagucccagcuacuugggaggcugagaugggaggaucacuuggugggaaguucaggcuguagugagcugugauugugccacugcacuccagccugggcaagaggaaugagacccugucucaaaaaaaagaagagaaacugcucaucagaaucccucaugugguuaaugccaauggauuaucuucuauccaucuuuacuggaccacuuucuauaguauuucacucuuugauuccugaaauucugcuuuccuggcuucuccuaugccaucuucccuugguucuucuauuacccuucacuuugccuuuacaggccuuuucccugcguucacuuccaccaucucccucuuaauuguuugccccaggauucugucuaaggcguuuuucaucucauucugcauacuccccaggagugaucucauccauuuccauggcuucaacucaccaauugcaaauaugacucuuauaucugcaguucuaggccauggcucuccugagccccauuuuucaacuccaccuggaggucucacaguccccucaaauuagccucugcaaaaguagaccucuuaucuccugguccccaauccuccaucccacccccaccaaauccauacuuuaucuccuggauucuacagcucaguaaaugauaauaccauuuacguacucaaaucagaaaucuaggaacuuucccugagucuuuuuugucucauaucugggaccugacaaacuaaaucacuuucaaauaugccccuuccuuccucgcccacugacacugccucacuucagagucucagcaacuuuugccugagcuguggcaauauacucuuuucuuuucuuuucuuuucuuuucuuuucuuuucuuuucuuuucuuuuugagacggagucuuacucugucgcccaggcuguggcgcgaucuuggcucauuggaagcuccgccucccggguucacgccauucugcugccucagccucccuaguagcugggacuacaggcgcccaccaccacgccuggcuaauuuuuuuuuuuuuuguauuuuuuuuaguagagacgggguuucaccauguuagccaggauggucucgaucuccugaccucaugauccgccugccuuggccucccaaagugcugggauuacaggcgugagccaccgcgcccagccaucaauauacucuuuucaaagauuuaaauguaccuaguuugacauuuuauuguuugaauagguauuacauuuacaugguucaaauuuagaaaauguaaaagguuuccuccugucuccgcugcuaaauucccuguccagagucaaucagcgcuucuccuguauucuuccaguggcauuuuuuacacgaaagguaguagcuuauacacacacuucugcaucuuauuuuucccacauaauguauccuagagaucuuuucauguuagcacauagagagcuuuuucauuuuuccuacugcccauuguauuccauuguauagauauacuauuauuauuaaacugcuagucccccuauuuaugggcauuaaagaguucccuaucuuuugcuauuguaaacaaggcuguaaagaacaucuuuguacacaggucacuucacacaggggcuaauauaucaaugggacaaauuccuagaaauggaacuccagaaccaaaaaguauaugcaguuguaauucugacaguauugccaaauuguucacaguaaagacgggcccauuuccagucuuaccagccaugugcaaaaaccuuaucucaggccucucugccgccacucaucccugcuuguaaauguguccuccacacgguugucagcaccauauuucuaaaaugcaaaucuggcaagucauuuucuugcuuucccugcuuaaagcccuucaggucaucuucacugcucuucaaggcuuuucaccaucuaaauauguccuguccaggguggacuaucagccucacauagcuacugaggcuacauguggccagucugaaucgagaugugauguaaguauaagaaaaacacuggguugcaaagacgugguaugauaaaaagaauguaaaaaucucauuacaugcugaaaugauuaaguuuuggauaugucaagcuaaauaacaucauuacaguuaauuucaucuguuucuuuauccuuuaaaaauuuccuaaaaaucauuaaaauuaauuucaucuguuucuuuauccuuuaaaaaauauggcugcaaaaauuuuagaaugaaccuacuggcucccauuguauuucugcuggacagugcccaucuagguaggcucucccuccuucauccccucacccaucuccucuccucccaggccccaggcccacucugugcuucagaccacaguggucccuaagccucaggugcuuuuccccccaauccuguccuccccaucucgccgccacacucaauuuauuaagauucugcuugaaacuuccccuuggaggccuuggagaaguuuugcuccuugguucacagguccgccuccccucaccagcccuugacaucagggccuugcucugcucuuugggcagcaagaaacaauucagugcuguugguuaaaucaagcaauggaggagaaaagcccgcagaagcccgucuaaaggguagaguuggagggagggaagggguaacaggucacaauuaccagaugaacacauucaaauuuucaaaaauggguaaguuuaacauggauucagaaugugaauuacuuuuuaggaucaaauaauagugguaacagcaguaagaguuacaaagaauaagaaacacaggagaaacuuacuuucuuugcauagucuacucacaagggaggccuggcccugggacccggguccgcgcccgucccccuucuccccgcccaccucgagccugcaggagaggggaccccgagggcccagaggcaccggaccuacucacccggcaggccgcucuccucggugcagacagcacagggaggagggggaagcggcucu

SEQ ID NO: 192629 - RNA, 65317 nt, Homo sapiens
cgccuccaggccccuucccgcgucgcgacgcacgcugccccggaaggccgcggcgcuguagugcggcgugggagccccagguucuuuaguggaagaacgcgaagcgaggaugagguaacuuaucugaggugguggcuggggagggagagggccccagggcgccuaccaggaggccaggaccccaggcuccuggacgaagucagccggcuuguaagagcucuuaacgggagaaucggccugcccucacgcccacucuguagagaucugguguggaaacugaggccuggggaggugcaguguccaggcacagggccuagugucuuauccaaggccugguagcgcgaaagccgggucuagaaucuggaguaaaggagcccagaggccccagaaucucgguccuuagacuugaagcgacgcuguuaccucaguaaucguuuucugaccuuuuuguaccagaggaaguuucuugugguccuaggacuggagaaggggauguguaguggggaggagaaagaggauucggagauagcaacugcagacauuuaggaucagccgcaacaggaucgcacugaauuuccuuuucauuuauuuuccucacagugauccguggaggcaguaacaggcgcggcgagggagaagugauucccgaagaaucaaggcugggccggacccgguggccuggcaacaggguaguagccuuaaaauagauaaauaauugucuuuuugugucaaauuucaugaauuuaauguaaagaugggagaaguguugaauuauaggagaaacacucgagaaaguuuacagaugguuuccauaacaggugguuuuucaggguaauuacgcaauccaacugcacucccucaccuucugccuuaggcacauuugucaauugauuuugggguaggugguuaugucuccuucaaccugucuguguaaauccuacccuuugaaggugugccgaagcuguuucauaucguaguuaaaugcuuuaaggcagaugguggcucuaguuugaaccccugcuuuauacuuaacagugugacuuugugccagcuaauuacauucuccagaguuuaaguaugcucauuguucaaauugggaaaaaaauaauaguaucuguuccuuagaguuguuggaaugauuaaaugaguuaauacaugaaagcaauuagaacaauuccuggagcaugauaagaggucuccaaaugguuauuuaaggcccagcucuacacuuauacuacauuuuaagaccaucuugguggcugccuucucuucuaaauagaaucauucuaggagguaggaauugcuauuuuguuuacagcaagaaaaaugguucagagaagcccaguccucugacuuuauggccuguauucuuaucugugucaucuauuuagcauuuaacauauaucugauauucuuaaguauauuuuuuuguaucuguguguguguacacauguacauaaacauacuuuucuuucccaaccagaacaauagcagagaguaugucuuguguagaaucuuugcauccccugcaucuaccauacugcucugcacauauuuguugaugacaauaaugauuuagugauguuuuauuacgguagccaggagggcacaaacuguuuugagccuauuuuacguuagagaggcuuccaacuauaaaucugagcuuucucuauuguaacaagagaaaaacagaaagucaagaaauugaggcucagaaugccugagguuugugcauuuacucauacuuucaaccuguauuuagcaaauccuaguacgugccagguacuagucuagccacugggaauacaguugugaaccaaagauauaagaaggcagccagcaaagauggucuuaaaauguaguaugaugguagaacugggcuuuaauaauaaccauuuggagagcucuuacuaugugccaggaauuguuccaauugcuuucauguauuaacucauuuaaucaucucuaagggauagguagguugcccucaugaagcuuaccuucugaggugaauuuucuccaaacauauauuaaaaugaacuauguuguacuagcucaagaauagacaaacagauuaaauuacuagaaacuaaguagaguccaaaaagauacccuguguauguguauguauacauagugcaugaaaaugugacguuucagauuguuucuguuaugucuauucauaacuaguuaccuuaugaauuuaugacuacugugugcauuuuuuaauccaucaauaacuuuaacauuaaaaauuagauucuuauaugacaccauucacaaaaauaccuuacuuuagaagauauguaaggaaaacaaaaccaaaaaaacaugaagauuuggagaauguuuuuuaucucuuggguuagagaggaccuuucuaaacaggacacaaaagacagaugccauagaggaaaagauuguuauauuucauauguaaaaauuguaaaaauggcugggcgcuguggcucaugccuguaaucccagcacuuugggaggccgaagugggcagaccacuugaggucaugaguucaagaccagccuggccaacauggugaaaccccaucucuacuaaaaauacaaaaauuagcugggcacguuggcacacgccuguaaucccagcuacuugggaggcugaggcaugaaaucacuugaacccaggagguggaggaugcagugagcugagauugcaccacugcacugcagccaggguaaacagagucagacucucucucaaaaaaaaaaaaaaaaauuguaaaauuaugguaaagaccccauagucaaauuuaaaaaaauaaaugacaaggagaaaauuuuacagccaauauaaaagagaaaagauuccuauccauguaugaaaagcuucugcaaaagaauaagacaaaccgauagaaauauagucaagggauaugaauagaaaauacauaaaagaaauaauggccagugaacacgaaaugugccugacaucccuaauaaucaaagaaauacaaauuaaaacacaaucauaccaauuuucaucuaacagauuggcaaaaauguaaaggaucauguguauauucauugcaguguugcuuguaauagcauacagcuugagugaccuccaguagaggugauguuuaaauauauuuugcugcauucuuaaaaggaaauguagcauaaugcagccauuuggagagaaugagauaacuauaugcacucucuuugaaaguuuugugacuacuaugugccgggaguugcacugggcuuucuuuaagguauuuucagcaaaccugucuuuuaaugauuuauauuguaccuaauaagagauauaugaauggaaaaacaguuuuugcucucacaucaugacaaucaacacaaaagacuucugugaccaaauguguggaguuuucuuccaccaacaagcaagcaaucaauucugcagcggacaccagcuggguaucaucuaauucaauucugacacugucuacuuggagauagggucagaucccuuagguuuagggcuuaguccugcaagagggacccccauuucugaugccaauccaagcccuaaguuguuuuaccugugcuucugacugaccagcuacacaugaggaauccuauuaauacacaccuugggguguauuaauuugcuagaggagcuaacaaaacugagggaaacauguuuuccaguuuauuauaaagauauuacagagacccugggcaacauggagaaacccugucucuacuaaaaauacaaaaaauuagccgagcgucauggcuugcaaguguagucccagcuacuugggaggcugaggugggagaaucaccugaaccugagaagucuaggcugcagugagccauaauuguaccauuguccuccagccugggcaacaggagugagauccugucuccaaaaaaaaauacuaggauacaaaugaagagaugcauacugugaaguaugggaaggggcacagagcuuccauguccucccugccugugauauccaggaaauuccuccaggaacuuccacauguucagcuauccaguagcucuuuguaccccauccucuugagccuuuuauggagauuucaauggauaggcaugacugaagcauggacaaucauuuuggaaaugugauuggacaaaaaagauaugaucugauacuaacagacugaguggggaaacccagcaaggccugucugcucagauucuucuuggcuucucuguucagcauuccuuccaggauauagggcaagacccauucugaaacaggggucuuaugaccuacagcuagacaagauaggucagagaaaggcagggaugauuagaguucugcuuuggagagaaggagcaggugaaaggaggagaggaggaagucagaaauagauucuguuuucugaggccuaaagcacccuaacauaacaagacuguaacaaaggcuaugggaguuaugagccagaaacuguggacaaaaacauauauauguauauguauauauguauguauggaaaugaucacacgcucuaucuacuucauagcccuguugugaggauuacacaagacaguguauaguauauuaacauagugcuuagcuuauauuaaacaguugauacauguuagcuuuacuauaaauaaggaaauacgcuuuuauuauauaaggauaucuuugagcuucaaaugcuuuaaaacuuuuuuuuuuuagagacagggucuugcuuuguugaccaggcuagucuugaacaccaauucucaagcgauucuucagccuuaaacuuuuuuuacauagagaaaguuuuagcaacaaauuaggauguggaccuuguuuuuuaauguuaggagaauugauuuuauucaauauacuauuuacuuauuuauuaauuauuauuauuauuauuuugagacagagucuagcucugucacucaggcuggagugcagugaugugaucucaggucacucaaccuccaccuccuagguucaagcuauucugccucagccuccugaguaacugggauuacaggcacgcgccaccaugcccagcugauuuuuuguauucuuaguagaaaugggguuucaccauguuggccaggcuggucuugaacuccugaccgcaagugauucacccaccuuggccucccaaagugcugggauuauaggugugagccacugccccuggccuuauucacuauacuauuuagaagcaaucuuugauuaucuuauauuuauguaacauuucugagcauuaguguguugaaggucagugcuucacuaggagggcucacaggacucagaauauaguguacuuacagcuaugauuuauuacagugaagggaaauaaagcaaaaucagcaaagggaaaaagcauauugggggaaaucagguacaaacuucugaguucucucccaguggaguuacguaggauaugcuuaauuccuccagcaaccagcuaugacaacauguuugaaguguugucuaccaaggaagcucaacuagacacucagugaucagaauuuuuauuggaggauggccacauaggcacccucuguauagguacucucgacuggcauguaccagaauucuaagacuccuggaaggaaggcggguauucagcaugaaccacauuguuuuucauaaacaguuuuaggcacagggagccacucuuaccagagaauggcagaaacccuccugaaaucuaaguucuagaugccagucaaaggccaaccuuguaagcacaccuuugaaaguauaguagucuuaggccugucauguuagcucuuuuuugcaguucuucuugugugauuaaaggaaguuaauuccuauccuagaauuauugugcagauuagagagagaaugugaagcuccuaucacaguuccugacucuuagugagugcacaauaaacaauaccugcuauagcuguuacaugugagguauaggaaucuugagcucuuuuacacugguuagaaaaaccaguuuucuauaaggaagaaaugaaaaaaucuacauucugccucucaaacaaggcaagaaaagcuguuuuuauuuauauugaaauuauauuucaaacauuauuuagguagugaacauuuccuggcuuuuugaccuuuauucucugauucuguuaaaauauagguaauaagagaaaugaagccaacagguacagacccaaggaucuuaucuauagcugcugaaguugcaaaaagcccugagcagaaugucccuguuauacuguugaaguuaaaagguaagaaaaucuuuuugugauuagauagcauuuuaagugaaaaaugguuccaucguugguacaauuuuaacauuucuuuuaaauuuguucagagaggucuuaacacuauaauagaacaguaauuuuuccuucuaauauauuuuuagugauuauucaacauauaaaaauacaaauagcuccuggauguauuaagcaaaaauaaauauaucuuauuuccuuuugccuuagaaauaauaaacaucacaccuuuaggaagcucagaguugaagaaaaucaaacaagauauauauuguuaugaucucauucaauauugccucuugguccucagucaagauuauucucgaauccagggugguuggacuacaauuucccagcuuacacagauauuaagguaaaauaaagcaguaagucagcuguucuugagggauguaguaguugauucugauuuucaacauuugcuuuuuauuuaucugccuaacaagcauuggcaaccuccuguuguagguuuugguuguacuuuuccuucauauuauauguuauuauucauaauuuuacuucagauuauuugacugucuaaaauuuuccuccacaagcuuaaugaagauggugaucauuuuuuuucucaccacugaauuccaagugccuaauauacuuuuuauugauuaaggaauuuuuaaagaagugaagaaauuaaggcacuggcucuguaccugagaaacuuaaaauagagauugggugacagucauguaaguauaugauacaaagcagaaugaaaucagugcuaaaaugaaaguaugcaagcaaguacuauaggagaacugauaaagaaacauuuuauuucacuauaucaauguagcuaucaacuguguauuucauuaagcaacccaaauacugucaauaaaauuuagaaguagaauuuacugaucuacugccaugcuagaaauuaauagaagagaaauaaacauuuuuuaaaggagguaguaaaauaaaccagauguucuuagugccuaagcuacuuccugauuaauaagugaaaguguguauuuacuaacuggauccuagccuucuuuuuuuguuuuuccuaaauaagccauuugaauuuaauaagcuauucccacugaaaggguuugucuuggaugcuagauuucuaagcugcuuaauccuacuguguuacuugguaaaggccaaauuuaaagcacacaguuacaaagaacaguugaaaaauauaugugauauucuuuuucauacuuuaauuuucaagauugauuuucuuaaguaaauaaagccuuauguuuuuguuuugauucgauaugcuaguuuaugaugauauugauuaagccaggcucucggguggaauucaagacuuaagaaauucccauguuucugaaugcacaaauaaacauaauuucauuuguuaaucuucucaaucaaaaaagauacucuuaaguaauuaacuuuaggaaccaaagagaaaagaaaagcugauacaugugagcauuagcccauuaacuuuaggaacccaggugcaaauaaacaacaacaacaacaaaaagugauacauguaaauauuauccacuuagguuuuuuuuuaacuuuuauuuuagguucagggguacauguggagguuuguuuuauagguaaauugcauacucaauguuuguucucacuuauaagugagaauaugcaguguuuggcuuucuguucuuguguuaguucacuuagguuaauggccuucagcuccauccauguugcugcaaaggacaugaucuuguucuuuuuuauggcugcauaguauuccaugguguauauguaccaccccaaagaaauauaccauuuucuuuauccagucugccauugauuacuuagauuuuuaacaugcucaauacauaguuguuauugcuuauuaguguccauacauuuuguugaaaagacucaaacagcaguuuuuguucauuagaguacacacauagagaccauucuuggguuugaggcucuuuugaauguuaguuuacagaaaaaccuuuuauuauugggacuucugacuuauguacaggaaaugacuuuuauguacaauuuuaagaggaccuuuuucucuaagugacuuucucuccucuaauguauauuguaaaguguuccuacuagaguuagguuuugccguuuguccuucugauauaaggaauaugcaaaugaguauuuugcaaaaaguagaucuauuggaagguaaaauugguaugaaauuaguguuugguuuccuuauguaucccuugcaaacaaauccuacuugggcauuuuucagcuauuaggugucuaaaauguauuaguuaacacaaaugcuuuucauaaauuaaacucucaagguauccuauagcuuugagaaugauuauagccaauucacugaaaacuuagcuucucuuuauugugagccaagugucuuuuauuugcugaaugagcugauauguagguuuuuaggauacauaaaucccagaccuaaguacaagcaugguccauaccacuguuuacuuuucuagaaaguuguuagacuaauuuuucaacaaaaauucuuuauugucuugguaacaaaagaagcauacuaaaaauucucaauaaggcacagugucucuagaagcuugagcauucaacauaaacuucuaauuaacacgaacuugugcucuuauuucagccauugcugugugggcuuggagccaggagaagaugcagaggaauuuuacaaugaauuacuuccaucagcugcagaaaauuuucuaguuuuggggagacaauuacaaacauguuuuaucaaugcagcuaagguauguguuuauuuagucuuuuguagcuaaaucaguuuaauucuuaagaagcuguucuguuauuuuuuaaaugugcaauauuuggcugaaaguacaauuaaaguagugaauuuaaacauuuucaaaguuacaaccuuccaaaaaucaucucuauguuugaaaaauuuuuaaugcugacugaagcuugccauuugauuuuuugaaggaucugccuugcuacuuuacuuguugggcagcacccauagacaauuauuuccauaacaucuuucuaaacauacuuuuuacuuaaauuaacaguagaggaaaguauguucucuagggcuagggcuuuucuaaguagcuccaguagugaagaauaaaggugaacuuccuauuugaucucucauaucuucuccagucaaaauauucaacccaaacauaggggucuuuucaaguauuucuugguugcauuaugcuagaugcuauacaugugcucuuuuuuugacccagggauuuagaaguguguugcuuaauuuccaaauauuugaagaucuacuagauacuuuauuguuaucaauuucuaauuuaauuauguuuuggucagauaacauucucuauaucauuucaauccuuuggaauuuuuucagacuuguuuuauggcccuccgcauauguuuuaucuuugugaauguucauuaaaagaaacuuuugugggcugggcgcaguggcucacaccuguaaucccagcaguuugggaggccgaggcgggcggaucaccugagguugggaguuugagaccagccugaccaacauggagaaacccugucucuacuaaaaaugcaaaauuagccgggcaugguggcacaugccuauaaucccagcuacuugggaggcugaggcaggaggaucacuugaacccaggaggcagagguugcagugagccaagauagugccauugcucuccagccugggcaacaagagcaaaacuccaucugaaaaaaaaaaaaaaaagaaaagaaaaagaaaccuuuguuuugcacaguuccaucuuaacugaaacucgugcaugucagaaccaugcaaagguuuugauaugcacagguuuuauuuaauauggugccaugcaaaagcuaggacuacuuguauacccaaaugugaacucugcaguuguauguaauguucuauaaguguuaauuaggucaauuugguuaguagaguuguugaagucuucuaaauucucuuuuuuuuuucuugucuacaguucuacuuuuuagugagcaaggguauuaaaauuuccaacuaugguugcggauuugucuaauucugucuuuaguucuauauguuuuugcuucauguauuacaaagcucugugauuagauacauacacauuuaggaauauuauaucuucuggaugaaugaaagcuauuaucauuaugaacuggucuuuuuuuuuuuuuucaaccuuacucauggacucaggucacaugaaaugauauuuaucucugauaauagaccuuaucuugaagucuacuuuguuuacuauuacgaauauugccacuccaguuuucuuaugauuaguguuuacaugauacacuuucugcaguuucaccuuucaugguuucaguuacccauggccaauagugguucaaaaauauuaaauggagaauuccagaaauaaacaauuaaauuuuaaacggcaugcuguucucauagcaugaugaagucucauaguguccuucccaggaugugaagcaccccuugaccagcauaucagcacuguacaggcugccugccaguuggucacuuaguagcuggucucaguuuucagauuaaaaaaaaaaguauauauaggguucaguacuauccacaccuucaggcauccacugggggucuuggaauaugucuuccauggauaagggggagacuauuguacaucauuucucaaccuuuacuuuuuaaccucugucuuauacuuaaaaugagucuguuuuaaauagcguauugucaggucuugcuuuuucaucuagucugacaagcuguuguuuuaaaggguaucauuuacuugcauuuaaucuaauuugugcuaugguuagguuuaauucuaccauuuugcuauuuuuaagaaauuuguucccaguuucuaucuuuugugcuauuuugucauguauuuuacuuuuacauauauuaugaaaucuaccauguguuauuuuuacuuuaaauaguguauugacuuuucaauaauuuaaagaaaugaaagaaaaaugauuuuuuuauaucuacuaugucugguugucuuuauuccuucaaacagaucugaauuuucauuugguaucauuuccuuuaagccugacaaccuccuuuagcauaucuuacagugcaauucugcugguaaugaauucucucagcuuuuugguuaucugaaaaugucuucaugaugccuucacuuuugaggaauauuucuguugcauguguauaauucuacuucaucaauuuuuuuuccucuuuuugcacuuuaaagauuuuuuuccauugucuucuggcaucuuuuguuucugauguaaauucagccuucauucuucuugucauucuccuauacauauugcaccuuuuuaucuuuggcuuuuuuaagauguucucuuuguuugguuuauuuuguuuuauuuucagcaauuuuacuuugaugaaccuuguuguagauuuccugaugucuaucuugcuuggagguccugaguuucaugugucugaguuaauguauucauauuaagaaaauuuucagcuaauauuuuuucaaauacuuuuguuugcccuauucucucuaccuucacucugggacuucugguuguugaggcugccuucauccuuuucuuguuguuguuuacuucaguuucgauaauuucuauuguucugucuucaaguacacugacccuaucuucuacagugucuaaugugcuaauaauccuaccuagugaauuuuucauuucauauauuguauuguucuaugauuuuuauuugcuucucuuauugauuguuuaccauauuuauuauaguuauuuuuaaguuguuguuuauaaauccaauaccuggaucauuugagagucuuuuuauuaucuguuuuuucucugggucaaauuaucugggucaaauuuuucugcuucuucacaucucuguuaauuuuuuguuuuauaaugguaacugugaaugacacauuguagaaauucguaucuuccucugaagacuugagagcaguuaaauucuggcagaucaauuguuccuguggaggcuugguuuuagccuuucuuuggagagguuuacuucaguuuugccauuagaguauugcccuuaguccugguucacaguccuuauaccuaaggugagauccuucugugguuuaaauggaaagcccaccauguuaacccagaccaucugacuuggaagaaccuaaacuccaaacucuguauacccagcacuaggcaaaagaugaaauugcugguaauuucuuucagccuuucagcuguagauucuucugggcuccguggagccuuuucucucauauguacaguuuaagagucaagaauucaauggaaguuuguauauagauuuugaagcucuguacuuuguggaucacuucuuuaacuguucuggcagccccaagcuccaaauucugacuccucagccaaguuauacugcaacuucuuauuugaacucuuucccuauguugauaaacacacacugggaaaagccaggcauauuagucaggucucuccagaaaaacagaaccaauagaagauauauggagagagagaaagaaagagaaagugcuugauuauaaggaauuggcaauuauggaagcuaacaaguccugagauuugcaguugguaagcuagagacccaggagagcugaugguauagucugaguuuaaaggccuuagaaucaggagaacugauagcauagugcuaguccaaaugccagcagacucgagauccaugaagaagcaguguuucaguuugagucugaagucaggaaauacugaugucccaacucaaaggcagucaggcaagaggaauuucccuuuaugugggagagggucaaucuuuuguucuacucaagcccucaacugauuguaugaggcccacccacauuaaggaaagcaaucugcuuuacucagacuaaaaauuuaaauguuaaacucaucuaaaaauacccuuacagaaacacccagaauaucuuugacaaucacacaagauaaauuuagauuucagucaguacauuuuauuucaggaucaugucugugugccuuugcuugcuaucuaaaaccuucaaacaguugcuuuuuauauuuuuucccgaguuuauacauuuggucagcaaaagcuuaggucaacaaacuauggccugugggcuaaauccagcuuauuuuuaaaaauuaaguuguauuggaacacagcugcaccuauuuguuuauauuauccaugacuacuuucacuauagccacagaguucaguaguuucuagagacuauaaugccuaaaauauuuucuggcccacaacuaacaggaaaguaaguucuauaaaggggaagaguagggaacaaccaaugugaacaagagugauuccaaaaagcuuuguggagccaaugguaccuggucuaucuaucucuaaagcauggaugagauuuggaaauaugagggcauuacaggcagcggaaauggacaagaccaggaaagaggaauaaguaugacaucuuugagucccagugcagauuccuaccagaguuagauagaguauucucauucagaaagauugaaggccagaugcaguggcucacgccuguauaaucccagcacuuugggaggcugagauggcaggaucacuugaccccaggaguucaagaccaaccugggcaacauagcaagaccuagccaagugugguugcacaugccugucuuccuagcuacucaggaggcuaaggcaggaggauugcuugagcccaggagcucacggcugcagugagcuaugaucacgucaccgcacaccagcuuuggcaacagagcaagauccuaucucuuuaaaaaaaaagaaaaaaagaaaaaaaaggaaaaaacagaaaaaguuugaacuugauucuacgauagugaagaggcuuuuuuuuuugaggagacauaagaguaugcuggagagagcggaagaagagaccauuuuaaauuauuguaguaagcuagaagaacuaagguaauaagugucuugacucacuaugacuuuggaaaaauagagggucaaaugaaauauuaagaaaaaaauuguaagaauauaaaagguguacuaucagacacugcuuuuauacagauaauauauaauauauuaaugaugagucuaaguugagucuaagguuucaaggcccuacagauguuuaagagaagugauaagccagagguaaaaacugggaaaaaggaugcaaucccuuugaaguuaguugcauuuucaaguggaaaugucuaggauggaauugaaguuggauugagagaucaggacuauggcuauagguuggaaaguccucuuaugaaugcuaauuaaaacuuugaagaggagcauacuagaggaugagcuuuccuagggaugugguguagagauaauaucugaaggcuguguucagagccuuagagaugucugacauagaugcaauguauuugggcaaauugaggaauuauggcucaauaugcuagauggaugaagaaaacugaaggcaaagaaguugaggccauuuuuaauuuuuuaauaaauauuugucaucucgaagagaugaauuugcuaggugcucuaccugccauuuaaauaauuuaaguagugaugucuaguacauggccucauggucuguucugcaugguauaauaugguagccauuaacccuguguaucaguugagcaauugaaauguaccuuuguaacugagacugaaaauuuuauuuaauuuuaauuauuuuaaauuuaaaaauugaugaucaauucuguuaggaaacuuaaguguguuuggaacaacuugaguaugugaaucuacuuuuacaacuguaaguuuuauaaaaucuaaauacauaccaagaauuucuaaugaaaauuuagccuccaaguagagaucugcuccaaguauaaauauucaccagauuucaaagaaauaccaaaaauuuuuuauauauauuccaugcuaaaaaugcuaauauaaaauauauuguuauuuguuuuaccuauuucuuuuuacucuuuaaaaacauugcuacuagaaaacuuaacauuaucuagauggcucacauuauauuucuauuggauggcaacacuauagaguuagauuacucaugaguaaaaaucauucaaaauucagcaugauauuuguuucagguaugcucauucucuuaaaacaagacuaauaaaguugaaaaagcauaauuauuaaucauuaauuacuauguuuaauaaguacauaauuggguauaagauauuaaaaauaugaauaacuagauacuuuuagguacuuauugcauuauucuuuaugucagggguccccagcccccaggccacagacuaguacucauccauggccugucagaaacccagccacacaggaggaaguaagugacgggcaagugagugagcaaagcuucaucuguauuuacagccacuccccauugcucacauuaccgccugagcucugccuccugucagaucagcgguaacauuagauucucauaagagcauaaauccuauugugaacugugcaggugagggaucuagguugcaggcucauuaugagaaucuaaugccugaugauuugucacugucucccaucacucucagaugagacucuuuaguugcaggaaaacacgcucagggcuucuacugauucuacauuauggugaguuguauaauuauuucauuauguauuacaauguaauaauaauauaaauaaagcacacaauaaauguaaugggcuugaaucauccccaaaacauccuuccccuugacccccuaguucauggagaaauuaucuuccaugaaaccggucccuggugcaaaaaagguuagagaccacugcuuuaaguaauuuuaaacacaguucucuaacuuuaaguugauuuuccuuauugaaaggcgcuuuuaaaaguugcuguuugcuuccacccucacaacauauuuccaguuuauuuacuuagcuucagauuuagguccucuuaagcuuugucugaaugccuagcuucugacugccuucuaaauuuaacuuuuucuucauuuacacacugauucuaggugccuuucugguucuuauucguggucaucuucugaccuuuauugccugcaccugcaugcauuugacauauagauauuauaaucucucuuuuaaaaucuguucagguuuuuuugguaauacuuaucaauuaucaaucagucucuugcuuguuuucuuguuuguuuuuccuaaaaguguuuacucucuccuuugggcucuaucuucaaguugucuaauaacuacaagcucacaugucuuuaguacuaccuugacuucuagcugcugggcccugcccuaaguccgguuuacuuacaugcuucucucuucuuuuggcaucccuguuugaagacaguuucuuagcuccauauggggaauguagcaggauuauuuugcuccaagcugucauuugauuuuuuaaaaaaugauauuuccucacuagguacccgcaagugggaauccaaaaauaaguaaugagaagaguggaacugggcauuaaugaauacauuauauuaauaugcaaacuauuuuuaccuuuugacagcagagguucaucuuagaauuuauaagaagugauaagucuacaaggcugaaacuccuuuaccuuagaagaguucuuggcuauauguacauuugggccuacuacuauaucagagcuugagcagauucacaacuguugucaauuauggacagauauuaauaacucagucacuugacuuacucuguucaggcugcuguaacaaaauaccauagacuuggugacuuaaagacauuuauuucuuauaguucuggagacuaagaaguccaagaucaagaagccaacagauccacuuccucauggggcccacuuccuggcuugcagacagccacucucuugugugcucacaugaccuccugcuuguguuuguguggagagggagagggagcucucuugucucuuucaugucuuuuccuucuuucuuucuuucuuauaagggcacuaaucccauccugaggacaccaccaucaugacccaaucuacaccuccaaagucuccaccaucacauuagagguuaggguuucaacauaugaguuuucagggacacaaacaguccauaaugaucaccagguuauauuaaguucuauuuauggugcuuugaguauauaaagaauagacacagucuuacauuuaaggaauucccaggcuaauagaguagaaaaggucuuagccauuuuuaauagaaaaccuaaaauagauguauuuuuaguuuaagaauuuuucuuuaauuagaagaaugaaauugaaugagagguauaauaguacagacaaccugcugcuuugaguauaagaaauacuguuggcagacaauuucuuuuucuuuucuuuucuuuuuuuuuuauuauacuuucaguucugggauauaugugcuggauguccagguuuguuacauggguauacaugugccauggugguuugcuguacccaucaacucgucauguagguuuuaagcccugcaugcauuagguauuuguccuaaugcuaucccuccccuugcucccuacccccugacaggccacagugugugauguuccccucccuguguccauguguucucauuguucaacucccgcuuaugagugagaacaugcaguguuugguuuucuguuccuguguuaguuugcugagaaugaugguuuccaccuucauccaugucccugcaaaggacaugaacucauucuuuuuuauggcugcauaguauuccaugguguauaugugccacauuucuuuguccaaucuaucauugaugggcauuugguuugguuccaagacuuugcuguuguaaauagugcugcaguaaacauacgugugcaugugucuuuauaguagaaugauuuauaauccuuuggguauauauccaguaauggaauagcugggucaaaugguauuucugauucuagauccuugagcagucgccacacugucuuccacagugguugaacuuacauucccaccaacaguguaaaagcguuccuauuucuccacauccucuccagcaucuguuguuuccugacuuuuuaaugaucgccacucuaacuggagugagaggguaucucauugugguuuugauuugcauuucucuagugaccaguaaugaugagcuuuuuuucauauguuuguuggccccauagaugccuucuuuugagaagugucuauucauauccuucacccacuuuuugaugguuuuuuuucuuguaaauuuguuuaaguuccuuuuagauucuugauauuugaccuucaucagauggguagauugcaaaaauuuuuuccuauucuguagguugccuguucacucugaugauaguuucuuuugccaugcagaagcucuuuaguuuaauuagauuccauuugucuauuuuggcuuuugcugcaauugcuuuuuguguuuuagccaugaaaucuuugccuaugccuauguccugaaugguauugccuagguuuucuucuaggguuuguaugguuuuaggucuuauguguaagucuuuaauccaucuugaguuaauuuucauauaagauguaaggaagggguccaguuucaguuuucugcguauggcuagccaguuuucccagcaccauuuauuaaauagggaauccuuucccuauuucuuguuuuugucagguuugucaaagaucagaugguuguagaugugugguguuauuucugaggccucuguucuguuccauuggucuauauauguguuuugauaccaguaccaugcuguuuugguuauuguagccuuguauaguuugaagucagguagcaugaugccuccagcuuuguucuuuuugcuuaggauugucuuggcuauacgggcucuuuuuuuuuuuuuuuuuuuugguuccacaugaaauguaaaguaguuuuuucuaaaucugugaagaaagucaaugguaguuugauggaaauagcauugaaucuauaaauuacuuugggcaguauggccaucuucacgauauugauucuuucuauccauaagcauggaauuuuuuuuccauuuguuuguguccucuguuauuuccuugagcaguguuuuguaguuauccuugaagagguccuucaugucccuuguaaguuguauuccuagguauuuuauucuguuuguagcaauugugaaugggaauucacuuaugauuugucucuguguuugucuaucauugguguauaggaaugcuugugauuuuugcagauugguuuuguaucuugagacuuugcugaaguugcuuaucagcuuaaggagguuuugggcugagacgaugggguuuucuaaauauacagucauaucaucugcaaucagagacaauuugacuuucucucuuccuauucgaauacacuuucuuucuccugccugauugcccuggccagaacauccaauacuauguugaauagggguggagagagugggcaucuuugucuugugcugguuuucuaagggaaugcuuccagcuuuugcccauucagugugauguuggcuguggguuucucauaaauaguuauuauuguuuugagauauguuccaucgauaccuaguucauugagaguuuuuagcaugaaugggguguugaauuuuauuggcggccuuuucugcaucuauugaaauaaucaugugauuuuugucauugguucuguuuaugugauggauuacuuuuauugauuugcauguguuaaaccauccuugcauugagugaugaagccgacuuaaucauaguugauaaguuuuuugaugugcugcuggauucgguuugccaguauuuuauugaggauuuucgcauugauguucaugagagauacuggccugaaauuuucuuuuuuuguggugucugugacagguuuugguaucaggaugauccugcucucagaaaaugaguuagggaggagucccucuuuuuguauuguuuggaauaguuucagaaggaaugguaccagcuccucuuuguaccucugguagaauucagcugugaauccgucugguccugggcuuuuuuugguugguaggccauuaauuacugccucaauuucagaacuuguuauuggucuauucagggauucagcuucuuccugguuuagucuugggaggguguauguguccaggaauuuguccauuucuucuagauuuucuaguuuauuuguguagagguguuuauaguauucucugauguuuguauuucugugggaucaguggugauauccccuuuaucauuuuuuauugugucuaucugauucuucucgccuuucuuuuuuauuagucuggcuagcggucuauuuuguuaaucuuuucagaaaaccagcuccuggauucauugauuuuuugaaggguuuuucgugucucuaucuccuucaguucugcucuaaucuuaguuauuucuugucuucugcuagcuuuugaauuuguuugcucuugcuucucuaguucucuuaauugugauguuagggugucgauuuuagaucuuucccacuuucuccugugggcauuuagugcuguaaauuucccucuacacacuguucuagcugagucccagagauucuggcacauugugucuuuguucucauugguuucaaauaacuuauuuauuucugccuuugguuauuuacccaguacucauucaggagcagcuugugccguuuccauguaauugugugguuuugagugaguuucuuaauccugaguucuaauuugauugcaccguggacugagacuguuuguuaugauuucuguucuuuugcauuugcugaggaguguuuuacuuccaauuauguggucgauuuuagaauaagugcgauguggugcuaagaagaauguauauucuauuuauuugggguggagaguucuguagaugucuauuagguccgcuugguccagagcugaguucgaguccugaauauccuuguuaauuuucugucucauugaucugucuaauauugacagugggguguuaaagucucucacuauuauugugugggagucuaagucucuuugucggucucuaagaauuugcuuuaugaaucugggugcuccuguauugggugaauauauauuuaggauaguuagcucuuuuuguugcauugaucccuuuaccauuacauaaugcccuucuuugucuuuuuugaucuuuguugguuuaaagucugucuuaucagagacuaggauugcaacuccugcuuuuuuuugcuuuccauuugcuugguaaauauuccugcaucccuuuauuuugagccuauguguguauuugcaugugagaugggucuccugaauacagcacacagauggguuuagacaguuuauacaauuugccagucugugucuuuuaauuggggcauguagcccauuuacauuuaagguuaauauuguuaugugugaauuugauccugucauuaugaugcuggcugguuauuuugcacauuaguugaugcaguuucuucauagugucauggggcuuuguauuuugguaugcuuuugcagugguugguaccaguuuuuaauuuccauauuuagugcuuccuucaggacucuuguaaggcagcccugguggugacaaaaucucucagcauuugcuugucuauaaaggauuuuauuucuccuucauaagcuucauaagcuuaguuuggcuagauaugaaauucuagguugaaaauuauuuucuuuaagaguguagauuauuggcccccacucucuuuuggcuuguaggguuucugcagagacauccgcuguuagucugaugggcuucccuuuguagguaaccugaccuuucucucuggcugccccuaagauuuuuuuccuucauuucaaccuuggagaaucugacaauuaaguguguugggguuacuauucucgaggaguaucuuagugguauucucuguauuucuugaauuugaauguuggcuugucuugcuagguuggggauguucuccuggauaauauccugaaguguuuuccaacuugguuccauucuccccaucaccuucagguacaccaagcaaucguauguuugucuuuucacauaguuccauauuccuuggaggcuuuguucauuucuuuucauucuucuuucucuaaucuugucuucacacuuuauuucauuaaguugaucuucauucucuuauauccuuccuucugcuagaucaauuuggcuauugauacuuguguaugcuucaugaaguucucaugcuguguuuuucagcuccaucaggucauuuauguucuccuaaacugguuauucuaguuagcaauuugucuaaccuuuuuucaauguucuuagcuuccuuacacuggguuagaacaugcuccuucagcucagaggaguuuguuauuacccaccuuccgaagccuacuuuuguuaauuaucaaacucauucucaguccaguuuuugcccuugcuggggaggaaucgcgaucauuugguggagaagaggcguucugguuuuuggaauguucagccuuuuugugcugguuuuuccucaucuucauggauuugucuaccuuugaucuucgaugcugaugaccuuuggauggggauuuuguguggguguccuuuuuguugauguugauguuauugcuuucuguuuguuaguuuuccuucuaacaggucccucuucugcaggucugcuggaguuugcuggagguccacuccagacccuguuugccuggguaucagcagcagaggcuguagaacagcaaauauuacucacaccuccuuccucuggaagcuucgucucagaguggcaccugccugauuccugccagagcucuccuguuuggaggugucucccagucuggaggcacagggucagggacccacuugaggaggcauucuguuccuuagcagagcucuagcacuaacaaauucaaauucaguauaucaacugugcugggagaugcgccgcucucuucagcgcuggcaggcaggaacauuuaagucugcugaaacugcacccacagucuccccuguccccaggugcgcugucccagggagaugggaguuuuauguauaagccucuuacuggggcugcugccuuuguuucagagaugacuugcccagugaggaggaaucuagagaggcagucuggccacagcugccuugcugugcugcagugaguuccacccaguccaaacuucccaguggcuuccuuaacacugugaggggaaaacugccgacucaagccucaguaaugguggaugcccuucccaccaccaagcucaguugucccagguuggucgacuucagacuguugugcugggagcgagaauuucaaggcaaugguucuuagcuugcuggucuccgugggagugggacccgcugaacaagaccucuuggcuccuugguuucagaccccuuuccaggggagugaacagucugucuugcugggguuuuagccaccacugagguacaaaaagaaacucgugcagcuagcucagugucugcccaaacagcugaccaguuuugugcuugaaacccagggcccuggugguuuaggcacacagggaaucuccuggucuguggguugcaaaaaccaugggaaaaacguaguaucugggccagauagcacagucccucccuucccuuggcuaggggagggagguccccagccccuugcacuucccaggugaggcaaugccccacucugcuucugcuugccaucugugggcugcgcccauugucuaaccagucccaaugagaugaacuggguaccucaguuggaaaugcagaaucacugccuucugcauugcuauugcugagagcuucagaccagagcuguuccucuucaaccaucuugccagaucccccuggcagagaauuuaacucagugguagagcauauguguuccauguaacagguuacaaauuccauuucugauaucuccacuggcauuuugugggauguuagcacuaaauaaauauuugcuagauuuaguuuaauucagguuaguugaagccacauaaacuauaggaauuguguuggauuugauuucuuuugcuggcugugccacaaacuaacucuagguucuauagcaaaucacuggauuucacuguaucucauuuuccucauuuguaaaauaauuucugucccauuaauagcucagaccauuauguaagcuuuaucuuuucuucaaagcaccuuuauuuaauauuccuauuuaagagcauuaauaauucuuuuuccuuauauauuauuaaaauuauguauuaauauguuauguauuuguauauuacuuucauuauaaauauacuuauucaguuaauuauuuucauuuauagaauccuuaauacuuuucauaauauuuuucuguccuuuauuauuguauuuuuauugagauaaagauucuuuaauguuauccaagaauuaauuggcuacagaaaaaguaaggccacuuaaccacagggcaaaauuaaaacaggggcauaaaaaagauguggcaaaaacuugaauuaauuuauuagucuauuuaccuaggagcuuuucaaucagauuuuuguuuuaauuagauaguacauaguuaguagaucauauggugggacauacacguucugaccuaaaauacaaagugguuuugugugaguauaugugagaauuucgauuuaaagguaaauuuuguuaaccugccucaagaaccaugaauuugugggugacauuaucuaaugugcauuuuaaggaaaguaggaagucuaagaguacaacacuaucuuuugggauugacaacaaugagaauuaccaugcccuuucugauguaucuuuagguaaaacucuggcaaagguagcuuccugaacuaaaaggauaaaaggauucuugcucuaaugugacguuucuuauggguuuuuuuuuuuuccauuguuauauucaagucagcacuuguccuagaauauuccuaggauauuaggaaaaaaauacuuucauuauuauaaagaauaaucauggcaaucauaauauuuuugcgggucucaucauuacuuuugugcuauaguacaaacauucaggacauggauaagauuagugaccuuuauccaacauuccacuaaaguuacauggccaauaaaugacaaaauuguaaauggaaucuauacuucuuauuucuccuuguggcacucuaauuuauaauaauuucucacccuacuuuccagaaaggaagagccagaaaaaacugucauuuauuuguugacuaaauguugauugaacauuuacuaugugucagaacuguccuagaaacugaguuuguauggggagcuaaaugacacgaucuuugcccuccuaaacuuaugaguagaaacuggaacugaaauacacuauuaauaaugcuucucaugcugacaucuacauuugcauauugcaguuauuuucacccaaguuguaaaaccaaaucaaccaccuaacuuugugcaaguacagauauccagacugccuuuggagauucaaauucaguauauuugaacuaaagcuugugcauagauguauuuaaaaagcucaacaggugauucugaugcauagcaaguauuaagacauccuaguguaucaacuuguagcccuuacacuacuuauguuguuuuauuuuaucuggauaacaaccauuucuaguagauauuacuauccuguaaccacaaguuuuacaaauuaagaaacuaaaggcaacaaaaucaugucccucauaaauagcuaaguuagauccagaaacuguauccucuaacuccccagagagaagucuccuuaaaaaaaaaaaaaaggaaaaaaacuauagaaaaguaaacugggcuuaucuuuuauguuaaggcugaagaaaaagaugaauuacuacacuuuuuccaaauugugacugauucucucuucuggcuuuugggaggccauguugaacuuauucagaaugguaagagaaaagauuuuaauguaacuaauagcuauuguagagucaacugcuaacaguuugaucguuuuuuccaaaaacaaaugccacaugaacugugcagauaaccacacugaaaugaaaccauguugaaauaagcucacaauuuuuuaaaauggauauuccaguuuuacauagccuacaucaacaaugugaauauuaaauuaaggagaauacuguugaaauaaaacuuuagcuuuuucuguuuagcaaaucuaagauaaagacaaaugauaauuugagcaguuuauuccuaaaaauaacuuuuaaguuuaaaagauuacagucaguguuuuagaccuaucaugagagaaaucccuauguucaggguggauaugauuuaacucauauagucuaacuauccaaguaagaguaagcuuuuauuuaaugaccuuuuaguaaacuuggaaguuauaggauauuucuguuuacauugagagauauaaacauguaugaguuuuauguuuucuuaagacugaaaaaauaauucuuaguuacauucauggugcucucccuagaaaaauuucaucuaauauagauguaacacucuuaagaauauuuuuuaaguaauacuugaacugaaauuuuacuuuaagcuuuucuccucagaaucauugcaugcacauaauuuaaagagucaaauaguucuguaaggaucauuaaaacacacacaaucccugacccucaugcccacuccauuucccauuuuccaaaggcaacuacguucaguuaguauaacuaauaccuuugguaguuaugcucaguuauugagcauggaauggaauggaaacugacauuuauuagaaauguucccuguucuaggauauuuuacauuagcucaugugagagcuauuauuucuaguuuuacagaugaagaaaugguuucuaagagguuaagcaacuuguauaaguauccagugcuaaaucguuauaacuggcugcucagagcuuaaagauuacaaaucaauaaaaggaaauuuuuguaguuagcguauucauuauuauauaaaacaauaugucacaaaauuaaauuuuuuaagguugugagcaaccaauuauagucaucugugccauuuccguuuccuuauauucugucuuugcaggaaauuuguuuuuauucacugaaauucauugauagaagaaaaagauucagauuuaggauaugauauuuucaauuuaaagagauaacaauagauucuuagcuuaguauuuaugccuauuuucugacuauauucauaaaaaugaaaugacuuauuuaucgcuauuuaaaauugccaugaauuuuacaucuuaaagucuucuuuaucguagagucuacaaagucagaaaguuuagcagagauggucaugcuuugauuugguuugaaaagaacaaaaucuuccuuuguuaucauaaaaucuuuacuuuaaucuuucuuuuuuuuucuuuuccuuuaguacuacaaagugaucauuucuuacauuuacugcaagcugacaauguccaaauaggaucugcagucaugaugaugcuacagaauauacuacagaucaacaggugacuugguuuuuacaaaauguuacugcuuuuuuuuuaucagaagcauuaccaauuuuauuccaauuuugcuaaaauugaccgcauaugauuuguauauaauguauauacaaguauaugcacuauauacucguauauaauguauauacaaguauaugcacuauauacuuguauauaaugcugaaguuccaucaccauugucuuucagaaaaauuaauauaaaauacuacaaaagacuggaaauuuauuauuaaauugauaccuuauaccagagcuuaagauuuuuagcucaaaucucaggcuuaaagaagagaauuagugugauaaucugaagaaaaauauugagaucacaacaaaaaauguuuaaucacauuuauuuaauaaacuucaagcuugguauuuuuacagaugcucaagaaggguauaaaagaagcaauuggcaauuauucaggguaacauggaagggcagaguauacacaauugaaauaauccauucuuucaguuuaguaugaauuuauuaugcagcugcugucugucauugcaauuauagaguugauuaagauauaaaccuugucuucaaagagcuuacaauagaauggaaaacacaaacaucauuguauacauuaaauuacaauauuaaaagugaccauaaauguuaaaggaccuucuaacccaaaccgaggggaggugcuuccuggagaagguaauaucugagaugaaacuucaaggaugguauauuggccagggaggaagaggagaaagagaaagcaguaauuccaggcaacauaaacaaaagcacagagauaagaaacaacaugcugaggaugaaaaguagguacaaauucauuauuguugggauauaaaguuccauauagggaggugacuagcaagcucggcugagacucaaagucaugaagaauuuauaugcuguguugaggaaacggagucuaauccuauaggcaacggggaccauugaagauuuuuaaaguagacgaaaguggucagauuacauuucaauuuuguuacucuggugacuaugugaagguagauuaaggggaagaaaacucuagacacaaaaggcaaucauacuaauccaagugaaguaaugauaacuuguccuugggcauugguaccugggauauggagguuuuaaaauaaugaauuaaaaucaucaggacuuuacuuccacuucugaucaagauggaauaguagggaugcauuuauccucccaccugaaaaaaaggacaaaaacaugacacauaauuuuuugagaaacuggguaucagucagugaaagaaaguaagcccagagaaaaaggaauaaacaaggugaaucuuacaauugcucuaacuuacaguauugagagaguuuccagguugaaguauagggagaggcaucccagccagcuugaguugaagugauagagcucagagucuggagagaacaagauaacuagaguucacaagucagaauacuagagaagagagcuauacauguagagaaccccagagaucugcagaggguauccuucaaguauuaaguagaguacugaucugcacauuguaaggaauacccaaugccagggaaaacaauaauccaaaaggauuaaaaggaacagugcaaggagcucacacagggccagaaauagugccuguuuccaacagccaaacuggaaagccucauaaacagugcgucauuggguagaguguucaggaagguuuuacuccaguagugaggaauaauuagcauuagaaugagcacuauuccagaucauaaaagcaagacccaaaagggucaaacuguuuccaaguaacuuaacugcaugugguuauugaaccuggcuguauuuuaaaauuaauuuuauuguagguuauacaaagguaggaaguucacuagaaauggcuauccuucgauuuggcuuuaaaaaggaugagaaaaaucccacuugugccaucauagaauauuugcuuugaugacucuuuuuuucuauuucuuuauuacuguaaaaugacuauuucuugcaguuacugauaacuacuugcaguacugcauguaucuugcaguacugauacaugauagauuauacagucaugacuaugcuacaaaacauacuacgauucaacgggugauuugauuuuacugguacugaaguacugggcaugcaaauaaacaagaaaacaggaucuaaaaugagaagaauuaaucaagacugguacauauguuggaauuaacagacaaggacacuaguuauuauaaccauacuccauauauuuaaaaaguugaauacagacauauaagacucaaagugaauuucuagacaugaaaucuacaauaucugagaugaaaaauacacuggaugggauuaacagcagauuaacauugcagauuagugaacuuuaaggcguaucaguagaaacuauccaaaaugaaacaaagaagaaacaagaggaaagaaaagcauaucagugaacugugggacaacuugagcaaccuuacauaaguguaaucagaguacguaaagcaggcaguagggucacaaaaaaaugugugaagaaguaaugacuuaacauuuuccaaauuugaugaaaacuauaaacaugcagaugcaaaaaggucgucaaacccugagggcaauaaauaugaagaaaauuccacauugaggcacaucguaaucaaaaugcucaaaccagugauaaagagaaaaaucuuaaaagcaaccagagaugaaaaaacauuauauagagaaauagagauaaggaugacagcaacuuucuuaucagaaacaacacaaguaaaaagacaguugaauacugaaaaagaaaacugucaaauuagaauuacaugcucagcagaaauauauucaaaagcaaagaugaaauacuucuucagaaaucaccagcagaccaacacuacaaaaaauauucaaggaaguccuuccaucagaagggaaauucaucuacacaaagaaauagaguaucggaaauggugauuacauaaacauauaagauaguuuuucuuauauuauuuuaauauaucuauaauauguuugccuacacaaaaauaaugcuguauuugaggaacauauguauaaguagaauguauuccaaaagggcauuaaggcugggaggagauaaauggaaguauacugauguaagacucuuauacuauacaugaagugguauaauaucacugugauaagugauaagacugugagaaauugaaauguauacuuugaaccucaaagcagugaagaaaauagcaaaacaaagaauuuacagcugauaagccaacaaaggcaauaaaaauuaaucauuaaaaaauacgcaauccagaagaaggaaguaaaaaaaaaagaagaacaaaggagaaacaaaaccaagugguagauuuaaaccuaucuaucuuagauguaaauguggaaaaacuaaaguuaaaagacagauugacagauuggauuuaaaaaguacaagccuacuauaugcugucuaccagaaaugcaccuuagauauaaagacacaaguagguuaaaaguaaugggguggaacaagauauaccgugcuuauaccacagaaaguugaaguaccuguauuaguaucagauaaaguaaguuacagaacaaagaauauuucuagugcuaaagaagguuauuucauaaucauaaaaaaagucaguucaucaaaaggauguguuuauugaccuaauagaguuuuaaaauacacaagcaaaaauugacaagaacuacaaggagaaauccucaauuaaagcaaaagauguuaauauaccucuuuugauauuuaauagaauaaguagacaaaaaaauuaguaugaccacagauuugaacaauaauaucaaccaaucugaccugauugacauuuuacaaauauucuaccaaacaguagcagaauacauguucuuuucaaaugcagauggaacauuuacaaagaagggugcauauuccgagccauaaauaaagucucaagaaacacaaaaggggccgggcacgguggcucacaccuguaaucucagcacuuugcugaggugagcagaucacuuaaguccaggagauccagaccagccugggcagcauggcaaaaccccaucucuacaaaaaguacaaaaaauuagcugggcaugguggcaggugccucuagucccagcuacuugggaugcugaggugggagaaucucuugagcccaggaagcagagguuacggugaguugagaucacaucacuacacuccagccuaggcaacagagcaagacccugucucaaaaaaaagaaaaaagcaacguaaaaggauuucaguuauacaaaguauguucucuggccucgauggaauuaaguuggaaauugaugccaagaagaucucugaaaaguccccaaauaugugggaaauaauaacauucaucuaaauaacucacaagacaaaggagaaaucaaaagugaaauuagaaauuauuuuuaaaugaauggaaauaaaaacaacaugagaauuucuggggaaauucuuaauuaaagcagaaugauacuuaggggaaauuuauaucacuaaugccuauauauuagaaaagaagaaaaaucucaaaucauugaccucggcuuuccccuuuaagaaacuaggaaaagaagggggaauuaaacucuaagcagaagaaagaaaaugauaaagguugagcagaaaucaauaaaauucuaagcaaacgugauagagaaauaaaccauaaacuggaucuuugggaagauugaaguuuuuugagaaaacaaaccauaaacuggcucuuugagaagaaaccuguagcaagauuaauauggaaaggaaaagacauaauacaaaugaccaaucucaggaauuagagagguaacaucguaacagagucuacaaauacuaaaaauaucacaagggaauaauauaaacaacuuuaugcuuauaaauuuaacaacuuagaucaaauggacaaauuuauugaaagacgcaaacuaccaaaauuuacucaaggagcaauagagaacccaaauauacucuagauagcuauaaaaaaaaauugaauuuguagcuaaaaaccuucccacaaagagaacuccaggucuggauggcuuuuucacugugaauucuauuaagcacuucaggaagaaauaauaaucuuaagcaaacuuuucuagaaaaucgaaaaggaggaaacacuuacaacucauucuauaaggucagcauuauccugauaccaaaaccaaacaaagacauuauaagaaaagaaaacuacucaucaguauauucauaaacauagauagaaauguucugaacaaaauuuuauaagucaaauucaacaauauauuaaaaaguuaauacgucaugaauaauucugguuuaucccggcauucagggcugguuuaauauucugaagucagucauuguaacuuauguuaacaagcuaaaaauggaaaaaacauaccaucauaucaguagauacagaaaaagcuuuugacaaaauccauuaucuagcccugauuuuaauuaaaaaaaaaaaaaaaaaaaaaggccuugcagcaaaguaguaauacaagggaacuuucucagaaagcagaucggugguuuccugggcauagaaugauagggaaggcaacaagggaggaacuacaaugaaauacaaggaagcuuuuaggggugauagauauauucauuuucuuguuuuauguuggugaaacaugucaaacugaugaaauuauaugcuuuacauauaugcaguuuguuguauaucaauuauauuuuuaaaaagcuguuuaaaacaaaaauuaugaugacuuggugaauguuuugauaugggguagauaaaauaaauggugcagucagauaugauaccaaguuuucuguauugggugauuagacugugguauguggaauauauaagaaguugguuuugugagacagaugauuaauucaauguugguuauguugaguauagguaguucaacaugcaguaaaaguaaguaucuauauaaagacuuauacacaaauguucauugagcuuuauuugugaaaaacaaggacuagcuaaaacucaaauguccaucaggugaauagguaaacuaacuucuggaagagauugggacuagaguuacagauuuacaaaucagcuuauacaugguagagaaaaacaugacagaaagugagauuaguaggaagugugaauacaaugagaaaauaaauggcuugaaaauggagucuuggggaauaaccuuuuaggguuauacuggggaaguggagcccacaaagacaaaugaaaaagaauggucagaaaaguauggguggaagguagaggggagaccagaacuuuguaucacagaagcugaguaaguagaaaguaucagauacaaacaagucuaggaaaagaaucacuuaugguauauaugugacuugacauuugggaaguuauacugaugaacuuaucaaggauaguauagugaaauaguaaaaaaugaaaacuagaugcagugguuugagaaaugagaugugagauaguggcaacagaaauuggauuagaagagaagcagagagauaagaugguagugguauagagaggaugucuuuaagauuaggagguugaagagcaucuaaaagcauuuaaacuacuguauuacauuauagcacaaacucuuggugggauauggaguaaagaugugauaagauugggauagggauaucuguagaaggcuuucugagaugagcauauuuuuuaaucugaguuuugaauagugugaugacauugacugaugggacagggugagcauccuaggcauagggaauagcauguaagagacacaguggcacagaaguagaugucacaaagauucucacauauuuugauuggauaacuuuauaaagucuuucaacucagagauuuuuacauuuaagguauguugcugaucucuuuucucuuaacaaaauuauuuuaguaacuacuaaaguacaauuuucaaaaagcucaaacaugagucuuauacaaauauaaaauuugacugcucaaaauuuuaugcaacucauuaaugagggaacaaauaagauauuuauacagggucaaaggagaauuugaggaaaauagauuuauggaguugguuugucgaagaaauguagaaguaaauuugcugauagauuuuuaaaauuugcuaauaggaaaauaugacuuauaaagcaauguagcuucuagaauuaccuuuucuacuggacagaaaucauuuguauugcuuugaauaagagucuguuuacauugcucuuagauaagaaucuuuagcauuguuuucuaccagccaaccucuauuuuuacagaauuguaaaguauuuuaauagugaguagaaaauuaaacagagguacauacgccuagaaaaucacauaacuccuuaaggggguaaauaaaaggauacucacuaacccuuuccuuuugacuauuucuaaguuuuagauaauuuuucacaacaucaguaauacaagauggguuguuaguauaaugaaggaaauaccaaggaaagauuuuaaguuucuccuauauuaagcacaugauagaauuccuauggcauuuuugucuuuguacaucauuuaaaaauuaacuguguaccugucuugauuucacuuuuaucauugccuugaagcuuuuaaauuauuuauuguuuaguauuuugcacauuuauauuucauccuugauuugauugcaggcuucucuaaggagaaggccuuuggcuacuuuguauucucuauuguaccuagcacacauggcaccuugcacacaguaggaauucaauaaauauuaagugacugaauaugauaucuucuuggaaccaacauauauuugaaaaagugguuauauucuuggaucaggacacaguccggcaucaaguuacugaaucuuauauuuuagauuuguugugauaccuguacaucaauuaguaaugguacuuuuuuuuuuauuuuguucuauuaguggugauuuacucagaauaggaagaaaagcccuguauucaauuuuagaugaaguuauuuucaagcuuuuuucaacuccuaguccaguuauaagaaguacugcuacaaaacuccuacuguugauggcugaaucccaucaggaaauuuugauuuuacugagacaaaguaccugcuacaaagguaguacauucauucuuucuuuucuugggauucucaaaaagaaaauuuuuauugaugguuuaugaaaaacaaaauucuuauauuuuaaagaguugauaacugaccuauguagauaaaacucacaacagauaccaauucagaaaaaaaaaagucuuuauauaaucaagcuaucuucaugucacuacagauagcauguggaagauacuuuucugaucagguugccauaaauauuuacucccucucugacaaaaagguuuuguguguugaauauaccauauaguauaguaaaauaaugaccaaaaagaucagugaccuuaucaagaccagcuuuaguggagaaaauggagcugugcuugagaggccaguggcccuuaugguauuuugaacuaucaauaauuacuuaacacugccuuuccucaaaaacaaacaaaaaaaauugccuuaccuccaaaaucaaauacauaugugaauuaaaagucagaaauuuugaggauaaaaggaguaagcguauauacauucucauauaauagcuuucauuuaauugagcauuuacugugugucaggcacauuccauauacuuuauaugcauuaaaauguuuaaucuuuacaacaauccuaugggauagauauucuuauccuuauuuuauagauauagaaacagagacaugguaauuugcccaagaucacaaagguaguauauauauuguuuaauugccaagcaaaguuauauguuaucuuuguuuuauuucuuugcugaccagagccauguauguauuauaaucuauuuuucuuauucagcguggucaggaaaugggauucuaguucauuaaauauacuuauuaacauaggguuauacuguaugggaauuuuuaaagguuagaauauaauaugaugcauuuaauaccuaaacaacuagaaaggucuuuaucauucuugaugauuuugaagacauuguaauaauguaccuugaauuagucauuacugaggguauuguaggaauagagaaggaaaguaccaguaauagagcucuuuaguugauauugugccagauagacauuuuucaauucuguaauucaauuccuaaagaaaugugaauguccaacagagucguuauaaaggaauuuuaccugaauccuucucccuuucuuugacuuauaucucaauagcagaacuuauucagauuccugaagauauuuuacaauuauuaauacugcugagaacuuggguguugaagagaguauaaggcauuaaaagauccauauagugguuuccccaauuauacacuacaaggcaauuuuaccuuauguauuuauuuugaauacacacauuauaauacaucauuucaguguacccuggaaacaguacuuacuuuguaccuuucacuacuacuauguauuauuuuggcaugaaaauguacuauccuaguguuguagcacuucaccuauaauguuuucccaggaaccuauugauuugccccaaauuauauauguuaccauauguuuauauuuaauaaucuuuuucaacuaauaaugacuaauaauaaucugcauaagugcuuccacagggcaagcauuuacugaauaugugucuguaguaauuuaucuuuaaaaugucuccauuuaaguauuuuuguucaaauaaaaaaaauuuaucucuacuuuuugauuuaccacagugauuccaucccacuccuuuuuuuuuuuuuuuauuaaagagauugucuagacagauuuuuuuuuuuuuaucagauaccacaauugagcacguaagaauucucaggagggaggaauaucuuaaagauuucaaccuggaauucucugagaaaaggaaaaagaaaaaucauaugauuaaucuuguuuucauuuguuuuuaagccagacuuuuuagcuucaaauuaauacugauuagauaacaaaaucauauuuuauuauuauaauaauaguuguaccuuuugcuauuccauuucaggacucagacgucuacuaaguaaacaggaaacugggacugaauucagucaagaacuuagacagcuuguuggccuuuuaagcccaauggucuaucaggaaguagaagagcagguauuaaguuacaaaaaaaaaaaauugcaugauauuugcugacuauauuaaaccuuaguuuuccuuaaauguuccucacuuucuuucucuuaagauuucaagcaaaauacccccaaaacagaaauaucuuuaaauuuuuuacucaggagguugaggcaggaggauugcuugaguccaggaauuggagacugcccuaugaucacacccaugaguagccacugcaccccagccuggucaaaauagcaaaaccccaucuuuaaaauauaauguuacaaaauuguaucucuccgccauucaaucugcuggaaaacauaauuucaaucucccauuuacaucuguuuauaaauacugccacaucaguuucauucaucauuucucaugaaagccccaucucugauguuuaucuucuuuuaucuauaagcuauuuaaacuuuuaaaacuguuuuuccaaaaaaaaucucuaauuguagcaaacuguauuuaugguuaccuauggcuacccuucuuguucuuugagauacaacaauaaugccuuuuccuuuguguaagaaaugguauuaauaaaauuauuuagaaauuugaggcagcaaguuauugauuauuucaucauacuuccucuagcauacucaaaaugauggcucuaaauagcccauucaacaggaagaggcauauugcuuucugauuuccagauaaagacuuaaauauggaaaacaucuaaaaugacuaaagauauuuuuuaauuuaaaaggaaaaggggacauuguauauccaaaauccaaaaccaaaaagacaauaaauuuaaaaauacaagcagaaaccaugaaaauaaguccaguaaggcaggagaauggguugggggaggcuggaaggaagagugcagaagaagggaauuccuuuuuucuguauauaugaaccaucgugaguuuagauuaaucucaaaacuaugcauaugcucaaauucauauugauuagguaacaaaaucauaaaacuauauuuuauuauuaauaguuguacccuuugccauuccauuugaggacucagaagucuauuaaguaaacaggagacugggacagaauucagucaagaacucagacagcucacugaccuuuuaagcccaauggucuaucaggagaauagcauaucaaaagcuuacagaacuaaacagagauucgagcaaccauccacaauggucaacagagcuuauaguuugaaccuaacuagguugauugccuauuaaguaaaaacauuaacauguuagcucaaaaaagauuaugaaaggucaggcggacuaugaaaucuuugaaaaggaaauggaagugagauuauucugggagaauuuggagcuaacuagacuauaucuugaguauguucuagaaauugccuuaccaagccuaacauaccuccuuugggagguaagguuuaauauucuuacccaucuuguuagagcuagagauuaauauuugcccuaaccugauacuuuaagagguaaacuuuuuuuuuuuuuuaaagaccuuccuagagauaucucuaaauuauuuucggcauuucagaaacuacaucaagcagcaugcuugauucaagccuauuggaaggguuuucagacaagaaagagauuaaagaagcuuccaucugcugugauugcuuugcagaggaguuucagguaaaaaaauuuggugaggggauugaugaucauagaaucuuacuagaguacaguugaauugaaauuuaggugauuuuuuuuuaauuuccuaguauguuucuuguuaucuuuucauuuuuuuuccauacguuucuggguaccaacacuccaguaaccagaugcacuuucaaagcaaaggauguaagacaggaaucugaugugucaaauaugcaauccuauccacuuaauaagauauuuggggaggggccaagccuacaaagggagccaaugauaguuauauuauuaaacccucuaaaccaacaguuaucauaauuucguguguauaauuauaacaauaacauguaugcguauaagaguuuaagucuguuaaccugauuuuccugaauaaauauggcauggauggauaucuucauugaauuaugauauaguucggcauuuauuucaaguagacugaaaaggaaauacugaagacauagcccacuuucugcaaugacuuaaccaauccagauccuccaaggucacagaacaagaaaaaauaacuuagcuucuagguaauuuaugguaaagaagaucuguuucagaggugacuuuuucaugcagccuaacuuaaagccaagcuuuaguuugcuaaaaugaaacuggcauuuuacagaaguuaauucuuuaaagaaaacugaaacuauucuuuuaauaacugcagaugcauuucucaguuauaaaaacauuuaaaaauagcucugggguucaaaauacuauguagucacagaguugaagacauugaaaucacucuagcuaacugugucucuuaguggguauccuauuaauugaugaacguuuucuucagggaagaauuaaagauggauuuuaaauauuauugggcaugaauauuguugguagcaaagaaaagaauuaauuuuuaaauauauaucaaaugccuaguauaugauauauguacuaggcauuuaacagauucgaguuuguaucucacuugagcagcuuacugguugagugaacuuggacaaucccccaccucucucagccucaaacuuccaaucuauaaaaugagaauaauaguuuauacacuuguaugaucaagauaauguaaaauuugagauaauacaaaguuuuuagcauauuaucuggcacuuaaaaaaugauagaaggaaaaaugcauauggcacauuuucuguccuugaaaauuuacaaaucuagguaaacaaauagaugcauuaaauagguaguacuaaugagaagcaaguauuauccaucuauuauuacucaaaguuuauugccuaucuuacaagcuguuuuuuuuuuaaaagcauuucugugguuagauaaauuugggaaauauugaguacuuuuugagucacaguguauauuuuucuacccaaagcaucugaggugcucuugguauugccucuguggugaauucagauagaguagguauuacuuauggauuccaccugcuaucauccuuaguuaccugucaucuuaaauuuaaggguacccuuauacauggauucagagcauuaauguuuagucccacaagaguucccaaauuugcucauauacucucucuuucaauauuaaaaucucuauuuaaaaguagcccaggauuacagauuuuuuucuacuuagaaguguaucuauggaaucuaauauuccauuauuuuaaaauagaaauuccauugcuuucuuuauguaaccagaagaguuauaaauacuuccauuaaaaagauaagcugugaagcaaaaauuauuuaagucucacauuuuguguuuguugccuuuccaguauuuuugcauuugagguuccagaauauacugaaaugcgguucuaaccuguuggauucuauuuaauuuuuuaauuuucaguuuucuccaguucagcaccuucgcucuucuauuaguuguaacaguucaugcaaaugucucuugcuuccuuuguagcuugguuuuuuuucaaagguuauuucugucuuuuugugcucaggacuuaucucaguaauuuccccuucccaugguuuugggagagagacugcccacuggucacacuuauggguccagguugauuaguguucuuuagauucagcaagaggcauucuuuuauagucacgcccuugcuaaugcacuuucauagugguuucuuuuuuauuuagucauuucucguauucagaaacuuugucucuuaaguacucuuauucagcaagguuuucugaagcggcuaacagcugcucuaguuaucuuagagaaaccucacaauuuaccuaccucuaucauagugcugauuuuuaaguguuuuaauuacauuuguugauuucaucuugaaacugagcuucuuaaaugcagauagcaucuuuuuucucucucucccucugaggcacagugucuuggcagcagaaaauuuggucaacucccacuuuaaugguaaaaauucagauugauuaaauguaaaucauggaauuuacuuauuucagaauaugacaucugaucagucauuucaucuucagaaguguaguacagaugccaggugguccagugccuacuaauucuuacaaagaaaccaguuggaagaauaauuguuugauuuuugagugauuagagaaacucugaacaaaauaacucgauguuauuuaauaauaaaugggggaauuacauucaaaaucacuucaguuccuaauaaauguuuucagauaugaaaguaaaacauaugaauccaauaagcacaccuguuuacaauuuagucccuauuuaaaucaccaaaucucacuuuuuuuuuuuuuuuuuuuuuugagacggagucuugcucuguggcccaggcgggagugcaguggcgcaaucucggcucacugcaagcuccgccucccggguucacaccauucuccugccucagccucccgaguagcugggacuacaggcgcccgccaucacgcccggcuaauuuuuuuguuauuuuuuaguagagacgggguuucaccguguuagccaggauggucucgaucuccugaccucgugauccacccgccucggccucccaaagugcugggauuacaagcgugagccaccgcgcccggcccaaaucucacuuuuguccugucuuucugguuuguacuuuacuuccaccuucaugcuccauagucuuuucauuuuugccauauuugauagccuacaugccuaaauuguuucccaaacccaguuuucugacagauuaaauauucuagcagaugcaauuuuaaugauuacuauguuuuucauacuaauaguguaaaaugguauuuaaaauauugauaaugcaguauuagacauuauaaucuauagccaauuagaaguuagaaacagagguaguuuuuugucguuguuguuguuuugaggcggagucucacucugucacucaggcuagagugcaguggcacgaucuuggcucacugcaaccuccaccucccagguucaagcuccugccucagccucccaaguagcugggacuacaagugcacaccaucacacccagcuaauuuuuguauuuuuaguagaaaugggguuucgcuauguuggccaggcuggucucaaacuccugaccucaggugauccacccaccuuggccucccaaagugcugggauuacaggcgugaaccaccgcgcccggccacagagguaguuuuuuaaaaaucaguuuaaaaggaggcucuguuuagggccugcucucuuuuacccucuaugaauggguaagagauaaaacauuauuaucugcaugcuguauaacccagaaguuuugaggugauggaguucuguagaacaggcaaguugcuaucagcuauucuuugggaagggagaggcccuuaccuacuucauuuccagcuuucacaaagagcaagagacacuuagaacuauucaacuagcccuagaucuucucuggaaucuuuugacacacauacacuuuugaggucuucucuacccuugauaauagggauaagaaagaaguuucaaaacaaauaaauucucuacucugcccuaaguagaaagcuagagaaaauuuaaguuguaauugauggaagaauuuaugagaaacaaccacaggcacacaaaauuuuaucaaaaucaaaauaaacuauuuugaguugaaaauucaguugaaaaaucauaauaauccuaacuauacuauaaugaagucugacuauuaagaguacaaagcuauagccaagguaccacauuuguuuacaguuuaauucuaagaauacaguuuaaaaaaaagaucuaagagaaaauguucuugagggagacacaugucaaauuaagucuauagcgguaaacuaaguaguuuauucugccuuucuucuuauccucguuuucuuuuucugugggugucugaaagcauuuugaguauauuuacuguaaacugacacuuguagucuccuuacauagugauauuggaagcaacaaaaacuagaugggaauggcuaaggagaaauuuuggugaauaaaagcagauaauacagaaauuauaauuauauaaaauguuuguggucacaugaaaauuuucauaaccaguuaugaaaguaauguucaguugucaauaauugagaaauaggcauaagaagaaaauaaagaucaacuguaauuacaucaugcaguaaaaaucacuugaaauuuuaauguuuuuuauuuuuuuuuuguguaaguaaauguaaguuuuuugacacaauuuugaugucauucuucuauauccugauuuuccuuuuaccugacauuagaucaucaguauauucucaugucacuaaauauucuucgaacauuuuauguuuucauaguucauagaaucccaucccaucaggugaaugaaccaguaucuguuuauccaacucgcuguugugagacaaaguuuguuuucaacuuguuacuguuguaauacuguggagaacauuuuugaacauaaauuuuuacauauauaucugauuauuuccuuaagaaaauuauuuguaauagaauuaauuggucaucacuuuuaaggcuuuuuauuuauauauuucaaauauuuuuccagacuuuuaaugcauauauucaaauauuucuacagaaagauugcacaacagcagcagaugacaagcuauuuuaucauaccuuauuaacacuagaaauuaucuuaaaauuuuuucuguuuacauuuauuugauuacuagugagguuaugcauuuuuucauaugauuuaugaaaauuauguauaacacacuguuuccaucacagauccaaacgaucaaagauguugcuggagauaaauaggcagaaggaagaagaggaccucaaauuacaauugcaacuucaaagacagagagccaugagacuuucccgagaauugcagcugaguaugcucgaaauaguucauccaggugaguggcaguaucaacuuuaucaauauaagaauauuuagguuaucuuuuaacaaaccaacuuuucuagcuacgugaugauuuuuuuuuaaauuuggacuuuuguccuuuuucucuguuuuucagauaaacuuuauuagaucuucugaguucaaaaacgguuacuguuuuuucaauucagaccuauuaguugacgaugaacaaucuccccaccaguuuuuuuucuuauccuucagauaauuuagugaaacauaaaaauguaugcauaaagauagcuguuagagacacaaagauacuucuugaacugaaacaaggaguuggaauauuauuacauucugccaucagaguuuaacucauuccuuaguacaaauguugugacaucuucuugccgccuuugacagacuaagcugaaauuaauaagaagauguggucugagaggucuuagugguuucaauauuaucuucaaauuauuuuaccugucuucuuguuauucaauccaggguccuucacuagcccuuuauuucacuucaucuccauuaaauauagauguuuucuaggguuccauccucaccuuauuccugucauuuuucucuuccugggguauccauccauaacugcagcucaacucucagcugagugcugagcagucucaaaucuggucuccaucuucaccuacucuccuaagcucuuagagcaaaauugcccaagauaaauuuuuacaaaaaugaaagguuguauaucuguaccauccaguaggguagccaguggcuagagauggcuauugaguauuugaaauauggcuagugcacugaaggaccugaauuuuaauuuuacuuuauuuuaacccaaguagccacuuguggauaguuucuacucuauugaauaacacaccucuguagccaacugccuauuggauccagcuuuaccuggauauccacaggcaucccaaacaccaaagucauuaucuuaccccucagauuuccuuuuccuuuauuccccaucucagguaauggcaccaacaacuuacucaguuucccauuugagacauccuagaguccuuucccucuuuuaccuccguauccaguugaucauuaaauuauaucaguuucuuauacuuccccaaauacgccccccuuuuuauuaacaauucuacugccuuauucugucacauauauacugugaacccugggcuguaugcugagcaacuccaagaaagcaaaaagaaagucaucuguauaacugacugagugacuuaagagaaauuuggaagcauguagaguagagaacacauacacacauuuugcccuuucccucuggugguacugaaugacuucuuaaucauguacuuaggaauuuuuuuuuuuuuuuuuaguguucuuuguauuggauuuucagccauuuucuuauuacucuaccacaaaaauauuauaugaguucuuucugugaagaagcugcauaaucugggaaagcuuuguuucuaaaaucuuagaaccaugguaaaauaguagaauugggaaaauuagugaacaauauugacaaaaauaaaaagaaugcaagauuauuauuaucauuguccugauuccagaacuuaagaaagcauggcagugaguauguuguaauagugucuaucaucuuuuuaggucagguggagaaacacuaucgggaaauggaagagaaaucagcacugauuauccagaaacauuggagaggguacagggaaaggaaaaauuuucaccaacagaggcagucucucauagaguauaaagcagcugucacacuucaaagagcagugagucuaauguagugaaaagagcucugaaucaagaggcaaaaacaugaguucaaaacugacuuugcuaauuaccuguuguaaagccuuggucaagacacuuaguuuucuugagccuuaguuuuuucuuuuguaaaagaaaaaccccuuaccucuggccgagcugauuuagacacucaguccuuaguacugccuuagaaccuuguacaucauuuacuauacugcaauguuguuuuguuaauuauuucccuucuuacuugggcugugaguucuucaagaauaaggagcuaagucuuauuguugucagcucaucacaugugcuugauguaugaauagauguuuacccuuacccuuuucacucaguuguuauguggaucagauacccuaauuuaugggaauguauuuuguaaauuacaaaguucugugcaagugcagcaugugauauuugauuuuuuuaaugcacagaugagauauuagguauauuuagaucauuauaacauuuuaauuguagaauuguauuuuuuuuuuuuuuuugagacggauucuugcucuguugcaaggcugaagugcaauggcacgaucuuggcucacuacaaccuccgccucccagguucaagcaauucuccugccucagccucccgaguagcugggacuacaggcaugcaccaccacacccaucuaauguuuguauuuuuaauagagacgggguuucaccauauuggccaggauggucucgaucucuagaccucgugaucugcccaccucggccuccgaaagugcugggauuacaggcgugagccaccgcucccggccucuuauucuuaaauagcaaucuuucugugaucucucuagagcauaguacuauuuuguugccuuggaaaagcauaguacgaggugguuuuuuaaauuuaaugaccaguuuuccuaacaucccguuguucucuuauacaugguuaacuuucauauuaggauuucagguccuauagcauuuagcuuaacaauccuuacugaauuuuuaggucaauuucaguuuucuacugugacagauuuugaacagucucugugauuaacuuuuuacaaaguuuuuuuuuuuuaaucauccaaaaaacauuguagaauaaauacuagagaaacaggaagagaugccugucuccuacuccuucuucaggcucuucuggggaucucagauugugucugcaacaaacaauccugcaccaucacuguaucacacguacuccugauuuuuacuuucugcuaaacaaagccaucuaagggguuaaccaguugauauuaggguuggagacacuuccuuuggaggaagcuuuggcuucuuucuaauacuuuuaccucauaaauaccuccuuuuuaaagucuucccugucauagaaauagcuggguccuuauuagguugacuuacuaccuugccugauuuagaugaccccaauacuuuguaaaaguauccuguacuguaaagugaaauauccugguuugccuaccauuucuuagagaaaaaaguaggggucaucauaggaacauaucugaaggcuacgaaggcaaaguuguuuuggcuuuuauacuuuccauuggcacgaaaggaagauuagucacauuugccucauaucuccucuagcuaagaaaaggaaugagucucuguuuaagagcaaaaagggaugggucaaggucauguuuauagucuuugcaucucauuaauaaaaauaagaugaagucaaagcaaaguuagccaaaauggaaaaggaaauaagaggauuacuuuuuuuuuuuuuuaagagacauggucucacucugucacccaggcuggaguacagugguguguucauaguucaucacagccuugaacuccugggcuaaagugauccuccugccucagccucccuaagugcugagauuauaggcaugaaccaccaugccuggccaagaauuacuuucaaagaaggaaaagagaaagaaaaaugggaaaguacacugagaaaauaaauagaaaaauagagaaaauuaaaacaaggcaauagucaauaaaggguacauuuugccauauuuuuaaagcauccuuuucuuuucuuuucuuuucuuuucuuuucuuuucuuuucuuuugagacagaaucucucucugucucccaggcuggagugcaguggugcaaucauaccccacuggagccuuuaucugcgaggcucaagagauccucccaccucagccuccacaguagcugggacuacaggcuugcaccaccaggcccagcuaauuuuuuuuuuuuuucaguagagacuaagucucacuguguucuccaggguggucuccaacuccugagcucaagugauccucccaccucacccucccaaagugcuggaauuacagaugugagccacugcgccuagccuaaaaguauccuuuucuaagacacacuagagaucugcacuguucaauaaaauaaucguuaagcauacguagcuggcuauggagaacuugacauguagcuaguccaaauugaaauguguuguaaguguaaaauacccaccagauuuugaaaauguagcaugaaaaagaaguguaaaguaucucaguaauacuuuuuuauauugauuacaugaugaaauacuaauauuuuguguauauuguuguauguuuuauauaacugaguaaauauuguuucgcccauuuuuuauuuucuuaaugugacuacuagaaaauuuaaaauuacauauaugacucaccuuacauuucuguuggcacugcaacugaucuugcuaagaaaaaaaugggaaauaauucauuagccucauugaaaguaauauaccagccugggcaaugucgcaaaaccucaucucuacuaaaaauacaaaaauuagccaggcgugguagcauguacugguagucccagcuacucugaaaacugaagugggggaaaaucaccugagccugggaaguugaggcugcagugagcugugaucacaccacugcacucuagccuggguaauaggaauaagacccugccucaaaaaaaaaaaaaaguaauauaaaggaguaggaauauccuuucaaugagugugucccucaggaagaacugguuauuaguguccuuggcaggaaaagaaaggccagaacaguuauccaccuucuguuucucucuuacuugaugcaaaaacagaggcauuguuucuccaggagcuaaaaauuggggaaauuugcuaaaagagaaaaaucaaggaaaggggagaauagaaagaaagaagagagucucaacagaaggaugcaagcacaguugaaaacucaaguaccauacugaaaacaaggccgggcacggugacucaugcuuguaaaucccagcacuuugggaggcugaggcgggaggaucacuugagcucaggaguuugagaccagcuuaggacacauaauaagacucuuucucuauaaaaaauuagcugggcuugguggcacauaccuguagucccggcuacucgggaggcugaagugggaagaucacuugagcccaggagguugaggcugcagugagccauaaucaagccacugcacuccagccagggugacagagugagacccugucuuagaaaaaauaccaaaaaguaagaguacuagggaaauuuucuaaaccgcuucuuagugcccacucuuaaauaucagcugaaagauaaguaucacugaauaucuaaggaaagccaaagacaaaacaaauggaauaaaacuauuugauagaauacaaacauugcagguauaaggaaaaaauuuuuuuaaucuguuauuaauauccucagagagauaaggaaagguaauauaugaaacaaaaccaagauaccguauaaaauggagcacacagaauaaaauuugacagggaaaacugaaagacuaauaaaaggacugugggggaaaaguuaaagaaaucucacagaaagcaaggaaaaaagauuuugccaguggcacacaccuguaaucccagcuacucagaaggcuaaggcagcaggauggcauuagcucaggaguucuaggccagccuggucaacauaugaaauaucauuagaaaaagaaaaaaagguagaaucuuuaauuaaaaaaaaaaaagauggauagaaaagacuaccagucuaggaggucaaacagccaaacauuugaaaucaagaacaagaaaaaacagaagauggaaaaucaaauaacuuaagauuuccaagaagugaaugucaugaauuuuagauuaaggggaccaauuaaguguccaauacagugacagaaacacuucuacauuuguuucauaauacuguaagauauacuaggaacaaaaggacuucuugacaggaacauuggaagcuaaaaaguauugaaguaagauugucacauauuugaaggaaaaugauuuccaacuagaauucuauacccaaccaaauuauuaauuaaagauaaggacagaccaaagacauuuuuagauaagagggaauaaccugagaaggaaggcaacauggaauccaagaaacacaagggaaagaugaaaaguagucaccgagaugauggugaauggagaccacaggaugacagcuaugcccaagguauagagagcagucaauccaaauuacagcaggucaggaagcucgagaaaauguguccaagaaaaugaauuugauagaauggcugcuguauuuuaauguguagaaaauuagggcagaguuuguaaaauauaaucgguaguauggaaaacaaagcaugggagaaaagagaauuaauaauuccagagaaaauaaaaaugugcaaggaaggaaaaguaauuauaguguacuauauuguucaaaagugaauagccuuuauguggucauaauuuuguaaacauugaacauuaauuuaacuaaaauuaugauguaauaauauaggauggauggggaguagaaacagugaaagauagcuaaauucauaccuuucauacaagaaaaucaauagaugauaccuauaucugaaaaaaaaaucacagaaaaauagauggagcuaaauaucaaaagaauaaccugaauuaaauuguugcccuugaaucaggggacaggguaaguggguaacucuaguaagaauucuaguaauucuuaugaaacugacaaauuaaacaaucgcauucuaguaauucuuacaaaacugacacauuaaacaauagaguuacaucagcaaacuuuucagggaagggcuauauaauaaaauauuuuaggcuuugcaggucauguagugugucacauguauucaguuauagcacaaaagcagccgaugagcauggcugucuuccaauaaaauguuauuuguagaggugggacgcgauggcucacgucuguaaucccagcucuuugggaggccgaggcgggcagaucacaaggucaagagaucacagccuggcuaacauggugaaaucccaucucuacuaaaaaauacaaaaauuagcugggcgugguggugcaugccuguaaucccagcuacucagggggcugaggcaggggaauugcuugaaccuggcgggguggagguugcagugagcugggauugugccacugcacuccagccuggugacagagcgagacuccaucucaaaaaaaaaaaaauguuauuuguaaacauuagauuuugaaucucauauaauuuuacaugccacuaaauauucuuuuauaauuuuacgugccacuaaauauucuuuucccuuuaaauuaacaauguaaaaugaaaaacaaaacaaaacaaaaaaaacaaaaacaaaaucacacacacauuuuuagcucucaagcccuaugaaaacaggcagcaggcuggauuuggccugugggccaugauuugcugaccccugcuuuaaacaaugugaacauguaacuuugaugaaaauaaaaacuacgaagacaugagcagagugaaaacaauuggaaagaauaauugcaaauuugucccauauaaugccuauuacaaaauuucuuuuuaccagaguccauucugaaggacaugagaaggaauucagacagaaauauacugucuccuugguguuuacaaucaucuaggcuguguagaauuaagaacccuuuuuucuauagacauagaaccuguccucuagagaucaagugccuugcccagaaucauaguuuauaagggacuagaauugagacuagaaucuauugcuuuuuuuuccucuucauugcuuacugcacaaauaauacgugacuauauccuuguaaaaagcacuacagaagacuguauauuuuaaaagucacuguucuccugcauuuugucacagucccauuccccuccuuauacacacucagaguuaaucauuauugcaaugugaucacuaccauauguuguagugagaaaauaguucuauuaguuaggggagaaaaaucacaaaccuucaauuuuuuuucuuccaggcgcuuaaauuccuagcgaagugccguaagaaaaagaaacuauuugcuccuuggcgaggacuccaagaacucacugaugcacgccgaguugaacugaagaaacgaguggaugacuaugucagaagacauuugguaugaagcuucuguaccauaucaguauuacauuauuccaaugcaugauauugauaacuguacacacacacacauauauuguguguguguguguguguguguguguguguacauuuauugcugguauaagguaaugcauuggcuuuaccauagaaguaaugguauaucuuuuucuaguuacauagccauagagguauagucaguagugaaggagacucugcuuuaaaucaguuuuuucccauacuaugucaauaagacuuguucauugcuucuuuugcaauaguacuguaaaacuuggacuauuuugaaccuuccagaaagaguauauguaacugucaaucaaugauuauucauucuuacauuuguuggacuacuaauguaccuccagaagccaauaagauauagcauuugacuauuugccucuuaugaucuuaccacaauaauacugcuagcaccuuuaucccaauagaaauguccauaucuuugacuuucuaugaccacaggauggcaggucaccuguuauucucuucucccaccugaauucuugaccaucuacuccuaugugucuucaaaggucauuucccuuucugccuugggaauaacucaccacuccugucauuaauuuuaaucaccugcaccuuugcugauuaccucuacuuucuuuucucuuacugcuucucccgugcuuucacacuuauguaauuuuauggagaaaguuagcaguuuauacauuucaaucuaucagaauuauucccucauuugaaccaagcacucauaguguaucuugguacuuuucacgaguuuuguugugauugugguggugguguuugugccugaguucauucucucucucucucucacacacacacacacacacauacacacacacagauacacacacagacuucuaaaauuugaagguucuggauaacugauguuagaggcuugaugugauauuuagggaguccuaucauucacccuuucauuccuccagagcauccaaaaugaaaggacuuuuuguaacaaacaaacaaaaacuacuguacaaauggaaaugaaguacaaauauauuaguagcugagcauguaucugguaaccacuggaacacagcaaugguaaaaccugaauuggauagcaaagcuuagucuaggaaguguaaauaagcccucuuacuuucugcuucugcuaaucuggauuuagggaccuaaaaccuaauggagucuguggagaaagagaggaggaaaagacuacccuucuauaucaggcccucugugauuaccauaaagagguagacaauggaaaaaguucugacauuaguuucuggccaagauggaguaacagggacuagauuuacuuccugccugaaacaaccagaaaaagaaacaagcagauaaaaugcaugaaaucguuuucaagacccuggacaucagacaacaaagaacaauaaucucugagagggaacgaagcaagcccuauaauuaccccagcuuacugucuugaaagaguuucuaggccauagcucaaggaagagaacagagaagggcucuuuagaauccuugaguuaaggagauggcacugagagucaggugacaccaagggaacuagacuucauagaacagaguaccugaguaaagagagcugcaaagagagagaaccccagauaucuacagaaucuaccccuugaguauucuccagaauacuaaucagcauguacaugugaggaaauuauccaaagccaaauuaucgagucaucugaaaagguaagacggaagugugucuggaacucacauagguccaggaauaguaucuguucccaucaaauaugcuggagaaacucauaauucacaggguauugugaagaguacucaggaagaccuucccuuaauaguagauuaugauuagccuagacggcuccauucugccaaacaaauuauaaaaucaagagucaaaaaaagauuaaaauguuuucauguaauuuaacagcaucccaaaaaaagacucaaaauuuuaagaaauaucaaaauauccagcacccaacaagguaaaagucacaaugucuagcagcuaaucaaauauuaaaggcaugcauggaaguaggaaaacaggacccauaaugaggaggauauucagucaaaccaacccagaaauuacauagauguuaaaauuggcagagaagggcauuaaaacagucauuauaacuguauuuuauauguucaaaaagucaaguagaaagaugaaaaauguaaaaaaaaauaccugaaucaaacuccuagagauaaaaacuucaaaguauggugugaaaaauauacuugaucaaaauaauagcagauuagacuuugcuggauggaagauuaauauaggugaagccauacuaguagauacuguacaaaaugagucacagagaggggaaaaaagagaaaaauauuugaaaagaccauuacugagcugugggacuguaaguggcccaguaaaugaaaacuuggaaucccugaaggagauguagagaaaaauaauggcugaaaacuuuccaaacuaaaaaugauaagcccauacccaaaccaguuaagguacauggaaaaaacugugccaaggaauaucauaaucaaaauugucaaaccagugauacagugaaaaucuuaaaaacaaaaaaaaauuuuuauauauauacuuuuuauuauacuuuaaguucuaggguacaugugcacaaggugcauguuuguuacauauguauacaugugccauguugguguguaaaaaaauuuuuaaauguuacguaaagacaaagauuacauugcucaguaggaacagugcaagcaagaagauaccuuuuuuuuuuuuuuuuugagacagaguuucgcuguugucacccaggcuggagugcaguggcgcaaucucugcaacugccgccucccggguucaagugauucuccugccucagccucccagguagcuaggauuacaggcgccugccaucaugcucagcuaauuuuuguacuuuugguagagaugggguuucaccauguuuaccaggcuggucucgaacuccugaccccaggugauccacccaucucagccucccaaagugcugggauuauaggcaugagccaccacccccggcgaaagauaucuugcuuuaaaguacugaaaggaaaaaaaguugucaaccuagaauucuguaccuggcaaaaaaauauuguuaaaaaaaaaaagacuuuuucagacauacaaaagcugaaagacuugaucaccaguacacuugcacuaccaaaaauguuaaauccuuaaaguuguaaaggauuuaacauugcagaaauguuaaauucuuuuuauuuguguagauugagggaguaaaaaugcacauuuacaugccuauauugcaagcuccugcccagcaaaauaaacagucaacaguaaacagccuauagaaugggaaaaaauaguugcaagcuauacaucuaacaaagggcuaauaucuagaaucuacaaggaacucaacucaagaagaaaaagacaaccccauuaaaaagugggcaaagccagaugcuguggcucaugccuguaaucuuagcacuuuggaaugccaaggccaggaggauugcuugagcccaggaauucgagaccagcuuaggcaacauggugagaccuggucucuacaaaaaauuuaaaaauuagccaggcauguugaugccugucuguggucccagcuacuugggagacugagguggggcgaucacuugagcucaggagguugaggcugcagugaggcauguucaugcuacugcacuccagccuguguggccgagugagacccugucucaaaaaaaaaaaaaaagugggcaagaaacaugaacagacguauauacaaguggucaacaaacaaugaaaaaugcucaauaucacuaaucaucagagaaauguaacuuaaaaucauaauaaauaaucauauuauaccaguuaaaauggcuauuacuacaaagucaaaaacaacagauguuagcaaggauguggagaaaagggaacacuuacacacuguuggugugaauguaaaucagaaauguuaaguucuuuaagguguaaaagacuuaacauuucuguuuaaaaugaugccaggaaaagauaccagagagaaaucuggcucuacauaaagaaauuaagagcacuggaaaugguaauuacagccaugugucacauaaugaauuuucagucaguguuggaccauauauacaacaguggucacauaauauuguaaugguauauuuuuacuggacauuuucuacauuuauauauguuuacauauacaaaaacuuaccauugcauuaaaauugcuuacuguauucaauacaauaacaugcuguacagauuuguagccuaagagcaauaggguauaccacauagccuacauauguaguagucuauaccauuuaaguuucuguagguacacucaaugacaugugcacagugccagaaucaccuaacagcacauguauagcaaacuaauuauugacagagauauacaguuaaugcagaaaaacuggagcaauuggcuauucacaugucaaacaauugaacuugaagccauacuucacuucauaugcaaaauguaacucaaaguagaucauaggccuaaaugcaaaaccuaaaacuauaaaacuucuaaaaggaaacaauggagaaauauugugaccuuucuugaauacaauaccagaagcaugauucaaaaaggaaaauuugauauauuggcuuuauugaaauuuaaaacuucucuucauaagacaccauuaacagaauuaaagaaacaaggcacagauugggagaauaucauugccaagcauauauuugauaaagguccuauauccauaauauagaaagaacucucaaaacuaaacaguaagaaaacauaugaacuaguuguuuuguuuuuuaaauggacaaaagcuuugaacagauacuucaccaaaagauagaugacaaauaaacacaugaaaaaugcaucauuaaucacuaaggaaaaugcacauuaaaaccacaauaagggcccagcacaguggcucauaccuguaauccuaacacuuugggaggccaaggugggaggauugcuucagcccaacaguuugagaccagccuggguaacauauugagacccucucucuaauuuuuuuaauaaaaauuuaaaauuuuucaaaaaauaaccgacaguaagauacuucauaccuguuggaauuuuaaaaauggaacaugccaaagguuagcaagcauguggcagagucaccacuuaggggaauguaaaagaguacaacuacuuuggaagacaguucaacaguuucuuuaaaaauuaaacauacaucuaucauaugauucagccauucuacuccuagauauuuaccccagagaaaaagaaauauauguccauauagacacuuguacaugaaugcucauggccaaaaacuagaaccauggaguaccauucagcauguauaaaggaauaaauugauacucucaacaacauggaugaaucucuggccgggcauggugacucacgcccauaauuccagcacuuugagaggccaaggcagguggaucgcuugagcccaggaguucgaggcugcagugagcagugauggcaccacugcacucuauccugggugagagagugagacccugucuucaaaaaaaauuuuuaaagaaaaagaaaaaaaaacguggaugaaucucaaaauaauuaugcuaaaugaaagaagccagacagaguagaauacauucuuuaugauucccuuuauguaaauucuaaaaauauaaaccaaucuauaguaacauuaaauagauaaguaguugcuugggauaaguaguugguggauggguaggaugaggauaaggguuuacaaaaggaaacaaggaaacguagugaugaacuagguauguguaugucaaagcuuagcaaauuguacccuuucaauauuuguuguuuaguguauguuauuuuuacgucaauaaagcuauauuuuuuaaaagguuguuuuaaccuaaaugcuuaaaaaaaaauuuagggguccugagauuuuaaaaauaaucagccuggccaccaauaaaacauggccaaugaaucucuucuuuuuaauuauuauuauacuuuaaguucugggauacaugugcagaacaugcagguuuguuacauagguauacaugugccaugggugguuugggacccaucaaccugucaucuacauuagguuuuucuccuaaugcuaucccucccuuaguucccuaccccacgauaggccccagugugugauguuccccucccugcguccacguguucucauuguucaacuuccacuuaugguugagaacaugcaguguuugguuuucuguucuuguauuaguuugcugagaaugaugguuuccagcuucauccaugucucugcaaaggacauaaacucauccuuuuuuauggcugcauaguauuccaugguguauauggccagugaaucucuuaagugcugaucaaucauauuagcaacuccucccuuagccaaacaccagaaccgaguuggagagaggggcagaaccacaacugaaagauuuuuccugugagcagagguagaaugaagacagacagaagcaugccuccucuccaacaaacagauaaucaguuccuaagcucuguagagaggacuauauugcuuuuaacaguuuuaaucauuuacaaauuuaaucaccuuuauaaaaauuacauacccaagccccacacaccccaagaaauucugauacaguaaguuuuguguggccucauguaucuguauuuuuaaaauuuauuuauuuucagggugguaaaauagauaaaauauaaaaauuaccauuuuaacuauguuuaaauguaguuugguagcauuaaguacauucauauuguuugugcaagcuucaccaccaucccaucuucagaacuuuuuucaucuugcagaauggaaacucugcauccuuuaaacacuaacucaccauucccucacuacccagcuucuggcaaccaccauucuacuuucugucuccaugaauuugccuacucuaaguaccucaugaguagaaucauacuucauuguuucaguuaguauaaugucuucaagguucauguuuuagcauaugucggaauuuucuacuuuuaaaggcugaauaauauuccauuauauauacuacauuuuguuuauccaaggaacacuuggguuccguccacccuuuggcuauugugaauaaugcuacugugaccauguguguacaaauaucuguguguguacuugcuuucaauucuuuugggugaguauccgaaauggaaaugcuagauugugugcuaauucuuuuuaaaaauuuuuuugaggaacugccauacuguuuuccauaguggcuguaccauuuuacauuucuaccagucacacacaggguuccaguuucuguacauccuugucaacauuaguuauuuuuguuguagucauuguuuuugauagcagcuaauagauaugaaguuguaucuuaugguuugaacuugcacuuuccuaauuagugauuuugagcaucuuuucauguguuuauuggccguuucuuuaucuuuuuugcagaaaugucuguucaagucauuuguuuauuuuuuuuuccacaggguuauauuuuguucauuuuuuaaucagguuguuuuuuguagaguuuugggaguucuuuauauauuauggagauuaaucccuuagauguaugauuugcaaacauuuuaugccauucuguggacugccaguuaacuuucuugauagugaucuuuggugcaccaagguuuuuaauuuugaugaaguucauuuugucugguuuuuguuguuguuuuuuuuuuccugugcuuuggugucguaugaagaaaucaucaccaaaaccaaugucaugaugcuuuuccuguguuuucuucuaggaguuuuacaguuuuagcucuuauguuuaggucuuugaucucucuuuuucuaauacacuauauguaguucugaugcaugcuccuguuuuucuuuuuuuaaagugcuucuuuagccauacucuagugcagcuguuuaagauccuguggcugagaaguaagguuuuaguggaacagggucauauccaggauaggaacaggaauauuugagaaagcuguggugucagguucuuuaucaccuccaaaguuaagauuauuucauccuugcccaaacuaaucaguuaaguuccccuuaaauuagcugacuagccaaaagaacaugguccuuuggaugauuuugucccuuguucuguggauccagaagcaguuacaacauauggcuuggauaaguuugggagugagaaugggauaagaaguaaaacaaagaaacaaagggauuggcguuguuacaccuguuauaggccagugucuuuuuuuuuuuuuuuuuuuuuuuaaggcagagucuugcucuguugccuaggcuggagagcaauggcgcaaucucggcucauugcaaacucugccucccagguucaaguaauucucccgccucagccucccgaguagcugggauuacaggcacccaccaucaugccuggcuaauuuuuguagagauggguuuucaccguguuggccaggcuggucuugaacuccugaccucaggugauccacccaccuuggccucccagagugcugggauuacaggcgugagccaccacacccggccccaggccagugucuuuacgaaaccauuuguaauuuuucacugugaucucucaagcuuaucucuucucccauaauuccacagugucugagaaaguaaaguauaggcacauacaaaaaagaaagacaaaaaacuucuccaccauuauuuuuaucuaaaacuuuuaagagacuaauuaauacuugcauaagaguacaagauagacaucaaucauaagauucaauugauaaaaugagagacagcuaagcagucuaaaaccucugcuaagugguuggguacuuugauaccuauguccucucugugacagguuuuucuguccuguguuuccagggcucuccaaugucagauguggucaguagggagcuccaugcccaagcucaagaacgacugcaacacuacuuuaugggcagggcccuagaagagcgagcccagcagcacagagaagcucugauagcacagaucagcaccaacguugaacagcuaaugaguaugugcucauuuuacuuucguucucuaaaaggaacaaccuaugcgagguuugugacauccaaaaccuuuagaaggaaaccauuacuaagcaucuuuagcucauccccuaaccucaggaaauuucuacauagaucagaccagcacacaauguuuucaaaugaugcggauuuuauaaccaccuucuuaccuguuuccccaagccuugccaucauucauaugugucaccccaaaguuauuaauuucagaugcugagcccuacuagccaucuuuuacuaaguaaucugaaaagcuuuuggucauauuuuguaaguagaugaugacaauaguuacagugccauucacuuguagagcauuuuauaaauuuuuuuuuauuauuauuuugagacggagucuugcucuguugccaggcuggagugcaguggugugaucuuggcucacugcaaccuccgccucccacguucaagcgauucuccugccucagccuccccgaguagcugggacuacaggugcgcaccaccacgcccagcuaauuuuuguaguuuuaguagagacggaguuucaccauguuggccaggauggucucgaucucuugaccuugugaccugccuaccucggccucccaaagugcugggauuauaggcgugagccaccgugccuagccuauaauuuuuaaugaagcacuuuacaaaaaugaauucaucauaaccacugauccauuuaaugagagaucccauccaugaagccccuguguuucagucagcaucuuggauuucuuuaguauauguaaacagaaaggaccaguguuuucuauuuaauggccacuacuugguaauuuuauauucuuaaauuggauaaauggcugaaacugagccucucaucuauaggaugagguucuauuaaaguuucuauucuuuaaauaaaccaucuuggcugggugagguggcucaugccucuaaucccagcacuuugggaggccgaagugggcggaucacgaggucaggaguucgagaccagcaugaccaacauggugaaaccccaucucuacugaaaauacaaaaauuagcugggcaugguggcgggugccuguaaucccagcuacucaggaggcugaggcaggagaauugcuugaacccgggaggcggagguuguaguaagcagagaucgcgcuacugcacuccagccuaggugacagagugagacuuugucucaaaaaauaauaauauaaauaaauaagccaucuuacaaaaaucuacaucuuuuuaaauuccuuuaaacacagaaauggccgggcacgguggcucacgccuguaaucccaacauuuugggaggccgagguagguggaucaucugaggucaggaguucgagaccagccugaccaacauggugaaacgcccgucucuacuaaaaauacaaaauuagcugggcaugguggcgcacgccuguaaucccagcuacucaggaggcugagguaggagaauugcuugaacccaggaggcggagguugcagugagccgagaucgugccauggcauuccagccugggcaacaagagcaaaacucugucucaaaaaaaaacagaaaugggcugaauauguugacacauggcuguaaucccaacacuuagggaagcugaggcagaaggauugcuugaguccaggaguuugagaccagccugggcagcauagugagaucucuacaaaaaaagaaaaaacauuagcugggugugguggcauagucccagguacuuaggaagcugaggugggagaaucacuugagcccaggagguugaggcugcagugagccgugaucuugcuacugcacuccagcuuaggcaauagagcaagacccuuucucaaaaguaguacauucagaguuggaaugcuguuucugccugcagaguuacagcucuguagcuuccaaguuccuaccugcuuggcauaggacucuucugcucaucuguuuauuuucuguccacuacagaggcaccaagucugaaggaggcagaagggaaagaaccugagcucuuccuaaguagauccaggccuguggcagccaaggccaagcaggcccaucucacaacccugaagcacauacaagcacccugguggaagaagcuuggagaagaaucuggagaugagauugauguuccaaaggaugagcuuaguauagaauuagaaaauuuauucauugguggaaccaaaccaccuuagugaguaacccuaagaauugacacaaaucucauauuuuaggagauuauauugguucugccucuggcaugcugguagacuagggccauccuaacuuauuauuuuccagagguucuccuccagacaagaccugcaguaagcaaagaguuauauucuaccucucucucaauuuucuuuuucuuuucucuguauccucaucguuagccacacacagauuuguguggcuuuuauuguagaacuaaacuuagcauaguguucuguuguuuacaugaaguguguuuuucuuugguuucuucuguuuuccaacuaaauauuuuuuucuaaauaaauauuuucaacaauugauuugaaaaauuugucaggauuauuucaacuuuucacauuuguuaucugaaauuccuauuuccuguuaacauaggaggugugugcagacuuuauuaaugugaggaaaagaaaugcucaauugaaggacauuucccuguuuucuauaaagcaaugguugaacucauuuucuauuuuguuauuucuaaaaggaacugcauaccaaaaaaaugcauucuuucuauuaaacugugagaacuacau

SEQ ID NO: 192630 - RNA, 64081 nt, Homo sapiens
guuaccauagcgacgugcacgcaguagccaggccugacccgcuggucccuugcuggcgggaggaaagaggcggcaccaugagccacgcaguaaccaucgaggagccccaggcccagccgcaggugucucaaacucgguaccgggagaggucgcgggcugggagccacaucuccuccaaucgagcguaugauuuucuguacgguaaggaccgccgcagaccuuccuccgcguccgucgccuccuaggccaggugggcucccagauggugggaccuggccaggggcauggcgaacgaaacacgacccucuggacugaccucuugcccacgguuguccuuggucgggugggggcagcuccgagcccuccagguggccgcacucagguuggggucggggguucggguacaucgaaaggcgcgggugcgcuccgcuucggggggcgauuuuccugaaaccuguuccgggcguuuugguacccagaaagugugcaacgauuuguacacucggagauucacucaacguuccugcauaaaaugcccuacaaaaaugaucuuuucucuccaacucucugggcaaauccaaguugggcgaaaagaagugccaguuuaucccaugcuuguuuuuagguuuuuuguuguuguuguuguuuguuuuuuuuaacuucugcgucaaagcauugcuuauagacuggguccgcuggcuccucuugggccaauaaaaccccaguuuauuuuaacggcuugguuguccauuuuauguuuucucucucuccacgcuccuugaguuccuuaaguuccuguucuacacauuuuuguagccuucugagcaccuauucuagugcugauacauauacuaggcgcuucaauaaauaaauguuuauugaauuugccguggcaagaacuguaaccagcuauaagcaugauuuuuuccaauuuugcccucugcaaucccagguuuuucaccugaaccuugcauugcuuucagcaaugugguguugccucugggaaucccagucuccuuugugugggaaucuaggguacacauuccuagauagaggcuguguaaugauugcugacauauucuggccaguguuuuucuguauuuacucuugguuuugugaaauaaaucaaguuagcuccuguaaacacaucaccauguuuuuuuuucacggguaauuugagaaggaggacaaacaucuccccaaaguauuuauuaagcugguuguuucuuugaugccgaagugucucuuuugcagaggaauugcuaaauguuuccaugucccuugcuaagaacagaaauucacucagaguagaucaaauaaaaguuuggauuguuauaaaacaaucucgccgcuagucauggacaggaagcgaaguauagccagggcggaugagaaccuggauggggaaaaucagaacuaagaugcugugcucuccugcuuucuuucuuugaccuuaugaccuuucaccuuguuaggguugccacauuuagcaaauaaaaauacaagaggcaccguuaagcuugaauuucagauaaugaauaauauuuuaguauaaauuuuuguccugugcaauauuuuggaacacauuuauacuaaaaaauuauucauuguguaucugaauuuaaauuuaacugggcauccuguauuuuaucuggcaacucuagccuucuuucuauguauaaucaagccccaaguaaugauauuucggucaacaguggacuacauguauaaggauggucccauaagauuauaaugaaguugaaaaacuccaauuacuucgugacauuguagcugucauaacauuguagcccaaugcaucacuuuuucuguguuuagauauacaaauaccauuguguuacaacugucuacaguauucaguacaauaacaugcuguauggguuuguagccuaggagcaauaggcuauacuauauagccuagguguggaguaggcuauaccagcuagguuuauguuaaguacccucugauauuuacacaacgauaagcucaccucauaacccguuucuaagaacguauccccaucauuaagcaacacaucucuaugcuugcuuccuuccaucugacagaaagccucuuguguauggauuucucuuacuaugauagggacuaggguggcgugcuucuugacuaauuagcccuaaagcucaccaccaauuguauagcgucuuuguguauuguagcugaaaauuuaaguuagaaauuuaagauugguuguuggcuggccaaugaauugacuggccuugggccagguuuccaccuugacagaacugugguggugcaaagaugaacaccuuuccagguucuuuuacccuuccuuaugaagcccuaugugauuaguucccuaguuacuucucuggccucuuaucuacucucuuuccccuccuucauucugccucauuuguccugguuucuuugcuauucuucagacguaucaggcauguucccauccuagggacuuugcuguucuucagauguaucaggcaugcucccauccuagaauguucuucagauaucuaacuagcuaacucccucaccuucaagucuccuuacaugccaccuucucaagggccugccccgaccacccuaguuaaaauugcaacccaaucuuccuuacccgauuucuucuuuuuuaaaaauaacaacccucaaauucuaauguguaauuugcuaguuuauuauguuuguuguuuguugucucucucucaugaagucaaagauuuuugucguuuuguugauguauucuaagcaccuagauagaguagccagucaauaaacauguguugaaugaaggagcaaaaagagccugagccucuugcagcuuuucagccuuggugggaauauccaaugucugcauucaguaaaucguauuuguuggguuacuaaugaauuauuagguuuuaggaauugacacacauuauccaaauucaaaagagacuuguuucuaaaucacaauucccaaauuauuaauuucuauggagaaauauguguuaccauguuaucuagacuagcuggucaggguauuugccuccccagagacaagucuacuugggaaaucaaguguauccaaaggcugcuuguuaauuuaauggcaaaucaguugauuuuaaagggugguacaguauagucaaucaugaauauucuucaucacuuuaaagauauaccugauaaacagauacuuauaauagcagggcaauauuuuguugaacuuuguaaaaauaacaguuccaucaucagcaaacuuacaaacuuaaggggugaauucugaagauagcugauuuuuuuuuuaaccguguucaccaauucugagauaucaugugguuugcaucuuucuagugcaccaaauaugggagaugguauaaauguauugcuucuuucacuugcaaauuggcauagugcguauauacaaggucuuucccuugaagaauuuuuuggguuacccaggcucaaaaggaguuuuguucauaggagagaagaaaguguguucaggguguaguacuugaaaacaugcuagacuuucuuuaugaauuccacuuccguaagcugacuuggaauacucagaaaagaaaaacaucuugacaacuguugcugguagaagugguagaguaacagggccacaugcacaacagagcaugagcugcugcagagucagacaauauuuaaacuuuuaaauuuguuuuccaauuaagagauuacauuacuuugccauuauucucagccuagggguagauauguucuaucuguuaugcuacuugauuguuuauuuugcagauccauuguuuauugugucaagugagaaagaccauacacaggcaaauauccaagcuacccugauucgcagcagacugguaugucuaauucaucagccaaggcuaccugaugaaccugaaccaucuaguuugccugacugcauugaucagauugacuaaucaccaaaucuucacuggauuuuagguuccacagaaauuaccuugccaagauuacuggagggcaaagcaucuuaauacguguggcucauugugaggauuaagucaccaauaaugaacagagaacccauaagcuaauuuauuucaaugggauaaauuuaauaauauaugcccauguuaaaagaauucaaguaguauaaaagcauauacagugugaaguaaauucuagcccuauccccuacccccuccacauaaacagccauugucaucaguuucuugggcauguauuuaaagauauuuuacgcauacagcaauaaccccucuucuuaugcuguauacauuguuuuguauguuuuuaaaaagaguuuacaauguaauuaaaaugcuuuagaaaagcugaugguauaauuuuguccuuugccucccuucucuaacauuagagaaaaguucccagguuuaaaaccauguucaguaaccugauccauuauccaagauauucucuauauuggagcaagucagauccugucccaccauuuaucagucgggaauggaagggacauaaggagaaacacagagaagcccuccggcagcucaccacguaagugucggguggcuccagggccuaaaauaaaugcauuaaaagcauuucuuuaaauucauuuaccaugugugguuuuaaaauguucaguugugguguuauaccuaggccaaauuuucuuucuaaaccucuuuugaccaaacaaaccugauuauauauuguauauaugagauauauauauauauauaauuuugucauauauauaaugacaacuugccaccaaagguagggaugauugaguuuguuguugcuuggauccaacuuagcaacugaaagugcucuguucugcuaguaucuaaaauauuuuuugggaacuuggggccaaagcaccuucaagaauaagucgaauucuuuauucuuuuaauuacuuacaaguucacauuuaguaaauuaaaaauuauaaagccuuuuaaccuggacauagaaaaagugucuuuuggccaggcacaguggcucacgccuguaaucccagcacuuugggaggccgaggcaggcggaucaugaggucaggagauugagaccauccuggcuaacacggugaaaccccgucucuacuaaaaauacaaaaaguuagccgggugugguggcaggugccuguagucccagcuacuugggaggcugaggcaggagaauggcaugaacccaggagguggagauugcaccacugcacuccagccugggugacagagcgagacucugucucaaaaaaaaaaaaaaaaaaaauugucuuuuaauauuuugcuauucuugugugcuuuuaauuaaaauugggcauuuuuguaugugggauuucauaaauccacucuuuucucagcucuugcucugucugacuagguucuggucuccuggcucaggggaagaaucauauauacucuaaguuguauggcagucaaaugcagguuauggaagacuuuacucucaguaugagauacucuguguagguccuacucuauacacauagaaauauuaaauagaaauuauauguggaaauauuuuagacuugaauaauguuuucuugcuucauuuuagaacugacgcuucuuuucagaugccuaaagaaguuuaugaagauccugaaguuacuggaaagaaucgcuauaaauacuuugaaagguagaacauaauuacuaaugaauauuugagcccuaauauuauuagagaaccucuuuaugauaauaauaauaguuaucauuuuucagugcauacaacgugccagacucuauuuuaagugcuuuacaugcauaugaucuaaucguuaaaacaggaauguaggcuaagauauauaugaucccuguuuuaccaguaaugaagcugagaccgagagaugauaaauagauugcucaaggucauauaagcuagcaagggguagaucugggguuccaacuaagccugccugacuuuagagauacugauugcaacuaagaauauguauuugaaaauauuugaaaugaagucaucaaaugaacgacacacaguuggagauaccaugaagucauagugaaggggaaacuuguguucaaagggauaacauuuguucucuuuguaugaaucuugccuaaaccaacaaggccaaaagguucauuuuauuucauuugugauuuaugcuuauguaauaaccauauacucaaaucaaauuaaaauuagauggggauuuccuuauauauccuacuggaguuagaaaaaauagucuugauaccacaucuguauaagcuuccuugagaaaguaaauuucuaauccacauuauuauuuaugagcaaccuccuuauggaaauuuugugauacugacuuuuccagagaaauguuaaauucuuaacuguuaacuauacaauucuguacaguuaacuguacaauucuuaacuuuuagggggaggcuucauauuaaaucacugugaauuccagaaugucucaggaacuugagaaguuguugggaacuaauggccagcugaagcccaaguacagggcuuaaaguguggcuucuucaagugugacuuguuucccaucugaagagaaaauacuggaguguuuauuaagaaugcacauucauuggcucuacccuauauguacugaaucucaugggccagaccugggaaucugcauuuuagacaagaaccuccccacccugcagugauuuuuuauguccagaaguuugaguaacacugauauaugggauauuuaagcucacugauuuuuaagggacaaauauuagagcuggaagagagcuuagagugcauucauugcaaaagucccacacauuuauguuuucuuuuuccucccaggccuuuucucccauuuuuucagcagaugccauucaauguuguuuaugccguauccaaguaaguaaccauuauuugaaaacucuuuuucaguuuauuuauuguuugcuuccauauuuuuucuuagaagauaguucacuaaaucacuauuuuucaaauuguggaucacaaaacauuagaaggguaugaaaucuucuagugugucaugagcagcauuuuaaaacaugaaacagaauagaaaauaaccaaagcaucaaguauauggaggguaaguugguuuuuguuuauaacuuuuguuucagaaaaauauaugcauauguuuauauguauaugauggauuaugauauaaaauguauuucuuacuguuaguuguccauuugugcugcuauaacaaauuaacagauugggugauauaaauaaaauaaauuuauuucuugaaguucugaaggcugggcaguccaagaagcaaggcaguccaaugggcagucagugucggugagggccuucuugcugugucuucacauggcagaagaagcaaaugcuguguccucacguggaggaagguggaaggccaaaaaggaccuaugcuaguucucuguaauccuuuuauaaggcacuaauccauugaugaggguggaguccucgugacuuaaucacuuccccuaaaagccuuaccucuuaauaccacgacaauggggacuaaguuuaaacaugaauuuuggagaagacacagacacauauucaaauuguagcaguuguaguuuaaaaaaguugaaaagugcuuuaaauaucuucuuuugcuucucugaaacacuuauuugaugacaguucuucaacauuucauuaaauaaacaaaucagucauguaauauuuuuugaaugcuagaauuuuauaacuuaauaaccaucuaaucuacacagauaaugugguauacaaagauaaauaaaacaugguuucugccccacaacggagugaaccaagguaagagggagguaagggacaagggcugaaucugagacaaauguguauuucuugucucuaguuucaggacaagacagcagacugguagaguauuccuuuaaaaaucuaauuuuugcuacacucuuuccucuguuaauauaauuuaauauuucuguaagagaaaaaagucuaagguauucaugaaauuaucaggaauagaaaccuuuuuuaaggucucauauuucugaauacaaauuuauucaggacuagguuuucaagggugcauuuaaagaauauaguuauuccuaauaauauauaucaucauaugaacaggacauguguuauuaaaugucuguaauccucaagauaaaugcuaguuaugacucuacuucacccuugacauuuuuuuaagacuguguggauggcuuuggcucuuuauagagauggaguacagauucccugcucucccuagacagagcaacuucuugggguaccaguuuauccagaaauagcuguagacuuauauucuaugaaauguuuuguaugagcaaaaggggagcuaugagcuauguagaucccuaaagagccuucugguaauucuuuaaaaucaggcucacugaauuaccugcuuuggaggucauaacugccucagucuaaaaguuguuaacuaauucuagggaguucagaggccugcagugaugaacaccaugaccuccccaacuccucccuaaauaaccgugacacaagggauaaagauuccauccaagaguuaaaccaugacauuugacauuguagcuacucucuaucugucuuagaacuuuuuaaagaaugaaucaguauuccugagugaggucaauucuggaauuccaguauguuugaguuucugagcagugaguauaaugccaccuuguguuaucagggauggaauugucuugggaccagcuggccuucuccagccacacccuuuucauggcuagcuguuggagucuuuccuuuggauucuacauaagcaccuuuucaaagagaauaaaaaguuaauacuuuuaaaacauucaaugaaguucauaguagaacaggauuugcuagguuugugaagccccucucuguacagcucuguuggggcugggagagaaaaucuagaagacuguagguauggcagacagugcaugcuccuggugccugggcagugguggaggaggaaagggccuggauagaacacauagagcagcccuggcugccauaagaguacuaaagccagagcaggugagccugagggcaggagccaggacacagcaggggucaggccagcauggagcagaugugggaccuuucugaguuuggguccuguuugagguuggggaggaggugggaaagggaucauugcucuuuguuacucauauuuuacucuccccuaaagccaacagaaauggggaaaaaauagguuggagaaauuaagaaguuaguuaagaaaccauguauuaaguuacugaaagaguucaaaguagcuuuccucuuuuacauucuauucccugacccaccuggaaagauacgaagccagaaaccuucaucagaggaguucauuaggccuuauuauaaacuaagcacauuugaucacaugguucaaauguguaauuauuuaauuugagaaaaaauaauuuauucucuugauucaagauaauggugcaguaauauaauaaaacuucaugugacuucggaugacaaagcugauuugaaguuauuuauucaacuagaauuuuauaguagaauaauuucuacugaaaacauaagaagccauauauuaucuacauguuagaaauuuauagcaacuauuggaaagugacuucaauagcaguuacaguucagcauuacaaacuaaagcccgugugcgguggcucagaccuguaaucucagcacuuuggaaggccgaggcaggaggauaacuugaggucaggagucugagaccagccuggccaacaugaugagacucugacucuacuaaaaauacaaaaauuagcugggugagguggugggcaccuguaaucccagcuacuugggaggcugagucaggacaaucacuugaacccgggagguggauguugcagugagcugagaucacgccacuguccucaagccuggguggcagagugagacuccaucucaaaaaacaaaacaagacaaaaaaaaaaaacaacuauuuaaaguacuugcuccagcacagguugaacuuccaaacagguauuucuuucuaacuggcuugaaaugcuuuuuuaaaaaauuuuuauuuuauuuuuauuuauuuauuuauuuauuuauuuauuuauuuauuuauuuauuuauuuuuugagauggagucuugcuccaucacucaggcuggagugcaguggcgugaucucggcucgcugcaaccuccaccuccaggguucaagugauucuccuuccucagccucccaaguagcugggauuacagguacgugccaccacacccagcuaauuuuuuguaucuuuaguagagagggaguuucacauguuggccaggcuggucucgaacuccugaccucaugauccgccugccuuggccucccaaagugcugggauuacaggcauaagccacuguaccucgcccuuuuuuuuuuuuuuaaacaucuuugguguauguauuugcugugcucguauauaagcucuuaccauugccucuguuuuucaaaauggaaauaucucuuuguuuuugccuucaucuuuaguuauuuauguaauuuaaucaaugcuuucaccaacuugaaaaaaaugccuuaagucaaaguggcuauauugguuuuuuucuuauucuagaggcaaugcauguacauguuaaaaaagaagauucagaaaaguauaaagaugaaaaaaauuaucuguauaauuuuaccaucuagaaauaauuacuauuaauuuauuguauauacaucuagguauuuuuguaugcauaaaaacacaguuuuaaaauguaaaaauggaauccuacuauacauaccauuuaauagugucauuuuuuucuucuuuacaaugaaucauggauauuuuugaaugcucacagguauagauuacauuauuauuuugaauagcugcauaaauuccauuauggcuguuucauauuuuuuuaaacaauucucguauugaugugaucauuuaaguuucuaauuuuucacucuuagaaaugagacuuuaugaacauguuugcauauauaucuuugaauaccuguccaguuauuuccuagaauaaauuccuaggaguagaaaugcuggagcagccgggcgcgguggcucacgccuguaaucccagcacuuugggaggcagagacgggcggaucacgaggucaggagaucgggaccauccuggcuaacauggcgaaaccccgucucuacuaaaaauacaaaaaaaaaauuagccgggcgugguggcgggcaccuguagucccagcuacucggaaggcugaggcaggagaauggccugaacccaggaggcggagcuugcagugagccgagaucgcgcuacugcacucuaaccugggcgacagagcgagacuccgucucaaaaaaaaaaaaaaaaaaaagaaagaaacgcuggagcaaagcguauuuuaacuugucaauuugguguaccuauuuguauuuccaucaacaguuuaugagaaggccuguuucuucacaacauaaucaaugcuagguacuuucagucuuuuaaaucuuugcuuaugugauaaaauagcauaaaauaguaucuugcuguuuuacuuuucuuugauuacuaguuauuuucauuaucuucucauauguuuguuagaaguuuuacuuuuuguuuugugaauucuccuuuacucauuuuuccaugggguauuuaacugccuaauugauuuacaagggcuuuuuauauagaaaggcuauuuaaacuuuuuaucauauauguuccaaaaccuuuuucuaaguuugccauucaccuuuuaaauuuguuugugauauuuugaggcauagaaguugaaacuuacccucaauucuauugaucaucuccuuuuaugguuucuggcuuuuaagcccggcuuaaaaagaccuucacucaaagaugauauaaauauugacuuauguuuccuguuaguacuuuuauagucucauuuuuacauuaauuuuuuuaaagaucuggaauuaauuuuucugcaagagacaagcuaacuuucccacauguuaauaacaaagugaucccagcauuaauuauugaaucauuuauccagauagagccugucugccugccugccugccuugguuccucccuuccuuccuuuuucucucucuuucuuucagcagaaaccaucucuucucuuuucucugcucccauauuucuggagggaaacagagagugguauggaacugaaacaaagaagaaagaaaccagagaauguaguaaugcugaacagguucagaagugcuguacagcauucuagaauagcucuguucuacaaccuugcccagugacacacauauaaauaggcacuucugugggucaaccaugguacuuugacccacuuaguuuccuggcagaggugagaauaacaaggcaauucucucaagauuugugcgcauaauccugguuauaauggauucaugauuuuguaccugucaacauuuaaaagaggaauggacuugacaaagcuucgaagauuuguuucuacuugauuauauaauauuuuaagugaccauaacagguuucaauuuuuaaacugauuuuucucuuuuagggcagaaccauacacuuuuccuccuacuucuacuaagcaccuauccaucccuucaaagucuacugugggcacucagacugauuaucgggaugcugacguucaaacagauccauacucugcagaauauguaguaugucaggacucaaucccugagcucuugacccuggcuacgcuuacuuggggugaguugguaaaucuccugacuauuggcagaugacgaugcugauaaccacgcaugcuguucaaauggcccauguacaggcaauugugguuuacaguguugcuauauaaagugucuuaguacagcaacuucauagacucauaauuuuucugauacuucuggucaaauaaagauacuaucuuuuuauugugaguaguuuuaucguacucuaucugugaagcugaauuucagcuuaauauugcaguugcuuugcugacuacucaccuauguccucucauuucucucuccuagugaaccacuuccuuuucauugagcaaucauacuucuuuaaacauaagcuuugaguguaaaauacugaaugcacauuccuauguaugucauauuaucuuaauuugccaaaauaucuuaauuuaccaauccucccuuauauacuuuauuagaugauuuggaugacuugacauuaucucugaaaugcuaaauaucuuucaggcucagaaauuaacucuuagaauguaauaaaaucuggccuaggccuauauuaugugaaccuauaaaauuaauaagugagacuaccuuuagaaauuauuagaaauuagcuuauguaacucacuuaguuguauuaauagcugggaaacugagaaccagagagguuaacuaauuccuccaaggacauagagauaguugguucaugguaaugauuuuuaaaugagauuacuuucccccgcauuguaacagauagcugugaucaagucugcgucccagacaaagaagauguucauaucugggcucuaguuuugauucuuguuuccuggcccacuuuaugaauccagauuaagcauuaucaacacccauacuuuuuuuugagacggagucuuacucugucgcccaggcuggagugcaguggugcgaucuuggcucacugcaaccuccgccuccuggguucaagugauucuccugccucagucucccgaguagcugggaguacaggugcaugccaccacaccuggcuaauuuuuuuauuguauuuuuaguagaggugggguuucaccguguuagccaggauggucucgauccccugaccucgugaucugcccaccucagccucccaaagugcugggauuacaggcuugagcuaccgcaccuggcccaacacccguacuuuaaagcagaggcucuacuuucaggccuagauggcaaauuaaaaauaugcugaaaccuucccuuucugcucugaaugcauaaaaauuacaggaaaaaauuaauaaacauguagacacacuuaaaagcaagaaagaaaauauucguaauguagaaauggagacuuuuuccuaagaaagaaguagcugggaaccuuugguggugaguaggagcugugcauggcagggaaccagguccaagucaccugccugaaggugaggggccagcgcccuucuccugcacacuggugcaacugaagccuggugccugcccaauaaagauuauagacagagcagagucaggcauuccugccuguggccuuggacuuuaccucuuggugugauaaggacuuggcguuaaacugcagaaggacaagagccaggcagaggcucagaaaugcuucauuaggcaaaaaacaaacaaaaaaaacaaccuaaucugguacacugucauagcagaacugaaguuaaagugucaauaaaagccucuaugagacaggccuacuccuaccauuugugggacccaggacucuaagggaggcccaccuaccauauguauagauauuuuaaaauuauaaaucaagcuaauaucuguuaaguaaaauacguugguuuuuuuuuuuuuuuuuuucacaaacaucuuuauaacaaguuaaaaggacaaguuuaaauuggaauucuuagacuccugggauuccauacuguaaugcagcagcgaggugagagccugcuguggccugcccuuuucucuccccacccuggcucugcucuacaucugaggggccugucaugcaugcccgugauuaccccagcucuucuucucaauguucacacaucccuacgaacagcugccauuuggccccaccuugggcuucagggugaagaaacagcagcauauaguaugcucucaggaaucugaauccugugaagaggcccauggaaccuuuggaagcaggcucggggccauuuguagaaggauuuccaggaccaccuggaaauagcuccaggugggcaugaggccuuggacuccucaccuuguggugaugagcaggguucuaagaaugaauuuagguaguagccacucgcaggucaaggcugcuuauugaccagggugcuuaugagagaaaccugcagcuggucuccacccaagaaccccaaagcacacaaggaacagagacaccaggagugacccacaacaaauaaaggaaauggaagaauaaauuucugaguaaacagaaaauggagcagucugaaaaggacuuaggaagugcuuucuauauucucaaaaggaugagggggaaauagcaacaccaaaacaagaaugggagucaugaaaaagaaccaguuggaaucaagggggaggaaaacuauaacguuugaaauaaagugaacucaauaguagaauagacggagcugaagagcaaauuagugaaaugacagauuaaauggacacauauuccacaaugcaacauauagugguagaacaagauaaaagaaaaguaagagcugugggggcuaggacaugaguauagggaaaaugguagagaagcaaugcaagaaucaguggcugagaacuccccagaacuaaagaaagacauuagccuucacacugaaaaauuccacugaguaccaagcagaaugauuuuuuaaaaacucacaccuccuaauaaaagagaaagaaaaagugaaaaaacuauuagaaaaacuauuagaaagauaacucagauuaccuacaaagaaaaaaaaagauggauauuuuguaguauugccuuuaaggugcugugggaaaaugauugcaaaccuagaauucuuuuaccaggcaaacuauuauugaggagugaaggcgagauaaagacauuuucauacauaagaagaauaucuaucucauaggauacuguaaggauuaaguaaauuuauuuauguaauguguucauaccuacaauccagcaauuucacuccuaaguauacaucaaaaaaaaaaaaaaugagcacauuauucugcuaacggaaaugcauaggaguguucaccaaaagacauauacaagaaaacucacagcagcauuaauuaugauaacuccaaacugaaaacaacccaaauguccaucaaccauagaauggaugaaugaaauauagucuauucacauaauggaauucuauauaauaaugagaaugaaguacaacuacaugugauuacaagggagauuguagauguguauauaauugcguauauaaugcugaacaaaauaagauacagaagagugccuacacugugauuucauuuacauaaaauguaaaaccagucaaaacuaaauuaacgcauuaggaaugagaaugguagcuauccuugggacagguagugacugggaagggaguaucaugggcauucuaguguucugguaauauucuauuccuugaucugggugcugauuauaugggauguuuguuuuuguuuauguaugcuguacauucaugaaaaguuuacauaaagauaagggaaaaauaacgacagugaaaaaggaugacacuguaagcacugcggggauaaaauuaagugcuuaugaugugucaagaacugauccaagugcuuuacauuuuaaaccuauucagucuucacauguuaaaugaauaauaaaguugaaacaaauaguugacaauacagaucuuuuaaaaggcaaaagaaauggucauuagggccauaaguaauuuucuaaugaagauuaauaauacagccaagccucuuguaggaagcaucaagaaagaagacagaagaugcaaacagaguauugggauagaaagggggacagaguaacuacagaauaaacaacuuaagaaauacgagagugcuaugaauaucuuuugcccuauauuuaaaaacuuagaaaggcugggcgugguggcucacaccuguagucccagcacuuugggaggcugaggcaggcggaucacuugaggugagaaguuugagaccagccuggccaacauggugaaaccccgucucuacugaaaauacaaaaauuagccagacgugguggugggugccuguaaucccagcuacucaggaggcugagguugcagugagugacccaagauugcaccacugugcuccagccugggugacagagcgagacuccgucucaaauacauaaaucaaaaaaaaaaaaacuuaggggccggacgcgguggcucaccccuguaaucccagcauuuugggaggcugaggcagguggaucacgaggucaagagaucgagaccaucuuggcuaacauggugaaacccugucucuacuaaaaauacaaaaaaaaaaaaaaauuagcugggcgcgguggcgggcgcccguagucccagcuacucgggaggcugaggcaggagaauggcgugaacccgggaggcucugcuugcagugagccgagaugaugccacugcacuccagccugggcgacagagcaagacucugucucaaaaaaaaaaaaagaaaagaaaacuuagauaaauuauacaauuuuuaaagaaaauguaaauuacuaaguugguuuuaagaagaaaucacaaaccugaauagaagaguaacuauagaaauugaccugguaaaaagaaaaaaaaauucuuuuaagagcaccaggccuaaacaguuuuacagguaaguuuaccacaccuuuaaggaacaaauaaacugcuuuaugcaacuucuuucaggaaacacagaauaaaaguuaauuuauucauuuuaugagaccaguauagccuuaauuugaaaacugaaugaggacaguacaguuauuacuuaguauugguagcacauugauuuuaggacccuccaacccuaccaagauuuuuggaugcgcaagucucuuauguaaaauggcauagcauuugcauauaaccuacacacauccucccauauauuuaaucucuagauuacuuauaauuccuaaugcaauguaaauuauacauaaauaguuauuauacuguauuguuuagggaauaaugacaagaaaaaaguuuguacauguucagaacagacacaguuuaaaaaaaaauaauuucaaccugcaguuggucaaauccacagauguagaaccauggauaugaagggccaacuauacuaguaaggaaacuuacaggccaaucucacauaugaagaaauaugcaaaaaaauucuaaauaagauacuagcaaucuaaucuugcuguauuuuaaaagagugacuuauaaccagauggaguuaaucagagaaguucaaguuuguugcaauaccagaaagccauucauguaauuuaccauuuuaaccgaaaacauaggaaaaauccucugggugcaggaaaaaguauuuuauagcaugcagugcucauuuaugacauauacucugaauaaacugggagcagaaggaaacuuuagagacuuaauaaggaauaucuaccacagccuguaauaaacaucauacuaaaggugaaacuucagaagcuuuaccuuaaaagaaaaagacauugguaaugcucauuaucacuacuauuuaacaacguagaggagaucuuagcccagaguuuaucaagccuggcuaugaucucuccuuucaggaacauuugggaauaugaguggcauuuuucuauguaauaaugauaggaagugcuucugguauuuagcucgugggacaggguauagcugauaggcuggcauggauacuaaacauccuguacugcuugggggaguuucauacaaauaauuaucugcccauuauggcaauagcacccugguugaggaacacugagucagugcagcaagauaagagaaaaauggaggcauggcgauuagaaagaagcagcaaaacuauccuuauuugcacacgugcucucuuagaaaaauaaauuaucagaacuaaaaagagaguucaacaagaagucaacauacaucagucgcuuuccuauaugagagaaauauccaauuagaaaaauuguugaggccaggugcaguggcucacaccuguaaucccagcacuuugggaugccaaggcaggaggauugauugaggccaggaguuugagaccagcuuggacaacauaguaagaccuccauuucuacaaaagaaaaauuagccaagugugguggugcacaccugugguccuagcuacucaagaagcugaugcaggauugcuugagcccagggguucaagguuacaguguacagugaaccaugaucuugccacuguauucccaccugggcaacagagugcgacccugucucuaaaaaaaaaaaaaaaaaaggaagaagaugaaagaaagaaaaagaagagaaaaauuauuuagcugaggucaggaguucaagaccagccuggccaacauggugaaaccccgucucuacuaaaaauacagagaaauuagcugggcaugguggcauaugccuguagucccagcuacucgggaggcugaggcaggagaaucacuugaaccgaggaggaggagguuucagugagccaagauugcaucacugcacuccagccuaggugacagagcaagacucugccaaaaaaaagaaaaaaaucuugaaaaaaauuacauucauuuauuuguuuuagagauggagucuuacucuguugcccaggcugaaguguaguaaugugaucauagcucacugcagccucaaacccuauggcucaagugauccucucaccccauccucccaaguagcuggggccacaaguccacaccaccaugccaugcuaauuaaaaaaauauauuuuuuuguggagaugggguuucauuauguugcccaggcuggucuccaauucuuggaccuagaaauucuccugucucggccuccaaaagugcugggauuacaggugagccaccgcacuuggcugaaaaaaauuacaugcacgguagcaaugaauaacaaagugccuagggaaucacuuaauaaaaauguacaagggauuuauggugaaaaguauaaauuauucuuuaagcacauaaacaaagauuuggugaaaagagagaaaauauuuaucaaugggaaacucaugcuugaauagauaagacuucucccucaaauaauuuauaccuucgaguaguucuaauccagauucccacucucaauauaacuaugccuggguaaauuagcacuuuucaucuucucuucccagaaauuauacaaaagcaaaagcaacaauacucccacgaacuccauuuucaguaaaacuaaaaauauauguaauucaugaaccaguaaauauuuguaaggacugcaaaaagcagcugagauugggcagaugcaaugugggaggaagugaagcaugcaccgugggagaggaaccauuaggggaucucagaaggcaggggcaaaaauauacuucugaggguaaauuaagcaauauccagaauuaaaaauaaucauauuuuaugauguagcugcuagacucuagcauuucuacuucuaagaauccuagagaagcucacauaugguacaaugagaccaguacaaggauguuuguugcaacauuauguaugaucaaaaaauuaaaagcaaucuaaaugucauuugagaagauagauagcuuaaauuguaauaaagccuuacaguggaagaaggaaacuagaucuguauauaucaguacagcuaggcuuccaaaacaaagaugaguaaaaaaagcaagcugcagaaugaauagcuauaguacaauaccauguauguaaauauuaaauaaacaucaguacugugucuugcuucuauagaauucauuuuugguucauauuugcuuuuacuagacaggaaguauaguauagugcacaaaaauacgagguucagacugccaugugcaaguuacuuagccuuuuagcccuucaguaucuuuauuuguaaaacaggcguaauuauguuuaugugauagggauuuguugaagauuaaaugcauuagaaaagugcuuggcauaauaaaagugcuuaaauagccaggcaugauggcuuaugccuguaaucccaacacuuugggaggcugaagcuagcagaucaccugaggucaggaguuugagaucacccuggccaacauggugaaacccugucucuacuaaaaauacaaaaaaaaaugagccaggcgugguggcaggugccuguaaguaaucccagcuacuagggaggcuaagacaggagaaucacucgaaccugggaggcagagguugcagggagccgagaucgugccauugcacuccagccugggugacaagagcaagacuucaucucaaaaaaaaaaaaaaaagugcuuggcauaauaaaaaugcuuaaguaauguuagguuuuauuauuauuauaauucauagacacauaaauuuguauauaaaauguuaagauugaauagaaaaccacaaauuccuuuuuguguuuacuuggggaaaugggagaagggaauggggcucaaugugguaguuaaaagguacaucggcuuuauuuauaagguuucaauuuuuuauuaaaaaaugugaaguauauaugacaaaauguguacaguuguuaagucugcauauuuaugguaugauuuucauaguuauuuuuuaaauuacuaaagaaaaugccacgcaagacccaccaaauaauauguagauacauauauauacauauauacacauacauauaugugguauuuuguauacagauuuauuuacuucuuuauacaucuauaaaaguaaaaagaugagcuggugguauuacuccucaccaaaugcaucauugugacugccucugggaaggugaucagaaugaggaagcagaguacagaacuuuagccuucucuauaauacccuaauuuuauuuuauuuuauuuuuauuuauuuaguuuuugagauggagucucacucugucacccaggcuggagugcaguggagugaucuuggcucacugcaaccuccgccucugggguucaagugauucuucugccucagccucccaaguagcugggacuacaggcgcccaccaccacgccuggcuaacaauacccuaauauuaaaaacaagagauagugaauucauauauuacuuauuugcuuuuuaaaagcauaaacauugcaaaagaucugaaauaagacacaaaucuuaggcaugcccuacuguacgugguagaaauaugaccuauuacuuauuuccuuagauuuuucuguauaauuauauuuuuaaaugaaaauaaaacaaagguuggcuuauugugguucagugaucaaacaggaaacuuguuccagccucccuuuccuuuaccugcuuuugcaaggccacauuuagaggugcuaggcaccuaagugugcuggcauccucaaaacuugauccagggaggcauacguuggcuuaggucucagccagugucucggagcuggucaggagacauauccaguggccacauccuccugccugaccuacagguauugugucuuugaaugcuuaaaguugcagguaagagauagcccuaaauuuuacauucacuauggggacaaaacccaaagauggugaauucucagcuagugauuagugucuucauuuucuguuauuuuuuaaaaaaguauguggccaaguggcucacaccuguaaucccaacacuuugggaggcugaggcggaagaauugcuugaaaccaggaguuugagaccagccugggcaacauggugaaaccuugucucuacaaaaaaauaaaaauaaauuagccaggugugguggcacaugccaguagucccagcuacuugggaggcugagguggggggaucauuugugccugggaggucaaggccacagugagcuguaaucacaucucuauacuccagccugggcaacagagugagaccuugauucacaaaaaagaaaaaaaaaaaguauauauuuuucacuuuuaucgaacaaauuccuuaccccauauuuuucccaccucagggcucugaaaaugccuuguauuucaguauauaaauuuguuuauuacagagcauuccaaggugugauuauucaguagucacuuaauauucuucaaaugcauuccagcauucuacaugcaacuaaaaugucuuacggcucaauuacuagcaagaggcaguggggcacagauaacacaagcugugaggcacaucuagaggcuguucccuaaugucauguuaugcugucauggcccuugaauuuggagaagaggaaaggaacugacagggaguuaauuauauacuggggggugcaugggucagcucacuuguuccuaagcugugcugcuuuauccugcaggucggggucucccagcaggacaagcugagguggagaugauagaaagagcccgcgagaagcgugcuugggaagccucucuccccgcucugagugacaccucccaguuugagaagaggaggaaaaugaugaaugaaauggagaggaaggagugggccuucagagagcaggagauugaaaaguagguucucuaucacccagacaacuguuccugcacuggugggaauaauguuaauacuuuauaucugcaaagcauucucccaaauguauggguugaaaagcaauccucaaccuauagagauaggaaauugggcauccgguucuuucaggagcagucacaugcuucugaugugguccagaagcucuguauaauuuucccuccaaaaacauuaaaauguagaaugcccucuguguguuugaagaagcucagcauggaacccagguuugaacaacuccugaagggcaucucugauucuucuuuucccuuuucucuuuaguaucuaucuuaacugucacagaaucccacuaauuucugcaaagcaccuuucaaacugucccuucauguucauucccagcgccacugucccagugccugggcuuucuucauaccccuucaaacagccuuggcacuaguccuagcucuuacccaccccccaccccgacccaagacacuggguucacagucaggaugccuugcgugcuagcuagagcugauggggcauuuccuaguuaaaagacaaauuauggaauucuuccauuaagagaugaguauauaacaauauacauaaauaacaauaugcugagguacuugugguuggguuuucaauuauuuuaacugauauauuuucaguaauggaguuguugcugauauguggaaaugauaagagauuaugagaaccaaaaaauuauaacucucuagcaagaacaaaggaagggcguuugcugaguuuguccuuugugcuaggcugugcugacgcacuuuauugcucuaagcaaugcuaccaaggacccuuacacacaagagagggaccuagagaguuagagucucagcuuggugcuaaauuuggaauauguuaaauuuuuugcaacaccuucagauuaagccugaaucuaggcuuugugauguuuugauaaaagcuugcaauuuaguaaaaaaauaguguuugggcaaaguaggugucaaauacccaauccuguuggcagaaauuuaaauuuauuauuguacuuuggaaagauaugugucuuuucaaaaggcauuaaaacuguuaaaaauguaucuggccagagugaaaacgucaucugagaaagcaaguacauuuguuaaacugagggcaauuuuaauacauguauuuugagucccuuuuacaugcuagacucugugcugugaguugggaaaauagggaugaauaggaaacugcucuuccugacagagcuccuuaugguccacuggggcagggggagcagggaagguggacaaggaagggacaaaagaucuuaguuagaucaaccccucucaggcugugucuaucaggugaugugcuguucuguacaaaaagugcuugguggaacccaggugaaagaacaguuaguucuauuuaaagugggcgauuugagaaagaaaacuacuaagaggagguagcuucugagcuggguuuugaaggguagguaagaagccaucaggcagauaguaguaucagacaauaauaucagaagcuaucagguagaccaauacuugagaaguguuggucugagauuuuuugcaccgucuccuugcccaucugccugccccuuccugccccagugaacuauaaggagcucugucaauaauaucagauugaugaugauaaugaugaugaugaugaugaugaugauaaugaugaugauuaguggacuauaaggagcucugucaauaucagauaagugaaugguaaggagcucugucaauaauaauaauaugauaaugaugaugacgaguggacuauaaggaguucugucaaugauaucagaugaagaagaagauaucuauagagcauggaacacuuauagagggcuuacuaugugccagaugauguucuaagcauguagaccucaaagugugguccacagaccagcagcaucaacauuaccuuggaacuugguagcaaugaggugaucaggccccaucccaggaccuacugaaucagggguugaggcccagcaaucugugucagaaccugcccuccagauuaugcugcacucuuaaauuugagacuauuguuagagcacuucguguauacauuaacucacguaaugcucacagcaacuucaugaagaggguacuauuauuaucuccacuuuaccauugaagagauugaggucaguggugacauggaaaauugaaccuagcauuucugacucuaaagagaaaggugacugggguguguggcuuaguuuuaaaaaugccuaccucuccauacucauuugucacuacacucucgccccucucaagugcauucacucugagaaacccugccagugugacaucuugcugucccuccaguccuuuugaguugaacauucagcuuccccugcugaggcccugcuuuuccuuugucaauguagcaaaucccaacccugaguuaacagcuccucuaaggaaggcuuccccaccuguucccucuuuucccccugcccuauccuuucuucuuccacgaagaguuuucacucuucuagccugguauguaucuccuugugcgggaaaugucgguucuuaugccuauuccaccagaacagugcuuguugagagaagguguuuuaucuuguacaucauuguuccugccuggcauauggugggcacuuaauaaauauuugacaaaugaauaagugaauaaauucagguaugaauuucuaagcaggaguaaaauguauguucaaaucucuguuuuaggaaggaaaaccuugacagcuggguggagcaaagauuagaaggaggacagacuagcagcuaggaguccacuuuaggagugauaugaccagacaugagccagggaauacaagaagcauugccgaggagagauccuuagcagcgggaagaagguguaagagggucagacuucugggggaacaaaugaguaggguuuuguuuuguuuuuuuaauugucaaguggugacuggagauucaaauagauggaaauucugguucagaaauaucuaagcugggcuggacaugguggcucacgcuuguaaucccagcacuuugggaagccaaggugggaucacuugaggccagggguucgagaccagccuggccaauguagugaaacuccaucucuaccaaaacuacaaaaauuagccaggugugguggugggugccuguagucccagcuacucgggaggcugacccaugaaaacugcuugaacccgggaggcagaggcugcagugagcuuagaucaggcuacugcacuccagccugggcaacagagcgagacucugucucaaaaaaaaaaaaagaaagaaaaaagaaauaucuaagcuggagguacagauaacagucaucugugcauuguuggaugcacaugagcaagguagcccaaggagaacaaguugaagguaggaggaaaggaaacaaacauuuguugaguaccuauuauaugccaggaacuggcauuuucaccucacuccuuaggauagcaugccagaaccgcauuuccucuucacucccccuauuauguaacccuccaggaauaccacucaaccuggcacugugcacaaaccucuuacuguuccuuuaggcccaccugccuagagagcccuucuuuuaccccaucugccuggcauaaucuucuucauccuugagaacuacacccauauauauuccuauuauauagagagucucuauugaguugccucccccacgcccucaauucaucugucauacuuuugccagaguggucuuuuggcaauacaugaauaugauagcagcccacagagaagagccugucuguggcagcuguucccuugcccucuguuugagaugccauaugcuucuuuauguuuuguaauuuacuugaagacugcaggagauucgccuggaaguucuaaaagagcuguugaggaagcgugaagagaaucagaaugaagugaauaugaagcacuugaaugcccgguggucuaaacugcaggagggaaaagaggcaaaaauggcaaaaauucagcgcacgcauguaucaaguaaugguguaguaugaacaaugaagacgguggaaaagugggcuuugcuuuggaucuuugaccaaaccugacuuaacuaugauauaauucuguuuugguccugggaaucacauagguaagggcuaagagaugaguuauuucuuaaagguagaagaauggaggaaauucccuuacuaagaaaaucaagugaugguguccuaacagguagucgaguuacugagauaguguguguguguguguguguguguguguguguguguguguguguguguggugggauaaguguuggguuccccauauucaugguccacagcccuggauaaagagcccuguuucuuacccuuucuucauuuugcccuuaaaggagacauuuuagacauccuuuuuccuaaucaccuugcuacaagaaauuuuaauaccgcagauauaacauauauauguuuauguacuauauguauauguauucuguacuuuauacaugaaaagaggaaguauaugguuuauuauuuuuauucacugcaagauuaauaaugacugaauuaaagauucaaguuaaauuuauauuugaaaaauuuaaggccgagagagguagcucacaccuguaaucccagcacuuugggaggcugaggugggaggauugcuuaaggcuagaaguucaagaccagccugagcagcauagugagaccacgucucuacaaauuuuuuuuaaaaacagccugauguaaugguacacaucuguagucauagcuacuuggaggcugaggugggaggauggcuugagcccaggagcucaaggcuacagugaguugugauagcaccacugcacuccagccugggugacagagaccuugucucaaaauaaauaaauaaauaguaucaauuacaugugcagacuauuuauauauguacucauucacaauauaaucacauuuuaaaaaaucauucaaaacuuauuuuuccaacaaaaacaaaacaaucacaaaaacaaauuauugcuuaaaauuauguuuagugaacuuaaauuuaaaauuuuucuuuuugagaaaagagcacuuaacugcuagauauuuauuuagauacaaucaacauuuguuucaguacuuggcauaacuaaugauagaucugacuaauuuuuguaggugaauaauaacauuuaaaucauuuuuacuuaauucuaaaacccaagucacacccagaagugcugagaaucaaacauaaacaauauccccaagacagcaguggcacacaggcccccucuugcagcaugacgucacgaucuuguauaagauuuuuacccccauugaaaacgcacaaugcagagccgccaaaaggucuugggucugugaugggauuugagagaaaaggagcacaggagguggcgagcaugacucuuuagaugaguauacuccugaugugcacaguugagccuuucccucugacugccaaacaguucagaaagcuguaagcugagacagucuuugguuuauuuugguguuaaccaagaugaaccuguagucuuugcuuuugauuauccuuguaggggagaauaauucccuaguuccccacugaacauguauuuuccaguugcuuugaguuucauucauuuaacaaacuuuuacugaauaccucuucuuggccuggagcuugaaaugcaguuauaaaagauuuuugacgaguaccgauugaggacacuagcugauucugcuucugucacuccugccugucucaugacaaucugggccacacagauggcagaucucuguuuuuaauguuacauucuggcugucgugagucaucaggaaauucauucauuucaauagcuucucugugaauaacacuagcauuggcuuacucuucugcauuuguaauucagaacaauauuuuagagauagucauggagguauguuuuauuucagcaaucagaaaacuuguaggaaagagaaagaauauagaagggaaguuggagagaagaaauaucaucaaggauuauucugauuaugcaucacaggucuauggaccucugucucgucuuggguguuucccagacaacaacucagaggacuuuguaguaaaaaacuacuaucucaacaccuaugaagguaagcaauuuacauaauuagaaauccaguauaagaagguugucucagaaauaugauuaaauauauaaaauguagaaauuuagauuaaaagcuaagcaauaaaaauauuugcaauaaacacugaugauacaaaccaauaaaaacuacuaagacccaaauaaauaaauggacacacuauagaacaguucagcaaggaccaaauucaauuagcuaguaaauguuaaaaaaauguuuaaugucacuaauaaucaaaguuauuuaacaaugaaauugagaaaaguuuuauuccagguuuaugaagccaacaagaaauauguauaaugaaaucaaccuuuuauaaagaaaugucaaaaaacuagugggcaagaggauggagaaccaggugauaaguucacggagaggacuauaccucuuaugaaguucaaaagaggcuuauuuaguuauuuaauuucacugacaaauugaaguaucacauggccaagaucaugaguugcugguuacacugcugaacuuguagcucuggcuggccaucuccagagcaaaauguaauaaauuggugaacgucuacuuuagaaggguggcaccacauaucauagaaucauuaauuuucuguugauuauuauuguggaauugcuacuuuuuuguagggcaauauuuucacuuuagaaugcauuucucauuguacagucuaagucacugacaacaugaguuaauuauauggaaaugugcuauuacauuucagggacacuucauucuauuauaugagauacacccucucaacaauucuaaugaaacugcuuggcaaacagcuacaaaaguuaacaauauaccuuaaaaauaauaaacguaagcacuggauacuaaaaacaugugcuuccuucccauaggauuaguggaacuugagucaugucucccagauuuugugacacaaccccaaaucagagcuccaaaaccuaaagucauuaccaccaaagcugguuuucugaagagggcagcaagguuggacuaugaguuggcagagguucauaagguauaaucauuaucuggaggacaaaaugcuucuaguaugauuuuugcagauaaaugcuacacuccaaaaauugcagcaauguccagugggucaaacauagaccuacauucucugcucugcacuuuucugagguugcccaugcugugcugaaccaauguguauuuccccucauuucacauuucaggagacuucuuggagauuuuuuuccccauuugcagaggucauauuacuuucugaaagcguuuuccacuuggaucucuauauaaaauuugacgcuauacuaagguguagcaaguuucuauuguugguguuaauagcuauaauaggcccgauuuucucccuuuuguguucaugugaucagggcauaugaagaaaaagagucauguucaacaccuuucucauguaguuaaagcucuaaaggcucuaguuaaagccuucaccaagacucacaguacgucauccaccagcugggcuuucccuuuugguagcuggacuauagguguauagaaucugugguuuaugcuggugguucucauucuuuccugugcaucagaaucucauggaggacuuguuaagacacaugcagcugggcuccauccccaaaguuuccgauucaguaggucugagguggggcuggagcauuugccuuuuuuauaaguuucccggugaugcugcugcugcugguccaggaaccacaccucgaggcccacuguuuuauaauacacucucaucacuggcccaugcaugcuuguuuguucaguugauuuuaguaguuaauaaaaauugaugggaaccuauccucaaaacaggaccuuaacaguaauuuauguauaucgaggugguucuuucccaccucauccccacgcccccaucuccuuucacccauccugaaugcuguguucaucauucugucacuuucuguuaagauuuuuuuauagauucuuuuuauuagguuacggaaguucucuucuuaauuuacuaaagccuuuaaucauguguuuauguugaauuuuaucaaauguuuaucacacaauuuuuguauauuuuuuaauuauuguaguaacauuuauaauuguuuauaaauauuaaucuauccuugcauaccugggaugaaccugccuuggucagagcauacagcuuauuuucaauaccuuguuggauuugauuuacucauauguugauuaggauuuugcuucuacauucaugagugaaaugaccuucuuguuuuucuuucucauuuugacuauguaugggguugguguuauaauuacgcaggucuccugaagugaacuugagaauauuccuuccuuuuucuuuuuuugagaagaguuuaaauaagauugggaugauuuguuccuucacuuugguagaauaugcauauaaaauuaucugggacaaauguuuucuucauaggaaaaauuuuaaccacuacugcaauuucuuuacaacuuauagaacucuucugcauuauuuuugguaaauuuuuuuuuauaaauuccauuucaccuaccuuuuccauuuuuuuggcauaugauuguugauaguauuguuuuauaaucuuuuaaauguuuguuuuaucuuauucaugucuacucuuuucacuuacaauauuguuuauuuaugccuuaacucuuuuccuuaaucaaguuuacugaaggcuugcuuauuuucuuaguauuuauguuuccaaacaaugaacuuuugauuuuguugauuuucuguguuauauuuuuaaucacauuaauuuauacuccuauauuuauucuauauuucuuucuacuuuuuuaggguuuguuucacaggucuuaccuuaaauugcacauguagcucaucaguuucaggcauucaucuguuuuauauaaguauuuuagguuaaacauuuccuucaaaauacugacuuuugguacauuucauuaguuuugauauguaguauuugucauucuuaauuucuaauaucaaaaaacccauuaugauuuuuuaaucugugaguauuuaauaguguguuuuaaaauuuccaaauaugcaggaauuuuaacucauuuucucauuaaccucuaacucaauugcauugugaucagaggucauagucugugugauaccuauccuuugaaauuucaugaggcuugcuuuguggaccaguauaugauuauacauguaaaauaauaaaaguacaucuucaaaucacacugugccacuugauggguagagcaggcaccuuagagcagauuauucccaacuccuucuucccuucccugugauauuccugucauucauuucacucguccaagugcuauauauaaucagccaauacuuuuuuacuuuuauugcuuuaguuaacaguuaucuuuuagauuaaaaauaagaacaacaauauauuuuauuuauuccuucucuucugcucuucuuauacuuauaucgaucuaaguuuuugaucuauaacauuuuucuccugccugaagaacuuuuuuuuuuuuauaauuucuugcagggaaugucugcuggccaugaauuccuucaguuuuuguuugccccuuuauuuuggggagcggggggaauguaauucgcacacaauaaaaucacccuuuaaaaauauauaauucaguaguuuuuagcauauuuacaaaucugugcaaccaucaccacuaucuaauuccagaauauuuuugucauccccaaaacaaaccccaugccuaauagugcucacuuccaauucccccuuccccucagccccuggcaaccacuauucuacuuucuuucuauuguuuuuuuuuuuuuuuuuuuuugaguuggaaucucacucuguuugucaggcuggagggcaguggugcgaucuccgcucacugcaagcucugccucccagguugacgccauucuccugccucagccuccugaguagcugggacuacaggcgcccaccaccacgccuggcuaauuuuuuuuuuuguauuuuuaguagagacgggguuucaccguguuagccaggauggucuugaucuccugaccucgugauccacccuccucggccucccaaagugcugggaucgcaggcgugagccaccgcgcccggccuauucuacuuucuuuuuauggauuugccuauucuggacauuucauauacauggagucaugcaguauauggccuuuugcgucuggcuucuuucacuuagcauaguauuuuuaagguucauccagguuuuaacacaucucaguacuucauucuuuuuuuaugauuguguaacauuccauuguguggauauaccacauuuuauuuaucuacucaucauuugaugaauacaccaagaauauaaccaugucuagucagugguuaacuuuuuuuuuuguuuuuugagaugaaguuuugcucuuguugcccaggcuggagugcaauggugcaaucucagcucacugcaauuucugccucccagguucaggugauucuccugccucagccucccgaguagcugggauuacaggcaugcaccaccaugcccggcuaauuuuguauuuuuaguagagaugggguuucucuauguuggucaucaggcuggucgguuaauauauuuuuaggaauaucauagcacgucuugagagauacacacauucuuguuaguguuucucaagcugaccuagcaucaccauagagaauauuaauauucugauuaauauuuauaucugugaccuagaucugguaaugaaggaaaauauaggguacaauauacauuauucaggugauggguaugcuaaaagccuagauuucaccauuauguaauacauucauguaaaaaacugcacuuuuaccucuuaaauuuaugcaaauuuuuguuaaaaaaagagauuauauuaauuggcauuauuucaggcacuguuggauaagaagaauaaaguucuugaaguaaagaaacccccucgcuuccuucaaagaaacccaauaccucaaccucggcuuccaacuccaaccuuggaaaugacguccaauguaaguuggaaacuuuuuaguugaaaugcuaaauucaauaucauugucagcuuauucuuaggauaguuuagcuuaaagcaaaucuaauuuagcaguguuaguuucccaagcucugacuuaaauauugucuuuauucuuauguaucaaacaucagacacagaaaaacaaacgagaugaaaugaaaucuaaacccaguccuucucaaaaauaaaaacacaauuuaaaaaaucuuuccaugaaaaaucagcaucagaagguagugcucauguauaugaaauagaaaaagaagauugagugaugaucagcuaccauagcuaucuucccacauggagagauggcugaugacuguuggagucgaagaggaaugaaaugccagaggugucaucaagacggacuugcuucuggggugggaaugacucaaagagcccugcccagggccacaucucaccagacucaauuugagcaaaguaucagaguugguuaggauuuagagggcugacucagacuaaacaaauccacaggaaacuguuagagaugccaugaugcaaauuuauuacuuuacagagagaacuauaacugccuacuggaucaggcuguuccucuuggcuggucagcacauuaucucucaguaugggacaguccucacaagaagccagauuguauucagaaggcugauguguuucuuggcugagggcagguguuggugggagaccaugcuaacaccuguuacuaccucugaugaguggcuccugcagagggaccagaaagcucccaccagccagcggggaugugcugcuggauaacauucucuuuucuagacuuugugcagggcuuugguugacauauugucuuuuuuuuuuuuuuuuuuuuuuuuuuuuuuuuuugagacagaaucucguucugucacccaggcugaagugcaguggugcaaccuuggcucacugcaaccucugccuccuggguucaagcgauucuccugcgucagccuuaugaguagcuggaacuacaggcaugugucaccacacccagcuaauuuuuauaguuuuaguagagaugggguguugccauguuggccaggcuugucucaaacucuugaccucaggugauccaccugcccuggccucccaaagugcuaggauuacaggcaugagccacugugcccagccugacaacacaucgucuuucauguguguuaaugucaucgauuagacugcuguuuucuuuuuacauucaaaggaaucuuaauucgauuuccagacccugcuuuuucugcuuuggacacagaguuuuuaagaugauuuuuauagauggcuaaccuugucucuuauauucugauuuuaucagcauagcuaaauucuugugagaaguaccuuacucugacauagacuagcuguauuugugucuacugaugaucaaacaugaaaaauccuauugcaaaaugauguuauaugcaauacuuguugcuuuaagaaauauuuugcuggaaaggaauauagggaaaugaaagugguuucauuuguagggauagcauggcagggagugaauuuuuugcuuguaauaugauuuguuaaugaugaaaaauaaugaauucuaauguaaguaacauuaaaauacuauauguucaauaagggcagggaccaucuuuuauuucucuuuaaaucuuuuuggcaucuagcacagucuguuuugcuugaaauaagucuucaaaagaauauuugaugcuuggacuacugcaguucucaagcugcuugguucucccuuuguucuuuuaggaagaagaagaaauggaaauggcugugaucuaccuucaaaaguuacuccggggcagagucguucagaacaugguguguagguccaaccgcuggcccugcauuucucuuuugagaauaaauuuuuuagaaugcauaugugcuugguuccuuggagugaaucccuuuugcacccugcuauccuauucagcuaaacucuugaguugccuacccauuuccuucuggugacccauuuccuucuaauggcaucauuuguccagguggguggcacagugucaaggagagagacagggaggaccuaccugcuauuugccaugguuguaacuaaggcaguaugaaacucacuucuuccuuggaauuguuaaauccauacauuuucucaccugaauuuuggcuauuuaagcauuaucaaccagguggauucccuaauuuuccacagucauaauacaauuauuugaguuugcauaugucuggcaaucccuacauuauaaaugaaagagcuaaauaauaaauuaugguuuugaaccuuuacuauaugcccacacuauuuauucuuugcucuacauauguugucucauuuuuuuuuccuauccauaaucucauuuuacaggcaaguaaucugagucugagggagauuuaguuaucugccagcaaauucagcucuggucuucccgaguguaaagccuuagccagauuauuuguguugcuggagcaggcacacuucacuuaaaaaauggacugauauaaagccccaguuaauuuuuuuucccagauagcuauaacucauaagagauucagauaugaugaguaaaucaucuggaugaacaacuuguguuuagcacuguucuuuacucuucuuucaguauuuucccaagagaaaugccacaguuaaauucagacaacagauuauuacaaaccagggacagauuuauuggaaaaaaacauauggccaugaaaaaugccauccucagguuuauuagggaaggagcacaggaaaugaggggaagguucugguuucuucagaugacccuggaguugucaucuuguccuugagaggcauucucagaaauuaagcacagcucacugaaaacuaagcccauuuucugccugagaagcugaaggcacagaaaagagggcugagcucuagcucugugggacacaucugcucuguggaacccaaaaggcaggacagaacccacuguucacaagugucucacaagucacugcgugugacuccuagugcuuggcacaaagggaugguaacuugcaggucugucuuugauuugauuugauacagauguuugaagggaaagaaaagcgacuggaguugauccaggaguugcgcaccugccacgcacuacaagaagaugaaaagcuggugaaaaaagccgagaagcaagugacccuggccuuacagcggcagaggaacuugcaugagcacaagguuuuccuuuuuuuguuuucuuguuacuuucuuguuaaauuuucucccuugauuuuaucaucacacagcaccauuauaauaaaaauuaaugaaaugaugaaaaagaaacagccccacaaucccaucacucugucagcauuugugugugugugugugugugugugugugugugugugugugauggaguuucacucuaucgcccaggcugaagugcagugaugcagucguggcucacugcaaccucugccucacggguucaaaugauucuccugcuucagucucccaagcugggacuacaggcaugcaccaccaugcuuggcuaauuuccguauucuuaguagagaugggguuucgccauauuggccaggcuggucucgaacuccugaccucaggugauccgccugccucagcuucccaaaguucuggaauucuuaaauaaugcugcuguaguccuuaauuugauuggggaugugcccuuacugauuugaauauggugcuauuuuuucuuuauuugcaaaacaauaacaacaaaacaagaagaaugcauucuuuucaacuuuaagauuuuuuuccuuccauuuuuuuccccaaauauccagugacuauuguauuucaguuagugagggcuuuguagacugaauaaauaacaaaagcaacaugaaaaaagugagaaauaagauuuaucuuaaaauauuagcauuuauuuuggaguuuuagagcugucauagcucaugcugguuaaacugcauauuaaauguguuacuguuucaugauauguggugacuuucgucaugaccucccagcugugugccgccugacacagcuaagaauuacagcuccaaaccaacaacuguaaauauuuuuccuauuuucuuccaauguuugucuauauauguauacacacuuuuaaauguuauugacauaguauagcuaugcuuuauuuuacucccucucccacuuuucuguaagucaaucugaaaaagaaucaauuugcacagaauuuaguguuauagggaaguaauacuuaaaguuaauaugacccccccuuuagcaacauacauaacucuuguguuaugugggagucgggcacaaaugguaagcagccuggaaaugaccacaacuuuguuucuuucacaugacagcagcaccauggauguuugcugagcuuggggaacuuuuggggggugaggcagaauggggaggaagcaagccacaggcugugagauccaacagaggaaccagagaaggaagaggagaaugucaacacuggagucccugaaucuagaaguccuagaguccuggaaaagcucagauaaggagcagaaugcccuggaagcgcuaggcccugagacuguggaugaaaaaaugcccuccuuggcccuuucaguuucugaucaugacuuuaguggguauagcuaagcuaacccaggcuuuucagcucauuuauuccauuuaguggauauacaugugagugaaaucguguccgccuacagcuaagggaggaguuaaugggcaaagcugucacuuagccaaggacucacucugcuuaccuucagcuguacuuggauacacccuggauauaugcagggaucugagggagugagcaccucauguauagaugcagcaaugcuggucugcccccuucccccuucucuuauauuucuguggaaaacaguccagaaaaugcacaacccccaauuacguaacacaguacuuucugugacuacaguggaguccccucccuaaacauuucccuuaauuucaaauuagaugguacugccugugccuacccagauuucuugcugagagaagaggcuaaacaugaacaggauuucuagccaccucaggauuuucaagguugcaccugacccugagugagggagcuuaugcucccuggagacaaggagagaaucuauuugugaucucugggcugaguaucuacuguuuaugaauggaaggaguagugagaugcucuuagcuuugcccuuuuuuuccaucucucccuauuauauaaguaaaguugaacuuugugguuagaaagugugugugggcuaggaggcaggugaggaugaagaugggugguguuggggccaacaaccacacuugacugaugcuuuuacccauagccccauggccucugagaacugaguauucccuccuuucauacagaaaccaggaaggaagcugagcauagagggagaacugucacugagaagguggcaugugacuggaagaugaacccuuuucccuuacaagcaaggauaggagaggaaaggggaugaaguugcaaagucaucuuaaacacuuuucuucuccauaugucaaagccaggacacagggauucauaaauaggcacuguagcugacuucuggcagagagcacaaugggucccuaauuuugccucagugauuagauggacauuuggucuguuuccugugcuuuuuuuuuuuuuuuuucugagauggagucucacucugucacccaggcuggagugcaguggcgcccucugccuccugggcgcaggcaauucuccugccucaggcucccgaguagcugggauuacaggcacgcaccaccacgacuggcuaauuuuuguauuuuuaguaaagacgggguuucuccauauuggccaggcuggucucgaacuccugaccucaggugauccacccgccucagccucccaaagugcugggauuacaggccugagccaccaugcccagccauuccugugcuauuucgaauauuguuguuaaugacuucaaaguuauuaaaaaaguaaaaaguaccaagguuuucuacuuucacguuauucaagaucuuaacuccuaacuugugugaaaggaaagauauugaaaaauuaacugauaucaugagugaauuucuaggagauucaauuugauuaaacuccaauauuaucuuuaauaaaaaacuugacauuucccuucauaucugagaagacacacuuuaccuuguugauaaaauugaaagaaaaaaaacccauucuccauggucacuaacagaaacgucuugcuaaauccucuugcuuauuugagggcugugguccaucagugacugaccagacaaucgacuuucucgugccucaguuuuccucauaagaacuuggguuggagccaauugagagguaauauucccaguaaaaauuaaaugcauucugaaagugaauugacugccaagaguuuugaguaauccagcacuucuucuaauaaucaccacucauaauggaauuuguguccuuaaaguuauguuauucuuuucaaggugucacugguugaaaaccauuuggccggacuggaaggaagggcacuagcagacauguuugacuuccuguccaaagagcuggugagacugcaggaggagaggaggauccaugccuuugucaugcuggcugagcgccagcggcggguacgagaggcugaagagaguggucggcgccagguggaaaaacagcgccugcgggaggaggacgagauauuuaaggaggcaaguaggggcagcuggguguguggaagcugccuagaaggagccaagucaaaccaaaggaagcucaugacauaaaauggcauuuggcuuuuguuuaugcauugaguuccuacuguaugccaggcacucuacagaggcacugugggaaacuuuggaggaaaaaacccagacacgaucccgucucuccuaaagcuuaaauaacacauaauacgcacguguauagaauuagaaacuguaaugaguuccaugaaggaaacaaauagggcccagagacacauuuuaagccaguuacuucacuugcuguguggagcacaggcuggagggaggacagagggggaacaaggcggccaggaaggagcuguugaaguagugaaggccagagugagagacaggaagucgaguauuacauccaguuucgggcuuaagcagcuggaagaugaugguauuauuucgugagguaggaaaguugagagaggaauaagcuuaggggcaggggaggaaucaggaaaucaguuuauauuucguuugggacaucuaagcagagguauuguuucaguagauggaucuacaagauggaauuuagaaaugaggguuuggccgaagauguaaauuuggaaguuggugaccagcuucuagccuccuacuaaucucaacacacuuuucuucaaaaacagugacugagauuuagaaauuauuggcaaaucagaacuugccauccuuuaccuaauaucacuaaggaagaaccagcuggggaugagaauaagaagaaauggaacagaggagcuacuauacacaaaagcagagaaaggaaaaagcugguaaaaaagcuucuuaggaagauaccuucuaaaugggaaugaugucagaaaacaucagcucugucuagcaagggcaagaaaggguuaauauagccuuucuagccugauuuaagaaccacuuagguaaaaaauguacucagcuauggacccacagauucaaauaucauccauauguuaauucucaaccuuccuaauuaaaauauagugacuauuuuccauccuacuuccccagccuccauucagauucucuugaagagaaauaugcuugcacauaaauuauaaaccagaaauguaauauuuaauaaauuuccaaaauaugcaucuagauagugagaaacacagauauaaagucaucgacucaucuuuaaauacauauaaauuuugcaggcacauacaugaggacauauuuacaaauauaaucuggugugcacaacauuagcaagacauagaggaacacacauagccacacuuuuccuuauucacauacauacacgcacaaacgucuccagaaauuuacacauuuauaaagauauacauaaacacacagguacauauacagcuauggauggaccauaguaaacuuuccaccucucuacuauuacgugacugagcuaauugauccauauagauccaacuugcuuccugaauaagagggugggcucuaugagagcaugaauauuguauauucccuuugugccuugcacaacacaguguagaucccuguaacuaauaggcauucagcagauauauuuugguugguuaguuguuugguugauacuguauuaaacuggccauugagacucucccauagagaaggcauagggauugaagguugauguuuuacacauagguguacaguaucauauacucagaauugugccaaagugccaauccacaaacagguacugaauuguuacugagucccaggcauuaucucagauacaaagcuauauuuagacaugaaacagaaaaaugcccuaccucuaaaaagcugauaaucuguugaggagacagcauacauauacaggcaaaacuaaguaugccacaguugaugcuuaaucuuucuauauacauacaccuguaaagcgggcaaaacuaaacuacuuuguuuaugguuacauaccuagguagcaaaauuauagagaaaagaaaguguuuacuaugaaagugggaaggugcugugguaaaggaagaaaccaugguggccuucugagauacuggcaguuacuauaauacauggcuucugacuuuacccuaauucauuacacuguacauuuaugugcucuguacuuuuuauuuuguuuuauuuuucuaaucucugaguuugcuugcaaugcacuuuuaaaaucuguauccuauuucaugauuucaaguaaacuuuaaaaagaagcagucaagggcugguaugauaguucaauaaauucauuagagacccaggauccuucuagcuuucugcucuucugcuccuaggucguaggccuucuggcaauuuaagaugauugcugguauuccagcauuauguccucaugaaaggagaaaugaagagagaaaaaaggaagccaggucuuucccuuuaagaauccuuucuuuggucagaacguggucauaugggcaauccagcuccugugggugcugggaaauguagucuuuauucuaggcaccuguuucccuagcuaaaauccagggguucuauuauguaagaggaaggagagaaaggacacugcagaauaccuccuagucugugcuacaguuagauaguuugaccaagucacguugcugguaagaacaaagccaggauuugaaccagcguuauugacucugaagcccauaauccuucagcagugcugucuugccugccugcccaauaagauccauaauucugaaaugggcuaaaugggugugggcugcccagagugaguagguagguggaugagaaacagacugaugagaugcuaaagaaaaugaaugauuagugaagggacuguugacuuauuaaaugaaauauaugagcuagaaaaaguuaaccaauguuuguguauuuuucuuguguuguuuacaacagcauaccuguuuuagugaggguauuauuguuuuuugcaggugguuaaaguucaccauaguacuauaagcuccuaccuagaagacauaauacugaauaccgaagcgaauacugcagaagaacaagccagggcagaaauagagaagauggcugagaaaaucaaugacauugcuuaugaaauggaaagccgguguguaucaagagaacagauuguagaauggacagcccauuugcugguacucauauauauuuuuucaagagcuuacaauuucaccaccaaguagaaacaaauaacucauacuucagcguccauuguuuuauuaacauuaacucuugagaagccaauauguguaugccuccguauguauucucaguuauccucugcaaucuggauuacucucauuacuuacuuuaagaauacucggaagcaugaaaacaaugugaauacgugugugcaacauuacugggacuucaucccaagguugcuggcuucuauguauaagcuguguuuccaacauucccuuccuggcaggcaggguaacugaaggacagggucaaauccaaauuuuuuuguggaguuaaacaaacuugccaggaaugugauauuucagaucacuuaaucaaggaaaaggugauggugggguuugaauggaguugcuuacacagcaggaaagcauaaaucagcagcucaagugaaaaaaccaaagaaauaauucaauuuguuuuauauuuuuuagccgaaccuaucuucagucagaggagauuguugcugaguugguuuauaguuuucugaucccagaggugcaaaaauacuuugucaaagaaaaagguaagccaauguaaaugcuuuacuuuaggauuuuuuaaagauguaaauuauuuucaauaucccagagauuuaaaauuaaacagagggaugaggaaauuucuaaaggaggaucacugaguuuucuuauuucagagcuugucagguucucuucaugcugccugauucuagaauauaaucaacucuaguacagauggguuguaguucuaauaagagugacaguaucaaaauccaaaccuuguuuaaaaggauguucccaaguuuucagaagagcuguauuuuuuuauuuauuuuuuuaaaaagcauaaaacagauauugagcauauaaaagauuuucacauuguagcagccuuucagaggcaggacacgugaaccgugaauguuaaaaaggaagggugcuagaaaggucuaagucuacccugcugcucugccuguaccccaaauagcuuauuucugcuggaacuccauccaaguauaaauauccuaauuuaucauuugucaccgguggcauguuuuuaaagauugaugcuuuuagucaauagagaaagagaaaauacuaucuuaaacagaaaaauaagauucuuccauagcucugaggcugcugauggcaggcuugauccuagacagaggggugcaaccaggagaagaccaguauuuaagugaaauagcagcucagaaguauugaaaauuauaccggggaauuccagaugggcuuaagcagaaaaaugcuuaacauuucaauuugcucaaucagggauaaagaaaugguggaguucuaacacauuuggagaggacaaagaaauaccugauuuuuccauugcaugguuguaguguaauuuuuaaaccaguacccccuaaggauaagcauuuaguuuguuuccaguuuguuuuccuguuacuaacagugcuucaaucaauauauuuuacacauauccugaccaugcuucugagaguacauucuuaacagugcaauugcugggauauaagguauauguauuuuacauuuugauagauaguaccaaauuuccuuacaaaaagauuguucuaccaauuugauauuaccaaauugccccacaaaaugauuguugacuugcaucaauaguguaugauagugcuuauacaaaaaauuaauuuucagaucaaguaauauauuucugugucacauuauguuauaaaaggaccuuauguuuucuaggaccuuaagaaaauaugcaacucuguuccacuucuccugaguucaaagugaggccagccugcuucaaagccauuacacccuugguugaauuccacccuaggauugaaagagaggaggaaaacuggguuuaauauuuacuaguuuguggccaggugcaguggcugaagucuguaaucccagcacuuugggagucuggggcgggaagaucacuugaauccaggaguugagaccagccuggguaacacagggagacccaguuacuacaaaaaauauuuuaaaauuagcuagguguggugguaugcaccuguagucccaacuacucaggagacugaagugggaggaucacuugagugcaggagguggaggcugcagugagccgagauugugccacugcauuccagccugaacacagaaugagacccugucuaaaaaaaaaaagaaaauuuacuaguuugugauccccucucccauguugggagucugaguugaggauuuggaggaagacuugagcuaacggaauccaguggaacuuaucuaugggcaaguugaaugaguccuuagccucuucccuuuauauuuuugccaaaucaaaaaagccauaugaacagggagcacacuaggaccuuuuucucucuguucaaaugagaaccauauguauuauauauacacucuuuacccaaaauuaagaugauaauauauacagacgauuuugagguauaucacuuuuugaaaagccaauggaucagaaagaccuuaaagauaccuguauauagauauaaaguaauaguaacugccaaauuuuaaaugcaugcuaaguuccaagaaguucacugaacauuuuuaaauguacacuaucucaauuucuuucaagaguuguagguauauucucauuuuucacuuaauggaaauuagcucuuagagacauaugacuugcaaauuugaaccauggucuaugugacuccaaagcccccacuuuuucaaccauauuacugugaagugcuaaaaacugcugagugaauuacccuaucuaaacuaccugauacccaaacagcaaagaauccacaguacuucuugcgguccuuuacuagcuauuugacuuuauguaaauuaccuaauaucucuguguccauguuucuucuucugagaaugcggauauuaaaauacuaucuucuaggaggauuaaaugaauaauuacaugugaacugcuuaaaacaguaccuggcacaaaguaaggacaaaugcuaacuguuaacaucaucaucaucacuacuccuuuccaagggcuuaggugcuuacccugauagugaauauucuuagaauuuggagcuaggacuauguucuaaagccaugagcucauaaacucaucaucaaucaguaagucccuuccacauuaagaacuaaggcucaaagagaaguauaagacuaggucuuuauauuuguaaguuacuuacacucuagauaucaaacgaaauguaacucacaugaagugcuucaaugcugaauagguugguacaaacucaagugcgguaagugguaaaucugggcugauguagucagaggagacuuccuggaggaucuuggacaugagcuuuccagguuuuagagugcaggcauuccagaugagggaaacugcugaggaguggaauggaggcaagccugguggaaaggaguaugacugggcugaaccagagagugggaacagagggagcagaaagaaauuagauuuggguuggguuuuaccuuuaauuugcaaaauuauuucuaucaugacucucuugaaacauuugggaaugguuuuguucagacuuucagaaugaaaauuuuucuauuacuuuggcacagugaggaacgcacagcggaaacauauucuugcagcccaucagaucauccacaguuacacggaaagcaugguucaaaagaaauuaacugagggagagcaagaugaggccucaaaugcugccauguuacuugagaaagaaacucaaaaugagaacaacagcuaaggugaguuugauuuuccaccaggaaaaaaagcagagaaaggaagaaaagcggcauuguucagcuuugugcugugcucaaacaaucauaaugugaagauugcuguuuaagaaauggaggacuuccacuuaaauuggcacauuuccucuaguuuauguuaucuacuguugagauuauuagaaaauuagaguugauauuacagcaauuagacucuugugauacaaaaaagaggacucuaaauuauuuuuauggguucuuuuagcauguguguaccucgucaaaugaagcuauagaaugugucaguguuacauauaaacaaucuuguucuuauggaaguagacaagguaugcccuaaugcauugugcuagcuguaagcauggcaugagacacagagccugcccaauucuagcucagacaccuucugcagugcccacaagggguuggucuugggcucaacuaaaggcugucauacucaugagacuaauacagaccauauuuggcaugaauguacuuagaaaaauauaagacaggaaacagcuuccagcaaggcaacaucagacauuucucuuccuguaggagcccuugccauacccaugcagaacacauagcuguuuucuuuaguccuuaguuuacggagugcagauacaauacaaggaaaagagguucacaccggguggguacaggagcugcccuggcguaaaacuucacaccccaggggcuggaaucucuuguaauaauuccauaggcauagcuuccaggguccccaccauggauuugcccagcuacaaaagucaacauacucacagaaacucaaagcugugguuuucuauuagguauacauuccucccaguucagauggaauuuaccaaucaggggucauuuuuaaguaguucaaauugcuuaguaacacaguugacacauaucaccuuaucaaguuacuaggagaauagagcuagggagucaacugaaaguaaaauucucaugagaaggggaauggagugaacuuuuugcuuauacuuucucccucaacccuuuugugguagaggcacaucugcugcuguuuugcccugaagguauaccaaccaucagguuggggagaguacuggggcuagggagaaauuuuaguuuggcauucagaaguuuuguauauuguccagcucugccaccaauuguauaaucuuacacaaauaauuucucuacuucaguccuugguccaauagaauggaaucuuaagucucaaucaaaaggaaucauggaaggaggguugagaugagagggaagguaagaaauauugcagagagaaagcuaauaagugacucuuaaauaucaaacuguggcuguaaauuacagcagaaaaacuuuugacuuuaauaguaaaauaaccucugaaauaauugaaaauauaaaacaucuauuacauguaauguuauauauugucuauaaaauguaaauucaaggaccaaagcauuuggcuaccuuauuauugugauaaaagcaagccuuaagguugggguagucauuuuucugacaugcaaauuuaauaagauuaauaauuuacacaauuugcauugaaugcaucugccuuuacuucugauuaugguaccuacucuaugacauccauagugaccugugaaaucaagccagaggagaaaaaaaucaucuucuauuuauacuuagugaaaguaaaauauauuucauuaaagccuauguaaagcauauaugauaauuauaaaaucuaguugcagaaaagucuaguugucaggcuaacuacagacacucaacaaagaugaccaaccaauaaauuaaaugguuggaacaugaagcuaagcuguccccaaaguauauccucccucuuccuucuugcagagggaagcagagaaugacagaugugagauuauucaaugaugucuagggaaaggggcaguagucaugggccacugauuuaaaauacauauuuaaaaauacauauuuuuaauuagcuugaacagagagcuaauaaaguagugaagaauuucugggccaagaucuaggagaagauagaaauuuagaggguugggucuggcauuuggagcuacuuuuuuccuggaagaauaugacaauucuagaaaauguggcugaaaggcugaggaguauuuuuaaaagcuuugcaaaacaagggggacaaaaaacuugagucaagguuggggcccugguaaaccuucuucauuuggguagggacucuaaaagucuaugcccuagugguaaggguuaacuggaaguaaacuaucccuggcauaugauauaguuuagcuucuaaucaucugagugauuuuaaaaaucucaaucccagaaauugaacuuaacgagauccuugguuucuauugcuucaaggaaccugccagaaauaaaauguaaauucucuuuacagaaaguuaacauuauucuagaccucuauuuucacaauuucuagaacacaaucaagaauauucagguacgugaggagacaugacagucugaacaaguggcaaaacaauagaugauagaaacagaccuaaaaggaucuaaaauauuggaaucguuagacccagacuuuauuuuuuccauaaguuauugggguauaggugguauuugguugcaugaguaaguucuuuaguggugauuugugagauuuugguacacccaucaccagagcaguauacacugcaccauauuuauagucuuuuaucccucauccccuucccacucuuccccccaaguccgcacaguccauuguaucauucuuaugccuuugugauuagacacagucuuuaaaauaacuauguugacuacuguggacuucuauccuccagaacuaugggaaaauacauuucuguuguuuaagccaucuagucuaugguguuugguuauggcagccccagcugacuaagccagauuuugguaccaggaguuggguacuacuguaacaaauaccuaaacaugugggaguggccuugccacugguuauggguagaagcuggaagaguuuugagguacauacuauauauauggacauugagggugauucuggugaguugucagguggaaauauggaauauguuauuagaaacuagaggaaaggugacccuuauuauaaaauggcaaagaccuugacugaacuguguucuaguguuuuauggaaggaagaacuugcaagcaaugaaauuggauauuuagcugaggauauuucuaagcaaaguguuaaaggagcaacuugguuccuccugacugcuuaucauaaaaugugaauggcaagagaugaauugaagaaggaaauguuaagcaaaaagaaaucagaaugugaagauuuggaaaauucuuagccuauuuauauuggaaaaaacgagaaagcucuuuccaaugugaaugcuaaggguggguuaacagacauuugauaaguguaugggaucauaugagcagaaacauugcaggaugaaguuaaggaagccuauugauuggacuucuugaauuagacaggaugggaugauagaacuauucagcugcaaacaugcacuauucuucaagaagaaggaaaaaugauuccacaggagauccagagaucaucagggccauugucccaguuucaacagccagguggcuuucaccaugagcuuuggaagaaggaccacccaguggaccccagcucagcagagcuauggggugggacccugggucagcagagcuacagggacaggacacuuaccuagagccauggggauggggcauuguagagucaaaggggcagagccaugggaaugauguugccaccccagugggcuuagaaagcaagacacuaagccaaagaagacuauacucaagaauuaagauccaguggaauuugccuugccaggucguggacuugcuuaggauccaucacccauuuuuuucuucugauuuuucccuuuuggaaggaaauaugucuccuaugccucucccaccauagcauuuuggaagcacauaguguggcugguuucacaggcucauagcuggagaauaauuuugccucaggacaagucauaucuugagucucacccguacuucauuuggauaauauuuaugagacuuugaacuuuagacuuuagaguugacaugggaaugaguuaagauuuuugguauuguugguauagaaugaauguacuuugcaugcaagaagaacaugaauucuaccugggguagaaugcuuguggauugaaauguguccuugaaaaugcguauguugaagcuauaacccccaaugugguauuuggagacaggaccuuagggagagaauuagguuuagagaagguaaugagggaagaacccucaugaugggguuauugcuuuuaugagaagagacaucacagugcuucuccucuccuucuuccacucccccucugccauucucccucucucucucuuccuuucucccucucuuccuccaucuucaaugugaagacacaguaagaagguggccaucuagaugacaggaagagaacucucaaccaaaacuaaccaugcugucaccuugaucuuggacuuguagccucuagaacugugagaaaagaaauuucugcuguaagcuauccaaucuaugguauuuuguuaugacagccugagcuaagacacuuacucuguucacaggguaaaugccaauauugaaaauuucaagagaacuggacauaauaaaaaugauauagcagauuugaagaaaauagaaauuccagaauuuaaaaauacaguagcaaaagugagaaacucagugaaucucuccugagagauauuuagaaagaagcacagaaagacaaaaggauagaaauuacagaagagagagaaggauagauuuagaauagcuuaaugauuuagaaaaggagaaagagugaguaggcauggaccacugauugaagaaauuucacuacuaaaggaaggaauaauauguugggagaucauauggaauacgaauuuuccaaaaacgauaaaagacuuguuuucaagaagacuucuuaacccuaagcagaauaaauaaaaagaaaacgauaccuagauacaccuuagaauacuaauacugcugaaagccaaaaagaaaaagaaaaaccuuuaaaagcauucagagaaaaacgauaaauuaccuucauaagagcaauaauuaagcugacaguugacuucucaucagaaacaaugaaagccaaaaagauggaaugauauguucaauauauugaaauaguaaaauaaaguaggauucuaggcaaacauauucuucaugcaaacauauucuucaagaauggcaacgaaagacauuuucagacaaaugaaacuaauaaaauuugucacuaggagaucugcaacacaagaaauuauuaaaggguacuuuuuaagcagaagaaaaauuaucccaguuggaagguuggaaauaaauuuaaggacagguauguggauuggcuuauugacugcauaaaaaaauuauaagaaacagcaauaauaggagcaaugcaguuauaaaacaaaagaguaauauauaagucagaagagggcuaaauggauuaaauuuuucuaaggcacuugcauuguuuaggaggaggauaaaaguauaaguugacauugauaacucaaugauccaugacaacucaaggauacauuuuguaaccucuaggguaacucugaaaggauaauaaagagauauaugacaucuaagcuaacagaagaaaaugggacuaaauuuucaaaacacucaauacaaaaaguggauagaaaggagaaaaaaggaaacagaaccaauagaaagcacugaauaaaaugguagaugcaaaccaaauuuuaucacugacuacauuaaauguaaauagacaaaauauuccaaguaaagucagaauuuaccagacugaauaaaaaucauacuaaauuauaugcugcuugcaggaagccuauauaaaaucuaaauauacaaaugguuguaaguuaaaagauugaaaaagauaccauaaaaacaccacccauagaaaagcagauauagcaauauucauaucaaagaaaacuuuaaggcagaaaguauuagagaaaaagagggacaugccauaaagauaaaggucuaauuuauugggaagauauaaugucacaauuuaaauauacuuaauagcacggccucccccuaaauguagcaaaauuuaacagaacugccuggagaaauagacaaauccacaauaauucugggaaauuuuaaucuuuaucaggaacuaacaagcaaguggagagaaaaaacauuuaaaaaugaaauauuuggcugggugcaguggcucacgucuguaaucccagcaauuugggaggccgaggcagguggaccaguucagcucaggaguucgcaaccagccuggacaacauggugaagccgugucucuaccaaaaauuaaaaaaaaauuagccaggcaugguggugugugccuguagucccagcuauucgggaagcugaggcaggaggauugcuugagcccaggaggcagagguugcagugagcugagaucaugccacugcacaccagccugagugacagagcaagaccuugucucaauaauaauaaaaauaaaauuaaaauggaauauuuuagauacauaauuuuuaaaaacuuggccuaauggacauuuauagaauauuacgcccaacaacuacagaaugcauauucuugccaagggcagagggacauuaccaggggaaagagaaaccagaggagcugugugggcuggccugauggauugggguacagaggagcccccagaguaaggccaaauuuucccauauaauguuagcuuuagguuuucgguagauacuguuuuucugcuugagaaauguuugaauaucucuuguuauuuaaugaguuaugucaguaauaaaauucacucaguuccauggacuuaaccauugacacuucuauaauuuuuuguuuuuuauggguuuuuauauauguguguaguuuguuuguuugguugguugguugguuuuuggucagaaagagaugcugaauauucugacuugcaccaucauacugacauucagugauucagagugguaaaguuucagugugacuuuuuuccagcucagggccaagauugagauuuuucuaaguaagaacaccauccucagcuacuguuacagaacacugaauggcuuuggaaauuggcuauugcugcagacuugguaauauuuuuuaaugaaucuauccuaauguugcaaggcaagcaaaacuuacaugcagagcuuaugcuauaguaaagucccuucauuggcaacuaacauuauuugaaucccaaauaauguauuuccuaugcuaugaaaaguuaaaacaagaaggaagaucuccauuccuacauauauuugcauuggauauauuuucugagccuaaacuacuuuucuaguagcauuuuuggaccuugaaacaagugcaaaggaaauuucaaaauuauuuaucugcaauggaagcauguucaucuuaccuucaaguggaaguaguuaaucuguauuguaaugaccugcuaaaaagaaaauaucaagagaagaaucuaauagaauucuauaaaugccuuccaagcaauaaauauggauauuuauauaaaaguauauaauuguggauggauaccaguauuggccauacuguucugaaugaaaagacauuuucaaagaugagauagggaugagaugagauagggaaaaaucucauuuucaaagaugaaaugagaaagaggaaaaucuaauuacacaucacuauuaauaaaugaacauuugcaaucaauuucaaugacuugaaccgaaauuaagcaaaauguuauucccccaaauaagaauuccauuccuuucauuaagauaacuauauuacagaaaacuauagucaauuauuaguaguguauuuugaauuuuauaaaaaauguugugaaaauuuguuuucucuuuuguuaaaugaguauccuugauuuugucauuuggcucacaaaaccuaaaauauuuacuauuaagcccuuuucagaaaaaguuuaucauuccuuacucuacagcaauuacaauaaaguagaacuaaauauaacacauggaagaaucucacaaauaugauaaguaccauaauaagccaaauccaaaaauaauccacaguaugaauuuauuuauauaaaguucaaaaccaacagcauuaaacuauaguguuuaggaaugcauacuuagaaaguuaagguguaacaaaaugcaagaaagugacuacuguaaaaauaaaauaaaaaucagaauagugauuaccuuuaggagguaaagagaggauugugauugggaagggguaaaugggagcuuauggaauacuauuuccugaccugugugauauuuacacagaugaguacuguacauuaauuuauuaggcugcacauugcuuuuagguacuuuccuauaugugucauauucuacaguugaaaguaauacaaaaacauaugaaaguauaaaacucauugguaaaaguaaguacacggucaaauucagaauauucuaauacuguaaugaugguguguaaaucacuuuuuaguaugaagguuaaaagacaaaacuauuaaaaauaauaucuacaauaauuuguuaagggauacacagcauaaaaagauguaaauuaugaaauugaaaacacacguguugaggaggguggauaaaaaguguagaguucuugcaugcaaucaaauuuaaguuguugccaguuuaaaauagccuauuguaacuauaagguguuuuauauauuccucaugguaaguacaaaacaaaaaaccuauauuaaauacacaaaaggugaagaguaagaaaucaaggcauggcgcuagagaaagucaccuaauuacaaaggaauacagcaagagaggaagaaaggaauaaggaccuacaaaacaaccauaaaacaaugaaccagaugauaguaguaagucuuuaucaauaauuaccuugaauguaauuagauuaaauucuccaauucaaagacauagaguggcugaguggauaaaaacaaacaaaugagaccuaacuauguccagccuacaagagucucacuucacaguuuaaggacucacauagacugaaagugaaaggaugaaaaaagauacucaaugcaaauggaaaccaaaauagaacaaguguagcuaaacuuacaucagauaaaauagguuuuaaguaaaaaacuauaaaaugagaccaaaaaggucauuguguggugauaaaggggucgauucaucaagaggcuuuaacaauuauaaauauaugugcacucaacauuggagccccuaaauauauaaaacaaauauuaauagauauggagggagagcuagacuguaauacaguaauaguggggaccuccaguaucccacuuucagcaaugaacagaacaucuagacaaaaaaucaauagagaaacaucagacuuacacuacaccuuagaccaaauggaccuaacagacauauauagaauauuccauccagcagcagcagaauacacauucuucucaaauacacacagaacauucuccaagacugaugacugauaauaagccuaacaaacuuaagaagauugaaauuauagccaguauuuuuuccaaccacugugguauauaaaauagaaaucaguaacaggagggauuucagaaaauucagaauuacauggaaauuaaacaacaugguccugaacaacaagaagucaaagaagaaaugaaaagggaaauuaaaaaaaaaaccuugaggcaaaugaaaauggaaacacaagacauaguuaugggaugcaacaaaagcaguucuaagagggaaauuuauagcaauaugugcuugcaucgaaaaagaagaaagaucucaaguaaacaacguaauauuacaccucaaagaacuaaaaaaagaacaacaaaugaaacccaaaauuaguagaaggaaagaaauaauaaagauuagaccagaaauaagugaaauagaaacuagaaaaauaauagaaaagaucaacaaaacuaaaauucgguauuuugaaaagauaaaauugacaaaccuuuaacuagacuacuuaaggccaaagagggaagacuuaaggaaaaucagaagugaaagaggagacauuacaacugauaccacagaaaugcaaaagauaagacuacuauaaacaauuauauaccaacaauuuggacaaucuagaagaaauggaugucuagacacaugcaaccuaucaagauugaaccaugaagaaaauagaaaaucagaauagaccaauaauaaguaagaagauugaaucaguaaugaaaagacucucaucaaagaaaaucccaggcaggacccaauggcuucacugcugaauccuaccaaauguuuaaauuucagucuuccaaaaaaauugaagaggagggaauacuuccaaacucauuuuacaagguuagcauuacucuuguuucaaaacuagacaaggauacuacaagaaagaaaaauuacaggccaauaucccugauuaacguggaugcaaaaauucucaaaaaaaguaacaaacuaaauucaacaaauuaaaaggaucuuucacuaugaucaagugggauucauccuacagaugcaagaauggcucaacauacacaaaucuauaaaugugauauaccauauuaacagaauaaaggacaaaaaucacaugaucuuaucaauagauucagaaaaaaaauuugacaaauucaauauucuuucaugacaaaaaaaacucuuaacagauucauuauagaacaaauguaccucaacauaguaaaguccauauaugacaaacccacaacuaacaucauucucaacaguaaaaaguugaagccuuuucuucuaugaucagaaacagacaaggaugcuccacucuugcuacuucuauucaacauaguacuggaagucucagccagcacaguugggcaagagaaagaaauaaaaggcacccaaauuggaaaggaagaaguuaaauuguuuuucuuugcaggugacauggucuuauauauagaaaacccuaaagacuccaacaaaaaaacuaauagaaaugauaaaguaauuaauuuacggguacaaaaucaacauacaaaaaucaguagcauuucuauacauuaacaacaaacuauacaaaaaagaaaucaagaaaacaaucccauuuauaauagcuacaaggaaaaaaauaaaauacuuacuuaggaguaaauugaaucaaggagaccuguacauugaaaacuaucaaacauugaugaaagaaauuaaagaagacacaauuaaaugaaaagauauccuguguucauggauuggaagaauuaauauuguuuaaacauccaugcuacuuaaagcaaucuacagauucaaugcaaucucuaucaaaauuccaaugacauuuuucacagaaauagaaaaggcaauccuaaaauucauauggaaccaugaaagaccccaaauagcuaaaacaaucuugaagcaaaaagaacaaagccaucacacuaccugacuuaaaaaucuacugcaaagcuaugcuaaucaaaacagcaugguacuacacacacagaccaauggaauguaauagagagcccagaaaugcacccacagauuuguggucaauugauuuuugacagaggugccaagaacacacaaugggaaaaggacagucuuuucaauaaaugaugcugagaaaacuggauaucuacauacagaagaaugaaauuagaaccuuuucuccacaccauauucaaaacccaacucaaaauggauuaaauacuuaagcauaaguccugauacuguaaaacugcgagaagaaaacauaagggaaaagcuccuaacauuggucuggauggugaucuuuuggauaugacucaaaagcacaggcaacaaaagugaaaauagacaaaagagauuacaucuaacuaaaaaguuucagcacagcaaaaaacaauaaacagagugaagagacaaccugcuaagugggagaaaauauguacaaaccauacaucugguaagagguuaauauucaaaauaugugaggaacucaaacaacucauuagcaagaaaauaaauaacccaauuaaaaaaugggcaaaggaccugaauagacauuucucaaaagaagacacauacaaauggccaacagauacaugaaaaaaaugcccaacauuacuaaucguucgagaaaugcaaacaaaagccacaaugugauaucaccucauacuguuagaauggcuauuaucaaaaagacaaaaaguaaguguugaggaggaugugaagaaaagagaaccguugcacauuguuggugggaauguaaauuaguacagccauuguggaaaacauuauggagguccucaaaaaauaaaaaauagaacuaccauaugauccagcaauuccacaacuggguguauauccaaagguaaugaaaucagugugugaaagagauaucugcacucccauguucacugcagcauuaaucacaauagccaagauuugaaaucaaccuaaguguccaccaacagaugaugguauacacacaauugaauacuauucagccuuaaaaaaaaaaagaaggaaauccugucauuugcagcaacaugucugaaccuggagggcauuaugcuaggugaaauaagccaggcacagaaauaccagcauaaugccaugaaccagguguaaugcauccacacacauacacauaugcuaucacuugcauguagaguagaaaaaaguugaauucauagaaguaaagaguagaauguugguugccagaagcuagugugguagggagauguuggucaaaggauacaaaauuucuguuaggaagaguaaguucaagggaugcauuguaaaaccguggugacuauauuuaauaacaauguguuauauuuugaaaauagcaaagagagauuuuaagcacccuuuccacaaaaaaugaaaaguauaugaaguagugcauauguuaauuagcuugacugagccauucuacaacgugcacguauuucaaaccaucaugcuguaccugacaaauauauauaaucuuucuuugucaguuuaaaguaaauaaaugaaauaguaaaggauguuggcaguaagucaaaguaaaauggaaagagaaucagaaacgguauuuaugaccuccagugucuacauaucaacuuuucccaaacaauuguuccauggauaacugcucuucaggacauucauaagcagggcugcuccugguauuugcaagacccaggucaagaggaugaauugaagcaucauaucauaugaaaauauauaaaguuguaaauuaggcuaacauacuguuauauaaaauuuauucuacccaccuacuuucacaaacauaucuuugagaugauaacauugaaaaacggguaagcagcuaugggcuuuauguaauugaaagauggcaagaaccaaagaugguaagcuuaguuauuauuguacaugucugacuauucuguuuaugguccaguaauauuugggcaaguaaugaaauaaaggcauacaugguuuuuuaaaaguuagaaauacauauguauauauacaaacaaauacauauauauauauacauuaugccugcaguauacagagaauauuucuggaaaggucaauaagaaguugguagguagcuguugccaggcauggaaacuggggacuggaguucacaccaggggaaaagagauuuaccuuucucauguugacauucuuuuguauuuuuauuuuuuuaugauguauguauacaacccaguuaauguacagauuuuuuuaagugcuagaauuuggaaacugacacacugugaaguaagaaacaucuggauccauaaggcuuauaaauagcagagcugggauauguguggggcugucugaguucaaagcuagggcucagacacacuguaucacaggaauuuuuugcauguauugaucugauaauguuucuaaaagaugacauaaucauaaacauuuguuuugcucuuuuuuacagauugugauuuuuuuguaaaagaagcuguacgaaucaucauaaauaauuccaauagucugcacuucucccaaggugugcacugcucauaaacuugccagugugugauucaugagaaaggagauuuauuuuccuuaaacauccaauaauuuaaaaugauuuucaauaauaauaaucaaaugaaaaagcuucauucucuucagugucuucuagaugcccuacuuaaagagaacauuuucuuaugucucauuucaauauuuuguuaacuaugaggaugugcugguuuguugaaucaaacaaaaggaaauguuguggaauauuuuuccaaguaguuuugguucacuauucacaggacauuggcauuaucuacuaaggcugaaaaugugcauauuccaugacucaggauuuuaucuccuagauauauauucaacagaaaugcaugaguaugugcaccaacaggcaugacaaaaauauuuauaguagugguguucacaauagucccaaacuggaaacccaaguguccaucuccaucggaacagaaaacuauacuuuggucugcuucuacaguggcacaucaacccaccuuugagcuuuagaucuaagaaguguguucaugcaacagccauagagauggugcuauugaaaggcaaucugcccauccuguguauugacaagcaucaggauuccaggaggauucuuccugauucaaagacugucaaauaggaaaaaagaaaacaguaaaugaacaaaaacaucaacauggaguccaaguaaugaauuuauagaggaaaauguaugcuacucugaaaacaaagcuuauguuagagaauaucuuacuguaagaaacaaggaaaauugcagaaacauuugcugaguguuuuuaauaggagucaaaaagaaagggucuuuucagaaacugaaguaggaaauaauaacagacaaggucaaaaaauagaugcaggcugaaaagaaaaggaagugggcuaagaugggaaaaauauaaaaagauuuaaaauccagcaacaaaauuuacacauucauuuggaugcagugaaaagggcagaaauaccacagcagagaauaaaauugauaauguuggcaacacauuuauuaagugauccaacaugggaugggaaggaaugggcaaagagauuaaaaugacagaaguuagcuguagaugaccuaucccacagcaaucggaguucuugaagaagaaaccagaacaaauaaaauagaaacaauaaucagaguuuaauaauuaauuuucugaguuuuuuuuuaaaaaaacuaauuauacaaacuugaaaggguucaccuugcccuagcaaaacuaggauugggacaccuuuuuuucccccugaggaucacugacaaaaaacacugcaccaguaaggaagcaacuaaauuuuguuuuguucuuugaaaaaggcuaaccugagcuagguaaagguuauaucauucacuuuugaaauaaaccaucgagaacacaaaaugacaagugaguuagguugggcugaugggauagaaggugggaggggaaugcuauacagcugggaacagcagacuuucucugaagggccagaugguaacuacauuaggguuugcgggucugauggucgccaucauaacugcauacucaacucugccguuguaggguaagagcagcacucgaugacacagaaaugaaugcacaugacuguguuccaguaaaauuuuauuuuaauuaaaaucaauucauguuugaaaaaggauuuaaaguagcuucuaauaaaggacauguguaaugaaacuuaaaauaugauauuuucuuuaaaaaucuuuauccuuauguagacuucuaaaacuauguuuugcauuuagacagucaaggaaaauacaaguuguuauacaauucucauugacuaauugaaguuuacuaggagaggaaaacuuuuucuugauaccggcaaucuuuuacuuauaauggcuugaguuaaaaugcuccaacuuuucuaauuuuugcuuuugaaaauaaaacaccuauagugacaauaaaaacacacauuuaaagccaa

SEQ ID NO: 192631 - RNA, 32771 nt, Homo sapiens
acgucugcucagcuccgcgguaauggaggcuagggaugggugcugaaguaucaggcucuggcucuagcuuuagcucuggcacuggaacugcgucggagucugggucugagucuggcagcccgaagccuggacaccuuuucuugauucucuaggcgggggcugccugcguccaagcagcugguuugcagcguuccaacgcugggagggaguucccuuaccugggguccagucuguaaaguugucgccgcuuucuagggaccccgccccaccggcugggacucuuccaugcgugaguauuacugagcugccccaagguccggcuguccuggaccugccucggcccucuugggugugcggcggagacugcuuugucuaccuuucugccgacuucucuuagggaccagucuguugaaguuuguggucuccugcaguccaccacaccgcauacucucaccucuuccgucccaguuuuuucccugcacuuuucuuucccuuugcuuguuaauggagcaaggaccagcagccccugcauccagcgguuugaaugcuuuguuugacuugggguuaguuuacagccgaaggcuguuaggaauagggagcauuugaaaacacggguuuuuuccagugucauccuuggguuuuaguuguauuguuuaggaaacauugguauccauguugacagaaucaugauuuuugccguagaaugaugaaaagagcuuuuuuuuuuuuuuccagugaggaucuuuaucuuuuacuugcuucuuaaucuugcaguuucaguaauuucuguaugauuuuacaccagcuuuucuggagcgggcauccccuugaagaguuucuuucaauauuuuaacccuaacauauagagauaccacucgaacaguuuuacuuuuaaacuguuaaaagaacuacugguacccuuucauuccacuuccucaguccugacaaccucugcagaacaggggacacuccccccccccgccccccccccuugaagaaacacacucagaagaacacacucagaaguuaacuuauccggauaaggucagauaauaugugaccaucugagcucacaagccauaucccuugauaacaaaaccuaauguuuuauaaagugccaauucuucuauauuucaaguaguuuaagugugaaacauugagcuggaaauguauaaggugugauguuucuuguaaacuucuauuugauuauaauaucuuacagaugauacaaaucaguugacaaaagacacaaaucaucacuugccuaaagcugaacagagcuuagaucagaacuuaggcuuuugacccauuagagucugaguaguccuuuaauucgaauaacguaaguaguagacacugggaacauucguuugaaaaucuuauuuuguaaggccugcuuacucaguguuugucguuguuuuguugccuacuuuaaaaauagucuacugauguuuaaauguuuuuguugucguucagaguugaaacugguugacaaccauuaaccuggguugcaacuacagguggcacuggaagcagacugguuccuggacaugcccgguggaaggaggggcccuagucggcaacagcuaagccguucagcuuuaccuucuuugcagacuuugguugguggaggcuguggcaauggaacaggcuugagaaacagguaaagaaaaaauaaggcuauauauaauuuuaauguccuuugaucaguaagacuaacauaaaagucaucaugucauucagauauuugcuuauugagauuuauucuugacacugugguagaaauccugcccuucaagacaaaauucagaauuccaaaauacuuuggagguaaaaagaugugaaauggggcccacaaagugaaagcagucccauucuuuauuuuggcugaucaucuaaauucuuguuauccccuuuuuaucuauuagaagaagggagaagugaaugaaaauacaagguaagugugaugguuuaucuacuuauaagcauucuuuuuuuagagggcaaauuauaagucaaauuccaucaaggauuuuaaauugucaaaaaauuguuuggucuuaauaaauguuagcuguuuuuuagcuggguuagcccaugccaucaggagguuugauaauguagcaguucaaagagauacuuuuaccuaaugaaguauuugcucaagauauuuucugccagcuaauuucuccuuccucccugaaaaaaguuuuucucuugucuugauuuuaauuuucagagcuagcaaucaguacuacuguauuuucaggccugucuaaugguauuuaugcacuuuuguuuucuaggccugaccuuuguccuuuuuuuuuccugacuuuccaaucccucuuccacccaaucuuuaaaauuaguucugaucucaucauuucaguggagcucucccugaaauuccaguuugaagggauuuuuccagucuccgauucucauacuaauuuuuaauccgaguuuuguuuauguauguauacagaguaacuaguuuaugcuagaguauuuuuuacucugccguucguuggauuuccuuauuuuaaaaaugaugguacuguuugcaucauagcaggauguugaaauaaaugaaguaguaaauugcaguaacuuuaaaaaacuuuacugaauuuuacaaaauuucuacaaauaaguauuauuuuauauacuuaaaaauaagaaugagaauaugcgaaaaugcuuuugaagaaagguacuaucuaauauagguauugagauaaaaguuguuugcucuuugagguacaugccuuaauuuuauuaauauaugcuaucaacuuauugauucaguacuuucaaauugugauagaaaaucuuagcugucccuaacuaggauucuagccaacuaaaaaauucuaacuuugccuccuaacucuagcaguucuuuguucguucucuuugacuuuggcuuugaggauuccucuagauaauuauguucucuagauaaaaauguucuuagacugucccaugaaaucccucuucagugucucagggguugcuguaggagggcuuagaagggaaaauggaucaggcaagccuaacagucuaggcuugaguuuuccucgucuucuuuuaauuagacugacucauuuuccuauguguuuuaaauauuaagauacuauguaaaauaucaugaggaaaggaaaauaaagcguucugcuauuaaaaagaacugaaagccaaugaaaaugucauuuguagaugcuucugcuugcacuuagagucugcagaugguauacugggaagaaguaggaacguucggaaaauaccucggcucuugacuggguuugguauucuuuucucugccuucacuguagcucuucuauccugguauucaagguuccaaccaugguugcuuuaaucugccuuucucuccuccuuuaacauauguuuauuuagcaauuaacuggggggagggagggaguggguagaaaaaaguauuuuccaacauuuuaaaaugaaagaaauaauuguuuaugguuugaaaagucaccaagacuauuauugagugauuauuugugacauguuuaccuagagaaauuauuuggggaaaagaaagcuuuauauuucuuucuuggugggaagcaagcagcuggaauaauuuguuauaaaagaccuggggacgagguaugaaaacaugaaagaacuagcggauagcuuauaauauaguuuuaggaaggauauauagaaagaaggaguguccagaugaggagaacucacuucuggagugucuauagaguauuggagggaaauagauaauugcuucaguauuacauacuuuuggaugauacauuugauucugcaagacagacauaggucagcuggagaggagagaauuugucccuguuugguaggugcuuguggucugauuggugaaguuaaacucuagaaugucaaggagcuaguuugguaacacagucaagguugaaauuguaguuccuuguccugcuguccaccuuuggggagcagggauuuguucuugcaacaguguauuuaaaguauuauccuuuuaaaaaaggaagauauauuguguauuucuggauuucuuagagaguuccugauugagggagaaucuuauuugagaagaacuauuguuuucuuugcuuauuccuugcauauacuuuguuaauaauaucaccugaacguguccaaaugaccacugcuuucccuaccucuucuauuccucuuuaugccuuugaaucuuucuucuuucauccauuugcuucccuaaauucugcugcuugcuggcuccauaccagucagucucaggccugcuguguuaacccuuugccacacacaaacuuuauaugcaaggacaaaacacagguguucagcauaaaccacauuguuuguauaaacaguuuaggcacagugagccacucuaguuauuuagggaaaguuuauaucacuguagggaacuguuuacuagucaugguucccagauguaagccuuguaagcaggccuuccuaagaguagcuauguugaacaccugcauucuuuuugggagucuagaauuuugguacugcuagaaagaaggugcccauguggccagcccccaauaaaaacccugggcaucaagucucuaaugagcuuuccuggaugaguagcacuucacauguguugucacaacucauugcuagagaauuuauauggguucugaauagauucuuaaaucuauuuuuauauucuuuuuuugguuuuguuuuugagauggaguuucacucuuguugcccaggcuguagugcaauggugcuaccucagcucaccacaaccuccgccuccuaaguucaagcgauucuccugccucagccucccaaguagcuggaauuacagguguccaccaccaugccuggcuaauuuuuguauuuuuaguagggaugagauuucaucauguuggccaggcuggucuugaacuccugaccucagguguuccgcccgccucggccucccaaagugcugggauuacaggugugagccaccacgccuggccaagaaaaguuuuaauaugacucccagguuucugaugugggcagcuaacugagugggccaugaacuaaggucaggacuauaggagggaagaacacagagauguccaguagggaguugaauaaugugucuauaauuuagcagugagcucuauggagagaaauuauagucuucaucauguaggagauaauggaggccauagcugcaucuuagaucacugacagaaaguguggagggagaaaagaggaucccaggauggagucuuguggggaaagcagacagugaagggguagauggaggagacagcaggagcccuuuauguucugugauacuggagguuaucaccauuugaguuaaccauaguuuucucuuucaggaaugguagugcuauuggccuuccagucccaccuaucacagccuuaaucaccccagguccuguucgucauugccaaauuccugacuugccuguggaugggagccuacucuuugaauuccuuuuuuucaucuaccuguugguugcucuuuucauucaguacaucaacauuuauaaaacaguguggugguauccuuacaaucauccugcuucuuguacaucacugguaagucuuacucagacuuuaaguucuucauguuacuuacccaagaaacuaccuggaaagccuuucuguagaaauuguuuuucuuaauaauuuuucuuuuaauaaaauguuuuucugcuaggccacagauuacuuucagaaauaaaauuucaugauaagaugguuaaauuauaaguacuaccagaggaaguaaaaauauaaaugaaaaugcagaaaacauuuaaauaauuuuuuauaauaauaucacggaaagguuuugguauuuaguuuucucuacaccauuuuaaauuuguaaguauaaggugucaguguuacuacauucuaacaacucuacccuuuuaauggcugaauuaggauagugguagcuucuguaacaaauaaacucugaggcaguuguccugguugccaggaguucuucaggggacccaggcugauggagauucuacugucuuccaacaugugaccuccaagguggcuguggcccaucccugucagccagaaggggaaagagcuuagggcaauguaaaggacaguuucuuaugggccaggcuuacaucauuuccacacauguccacuccuaauuacaagagaagcuaaauauaguccuuuagcuggguacauagugaacuuaaaucaaauugggaaauugggaagugaaauugagaaauuggcugucuuugcugaaguacauaaaaauauauuguagguuucuucuguucucuuuccauuuauuaagaguaccaugauaggccgggcgcgguggcucacgccuguaaucccagcacuuugggaggcuaaugcgggcggaucacgaaguuaagagaucgagaccauccuggcuaacacggugaaacccugucuccauuaaaaauauaaaaaauuaaccgugugugauggcaggcgccuguagucccagcuacuugggaggcugaggccggagaauggcaugaacccgggagguggagcuugcagugagccgaaaucgagccgcugcacuccagccugggcgacagagcgagacucugucucaaaaaaaaaaaaaaagaguaccaugauagucuugaugcagagaagguucaccauagauggguauauaaaaaaauauugguaaggccugggcaugguggcuuaugccuauaaucccagcacuuugggaggugaaggcagcaggauugcuugagcccaggaauuugagaccagccuaggcaacauagugagaccuugucucuacaaaaaauaaacaaaauuaacugggcaugguagugcacacuugugguccuaguuucuggggaagcugaagugaggauugccugagcccaggagaucaagacuacagugagcuaagauuguggaaacuguacuaaggcuagucagaugacuugacagauagguuguuggcaauggcagauuugcaugagugauagagauaggcucuaggcgaaagaagacuauugucuuauauauguguuugggacuaauaaagauuagaaagccucccuaucauggugaacauagaaaggaaaugugggccaaaauccuuaagauaguauggaaagagaauaaaaauuuuuguuuuaaauauuuguaucauuugguuguuccugguauuaaaaauuuucuugcuauauugaccuccugucuacuuaauaucaugugauaagaaugucaguuucuguguugaaaaauugcaaugauauagugccaaauuuuuuuuuaagucuuuuuuucuuaucuggauuaagagcuuauugaguguaggaacuguacuucauucauccuuuuuggccaugguguuuuaaaagaaagaaguuggauuggauguucuuuaaggccuuuuacagcuauauaguucuauaaauaaauacucacuaucuuaacagugucaauaacgaacacacauuaaaauauuuagauuauuuacaaguauuaucucauuugcucuuuauaaaaauggguugguaccguuauaugacucccauuuuauauaugaauguaagacaaaauggguagguaccauuauaugacucccauuuuauaaaugaauguaagaccuauaaacugguucaaaaaucacauagcggcauagugagugcccaaguccagaccaaucuacugugcuuuacuuccuguuuuaguccuauauuuauucuguaagugcuucuuggguaguucauuauaaaauuucuacuuggguugacauuucccuggaaacuucucauuuguugaauuuucagucucaucgaagaguucuuugcccaaucuaacauaucugacuauaguucuuuagaaagucaccuacaaauacugccuugaaacagggagccaguguucuugucauaaucaggaaccugcuguuauagcugcugacuccagaauuaaugcuuccuuugcuuugacccuuaccaccaaaaauggaugccuuuugcuaccuuucccccuaacuucacucacuucuauucaaguuuuauaugaugccugugguugacagaaccuaaaucguaucuagagucugaguugcaagaaaguuuggaaaugucauuuuuagcuuuccagccucugcaguagaggaacgcacacuuaauggagguuguagaguagauuggcucacuuaucugaugcacauaaucuuugcuaacacaaagcuuaaaauuggauugugaagccaagaguaacaugugaaauagcaaauaagaguuuagcccaugaaucugaaaggagccuguaucagugaguuguucaaagauagauuggacugccggagaucaaguuauuucccaucacugaagguauugaaguguggaaggugguuaccuggucaggaggcucuagcaaggacuucugucccaaauauguggucugucuuuuaaguuuucuucuauuaugagugucugggucagauacucauaauaauuuugucagauuuauuuauuagguuuuuauuuuuccauuucaagaccuuaauaucaaaaagaaaauguggacaccugaauaugugaaguaucauucuagcugucaaccaauuaacugaaugagucuuaacccuaagaaacauaaaagcuagaaguaguaaauauucagaauagucaggaauagagggcucugauuaaucaaauauucuggguuacaaagaguuaaucauaagcacauuaccauuuucauugauuugguuauaacaugauuugcuuaacaaaaagauguauuaggcacuuaaauauuuugauuuuuuuuuugagacggaguuuggcucugucagcaggcuggagugcagugguaugaccucugcucacugcaaccuccgacucccugguucagcgauucuccugccucagccucccgaguagcugggauuacaggcaugcaccaccaugcccagcuaauuuuuguauuuuuaguagagacaggguuucaccacauuggccaggauggucuugauauccugaccucaugaucugccugccuuggccucccaaauuacugggauuacaggcgugagccaccgcacccggccaauauuuugauuuuuaaaaaugucuuagauggacuggugaugcauuaauaagacccagacaucagccaggggucgagugaaucugcaugcauuauuuuggaggaguaggguaggcaaggaggagucccaaaaauaggaggggauaaauacuguuagaauccauuauacuuagagagggagaaaaggaaaugaucuaaggaguggcaagccacucuugacauucuggcuguacuaucucuaaaauguauacuaaauuuggccacuuaauuccaucuccauugcuacucacacuauucagucuguuaucauuuuucacucgaauuaaaagcaagagcuucuuaacugaucuugccccacuacaauaauuaucucacuccagccuucuugcugcuuuuuagacacacuaggcauauauuuuccugucuuagggccuuugugauugcuuuuucuucugucuggggcccuuuguccccagagcuuguaaugccaggugccuuuuugucauucagcucucagcccaaaugccauccucucagagauagccucccuaaccaccaguuuaaaugggcucugcaccuccuucuuagucauuauuuguuacuguuuuauuucuuacaagcaguuuuaacuauuuaaaaugcuuuuguuugggagcuuguuuauugucauuacuugcccugcuucuccaaacaaauuuauugaagauauggguuuagcugccauaacaggguggcuaaaacaaaauagaaacuuauuucccuauuuaauaaacguuuaggugggugauauaacaucagcauggcaacucuuuguauuuauugcucuuccauccccaauaugcuucuuccaaaccaugguccaaggcagguacucuaacuccaguuaucauaucugaccagcaggaaggagaaagaaaagagaaaaggggacagcucuuucuagaagaguauggcuuagaaguugugcguauuacuuuuucacucaucccuuggcuaaaaguaguuuuugcaagggaggcuggaaaaugaaccuuuagcuggcuaggagucagugccuaguuaaauuuuauggugaugcagaaggaacgaauaguaaucucugccauuuccuuucccucugacaccacaguagaaaguaagacccaggagagcaggaaccuuggcugucaucuuccacacuguaucuuuagugugaaggagaguaccuggugcauuguggaugcuauguauagauuuauuaaauuaaguaaucaagaaauuuaauguuucauucuggaaggaauuguggaaaccuacagaccuuuugaucaucaaaaugaaaauacauccugauuuuggugguuccugggauauuguugcuaaagacuuuucauuugcuuauuaccacaguuguauauacagauuuagaacuagaaggaacuguagacagcaucuagguaaugcuauuauuuuuuagaagagaccaaacauaaggcauacuucuaaaucaaacuaggagaaacacuaaaugaguauaauugauguaccaucuaguagagaauuuaguagaugcccaauuagauuaacauaagcuuguguaagagaccaacaacaguaacuucugaagacugaaucccaacugauaguuugacacauuauaaauaugccauuuuauauaaauuauucuugccauaauucugcagguuauaacuuguuaacucaaagcugcaaucuuuuccuuuuaguacaguaauacuuuugaaaagggagaggaauauauugcagguaguuuaaaauaguguuuaaaaacuuaaagcaauuuguuaugaaagaagaaguagaagguacguagucucuucaagaucucucauauucccauaaucuguaaggguguggugaucuaaggaagaucuuuugagggauaaaccucuauucuuguaguagugccagcugaauacacaucauauuucuuucugauguaguuauuuauuucuguuguagaauuuucaucucauugauuaucaucuggcagcauucaucacagugaugcuugcgaggaggcuuguaugggcucucaucucagagguaacaguucauugacuauauucuaucacauguagcuagaguuaguuacuagaaugggugcagguuaaaaacgugacguguccccauuuaaugaaacaauaaauuacuuuacucccaugugaguucugccaguacuuuaaaaaauguuucccugcaguguaauuuuuuaaaauucaagugucaaaaacuguuagaaaauucauucguagggucggagcuuguguuccgcuacugaguuuuucaguacaauuuaaacaauuuaaauaguuucaguaaaaauaggaugaauuucagguaacuauuaauacgaaguguuaucuguacacauacaauugcaccuaaaacauucaguuccagauaauauucacuugauacuguuuauauauaccauuugagaagauuguuagcaagaaacauuuauuugaguuucuuagaauuuuaaaaaccagugaguaucagaauucguauaggauuaaucugaagauuagaaucuaaguuuagugagcagaaugagaaagaauuagaacauuaaaugaucuuuuuaaaauuaaaaauuguugacagagcuaggccauugguaucauuuuucuuuccuuuuuuuuuuuuuuuuuuuuuugagacggaguuucacucuuguugcccaggcuggagugcaguggcaugaucucggcucgccacaaccucugucuccuggguacaagcgauuuuccugccucagccucccaaguagcugggauuacaggcaugcgccaccacgccuggcuaauuuuguauuuuuaguagagacgggguuucuccaugucggucaggcuggucucgaacucccgaccucaggugauccaccugccucggccucccgaagugcugggauuacaggcgugagccaccaugccuggccucauuuuucauauauuuguaaaucccaaugaggcagggaaaugugcuuucuuaaaauauuguuaucuugugcucuauaagugauuacaaaaacaaaaaauguuaauuuagcugaaguggcuaauaauuuuaaucuuggaacuuauaauucagugugaaauuuuaaaugaauaguuacuauaaucacaaauaauugagagucaacuucuuuuucccaaaacauacauggaaggucuguguguguaagcucugauuuucaggaacccuauuucuggaagcagaguaacuggaaauacuaagucaagaucugaaaaccauuugaaguuaaccaaaaagcacagguaguaggauuccuuguuuuucacaguaggaacgucuguuuauaaucuuuucuuucagaguuuuuauuuagaggauggaaauagaaacucacuuuuuguuauauugugaaagcauguucuuucuuuagaggaucucaguggaauuuuauguuuucauuuguuaaaauaggaaaugauuuuguuucauuccuucaguuacuuggacaugcuacuuguacauguccaauuaguaugcccaguuaguguguaacccuucaaaacugggauuucuaccuuguugcugcaaagauaacuuaaaugcccuaaaaguaguauagcagcuuuugcauagccuuaguuggaauaggcuugcaauucuuuuuuuuuuuuuuuuuuuuuuuuugagauggagucuggcucugucgccuagguugaagcaggagcacaguggugccaucucagcucaugcaaccucugcuucccagguucgagcgauucuccugccucagccuccugaguagcugggauugcaggcgcccacgaccauacccagcuaauuuuuguguuuuuaguagagacaggguuucacuauguuggccaggcuggucucgaacuucuggucuaaagugauccacccaccuuggccucccaaagugcugggauuacgggugugaucccaagugccuggccaaggcuugcaguucuuaaugggaacagaauacuuaagcuaaauuuaaacaucguuuuaucaaagucuuaauucuauaacuuaauguucaucaguaagggaauguuuaaauaauuuugguacaucuacauaauggaauagcauacagccauugacaacaugaaaauguguuuauguauugaccuccaagauguuaaaugaaaaaagcaaggugcagaacaguguuuaaaaugagacaggagggaacaaaauauauuugcuuauauaugaauaaauuguuuccagaaggacauacaaacuaauaacagguugcacaguugguggcuaggagacaggaucagcaggugggaagcuuuucacuacaagcacuguuacauguuuuguguuuugagugauaugaauguguuaccuauucaaaaauuuaaaauaagagcuguauagugauuuuccuccuaaaauaucuaaauuagauggauaaaaccuaucauaaaucaucuuuccuuccuuccauuaaaauauguuuuccuccuuuuuuugcauauaucacagaaaggaucccuacccugagaaagaucaauaauauuuaaggagaggcugcugguaauuaauucauaaacggaaaugcuauucagagaggacuaccucuccacguagguagaguccguuuauucaccuucaggccagcucugccuguucaccuccaggcuaacucuacuucuauacuugcuucacaagacuagaaauaaauuuagcuguuuuuucaccaaccugaagcaacucucuuuuuaaaaauuguuuuucuaggaaaauaguauauuuuauugaaaaaaauuuggaaaacacuaaaauauaaagcaggacauuuaaaaauugcucacaaucucauuauugaagaccacuuuuuuugggggguggggggcagacagaguuuugcucuugucgcccaggcuguaaauggcaugaucuuggcuuacugcaaccuccgccuccuugguucaagcgauucuccugccucggccucccaaguagcugggauuacuccuugguucaagcgauucuccugccucggccucccaaguagcugggauuacaggcgcccaccaccaugcccagauaauuuuuguauuuuuaguagagacaggguuucaccauguuggccagguuggucucaaacuccagaccucaggugauccaccugccucugccucccaaagugcugggauuacaggugugagccauugcacccggccaaagaccacauuuugcuauauuuucuucugaucuucauaugcguaugaagauuuuauauuuacauuuauuuuacuauauuugagaauuauuuauauacaguuucauauccuguacuuuaaaauuaacauaauguuaugaauauuuuucugccccucaccuagcgaaaucuugcuuauccuuuaggucucagcuuaaauaccguuuacuaacacaagccaucucuagaauaggaucuccuguuauuuacuuuccauagcagccuacucuuccuauagcacucauuacaauuaaaaaaaugauuagauaaaaguuuaauauuuguuuuucuugguuagucagcuucauaagcacagggguuuuguuugucuugguuaccacuguaccccuaggaccugguaaagggucugugacauacaccacagugauuagcggcuuggggcucuggaauaaggcaaaauuaacaaauccaagcucugugcucugaugacauugggcagaaauagucuuuuuuauuucuaacccugaacuuuugagaaggagguaauagaguaacuccaauagcuuaaauaacuuuacuaagcuuugauaugugagguaaauuggcaugaagguauguaucaggggaguuauaugaagcuaugugccaggcuaugacugagaagagcuugagccaucuucacaguuugaggcuuaagccguucauuauggcauuuauucaacugcugcuuugcauuuuaaaguaacuauauauuacguauauaugcuguauauauauaguauucaguauacaguauauugcguauauguuauagguacuccauaauaugaucuguaaacuaagaaacggauauauaggagggaccugaaaagcuccuuauccccuaccauguacuguugacucuagauaauuuuuuucuccuuuuuggguuccaucacugcucucuuagagguuauggggaucuuccauuuuccccuacauuuugcucauucucuucucccuaguucauucagaaagaaaauggcauugcagaguaaguuuugacaaguacuuaauauauuuagucaguuuuaaagauuugcgauugaagaagcauauuugaauagcugugauaaaaagaauuggaagugauuaugcauuauuuccauguuugcaaaaguuaaaaaagaaacuuauuuauauagggaucugucaaagaagaucggauuauuuuuugaaacuucacuaauuuauuaaacauuaauucaccaagcaaauuagaggugaggauucaaagaaaaauaaaaauauuguuacugcuguugaggcccuuuauaguuuagugggaaguaagacagauaaauuagugucucuccauguuuauguacauaaaaaaucaggccgggcacaguggcucaugccuguaaucccagcacuuugggagguggguggaucacgaggucaggaguuaggacaauccuggccaacaugguaaaacccugucucuacuaaaaauacaaaaauuagcugggcguggugguguacgccuguaucccagcuacucaggaggcugaggcaggagaaccgcuugaacccaggaggcagagguugcagugagccaagauugugccacugcacuccagccugggcaacagcaacagagcgagacuuugucucgaaaaaaaaaaauuaaaaauaaauaaauaaauaaaacacugguuaaguuguuaaaauauagguugcuugacucaagauuuuauuccuuaccccuugagaggaaaguuguuaggaguuuacauguccaauuaguagcccaggucauucugauggaacaaaauaaugugauccguggaacauacuuugagaagcuccaauguuaauaaauuagaugauauaaaaagaccuuaaaagaguucuguagauggcacucucggggugcaagaaggaaacaacugugccuggagaagucugaauuuucaauuauuacgaagauaaggugggauggggcaguuuuucuuuuauuucacuuuuuaaagacacauuuuagcuuccacuaaaccuauuaaguucuuacuugaauuacaaugcuuuugaagaagaucauuuacaaaauguucauuuuggugcuuccaaacuuucaggcuacuaaggcaggugcagcaucaaugauucacuacaugguucugauaucagcucgcuugguacuacucacuuuguguggauggguacuuuguuggacccucgucaaucucuuucgaagccauucaguccucaaucuccuuuuccuuggcuacccgugaguacuccaguuuuaccauguuauuaguaaaucuuuagaaauuauuucggucacguaaacgauacuuuuaagagugaaaaaugaaauucuucaaauauaaaugaagcauuuagaaaacugggaaauccaugagcauggugaacauauaauuuguuuucuaaacuggaguacaguugggacaacaggcauaaaccaggacuguccugggaaaccuggaauguaggguguguugccaguggagaauauuuuaauugucucucuucaccaaguaaaggccccucuugcuaucuauauuuggguaaacgguaguuaauuuuagaugaaugcacugguucgaaaaccagucuuacccuugguuggucauauuacuuugaucuucuguuuccuguaacagaaguacaauaaguaguccucccuuauccaugguuuugauuucugaaguuucgguuaccugcgaucaaccaagguccagaaacauuaaauagaaaauuccagaaauaugugacaaauuauguuuuaaauugugugcuguucugaguaguauggugaaauuucucgccaucccauuuugucccaccaggaugugaaucaucucuuuguccaccaugucugugccgugcaugcuaccugucaauuaguugcuuaguagcggacuugguuauuagauggacuggcauggugucacagggcuuguguucacgugaccuuuauuuuacuuaauauggcuccaaaguguaguuaugcucacaauucagguaugccaaaggaaagcuguaaagugcuuccuuuaagugaaaagggaaaguucuugacuuaguaaggaaagacgaaaaaucaugcugagguugcuaagauuuacuguaagaaugaaucuucuauccaugaaauuguaaacaguauauuguuauaauuguucuauuuuauuauuaaucucuuaauguaccuaauuuauaaguuaaaacuuuauuguauguauguguauauaguauaggaaaaaacauaguguauguaggguuugguacuauccaugguuuuaggcauccacugggguguuggaaugucuuccugcagguaagagggucuacucuaugccauauucaagugcuguagacauguauauauauuauuaugauuguaacuaacauuuuauuacaaaaccuuuuaaacauucaacaagguugaaagaauuuuacagcuaucaccaguguaauccuuacccagaugauucugccuauuaauguuuuacuauaacuguguaauacuuaucuguccaucucuccaucccucuauccauuaguccaucuuacuuuugaugcauuucaaaguuaaauuucagaccucaguuugcuuccuccucaauacuucagcauguguguaucauuaacuagagcucgauauuuguugacagcuuuuuuuucuuuugagguuaaauucauauaaauaaaauucccgccgggcgcgguggcucaagccuguaauccuagcacuuugggaggccgaggugggcagaucaccugagguuaguaguucgagaccagccucgccaacauggcgaaaccccgucucuacuaaaaauaaaaaaauuagcagggcgugguggcacgugucuguaaucccaguuacucgggaggcugaggcagaagaaucacucgaacccaggagauggagguugcaaugagccagagccaggaucgcgccauggcacuccagacugggcgacgagcaagacucugucucaaauaaauaaauaaauaaaauaaaauaaaauaaaauucccaaaucuuguguauauggaguuuuguuaaauguggacauaccugugugacuuaauccccugucaagacuucagagcguuacacauacuccacaagauucugucaugccacuuucccaucaaaccccaccacuguccagagacgguugcuuuuuuuuuuugagacaggguuuugcucugucauccaggcgggagugcaguagagcgaucucagcucacugcagccuugaccucucaggcucaagcaauucucccaccucagccucccaaguaguugggacuacaugugcacaccaccaugccccgcuaauuuuuguuuuguuuuguuuuguagagacaggauuuuaccauguugcccaggcugaggaguaagguuuuuuugauuccagagucuuugucuuaaucauuacuguaucaguaguucucaaaauguaguuucuagaacagcagcaucagcaucaccuauaaauuuguuggaaauucucagaaucuaccccaaaccuacugaaauagaaacuggaaaguaggaccuagcaaguuguguuuuaacaagcccucaaggugauucugaugcaugcucaaguuugagaauuacugcuuuauauuauuuauggugcugaaguguuagcgugaauuuauguggguaauuacaaaguauaaaaucaagucauaauuagagauugugcuaauaaggaugacaggaacagucuuucuauugguuauacuauaguaggucugauuacauuguuuaaacaguuauuuaagucacucaucaacugaauucauuaauauuacccuuguuuucuacaaaaugaauuaucuguuacgaacauuuuucaugacucugauuucauaugaggaauauauuuuacaugaauuguuucuauauuuauagauuaauauuucagccauuugaguugaaaauaaauuuuuagucauucuccuuacugguugaaucagaagauuaaccgugucugauuugaacggcuaauuauggguauauugaagaauauuuuggccaaguuuaagaggauuacuauuaucaggauggcuagcaaacuuuucuguuucaauuuaaguauauaaagaaacuuacucuuagaggcucuccacaccccuuaaaacaaugaaauaauuauguaauuuaaauacauuuuaguuuuaaacauacaggcauaccucagagauguuguaaguucuguuccagacugcugcaauaaagcgaauaucacaauaaacgagucaugucaauuuuuugauuuccuagugcauaugaaaguuauguguacacuauacuguagucuauuuuauuuuauuuuauuuuauuuuauuuuuugagacaaggucuugcuguguugcccaggcuggagugcaguggugcaaucacagcucacugcagccuugcccuccuaggauugcucaagcaauccuaggggacugggacuguagccgugugccaccaugccuggcuaauuuuuaaauuuuuuuguagagaucgggucucguuuuguugcccaggcuggucuugaacuccugggcucaagugauccucuugccuuggccucccaaagugcugggguuacagaggggagccaccaugcccagccuuauacuaucuguauucuauuaaguacauaauagcauuaugucuuuuaaaaguacauaucuuaauuaaaaaauacuugauugcuaaaguaugcagaugagcauuugagccuucagugaguuguaaucuugcugguggagagucuugccucaauguugauggcugcugacugaucaggguggugguugcugaagguugggauggcuuugucacuuucuuaaaauaagacaacagugaaguuggccacaucaguugacacuuccuuucaugaaacauaucucuguagcaugugauguguuugauagauaauauuuuacccacaguggaacuucuuucaacauugaagucauuucucucaaacccuauugcugcuguaacaacuaaguuuauauaauauucuaaacucuuugucauuucaacaguguucucagcaucuuuaccagaaauagauuuuaugucaagaaacaacuuucuuauccauaagaagcagcuccuuauccguuuaaguuugauugugagagagugcagccacaucuucaggcuucacuuuuuuuuuuuuuuuuuuuuuuuugagacagggucucacugucgcccagguuggagugcagugguauaaucauggcucacugcaacaucugucuccugggcucaagugauccucccaccucagccucucaaguagcugggacuacaggugugugccaccacacccggcuaauuuuuguauuuuguuuuuuuguagaggugggguuuugcuauguugccuaggcuggugucgaacuccuaggcucaagugauccagccuccuuggcuucccaaagugcugggauuagaggcaugagccacugcaccuaguccaggcuccacuucuaauucuaguucuguugcuuuuucuuccacauuugcgguuacuuucuccagugaagucuugaaccucucaaagucauccaugaggguaggaaucaacuuccuccacauuugcucguguugauauuuugaccuccucucauaaaucacaaauguucucaauggcauuuagcauggugaauuguuuccagaugguuuucaguuuacuuugcccagauccauuggaggaaucucuauuuaaugcagaaauagccuuacaaaacguauuucuuaaauaauaagauuugaaaaucagaauuacuucuugauucauggcugcagaauggaugcuaucuuaacaggcauaaaaacaacaaucuccaucagagccuuuggugacuagguacacugucaaugagcaguaaguacuuuuuuuuuuuuuuuuugagauggagucuuucucuguugcccaggcuggaaugcaguggugugaucucagcucacugcaaccucugccucccagguucaagugauuguccugccucagccucccaaguagcugggacuacaggugcaugccaccaugccuggcuaauuucuuuggauuuuuaguagagucgggguuucgcuauguuggccaugcuggugucgaacuccugaccucaggugcuccgccugccucagccucccaaagugcugggauuacaggcgugagccaccgcacccagccguacauaauauuuuuaaaggaaucuuuuuucuaaaccguagguucaacagugagcuuauucaguaaaccaugcuguaaacagauguacugucauccaaauauguuguucuauuucuagagcauuggcagaguagauuuugcauaauucuuaaggaugguaggauuuuuggaaugguaaauaagcauuggcuuccacuuaaaguuaccagcugcguuagccacuaacaagagagucagcuuauccuuugaagcuuugaagccaggcauugacuucuccucucuagguauggaagucuagauggcaucuucuuccaauacaguauaaggcuguuuugucacccuugaaaagucuguuaguuuagucaccuucaucagugaucuuagcuaggucuucuggauaacuugcuacaguuuguagauucacacuugcuguuucacauugugcuuuuauguuaugggacagcuucuuuccuuaaaccucacgaacuaaccgcuguuaaccuucauacguuucuucuguagcuuucucaccucucuggagguucauagacuuaaaaagaguuagggcuuugcucuggauuaggcuuugguuuagggcaaugucguggcuggucgauccagaccauaucagcaaaacuuucuccauaucagcagugaggcuguuuucuuuguuaccauuuguauguucacuggaguagcacuuuuaauuuccuugaauaacuuuuucuuugcauuuacaauucggcuagcuaauacaagaggcccagcuuucagcuugucugggcuuuugacauguuuucucacuaagcuuaauauccacuuuuugauuuaaagugagagaugugugauguccuuucacuugaacacucggaggccauuuaggguuauuaguuggccuuauuucaauauucuuguguuuuagggaauagggaggucugacgugagggagagagaugggggaauggcucauugauggaacaaugagaacaaacauuuauccauuaaguuugcugucucauauggugcaguuuguagugccccaaaacaauuacaguaguaauaucaaagaucacauuucgcauaacagauguaauaguaaugaaaaaguuugaaauauugggagaauuaccaaaauauggcagagacacaaagugagcacuuuggaaaauggcacccccagauacgcuugaugcaggguugccacaaaccuucaguuuguaauaaauacaguaucugggaagcacaaugaagugaaaugcaauaaaaugagguaugccuguauuugccuucguuacuuuuaagaaguuguauaauccaccuuuuaucuaaacuucaauuuaaaaaucaaaagugcgagaaauuuaaaauacuagauuaugacaauagcaacauguuuaauuuccuguuuauucauagguuaaacuaagaaagaggcccuuuucugccucuuuuucuuaccccucaguucucaaauagcuucucauuagggugaauuagucuaaagucuaacaguugugguuccuaaguguaucuugaauugguccaaugcucuccauaguuuuuacuauugcauuaucaaccuucaucuggucuucugauaauccauucuuguuccccuccauuucauuuuuauuguagcuagaaugauuuucacaaugggaaauuuaaucauguuacuaacccucuuuaaaauccuuuaaugaauuauuuucuuuaccucacaaagcccuccauuguagagcccaguauggggauagggcaggucgccucacccauagaaugagggccaugcaguuauguggcagugagacuacaaaggaggguaaagaauuggggccaucauuacaaucuaccacacacuccagccucuuauccccaccucuacaccuacacaugcagcuuguguuuuggcagcauugaacuucugaugaccugcucuagccaucacagauaugcacaugugagagauuuuugucuaauacuucuucucugucugggugcgguggcuuacaccuguaaucccaccacuuugcaaggcccaggcgguaggaucacuugagcucaggaguucaagaccagccugagcaacauagggagacccuguuucuaccaaaaauaaaauaauuagccgcguguaauggcaugcgccuguaguccuagcuacuuaggaggcugaggcgggagaauugcgugagcccaagaaguugaggcuucagugagccguaaucucgcuacuguacuccagucugggugacagaguaagaccuugucucaaaaaaaaaaaaauuagaauuaauacuucuacuucuacccacucuuguccucccaagggcacauucacaguagaucccagagcuaaugcuaagaauguucuuaauuaguaacaucaguucucccucuguagaaaacuauggauaagugucaucuguucauuuuguuauaaaauguauaacuaaauaucuuuuuuuuuuuuuuuuuugagaaggaguuucacucuuguugcccaggguggagugcaaugugcagucucggcucacugcaaccuccaccuccaggguucaagugauucuccugccucagccuccgaguagcugggauugcaggugcgcgccaccacacccagcuaauuuuuguauuauuaguagagacagaguuuuaccauguugaccaggcuggucuugaacuccugaccucaggugaccugcucgccuuggccucccaaagugcugggauuauaggcaugagggacugucccuggcccuaaauaucuuuuuauuugcuauuuuucauaucugaauuuaugugcaugaaaugaccauuuaauuuauaauaccuaggucacaauguggaaauuacuuaaugaggacuugaaguauuuaaacaaauuuuaaggaaccaacaguuggaauacuauaagaaguuaucagaagucucaaaaauguucacuucuuuaaccaauuaauuuuacugguagaaauucauuuguacuuccagaauuuuuuuuuauuaaugagaaguuuauugcauacuuaaacaguguuacagccacuaucugagguaccagaguuacagcagugaauuaauuacguugaaaucucugguucauagagcuuaaauuguagugaagggaagauugacuaagaaagaaaacaaacaaaacuacccccaaaguuaaaaaucgaauaaacaugguaagaucuguggagaaaaauaagcaggaaaggagaagaagggucgccugugggagugggaugggugauacaguagggaggcaggagggcccccuacuaagaaagggacauuugaaguaaagaacaagcuguacuaaaaugaccaaacguacacacguauugggaaaauccuuaucacauuguuauuuauaguaguggaaaauaagaaacagccuguuuccaacaagagagaaauggguaaauuaugguauuucuauaugagaauacuauuguaucuuuaaaaauuucuauagaaaaauauuuagacuugagaaaauacucacuacacagggaaaauacucaauauacacacaugcacacauacaaaguuuaaacagcaggauacaaaacacaugguacuguaugaagccaaacacaaaaggaaaaaagcauauguaacuauaauacaaaguuuacaaacuuuauauuggaaauaugugcaucuaguuauaaaaaugauuauugcuaagugauguguguuuugccauugugguuuuucuguagguucuuaauaaucuacaaugaaugugcacugcucuuauggaaagaaauugaagagcuccccagauaaugaauuuacuaucagcaaugucccucuugaguuauguuuacuccugcggguccugacuauuuuauugaccuaaguuauaaguuauauugacguaaguuauaaggugugauuuuaggugguaucuguggucucauuuucacacuuuguuuuacagguuugguguuuauguuccucuuugcuguuuucaucaagauaguagagcacaucuucuucucacagacuacaacuaugugguucagcacgaggcaguagaggaaagugccucgacugugggaggcuuggccaaauccaaagacuuucucuccuuguugcuggagucgcuaaaagaacaguuuaauaaugccacacccauccccacccacaguuguccccuaucuccagaccucauucgcaaugaaguagaaugucugaaagcagauuucaaccacagaaucaaggagguucucuucaacucccucuucagugccuacuauguugcauuucucccccuguguuuugugaagguaagugguuaucuuacuuuuaugugcuuccuggauuugugugugaauuacauaaacuggguauuucuuguuuaaucccccuuuucucugucuccccuuuggcagccuggaugguggaguucggcugcaucuggagugcacuaauaccgcuccugguuggcggauagguauuuccauauaugugaugcacccguggugguucccucuuuuuuucuuuuuuuuuuuuuuuuuaaguauuuuuaguuucuggggagaaucaaaauguacuuauaauagaaucaguauguaguagcuuaagaggaccaagguuucaguaaaacucagccuacugugguugaucuuaacaugguuaucaggaguuuccuugaauuuaaucuagcccuuaucuaaacuucaguuuacuuuaauagaaaagaaaaauggucuggaugucacuugggcccaaaaucuuuugguacauuuuagugcccuuucuucacccauucagaaguacuucugcagcuggaaugguccuucagagaacacucaguucuucuagaaaggagacacuuaaaauauaauugccucucccucccaucccuaacucauacagccagaaagucagguugaaggauuguggaggacucugcucuugaacuuuucugcacggacagcaggaccaccagugcaugugugacucaguguggcauuugucugcagggcauauguacaccaacccaucccugccucuuuuuaccagugcauggaucauuucucucucuucugaucucuuccagaguacccaguacuaugacaugcgcuggucaugugagcaccucauuaugguguggaucaaugcuuuugucaugcucaccacgcaacuguugccauccaaauacugugauuugcuacauaaaucagcugcucaccugggcaaguggcagaaguuggaacauggguccuacagcaaugcuccacagcacaugugaguaagcuagaggguaaaaccauguaacacuuucuacaugcugcugaucauguuuauuugcuuuguaugucauucuuguucuuggcuuugaacauuuaauuuuuaguuuuugucuuacauggaugcuugucaucaugcuaaacugaauacaagggacauuaacucauuuccaccaccaccccagcuccuuaaaugcguucuaccuuucagcugcccagucacucuaguguguguaauuugucucccaagcaaugcacuuggcguucucuuucaaucuuaccccuuugcccgaauucaaagagucauauauuuuauuucuuuuuagaagacuuuaagauuugucuucucaucuucauugccacagcugaguaguugcuagcuauucaucucacacuuagcuggaauaugauucucucauuuuuucuuucuaauacaugcaguuuuguucuaguaauuuuccuuaccuguacuuuuuuacuauuauuuucuuucuaaacucucuacugaauauuucccugcuucuccuguguuuaagugagaacugugccugacugaguucuuuggaagaauuuuucucauugugucccccuuaucagucauuacuccacauggcuccuaugauccaaaauggcuaacauuaggaccguuuuauucugucacuucugaguccuucaucauacuuuucuuucagacccaaaccaucuucaucuucccccuuuuguaauuugaacauuucacaaauuucaucuagaaauuuuucccuaguuaagugggacagauugaggugaccuucccuuucccucucccccugagaguucucccuucaauuaucugccuugaugucugauacagauuagcacaggccuucaagcccaggaacugaaagagauugggccaggcugaaaagaaacccgacugugggcaaaggacagauuucaauaaaaauugaaaauacaauccacaguacuaguacuguacaucuucaggcuacugauggcacauggccaugagguguaucaucacuuuaaugcugguaagugugagcaaggccgguggaacauuuucugaacugggaaagcuuuagggugcuagaauuuuuuuuuuuuuuuuuaauaacauaucuaaacugccucccaguucuuauccuaggaaacuaaccuuuccaaaaucaggaagagaugaauuaacuuagauuuuuuuuuuuuuuuuuaaaaagcuuaaccugaagaucccuguccccacccaaacuccauuaugcuggaaagaaugaagcugcugcuucuguaacuucuuuucccccagagaaaccucuauaaaaauaaaccaugaaagcagugaaaagucugugugugugugugagauguaucgcuguguucuacuguauaucuucuuacaguugugagguauuugaauugugugauaagcaaacugauuuccuauaguuuuuugggauguaauucugcaguaaaugucaugcuagauugacaaugugcuaauuucuccacuauucuuauuaccaucagcuuucucuucuuguuuguucccucuagcauuuccaccaguagacucugcucacuugggauggagaugacagucacccugcuuacacacuguuuucuggcuuacacauuuaugucugcucauucuucuaagccucuuaaguccuuugacacugaguuaacuauauuucuuugcaaccucuguuuacuauauagcaaugaaguuaaaguaacaaauccuuucuaaaacuacuccaguuugaccauggaauuacuguauuuucagaauucaggcagaugaagccuugauuauuuaauuccuuccauaaaaauacagcuggccuugccagaugcuaucuuaucuguaauugccaauaugcuaacauugcauuucuuucucccuuaguuggucagaaaauacaauauggccucaaggggugcuggugcggcacagcagauguuuauauagagccauggggccuuacaacguggcagugccuucagauguaucucaugcccgcuuuuaugcaaguaccgcuuauuuauuuucaaacauaagcuuagggguaaguguuaggaggccacucuauguggaagcauguagcauagcauguagcacauacuaggaaauuauuacaugguaauuauugcuacuagcguaacaguggucccuguacuuuggaaaugucuuuugaagggcaguuugaagaucauauacuguuauuccaguuucaguagcuuagcugguuucucuaguuacauugguauuugucgaaucuaguauuacuugaaacaagcaggcaguuaucuaagacuccuuuuucaucuuaccauuuuuguuuuguaagaguuugguuuagugguauuguuaagauauauuguaucuguguauccauagugacauuuaauauauuaauagugcggugguuuuauuuuuagguauuugucauauauauuguuucuuuacaaaggcuuuagcuuccccuuuggaagucagacaaaugccaugaaaaggaaaaaagcuuaaaaguuaaaaaaggaaaaagcaauagaaacccacuacauuccauugaacucaugccuucgguuaugaucuauuuggucuuucagccuuccagaaauugucuguacaaggcaaaaguauauacuuauaaaagaaaggccagcugacuaaugcaaguggggaaaaguaggugccugcaggggacuguuuauaguaaaaaugccuauagugcagugcauugcuuuugaaaggggaucauauucuaaacaagaauuggagaucuuuuuuaagauacuugcaucucuuucucccucuguccuucucaguuccugugaggguauauggacuuucugguucugcagguguuuguuauugagggacacuucaauuaaguuuugggaacuugccccugggcaugaugcuuauaaauaccaugguaggggaaugcaggguggggcagauugggaggaacauggggaagguggaaagcccuugagugagaaaacgacaagcaucuccuucuugacgccaguggaaaugccuuaagguggaggaaaggacuuaagucacaaguacaugagcacuugauuucuauauagaauauuuaauucagccagcugaauucucuaggccauuaaugacuucuguugguccuugcugucuccuugagaccugugauagcgaaauaguucauuagaauuuucugcuugaaaauuaaguaguuuccuugcuagcuuuggacagcugaaaaaucggguggaaucuauggaaaaaagauuaggcaaguugauuuauuacugauuuugcaggacuggauagacaguuaaaucagugcuucuccaagugauccaugggccaccugcugauaaaucaccuggcccacuauuuuuaaaaagugauucagggccccuauaucagacuucugaaccagaaucucuggaugaucccaggaauuggcagcauuuguggauuuggaaaugauucuuaggcacacugaaguuucaaaacagucauuuaaagugugccuauuaccuauagcugucaaacuccagguuaaacauuuucuuccucuugaaccuggaaacuuuuuaaagcugucaugauaauuuggcuucauucugagguguaagcucuuaagaucuaaauuccaucuaaauuaguuauuuuagaucugaucacugcuguuacugcacucuugucuucaucuagauuuaggauuagacugguuaagcugaauuguuaauguucuuuuacaacuuguggccuauauguuuguauucauaauaacuuuguauuagaaaaccagaauuuagccuuuuaaaguggagaauuuagugggaguaaauauaguaguaaucccuauuuuuagucuaauucugacucauuuuuccuuccuuccuccuuauccugucuuugugcacccugcuucucaauauccagaaaaaaaucaguaauuaaacacacagguauaugguguagaggauuucagucagugaccaugguggguaaacaguuuaaggaaaaacuaagaaacuauuguauucauauuugacuuguaaccucucuuuuccccaaacuugucuaguguugguauuuaugucuuaguuuacaagccaagaauguuuuuuacauuuuuaaaugguuacauaaguaccuauguaauauccuuaauuuuugccucuugacuuacaaagccuaaaauauuuccuguuugguccuuuauccaccucugucuuagaugaauauacuuuuguguuuauccuaaauaaaauauauaccuaaaauauaaucuaagaaaaauguuuauaaguaguuuucuuuugggcauaaucucuuuucgugucucaggggcauugaaauaaaaauuauuucauuauuucuugagcaaaaaggaaaagguuucaaucuuuauagcaagaaauagccugauugauauuaaauaaacagaucuauuuauuauuauauaugggaaccuguaaauguuaaauuauuuuagaaaaaucaaugcaagaauaacuguagccauuacuuuucuaugaaauaauguuuuacuuuuuuaacuuccuuacaguucuuauuucaucgaccauuaaggcuguuaaaucugcucauccuuauugagggcagugucgucuucuaucagcucuauuccuugcugcggucggagaaguggaaccacacacuuuccauggcucucauccucuucugcaacuacuauguuuuauuuaaacuucuccgggacagaauaguauuaggcagggcauacuccuacccacucaacaguuaugaacucaaggcaaacuaagcugccucucaacaaugagggagaacucagauaaaaauauuuucauacguucuauuuuuuucuugugauuuuuauaaauauuuaagauauuuuauauuuuguauacuauuauguuuugaaagucgggaagaguaagggauauuaaauguauccguaaacaaggugaugugaucuuucauguguuaguauauucgaauaauauacauaugagagguaugccuguccaguaaagagauugauuuguuuguauggcucuggaauaacucauucguuuaugaacacaucucauguauuacuugacacaguaccuuugguaugucugcuuuucuuucaauccucauuaucuuuagcccucagcuggccaguacuuauugcuaaagaaagggagaucaauggaguugccuaccagcacccauucucuuuuaguucagcuggcuaauaguauuggaauacauugggaaaagaguggguuaaaguccuaggugggguucucuuuguugccuaccaggagaaagcaguaggcuuccuuucuaagauacggacucagcuggucuauuuuacccugugacauuuaaauauacuuuugaauaagcuacuauccugaggcugaggguuuugcugccacuuuuccuguguuuccacuucugcuuccaaagauuuuccucuuaguuguuugaaauaauacuuugccagacaggaagucuuuagacugcccacauucaugaagaagaugauguguggcuggaucaguaggagaagcugagugcaaaugccaugugggcuagaguaugggaagguugaaaauuccaaguaacugggagagugggcaaguccucagcugaacaaucuuggauguagucuagcagcaacccaccuacaauggcguuauguuuggaguuaugaggggaagugaaagauaagaauuaccuacagcuuuguacucagauaauuuauauccaaaauuuguguuuuaaauuucauacuccagaacuuucauguuuaugaguauuagccuuuuaaguuaugggaggugauauacuuaguccauugauguugucacuugucaucuaaacuuaugagaccuugucuuagagaaucuaaaauauauugucauauguuuucugugc

SEQ ID NO: 192632 - RNA, 32771 nt, Homo sapiens
gcacagaaaacauaugacaauauauuuuagauucucuaagacaaggucucauaaguuuagaugacaagugacaacaucaauggacuaaguauaucaccucccauaacuuaaaaggcuaauacucauaaacaugaaaguucuggaguaugaaauuuaaaacacaaauuuuggauauaaauuaucugaguacaaagcuguagguaauucuuaucuuucacuuccccucauaacuccaaacauaacgccauuguagguggguugcugcuagacuacauccaagauuguucagcugaggacuugcccacucucccaguuacuuggaauuuucaaccuucccauacucuagcccacauggcauuugcacucagcuucuccuacugauccagccacacaucaucuucuucaugaaugugggcagucuaaagacuuccugucuggcaaaguauuauuucaaacaacuaagaggaaaaucuuuggaagcagaaguggaaacacaggaaaaguggcagcaaaacccucagccucaggauaguagcuuauucaaaaguauauuuaaaugucacaggguaaaauagaccagcugaguccguaucuuagaaaggaagccuacugcuuucuccugguaggcaacaaagagaaccccaccuaggacuuuaacccacucuuuucccaauguauuccaauacuauuagccagcugaacuaaaagagaaugggugcugguaggcaacuccauugaucucccuuucuuuagcaauaaguacuggccagcugagggcuaaagauaaugaggauugaaagaaaagcagacauaccaaagguacugugucaaguaauacaugagauguguucauaaacgaaugaguuauuccagagccauacaaacaaaucaaucucuuuacuggacaggcauaccucucauauguauauuauucgaauauacuaacacaugaaagaucacaucaccuuguuuacggauacauuuaauaucccuuacucuucccgacuuucaaaacauaauaguauacaaaauauaaaauaucuuaaauauuuauaaaaaucacaagaaaaaaauagaacguaugaaaauauuuuuaucugaguucucccucauuguugagaggcagcuuaguuugccuugaguucauaacuguugaguggguaggaguaugcccugccuaauacuauucugucccggagaaguuuaaauaaaacauaguaguugcagaagaggaugagagccauggaaagugugugguuccacuucuccgaccgcagcaaggaauagagcugauagaagacgacacugcccucaauaaggaugagcagauuuaacagccuuaauggucgaugaaauaagaacuguaaggaaguuaaaaaaguaaaacauuauuucauagaaaaguaauggcuacaguuauucuugcauugauuuuucuaaaauaauuuaacauuuacagguucccauauauaauaauaaauagaucuguuuauuuaauaucaaucaggcuauuucuugcuauaaagauugaaaccuuuuccuuuuugcucaagaaauaaugaaauaauuuuuauuucaaugccccugagacacgaaaagagauuaugcccaaaagaaaacuacuuauaaacauuuuucuuagauuauauuuuagguauauauuuuauuuaggauaaacacaaaaguauauucaucuaagacagagguggauaaaggaccaaacaggaaauauuuuaggcuuuguaagucaagaggcaaaaauuaaggauauuacauagguacuuauguaaccauuuaaaaauguaaaaaacauucuuggcuuguaaacuaagacauaaauaccaacacuagacaaguuuggggaaaagagagguuacaagucaaauaugaauacaauaguuucuuaguuuuuccuuaaacuguuuacccaccauggucacugacugaaauccucuacaccauauaccuguguguuuaauuacugauuuuuuucuggauauugagaagcagggugcacaaagacaggauaaggaggaaggaaggaaaaaugagucagaauuagacuaaaaauagggauuacuacuauauuuacucccacuaaauucuccacuuuaaaaggcuaaauucugguuuucuaauacaaaguuauuaugaauacaaacauauaggccacaaguuguaaaagaacauuaacaauucagcuuaaccagucuaauccuaaaucuagaugaagacaagagugcaguaacagcagugaucagaucuaaaauaacuaauuuagauggaauuuagaucuuaagagcuuacaccucagaaugaagccaaauuaucaugacagcuuuaaaaaguuuccagguucaagaggaagaaaauguuuaaccuggaguuugacagcuauagguaauaggcacacuuuaaaugacuguuuugaaacuucagugugccuaagaaucauuuccaaauccacaaaugcugccaauuccugggaucauccagagauucugguucagaagucugauauaggggcccugaaucacuuuuuaaaaauagugggccaggugauuuaucagcagguggcccauggaucacuuggagaagcacugauuuaacugucuauccaguccugcaaaaucaguaauaaaucaacuugccuaaucuuuuuuccauagauuccacccgauuuuucagcuguccaaagcuagcaaggaaacuacuuaauuuucaagcagaaaauucuaaugaacuauuucgcuaucacaggucucaaggagacagcaaggaccaacagaagucauuaauggccuagagaauucagcuggcugaauuaaauauucuauauagaaaucaagugcucauguacuugugacuuaaguccuuuccuccaccuuaaggcauuuccacuggcgucaagaaggagaugcuugucguuuucucacucaagggcuuuccaccuuccccauguuccucccaaucugccccacccugcauuccccuaccaugguauuuauaagcaucaugcccaggggcaaguucccaaaacuuaauugaagugucccucaauaacaaacaccugcagaaccagaaaguccauauacccucacaggaacugagaaggacagagggagaaagagaugcaaguaucuuaaaaaagaucuccaauucuuguuuagaauaugauccccuuucaaaagcaaugcacugcacuauaggcauuuuuacuauaaacaguccccugcaggcaccuacuuuuccccacuugcauuagucagcuggccuuucuuuuauaaguauauacuuuugccuuguacagacaauuucuggaaggcugaaagaccaaauagaucauaaccgaaggcaugaguucaauggaauguaguggguuucuauugcuuuuuccuuuuuuaacuuuuaagcuuuuuuccuuuucauggcauuugucugacuuccaaaggggaagcuaaagccuuuguaaagaaacaauauauaugacaaauaccuaaaaauaaaaccaccgcacuauuaauauauuaaaugucacuauggauacacagauacaauauaucuuaacaauaccacuaaaccaaacucuuacaaaacaaaaaugguaagaugaaaaaggagucuuagauaacugccugcuuguuucaaguaauacuagauucgacaaauaccaauguaacuagagaaaccagcuaagcuacugaaacuggaauaacaguauaugaucuucaaacugcccuucaaaagacauuuccaaaguacagggaccacuguuacgcuaguagcaauaauuaccauguaauaauuuccuaguaugugcuacaugcuaugcuacaugcuuccacauagaguggccuccuaacacuuaccccuaagcuuauguuugaaaauaaauaagcgguacuugcauaaaagcgggcaugagauacaucugaaggcacugccacguuguaaggccccauggcucuauauaaacaucugcugugccgcaccagcaccccuugaggccauauuguauuuucugaccaacuaagggagaaagaaaugcaauguuagcauauuggcaauuacagauaagauagcaucuggcaaggccagcuguauuuuuauggaaggaauuaaauaaucaaggcuucaucugccugaauucugaaaauacaguaauuccauggucaaacuggaguaguuuuagaaaggauuuguuacuuuaacuucauugcuauauaguaaacagagguugcaaagaaauauaguuaacucagugucaaaggacuuaagaggcuuagaagaaugagcagacauaaauguguaagccagaaaacaguguguaagcagggugacugucaucuccaucccaagugagcagagucuacugguggaaaugcuagagggaacaaacaagaagagaaagcugaugguaauaagaauaguggagaaauuagcacauugucaaucuagcaugacauuuacugcagaauuacaucccaaaaaacuauaggaaaucaguuugcuuaucacacaauucaaauaccucacaacuguaagaagauauacaguagaacacagcgauacaucucacacacacacacagacuuuucacugcuuucaugguuuauuuuuauagagguuucucugggggaaaagaaguuacagaagcagcagcuucauucuuuccagcauaauggaguuuggguggggacagggaucuucagguuaagcuuuuuaaaaaaaaaaaaaaaaaucuaaguuaauucaucucuuccugauuuuggaaagguuaguuuccuaggauaagaacugggaggcaguuuagauauguuauuaaaaaaaaaaaaaaaaauucuagcacccuaaagcuuucccaguucagaaaauguuccaccggccuugcucacacuuaccagcauuaaagugaugauacaccucauggccaugugccaucaguagccugaagauguacaguacuaguacuguggauuguauuuucaauuuuuauugaaaucuguccuuugcccacagucggguuucuuuucagccuggcccaaucucuuucaguuccugggcuugaaggccugugcuaaucuguaucagacaucaaggcagauaauugaagggagaacucucagggggagagggaaagggaaggucaccucaaucugucccacuuaacuagggaaaaauuucuagaugaaauuugugaaauguucaaauuacaaaagggggaagaugaagaugguuugggucugaaagaaaaguaugaugaaggacucagaagugacagaauaaaacgguccuaauguuagccauuuuggaucauaggagccauguggaguaaugacugauaagggggacacaaugagaaaaauucuuccaaagaacucagucaggcacaguucucacuuaaacacaggagaagcagggaaauauucaguagagaguuuagaaagaaaauaauaguaaaaaaguacagguaaggaaaauuacuagaacaaaacugcauguauuagaaagaaaaaaugagagaaucauauuccagcuaagugugagaugaauagcuagcaacuacucagcuguggcaaugaagaugagaagacaaaucuuaaagucuucuaaaaagaaauaaaauauaugacucuuugaauucgggcaaagggguaagauugaaagagaacgccaagugcauugcuugggagacaaauuacacacacuagagugacugggcagcugaaagguagaacgcauuuaaggagcugggguggugguggaaaugaguuaaugucccuuguauucaguuuagcaugaugacaagcauccauguaagacaaaaacuaaaaauuaaauguucaaagccaagaacaagaaugacauacaaagcaaauaaacaugaucagcagcauguagaaaguguuacaugguuuuacccucuagcuuacucacaugugcuguggagcauugcuguaggacccauguuccaacuucugccacuugcccaggugagcagcugauuuauguagcaaaucacaguauuuggauggcaacaguugcguggugagcaugacaaaagcauugauccacaccauaaugaggugcucacaugaccagcgcaugucauaguacuggguacucuggaagagaucagaagagagagaaaugauccaugcacugguaaaaagaggcagggauggguugguguacauaugcccugcagacaaaugccacacugagucacacaugcacuggugguccugcuguccgugcagaaaaguucaagagcagaguccuccacaauccuucaaccugacuuucuggcuguaugaguuagggaugggagggagaggcaauuauauuuuaagugucuccuuucuagaagaacugaguguucucugaaggaccauuccagcugcagaaguacuucugaaugggugaagaaagggcacuaaaauguaccaaaagauuuugggcccaagugacauccagaccauuuuucuuuucuauuaaaguaaacugaaguuuagauaagggcuagauuaaauucaaggaaacuccugauaaccauguuaagaucaaccacaguaggcugaguuuuacugaaaccuugguccucuuaagcuacuacauacugauucuauuauaaguacauuuugauucuccccagaaacuaaaaauacuuaaaaaaaaaaaaaaaaagaaaaaaagagggaaccaccacgggugcaucacauauauggaaauaccuauccgccaaccaggagcgguauuagugcacuccagaugcagccgaacuccaccauccaggcugccaaaggggagacagagaaaagggggauuaaacaagaaauacccaguuuauguaauucacacacaaauccaggaagcacauaaaaguaagauaaccacuuaccuucacaaaacacagggggagaaaugcaacauaguaggcacugaagagggaguugaagagaaccuccuugauucugugguugaaaucugcuuucagacauucuacuucauugcgaaugaggucuggagauaggggacaacuguggguggggauggguguggcauuauuaaacuguucuuuuagcgacuccagcaacaaggagagaaagucuuuggauuuggccaagccucccacagucgaggcacuuuccucuacugccucgugcugaaccacauaguuguagucugugagaagaagaugugcucuacuaucuugaugaaaacagcaaagaggaacauaaacaccaaaccuguaaaacaaagugugaaaaugagaccacagauaccaccuaaaaucacaccuuauaacuuacgucaauauaacuuauaacuuaggucaauaaaauagucaggacccgcaggaguaaacauaacucaagagggacauugcugauaguaaauucauuaucuggggagcucuucaauuucuuuccauaagagcagugcacauucauuguagauuauuaagaaccuacagaaaaaccacaauggcaaaacacacaucacuuagcaauaaucauuuuuauaacuagaugcacauauuuccaauauaaaguuuguaaacuuuguauuauaguuacauaugcuuuuuuccuuuuguguuuggcuucauacaguaccauguguuuuguauccugcuguuuaaacuuuguaugugugcauguguguauauugaguauuuucccuguguagugaguauuuucucaagucuaaauauuuuucuauagaaauuuuuaaagauacaauaguauucucauauagaaauaccauaauuuacccauuucucucuuguuggaaacaggcuguuucuuauuuuccacuacuauaaauaacaaugugauaaggauuuucccaauacguguguacguuuggucauuuuaguacagcuuguucuuuacuucaaaugucccuuucuuaguagggggcccuccugccucccuacuguaucacccaucccacucccacaggcgacccuucuucuccuuuccugcuuauuuuucuccacagaucuuaccauguuuauucgauuuuuaacuuuggggguaguuuuguuuguuuucuuucuuagucaaucuucccuucacuacaauuuaagcucuaugaaccagagauuucaacguaauuaauucacugcuguaacucugguaccucagauaguggcuguaacacuguuuaaguaugcaauaaacuucucauuaauaaaaaaaaauucuggaaguacaaaugaauuucuaccaguaaaauuaauugguuaaagaagugaacauuuuugagacuucugauaacuucuuauaguauuccaacuguugguuccuuaaaauuuguuuaaauacuucaaguccucauuaaguaauuuccacauugugaccuagguauuauaaauuaaauggucauuucaugcacauaaauucagauaugaaaaauagcaaauaaaaagauauuuagggccagggacagucccucaugccuauaaucccagcacuuugggaggccaaggcgagcaggucaccugaggucaggaguucaagaccagccuggucaacaugguaaaacucugucucuacuaauaauacaaaaauuagcugggugugguggcgcgcaccugcaaucccagcuacucggaggcugaggcaggagaaucacuugaacccuggagguggagguugcagugagccgagacugcacauugcacuccacccugggcaacaagagugaaacuccuucucaaaaaaaaaaaaaaaaaagauauuuaguuauacauuuuauaacaaaaugaacagaugacacuuauccauaguuuucuacagagggagaacugauguuacuaauuaagaacauucuuagcauuagcucugggaucuacugugaaugugcccuugggaggacaagaguggguagaaguagaaguauuaauucuaauuuuuuuuuuuuugagacaaggucuuacucugucacccagacuggaguacaguagcgagauuacggcucacugaagccucaacuucuugggcucacgcaauucucccgccucagccuccuaaguagcuaggacuacaggcgcaugccauuacacgcggcuaauuauuuuauuuuugguagaaacagggucucccuauguugcucaggcuggucuugaacuccugagcucaagugauccuaccgccugggccuugcaaaguggugggauuacagguguaagccaccgcacccagacagagaagaaguauuagacaaaaaucucucacaugugcauaucugugauggcuagagcaggucaucagaaguucaaugcugccaaaacacaagcugcauguguagguguagagguggggauaagaggcuggagugugugguagauuguaaugauggccccaauucuuuacccuccuuuguagucucacugccacauaacugcauggcccucauucuaugggugaggcgaccugcccuauccccauacugggcucuacaauggagggcuuugugagguaaagaaaauaauucauuaaaggauuuuaaagaggguuaguaacaugauuaaauuucccauugugaaaaucauucuagcuacaauaaaaaugaaauggaggggaacaagaauggauuaucagaagaccagaugaagguugauaaugcaauaguaaaaacuauggagagcauuggaccaauucaagauacacuuaggaaccacaacuguuagacuuuagacuaauucacccuaaugagaagcuauuugagaacugagggguaagaaaaagaggcagaaaagggccucuuucuuaguuuaaccuaugaauaaacaggaaauuaaacauguugcuauugucauaaucuaguauuuuaaauuucucgcacuuuugauuuuuaaauugaaguuuagauaaaagguggauuauacaacuucuuaaaaguaacgaaggcaaauacaggcauaccucauuuuauugcauuucacuucauugugcuucccagauacuguauuuauuacaaacugaagguuuguggcaacccugcaucaagcguaucugggggugccauuuuccaaagugcucacuuugugucucugccauauuuugguaauucucccaauauuucaaacuuuuucauuacuauuacaucuguuaugcgaaaugugaucuuugauauuacuacuguaauuguuuuggggcacuacaaacugcaccauaugagacagcaaacuuaauggauaaauguuuguucucauuguuccaucaaugagccauucccccaucucucucccucacgucagaccucccuauucccuaaaacacaagaauauugaaauaaggccaacuaauaacccuaaauggccuccgaguguucaagugaaaggacaucacacaucucucacuuuaaaucaaaaaguggauauuaagcuuagugagaaaacaugucaaaagcccagacaagcugaaagcugggccucuuguauuagcuagccgaauuguaaaugcaaagaaaaaguuauucaaggaaauuaaaagugcuacuccagugaacauacaaaugguaacaaagaaaacagccucacugcugauauggagaaaguuuugcugauauggucuggaucgaccagccacgacauugcccuaaaccaaagccuaauccagagcaaagcccuaacucuuuuuaagucuaugaaccuccagagaggugagaaagcuacagaagaaacguaugaagguuaacagcgguuaguucgugagguuuaaggaaagaagcugucccauaacauaaaagcacaaugugaaacagcaagugugaaucuacaaacuguagcaaguuauccagaagaccuagcuaagaucacugaugaaggugacuaaacuaacagacuuuucaagggugacaaaacagccuuauacuguauuggaagaagaugccaucuagacuuccauaccuagagaggagaagucaaugccuggcuucaaagcuucaaaggauaagcugacucucuuguuaguggcuaacgcagcugguaacuuuaaguggaagccaaugcuuauuuaccauuccaaaaauccuaccauccuuaagaauuaugcaaaaucuacucugccaaugcucuagaaauagaacaacauauuuggaugacaguacaucuguuuacagcaugguuuacugaauaagcucacuguugaaccuacgguuuagaaaaaagauuccuuuaaaaauauuauguacggcugggugcgguggcucacgccuguaaucccagcacuuugggaggcugaggcaggcggagcaccugaggucaggaguucgacaccagcauggccaacauagcgaaaccccgacucuacuaaaaauccaaagaaauuagccaggcaugguggcaugcaccuguagucccagcuacuugggaggcugaggcaggacaaucacuugaaccugggaggcagagguugcagugagcugagaucacaccacugcauuccagccugggcaacagagaaagacuccaucucaaaaaaaaaaaaaaaaaguacuuacugcucauugacaguguaccuagucaccaaaggcucugauggagauuguuguuuuuaugccuguuaagauagcauccauucugcagccaugaaucaagaaguaauucugauuuucaaaucuuauuauuuaagaaauacguuuuguaaggcuauuucugcauuaaauagagauuccuccaauggaucugggcaaaguaaacugaaaaccaucuggaaacaauucaccaugcuaaaugccauugagaacauuugugauuuaugagaggaggucaaaauaucaacacgagcaaauguggaggaaguugauuccuacccucauggaugacuuugagagguucaagacuucacuggagaaaguaaccgcaaauguggaagaaaaagcaacagaacuagaauuagaaguggagccuggacuaggugcaguggcucaugccucuaaucccagcacuuugggaagccaaggaggcuggaucacuugagccuaggaguucgacaccagccuaggcaacauagcaaaaccccaccucuacaaaaaaacaaaauacaaaaauuagccgggugugguggcacacaccuguagucccagcuacuugagaggcugaggugggaggaucacuugagcccaggagacagauguugcagugagccaugauuauaccacugcacuccaaccugggcgacagugagacccugucucaaaaaaaaaaaaaaaaaaaaaaaagugaagccugaagauguggcugcacucucucacaaucaaacuuaaacggauaaggagcugcuucuuauggauaagaaaguuguuucuugacauaaaaucuauuucugguaaagaugcugagaacacuguugaaaugacaaagaguuuagaauauuauauaaacuuaguuguuacagcagcaauaggguuugagagaaaugacuucaauguugaaagaaguuccacuguggguaaaauauuaucuaucaaacacaucacaugcuacagagauauguuucaugaaaggaagugucaacugauguggccaacuucacuguugucuuauuuuaagaaagugacaaagccaucccaaccuucagcaaccaccacccugaucagucagcagccaucaacauugaggcaagacucuccaccagcaagauuacaacucacugaaggcucaaaugcucaucugcauacuuuagcaaucaaguauuuuuuaauuaagauauguacuuuuaaaagacauaaugcuauuauguacuuaauagaauacagauaguauaaggcugggcaugguggcuccccucuguaaccccagcacuuugggaggccaaggcaagaggaucacuugagcccaggaguucaagaccagccugggcaacaaaacgagacccgaucucuacaaaaaaauuuaaaaauuagccaggcaugguggcacacggcuacagucccaguccccuaggauugcuugagcaauccuaggagggcaaggcugcagugagcugugauugcaccacugcacuccagccugggcaacacagcaagaccuugucucaaaaaauaaaauaaaauaaaauaaaauaaaauagacuacaguauaguguacacauaacuuucauaugcacuaggaaaucaaaaaauugacaugacucguuuauugugauauucgcuuuauugcagcagucuggaacagaacuuacaacaucucugagguaugccuguauguuuaaaacuaaaauguauuuaaauuacauaauuauuucauuguuuuaagggguguggagagccucuaagaguaaguuucuuuauauacuuaaauugaaacagaaaaguuugcuagccauccugauaauaguaauccucuuaaacuuggccaaaauauucuucaauauacccauaauuagccguucaaaucagacacgguuaaucuucugauucaaccaguaaggagaaugacuaaaaauuuauuuucaacucaaauggcugaaauauuaaucuauaaauauagaaacaauucauguaaaauauauuccucauaugaaaucagagucaugaaaaauguucguaacagauaauucauuuuguagaaaacaaggguaauauuaaugaauucaguugaugagugacuuaaauaacuguuuaaacaauguaaucagaccuacuauaguauaaccaauagaaagacuguuccugucauccuuauuagcacaaucucuaauuaugacuugauuuuauacuuuguaauuacccacauaaauucacgcuaacacuucagcaccauaaauaauauaaagcaguaauucucaaacuugagcaugcaucagaaucaccuugagggcuuguuaaaacacaacuugcuagguccuacuuuccaguuucuauuucaguagguuugggguagauucugagaauuuccaacaaauuuauaggugaugcugaugcugcuguucuagaaacuacauuuugagaacuacugauacaguaaugauuaagacaaagacucuggaaucaaaaaaaccuuacuccucagccugggcaacaugguaaaauccugucucuacaaaacaaaacaaaacaaaaauuagcggggcaugguggugugcacauguagucccaacuacuugggaggcugaggugggagaauugcuugagccugagaggucaaggcugcagugagcugagaucgcucuacugcacucccgccuggaugacagagcaaaacccugucucaaaaaaaaaaagcaaccgucucuggacaguggugggguuugaugggaaaguggcaugacagaaucuuguggaguauguguaacgcucugaagucuugacaggggauuaagucacacagguauguccacauuuaacaaaacuccauauacacaagauuugggaauuuuauuuuauuuuauuuuauuuauuuauuuauuugagacagagucuugcucgucgcccagucuggagugccauggcgcgauccuggcucuggcucauugcaaccuccaucuccuggguucgagugauucuucugccucagccucccgaguaacugggauuacagacacgugccaccacgcccugcuaauuuuuuuauuuuuaguagagacgggguuucgccauguuggcgaggcuggucucgaacuacuaaccucaggugaucugcccaccucggccucccaaagugcuaggauuacaggcuugagccaccgcgcccggcgggaauuuuauuuauaugaauuuaaccucaaaagaaaaaaaagcugucaacaaauaucgagcucuaguuaaugauacacacaugcugaaguauugaggaggaagcaaacugaggucugaaauuuaacuuugaaaugcaucaaaaguaagauggacuaauggauagagggauggagagauggacagauaaguauuacacaguuauaguaaaacauuaauaggcagaaucaucuggguaaggauuacacuggugauagcuguaaaauucuuucaaccuuguugaauguuuaaaagguuuuguaauaaaauguuaguuacaaucauaauaauauauauacaugucuacagcacuugaauauggcauagaguagacccucuuaccugcaggaagacauuccaacaccccaguggaugccuaaaaccauggauaguaccaaacccuacauacacuauguuuuuuccuauacuauauacacauacauacaauaaaguuuuaacuuauaaauuagguacauuaagagauuaauaauaaaauagaacaauuauaacaauauacuguuuacaauuucauggauagaagauucauucuuacaguaaaucuuagcaaccucagcaugauuuuucgucuuuccuuacuaagucaagaacuuucccuuuucacuuaaaggaagcacuuuacagcuuuccuuuggcauaccugaauugugagcauaacuacacuuuggagccauauuaaguaaaauaaaggucacgugaacacaagcccugugacaccaugccaguccaucuaauaaccaaguccgcuacuaagcaacuaauugacagguagcaugcacggcacagacaugguggacaaagagaugauucacauccuggugggacaaaaugggauggcgagaaauuucaccauacuacucagaacagcacacaauuuaaaacauaauuugucacauauuucuggaauuuucuauuuaauguuucuggaccuugguugaucgcagguaaccgaaacuucagaaaucaaaaccauggauaagggaggacuacuuauuguacuucuguuacaggaaacagaagaucaaaguaauaugaccaaccaaggguaagacugguuuucgaaccagugcauucaucuaaaauuaacuaccguuuacccaaauauagauagcaagaggggccuuuacuuggugaagagagacaauuaaaauauucuccacuggcaacacacccuacauuccagguuucccaggacaguccugguuuaugccuguugucccaacuguacuccaguuuagaaaacaaauuauauguucaccaugcucauggauuucccaguuuucuaaaugcuucauuuauauuugaagaauuucauuuuucacucuuaaaaguaucguuuacgugaccgaaauaauuucuaaagauuuacuaauaacaugguaaaacuggaguacucacggguagccaaggaaaaggagauugaggacugaauggcuucgaaagagauugacgaggguccaacaaaguacccauccacacaaagugaguaguaccaagcgagcugauaucagaaccauguagugaaucauugaugcugcaccugccuuaguagccugaaaguuuggaagcaccaaaaugaacauuuuguaaaugaucuucuucaaaagcauuguaauucaaguaagaacuuaauagguuuaguggaagcuaaaaugugucuuuaaaaagugaaauaaaagaaaaacugccccaucccaccuuaucuucguaauaauugaaaauucagacuucuccaggcacaguuguuuccuucuugcaccccgagagugccaucuacagaacucuuuuaaggucuuuuuauaucaucuaauuuauuaacauuggagcuucucaaaguauguuccacggaucacauuauuuuguuccaucagaaugaccugggcuacuaauuggacauguaaacuccuaacaacuuuccucucaagggguaaggaauaaaaucuugagucaagcaaccuauauuuuaacaacuuaaccaguguuuuauuuauuuauuuauuuuuaauuuuuuuuuuucgagacaaagucucgcucuguugcuguugcccaggcuggagugcaguggcacaaucuuggcucacugcaaccucugccuccuggguucaagcgguucuccugccucagccuccugaguagcugggauacaggcguacaccaccacgcccagcuaauuuuuguauuuuuaguagagacaggguuuuaccauguuggccaggauuguccuaacuccugaccucgugauccacccaccucccaaagugcugggauuacaggcaugagccacugugcccggccugauuuuuuauguacauaaacauggagagacacuaauuuaucugucuuacuucccacuaaacuauaaagggccucaacagcaguaacaauauuuuuauuuuucuuugaauccucaccucuaauuugcuuggugaauuaauguuuaauaaauuagugaaguuucaaaaaauaauccgaucuucuuugacagaucccuauauaaauaaguuucuuuuuuaacuuuugcaaacauggaaauaaugcauaaucacuuccaauucuuuuuaucacagcuauucaaauaugcuucuucaaucgcaaaucuuuaaaacugacuaaauauauuaaguacuugucaaaacuuacucugcaaugccauuuucuuucugaaugaacuagggagaagagaaugagcaaaauguaggggaaaauggaagauccccauaaccucuaagagagcagugauggaacccaaaaaggagaaaaaaauuaucuagagucaacaguacaugguaggggauaaggagcuuuucaggucccuccuauauauccguuucuuaguuuacagaucauauuauggaguaccuauaacauauacgcaauauacuguauacugaauacuauauauauacagcauauauacguaauauauaguuacuuuaaaaugcaaagcagcaguugaauaaaugccauaaugaacggcuuaagccucaaacugugaagauggcucaagcucuucucagucauagccuggcacauagcuucauauaacuccccugauacauaccuucaugccaauuuaccucacauaucaaagcuuaguaaaguuauuuaagcuauuggaguuacucuauuaccuccuucucaaaaguucaggguuagaaauaaaaaagacuauuucugcccaaugucaucagagcacagagcuuggauuuguuaauuuugccuuauuccagagccccaagccgcuaaucacugugguguaugucacagacccuuuaccagguccuagggguacagugguaaccaagacaaacaaaaccccugugcuuaugaagcugacuaaccaagaaaaacaaauauuaaacuuuuaucuaaucauuuuuuuaauuguaaugagugcuauaggaagaguaggcugcuauggaaaguaaauaacaggagauccuauucuagagauggcuuguguuaguaaacgguauuuaagcugagaccuaaaggauaagcaagauuucgcuaggugaggggcagaaaaauauucauaacauuauguuaauuuuaaaguacaggauaugaaacuguauauaaauaauucucaaauauaguaaaauaaauguaaauauaaaaucuucauacgcauaugaagaucagaagaaaauauagcaaaauguggucuuuggccgggugcaauggcucacaccuguaaucccagcacuuugggaggcagaggcagguggaucaccugaggucuggaguuugagaccaaccuggccaacauggugaaacccugucucuacuaaaaauacaaaaauuaucugggcaugguggugggcgccuguaaucccagcuacuugggaggccgaggcaggagaaucgcuugaaccaaggaguaaucccagcuacuugggaggccgaggcaggagaaucgcuugaaccaaggaggcggagguugcaguaagccaagaucaugccauuuacagccugggcgacaagagcaaaacucugucugccccccaccccccaaaaaaaguggucuucaauaaugagauugugagcaauuuuuaaauguccugcuuuauauuuuaguguuuuccaaauuuuuuucaauaaaauauacuauuuuccuagaaaaacaauuuuuaaaaagagaguugcuucagguuggugaaaaaacagcuaaauuuauuucuagucuugugaagcaaguauagaaguagaguuagccuggaggugaacaggcagagcuggccugaaggugaauaaacggacucuaccuacguggagagguaguccucucugaauagcauuuccguuuaugaauuaauuaccagcagccucuccuuaaauauuauugaucuuucucaggguagggauccuuucugugauauaugcaaaaaaaggaggaaaacauauuuuaauggaaggaaggaaagaugauuuaugauagguuuuauccaucuaauuuagauauuuuaggaggaaaaucacuauacagcucuuauuuuaaauuuuugaauagguaacacauucauaucacucaaaacacaaaacauguaacagugcuuguagugaaaagcuucccaccugcugauccugucuccuagccaccaacugugcaaccuguuauuaguuuguauguccuucuggaaacaauuuauucauauauaagcaaauauauuuuguucccuccugucucauuuuaaacacuguucugcaccuugcuuuuuucauuuaacaucuuggaggucaauacauaaacacauuuucauguugucaauggcuguaugcuauuccauuauguagauguaccaaaauuauuuaaacauucccuuacugaugaacauuaaguuauagaauuaagacuuugauaaaacgauguuuaaauuuagcuuaaguauucuguucccauuaagaacugcaagccuuggccaggcacuugggaucacacccguaaucccagcacuuugggaggccaagguggguggaucacuuuagaccagaaguucgagaccagccuggccaacauagugaaacccugucucuacuaaaaacacaaaaauuagcuggguauggucgugggcgccugcaaucccagcuacucaggaggcugaggcaggagaaucgcucgaaccugggaagcagagguugcaugagcugagauggcaccacugugcuccugcuucaaccuaggcgacagagccagacuccaucucaaaaaaaaaaaaaaaaaaaaaaaaagaauugcaagccuauuccaacuaaggcuaugcaaaagcugcuauacuacuuuuagggcauuuaaguuaucuuugcagcaacaagguagaaaucccaguuuugaaggguuacacacuaacugggcauacuaauuggacauguacaaguagcauguccaaguaacugaaggaaugaaacaaaaucauuuccuauuuuaacaaaugaaaacauaaaauuccacugagauccucuaaagaaagaacaugcuuucacaauauaacaaaaagugaguuucuauuuccauccucuaaauaaaaacucugaaagaaaagauuauaaacagacguuccuacugugaaaaacaaggaauccuacuaccugugcuuuuugguuaacuucaaaugguuuucagaucuugacuuaguauuuccaguuacucugcuuccagaaauaggguuccugaaaaucagagcuuacacacacagaccuuccauguauguuuugggaaaaagaaguugacucucaauuauuugugauuauaguaacuauucauuuaaaauuucacacugaauuauaaguuccaagauuaaaauuauuagccacuucagcuaaauuaacauuuuuuguuuuuguaaucacuuauagagcacaagauaacaauauuuuaagaaagcacauuucccugccucauugggauuuacaaauauaugaaaaaugaggccaggcaugguggcucacgccuguaaucccagcacuucgggaggccgaggcagguggaucaccugaggucgggaguucgagaccagccugaccgacauggagaaaccccgucucuacuaaaaauacaaaauuagccaggcgugguggcgcaugccuguaaucccagcuacuugggaggcugaggcaggaaaaucgcuuguacccaggagacagagguuguggcgagccgagaucaugccacugcacuccagccugggcaacaagagugaaacuccgucucaaaaaaaaaaaaaaaaaaaaaaggaaagaaaaaugauaccaauggccuagcucugucaacaauuuuuaauuuuaaaaagaucauuuaauguucuaauucuuucucauucugcucacuaaacuuagauucuaaucuucagauuaauccuauacgaauucugauacucacugguuuuuaaaauucuaagaaacucaaauaaauguuucuugcuaacaaucuucucaaaugguauauauaaacaguaucaagugaauauuaucuggaacugaauguuuuaggugcaauuguauguguacagauaacacuucguauuaauaguuaccugaaauucauccuauuuuuacugaaacuauuuaaauuguuuaaauuguacugaaaaacucaguagcggaacacaagcuccgacccuacgaaugaauuuucuaacaguuuuugacacuugaauuuuaaaaaauuacacugcagggaaacauuuuuuaaaguacuggcagaacucacaugggaguaaaguaauuuauuguuucauuaaauggggacacgucacguuuuuaaccugcacccauucuaguaacuaacucuagcuacaugugauagaauauagucaaugaacuguuaccucugagaugagagcccauacaagccuccucgcaagcaucacugugaugaaugcugccagaugauaaucaaugagaugaaaauucuacaacagaaauaaauaacuacaucagaaagaaauaugauguguauucagcuggcacuacuacaagaauagagguuuaucccucaaaagaucuuccuuagaucaccacacccuuacagauuaugggaauaugagagaucuugaagagacuacguaccuucuacuucuucuuucauaacaaauugcuuuaaguuuuuaaacacuauuuuaaacuaccugcaauauauuccucucccuuuucaaaaguauuacuguacuaaaaggaaaagauugcagcuuugaguuaacaaguuauaaccugcagaauuauggcaagaauaauuuauauaaaauggcauauuuauaaugugucaaacuaucaguugggauucagucuucagaaguuacuguuguuggucucuuacacaagcuuauguuaaucuaauugggcaucuacuaaauucucuacuagaugguacaucaauuauacucauuuaguguuucuccuaguuugauuuagaaguaugccuuauguuuggucucuucuaaaaaauaauagcauuaccuagaugcugucuacaguuccuucuaguucuaaaucuguauauacaacugugguaauaagcaaaugaaaagucuuuagcaacaauaucccaggaaccaccaaaaucaggauguauuuucauuuugaugaucaaaaggucuguagguuuccacaauuccuuccagaaugaaacauuaaauuucuugauuacuuaauuuaauaaaucuauacauagcauccacaaugcaccagguacucuccuucacacuaaagauacaguguggaagaugacagccaagguuccugcucuccugggucuuacuuucuacuguggugucagagggaaaggaaauggcagagauuacuauucguuccuucugcaucaccauaaaauuuaacuaggcacugacuccuagccagcuaaagguucauuuuccagccucccuugcaaaaacuacuuuuagccaagggaugagugaaaaaguaauacgcacaacuucuaagccauacucuucuagaaagagcuguccccuuuucucuuuucuuucuccuuccugcuggucagauaugauaacuggaguuagaguaccugccuuggaccaugguuuggaagaagcauauuggggauggaagagcaauaaauacaaagaguugccaugcugauguuauaucacccaccuaaacguuuauuaaauagggaaauaaguuucuauuuuguuuuagccacccuguuauggcagcuaaacccauaucuucaauaaauuuguuuggagaagcagggcaaguaaugacaauaaacaagcucccaaacaaaagcauuuuaaauaguuaaaacugcuuguaagaaauaaaacaguaacaaauaaugacuaagaaggaggugcagagcccauuuaaacuggugguuagggaggcuaucucugagaggauggcauuugggcugagagcugaaugacaaaaaggcaccuggcauuacaagcucuggggacaaagggccccagacagaagaaaaagcaaucacaaaggcccuaagacaggaaaauauaugccuagugugucuaaaaagcagcaagaaggcuggagugagauaauuauuguaguggggcaagaucaguuaagaagcucuugcuuuuaauucgagugaaaaaugauaacagacugaauagugugaguagcaauggagauggaauuaaguggccaaauuuaguauacauuuuagagauaguacagccagaaugucaagaguggcuugccacuccuuagaucauuuccuuuucucccucucuaaguauaauggauucuaacaguauuuauccccuccuauuuuugggacuccuccuugccuacccuacuccuccaaaauaaugcaugcagauucacucgaccccuggcugaugucugggucuuauuaaugcaucaccaguccaucuaagacauuuuuaaaaaucaaaauauuggccgggugcgguggcucacgccuguaaucccaguaauuugggaggccaaggcaggcagaucaugaggucaggauaucaagaccauccuggccaauguggugaaacccugucucuacuaaaaauacaaaaauuagcugggcaugguggugcaugccuguaaucccagcuacucgggaggcugaggcaggagaaucgcugaaccagggagucggagguugcagugagcagaggucauaccacugcacuccagccugcugacagagccaaacuccgucucaaaaaaaaaaucaaaauauuuaagugccuaauacaucuuuuuguuaagcaaaucauguuauaaccaaaucaaugaaaaugguaaugugcuuaugauuaacucuuuguaacccagaauauuugauuaaucagagcccucuauuccugacuauucugaauauuuacuacuucuagcuuuuauguuucuuaggguuaagacucauucaguuaauugguugacagcuagaaugauacuucacauauucagguguccacauuuucuuuuugauauuaaggucuugaaauggaaaaauaaaaaccuaauaaauaaaucugacaaaauuauuaugaguaucugacccagacacucauaauagaagaaaacuuaaaagacagaccacauauuugggacagaaguccuugcuagagccuccugaccagguaaccaccuuccacacuucaauaccuucagugaugggaaauaacuugaucuccggcaguccaaucuaucuuugaacaacucacugauacaggcuccuuucagauucaugggcuaaacucuuauuugcuauuucacauguuacucuuggcuucacaauccaauuuuaagcuuuguguuagcaaagauuaugugcaucagauaagugagccaaucuacucuacaaccuccauuaagugugcguuccucuacugcagaggcuggaaagcuaaaaaugacauuuccaaacuuucuugcaacucagacucuagauacgauuuagguucugucaaccacaggcaucauauaaaacuugaauagaagugagugaaguuagggggaaagguagcaaaaggcauccauuuuuggugguaagggucaaagcaaaggaagcauuaauucuggagucagcagcuauaacagcagguuccugauuaugacaagaacacuggcucccuguuucaaggcaguauuuguaggugacuuucuaaagaacuauagucagauauguuagauugggcaaagaacucuucgaugagacugaaaauucaacaaaugagaaguuuccagggaaaugucaacccaaguagaaauuuuauaaugaacuacccaagaagcacuuacagaauaaauauaggacuaaaacaggaaguaaagcacaguagauuggucuggacuugggcacucacuaugccgcuaugugauuuuugaaccaguuuauaggucuuacauucauuuauaaaaugggagucauauaaugguaccuacccauuuugucuuacauucauauauaaaaugggagucauauaacgguaccaacccauuuuuauaaagagcaaaugagauaauacuuguaaauaaucuaaauauuuuaauguguguucguuauugacacuguuaagauagugaguauuuauuuauagaacuauauagcuguaaaaggccuuaaagaacauccaauccaacuucuuucuuuuaaaacaccauggccaaaaaggaugaaugaaguacaguuccuacacucaauaagcucuuaauccagauaagaaaaaaagacuuaaaaaaaaauuuggcacuauaucauugcaauuuuucaacacagaaacugacauucuuaucacaugauauuaaguagacaggaggucaauauagcaagaaaauuuuuaauaccaggaacaaccaaaugauacaaauauuuaaaacaaaaauuuuuauucucuuuccauacuaucuuaaggauuuuggcccacauuuccuuucuauguucaccaugauagggaggcuuucuaaucuuuauuagucccaaacacauauauaagacaauagucuucuuucgccuagagccuaucucuaucacucaugcaaaucugccauugccaacaaccuaucugucaagucaucugacuagccuuaguacaguuuccacaaucuuagcucacuguagucuugaucuccugggcucaggcaauccucacuucagcuuccccagaaacuaggaccacaagugugcacuaccaugcccaguuaauuuuguuuauuuuuuguagagacaaggucucacuauguugccuaggcuggucucaaauuccugggcucaagcaauccugcugccuucaccucccaaagugcugggauuauaggcauaagccaccaugcccaggccuuaccaauauuuuuuuauauacccaucuauggugaaccuucucugcaucaagacuaucaugguacucuuuuuuuuuuuuuuugagacagagucucgcucugucgcccaggcuggagugcagcggcucgauuucggcucacugcaagcuccaccucccggguucaugccauucuccggccucagccucccaaguagcugggacuacaggcgccugccaucacacacgguuaauuuuuuauauuuuuaauggagacaggguuucaccguguuagccaggauggucucgaucucuuaacuucgugauccgcccgcauuagccucccaaagugcugggauuacaggcgugagccaccgcgcccggccuaucaugguacucuuaauaaauggaaagagaacagaagaaaccuacaauauauuuuuauguacuucagcaaagacagccaauuucucaauuucacuucccaauuucccaauuugauuuaaguucacuauguacccagcuaaaggacuauauuuagcuucucuuguaauuaggaguggacauguguggaaaugauguaagccuggcccauaagaaacuguccuuuacauugcccuaagcucuuuccccuucuggcugacagggaugggccacagccaccuuggaggucacauguuggaagacaguagaaucuccaucagccuggguccccugaagaacuccuggcaaccaggacaacugccucagaguuuauuuguuacagaagcuaccacuauccuaauucagccauuaaaaggguagaguuguuagaauguaguaacacugacaccuuauacuuacaaauuuaaaaugguguagagaaaacuaaauaccaaaaccuuuccgugauauuauuauaaaaaauuauuuaaauguuuucugcauuuucauuuauauuuuuacuuccucugguaguacuuauaauuuaaccaucuuaucaugaaauuuuauuucugaaaguaaucuguggccuagcagaaaaacauuuuauuaaaagaaaaauuauuaagaaaaacaauuucuacagaaaggcuuuccagguaguuucuuggguaaguaacaugaagaacuuaaagucugaguaagacuuaccagugauguacaagaagcaggaugauuguaaggauaccaccacacuguuuuauaaauguugauguacugaaugaaaagagcaaccaacagguagaugaaaaaaaggaauucaaagaguaggcucccauccacaggcaagucaggaauuuggcaaugacgaacaggaccuggggugauuaaggcugugauaggugggacuggaaggccaauagcacuaccauuccugaaagagaaaacuaugguuaacucaaauggugauaaccuccaguaucacagaacauaaagggcuccugcugucuccuccaucuaccccuucacugucugcuuuccccacaagacuccauccugggauccucuuuucucccuccacacuuucugucagugaucuaagaugcagcuauggccuccauuaucuccuacaugaugaagacuauaauuucucuccauagagcucacugcuaaauuauagacacauuauucaacucccuacuggacaucucuguguucuucccuccuauaguccugaccuuaguucauggcccacucaguuagcugcccacaucagaaaccugggagucauauuaaaacuuuucuuggccaggcgugguggcucacaccuguaaucccagcacuuugggaggccgaggcgggcggaacaccugaggucaggaguucaagaccagccuggccaacaugaugaaaucucaucccuacuaaaaauacaaaaauuagccaggcauggugguggacaccuguaauuccagcuacuugggaggcugaggcaggagaaucgcuugaacuuaggaggcggagguuguggugagcugagguagcaccauugcacuacagccugggcaacaagagugaaacuccaucucaaaaacaaaaccaaaaaaagaauauaaaaauagauuuaagaaucuauucagaacccauauaaauucucuagcaaugaguugugacaacacaugugaagugcuacucauccaggaaagcucauuagagacuugaugcccaggguuuuuauugggggcuggccacaugggcaccuucuuucuagcaguaccaaaauucuagacucccaaaaagaaugcagguguucaacauagcuacucuuaggaaggccugcuuacaaggcuuacaucugggaaccaugacuaguaaacaguucccuacagugauauaaacuuucccuaaauaacuagaguggcucacugugccuaaacuguuuauacaaacaaugugguuuaugcugaacaccuguguuuuguccuugcauauaaaguuuguguguggcaaaggguuaacacagcaggccugagacugacugguauggagccagcaagcagcagaauuuagggaagcaaauggaugaaagaagaaagauucaaaggcauaaagaggaauagaagagguagggaaagcaguggucauuuggacacguucaggugauauuauuaacaaaguauaugcaaggaauaagcaaagaaaacaauaguucuucucaaauaagauucucccucaaucaggaacucucuaagaaauccagaaauacacaauauaucuuccuuuuuuaaaaggauaauacuuuaaauacacuguugcaagaacaaaucccugcuccccaaagguggacagcaggacaaggaacuacaauuucaaccuugacuguguuaccaaacuagcuccuugacauucuagaguuuaacuucaccaaucagaccacaagcaccuaccaaacagggacaaauucucuccucuccagcugaccuaugucugucuugcagaaucaaauguaucauccaaaaguauguaauacugaagcaauuaucuauuucccuccaauacucuauagacacuccagaagugaguucuccucaucuggacacuccuucuuucuauauauccuuccuaaaacuauauuauaagcuauccgcuaguucuuucauguuuucauaccucguccccaggucuuuuauaacaaauuauuccagcugcuugcuucccaccaagaaagaaauauaaagcuuucuuuuccccaaauaauuucucuagguaaacaugucacaaauaaucacucaauaauagucuuggugacuuuucaaaccauaaacaauuauuucuuucauuuuaaaauguuggaaaauacuuuuuucuacccacucccucccuccccccaguuaauugcuaaauaaacauauguuaaaggaggagagaaaggcagauuaaagcaaccaugguuggaaccuugaauaccaggauagaagagcuacagugaaggcagagaaaagaauaccaaacccagucaagagccgagguauuuuccgaacguuccuacuucuucccaguauaccaucugcagacucuaagugcaagcagaagcaucuacaaaugacauuuucauuggcuuucaguucuuuuuaauagcagaacgcuuuauuuuccuuuccucaugauauuuuacauaguaucuuaauauuuaaaacacauaggaaaaugagucagucuaauuaaaagaagacgaggaaaacucaagccuagacuguuaggcuugccugauccauuuucccuucuaagcccuccuacagcaaccccugagacacugaagagggauuucaugggacagucuaagaacauuuuuaucuagagaacauaauuaucuagaggaauccucaaagccaaagucaaagagaacgaacaaagaacugcuagaguuaggaggcaaaguuagaauuuuuuaguuggcuagaauccuaguuagggacagcuaagauuuucuaucacaauuugaaaguacugaaucaauaaguugauagcauauauuaauaaaauuaaggcauguaccucaaagagcaaacaacuuuuaucucaauaccuauauuagauaguaccuuucuucaaaagcauuuucgcauauucucauucuuauuuuuaaguauauaaaauaauacuuauuuguagaaauuuuguaaaauucaguaaaguuuuuuaaaguuacugcaauuuacuacuucauuuauuucaacauccugcuaugaugcaaacaguaccaucauuuuuaaaauaaggaaauccaacgaacggcagaguaaaaaauacucuagcauaaacuaguuacucuguauacauacauaaacaaaacucggauuaaaaauuaguaugagaaucggagacuggaaaaaucccuucaaacuggaauuucagggagagcuccacugaaaugaugagaucagaacuaauuuuaaagauuggguggaagagggauuggaaagucaggaaaaaaaaaggacaaaggucaggccuagaaaacaaaagugcauaaauaccauuagacaggccugaaaauacaguaguacugauugcuagcucugaaaauuaaaaucaagacaagagaaaaacuuuuuucagggaggaaggagaaauuagcuggcagaaaauaucuugagcaaauacuucauuagguaaaaguaucucuuugaacugcuacauuaucaaaccuccugauggcaugggcuaacccagcuaaaaaacagcuaacauuuauuaagaccaaacaauuuuuugacaauuuaaaauccuugauggaauuugacuuauaauuugcccucuaaaaaaagaaugcuuauaaguagauaaaccaucacacuuaccuuguauuuucauucacuucucccuucuucuaauagauaaaaaggggauaacaagaauuuagaugaucagccaaaauaaagaaugggacugcuuucacuuugugggccccauuucacaucuuuuuaccuccaaaguauuuuggaauucugaauuuugucuugaagggcaggauuucuaccacagugucaagaauaaaucucaauaagcaaauaucugaaugacaugaugacuuuuauguuagucuuacugaucaaaggacauuaaaauuauauauagccuuauuuuuucuuuaccuguuucucaagccuguuccauugccacagccuccaccaaccaaagucugcaaagaagguaaagcugaacggcuuagcuguugccgacuagggccccuccuuccaccgggcauguccaggaaccagucugcuuccagugccaccuguaguugcaacccagguuaaugguugucaaccaguuucaacucugaacgacaacaaaaacauuuaaacaucaguagacuauuuuuaaaguaggcaacaaaacaacgacaaacacugaguaagcaggccuuacaaaauaagauuuucaaacgaauguucccagugucuacuacuuacguuauucgaauuaaaggacuacucagacucuaaugggucaaaagccuaaguucugaucuaagcucuguucagcuuuaggcaagugaugauuugugucuuuugucaacugauuuguaucaucuguaagauauuauaaucaaauagaaguuuacaagaaacaucacaccuuauacauuuccagcucaauguuucacacuuaaacuacuugaaauauagaagaauuggcacuuuauaaaacauuagguuuuguuaucaagggauauggcuugugagcucagauggucacauauuaucugaccuuauccggauaaguuaacuucugaguguguucuucugaguguguuucuucaaggggggggggcggggggggggaguguccccuguucugcagagguugucaggacugaggaaguggaaugaaaggguaccaguaguucuuuuaacaguuuaaaaguaaaacuguucgagugguaucucuauauguuaggguuaaaauauugaaagaaacucuucaaggggaugcccgcuccagaaaagcugguguaaaaucauacagaaauuacugaaacugcaagauuaagaagcaaguaaaagauaaagauccucacuggaaaaaaaaaaaaaagcucuuuucaucauucuacggcaaaaaucaugauucugucaacauggauaccaauguuuccuaaacaauacaacuaaaacccaaggaugacacuggaaaaaacccguguuuucaaaugcucccuauuccuaacagccuucggcuguaaacuaaccccaagucaaacaaagcauucaaaccgcuggaugcaggggcugcugguccuugcuccauuaacaagcaaagggaaagaaaagugcagggaaaaaacugggacggaagaggugagaguaugcggugugguggacugcaggagaccacaaacuucaacagacuggucccuaagagaagucggcagaaagguagacaaagcagucuccgccgcacacccaagagggccgaggcagguccaggacagccggaccuuggggcagcucaguaauacucacgcauggaagagucccagccgguggggcggggucccuagaaagcggcgacaacuuuacagacuggaccccagguaagggaacucccucccagcguuggaacgcugcaaaccagcugcuuggacgcaggcagcccccgccuagagaaucaagaaaagguguccaggcuucgggcugccagacucagacccagacuccgacgcaguuccagugccagagcuaaagcuagagccagagccugauacuucagcacccaucccuagccuccauuaccgcggagcugagcagacgu

SEQ ID NO: 192633 - RNA, 50343 nt, Homo sapiens
gcucccucagcaagacaggaucuugaggaaggcuuuccggaacucgauauugaaggugguauagaucacaggguugagggcgcuauucacguagcccagccaugucguggcacuguaaagcucuggggacacguggcaugucuggcaguggguauugagaacaugggucaagaagaagggcagccagcagacaaugaaggccccuaaguugccaaauaagagagaaacuggguaagggauuugcuuacuccuuuuguuauaacaugagaaugacucacgguugucuacuuuaugccagccacuaagcuggaaguuuugcauacccacuuacuuuuuuuuauaacaacccuaggccgggugugguggcucacgcuuguaaucucaacacuuugggaggccgaggcggguggaucaccugaggucaggaguacaagaccagucugggcaacaaggugaaacccuaugucuacuaaaaauacaaaaauuagcugggcgugguggugcgugccuauaagcccagcuacucgggaagcuggggcaggagaguugcuugagcccgggaggcagagguuguggugagccaagauugcgccauugcacuccggccugggugacagaguaauacuccaucucaaaaaaaacaaaacaaaacaaaaaaaacccaacccuaugaaauaggugugauuagccaaacuuuuuuaggugagaaaacugcaugcuaaugucuuucauucacuuuggccuuuguuacuaaaucaguuuucuaguugggucucuagguaguucuuuacuagucuuuuucuuuuucaauucaauucagacguuuauuuaaugccuaccuaugcaaaacaugauccuaggcacugauagguaugaagaccuuaaagaugugacugacaucguuccugcuguugaggagauuacaucuaggaguucuaguaaacucccugauacaggagagaguugggguuugucagugacacugaacaggaugaacugccuucacuaacucuauagcauaccugugauuuauucauuuuuaauuucuuuauuuaaauaaaguucaggcugggcacaguggcucacaccuguaaucccagcaguuugggaggccaagguggguggaucaccugaggucaggaauucaagaccagccugacuaacauggcgaaaccuugucuuuacuaaaaauacaaaaauuagccgggugugguagcgcaugccuguaaucucagcuacuugggaggcugaggcaggagaaucacuugaacccaggaggcagagaacccagaacucaggaggcugagaugggaggauugcuugaugccaugaguuugagaccagccugggcaacguaaugagacccugucacuacaaaaaacaaauaaaaauuaaaaaaauuagcuggucaugggggcauacgccuguaguucuagcuacucgggaggcucaggcaggaggauugcuugagcccaggaguucaaggcugcagugagcuaugauugugccacugcacuccagccuaggcaacagagucagaccaugucucaaaaaaacaaaaaacaaaaaaucuugauuguaugcauuauggaaagcuugguaaauacagacaaguaggaaaaaaggaauaagcacccaccacucaaagacaaucacuuuugauauauuggugaauuucuuuccagucuuuuuuacucuguauuuaaaauaaucuagauuuuuuuuuuuuuuuugagauggagucuugcucugucgcccaggcuggagugcaguggcgugaucuuggcucacugcaagcucugccucccagguucaggccauucuccugccucagccuccugaguagcugggacuacaggcgcccaccaccacgccuggcuaauuuuuugcauuuuuaguagagacgggguuuaccguguuagccaggauggucucgaucuccugaccucgugaucugcccaccucggccucccaaagugcuggaauuacaggcuugagccaucaugcccggccuaaaguaaucuagauuuuaucauaccauaucacaauaguguuuugcauucuuauuuuuaucacuuaauauuuuaaauaacuaagcauuuguuaaauauccaauauguaccagacaguuuuauugaaucauuaucuuacuuauuguuugauuuauguguuguagcuccauauaauggacagcgcaguuaaguggcuuguucagcuucauaaauuucagccuaggucuuuugaauuuccaccagaguuagcauuuauacacaaauacuuuucaauuauauugugaacauuugauaaguauuacugucaucaaauuuccgauagcaucuucuaccagcuccacuuaacuuaacacaaccuaacccaacccaacacagcucaagccaacccaaacuuaccaagcacaauggccaccauuuggguugccuucuucucccgaaguggcacuccccgagguugcaggggccccagcuucaaagaugucgauaaucugccauugcugaguuuucgaacuucuaagcugagcuugggcgcuauggugggacucagggaauuccgagucuucuccucucuuuucaacucuccuccucuuucuuggaagccugguccacccaaggcaguguccuggcagaugcuguaguaacgcuucagcuccagaugugccgggucaggagagagggucugcaggugugacaagagggaaucuugacauuucuggggguauuguuuaucuucugaauguuccugaaagggccagagaauucaaagaaggaagacggcaacacaguugugggaaaccuacaaagggaacaucugagggaguggugggaccaugagaaguuaagggaaaugaaauuugcuuuagacuuuacaacuaaaaagcacccaccauaucaucagagugaacaggcagccuacagaaugggagaaaauuuuugcaaucuauccaucugacaaaggucuaauauccagaaucuacaagaaacuuaaacaaauuuacaagaaaauaaccccauuaaaaagugggcaaaggauaugaauagacacuucucaaaagaagacauuuaugcagccaacaaacauauaaaagaaagcuugucaucacuggucauuagagaaaugcaaucaaaaugacaaugagauaacaucucaggccaguuagaauggcaaucauuaaaaagucuggaaaacaacagauguuggugaggaugagaauaggcacgcuuuuacacuguuggugggaguguaaguuaguucaaccauuguggaagacuguggcgauuccucauggaucuagaaccagaaauaccauuugacccagcaaucccauuacuggguauauauccaaaagauuauaaaucauucuacuguaaagacacauacacauguauguuuacugcagcaauauuuacaauagcaaagacuuggaaccaagugaaaugcccaucaaugauagacuguauaaagaaaaugugacacauauacacuauagaauacuaugcagccauaaaaaagaaugaguucauaucuuuugcagggacauggaugaagcuggaaaccaucauccucagcaaacuaacauaggaagagaaaaccaaacaccacauguucucacucauaagugggagcugaacggugagaacacauggacaaagggaggggaacaucacacaccagggccugucaagggauggggggcaaggggaggaagagcauuaggacaaauaccuaauccaugcagagcuuaaaaccuagaugauagguugauagauucagcaaaccacaauggcacauguauaccuauguaacaaaccugcacguucagcacacguaccccagaacuuaaaguaaaaaaaaaaaaaaagcagcacccaccacauauagaacauuugauaaucacaacaaccucuugagcaggguagcacagaauuguagucuggccuuuuugaguuagaaugaccuggugauacagagaaacacauuaagugacaccacuaugacauaagccccgaaauguggagugugggaaacuccacaagacaaaugacucaguuucuucaacaaauaaauuuuaacaacaacaaugacaauacuuaccaguugcaaaauaugugccuuauuugaauuuugauucaaacaaaccaacuguaaaauaauuuacaagacaauuggggaaauuugaacaucaauuggacauuuaaugauauuagaaaacuauuaauuuuuuagugugaugugguauugugguuaugugucuuauaaaacaguccguauucuuuuuuuuuuuugagacagacuuucgcucuuguugcccaggcuggagugcaguggugugaucucgguucacugcaaccucugccucccggguucaagagauucuccugccucagccucccaaguagcugggauuacaggcaugugccaccacgccugccuaauuuuguauuuuuaguagagauggguuucuccauguuggucaggcuggucgcaaacuccugaccucaugugaucugcccaccuuggccucccaaagugcugggauuacaggcgugagccaccgugccuggccaacagucuguauucuuuagaggaucuugcagaaauauuuuggguugaaauaauacgguguuuaguauuugcuucauagcaauccaguggggaugugugaacguaggugggauuguagaugaaauaagacugaccacgaauugaucacgacugaggcugccugauggcuacugggggguuguuauauuugucuacuuuuuuauuuuugaaaacuuccauaauagaaauuaaaaaaaaaaaaagaaaacccaggauuuucuucucagcucucuuacuuaguagauguaucuuuaggcaaguuaauuuaauaucucugagcuuccuuuguaaaacagaaaagaaauagggaaaaauggguuugggaugaguagccucugagaauggaauacugaaauauguuaacuuuucugguauggagggggaggugugugugugcccaacuugaacuucuuuucauguuugaagaaucagacuauugugucagucuugaacaggaggcagaacucaacucuucaacucccauuacugauggcauaaaagccagauauucacuucauaccuccauucccaugcagcuagagcucaggcacaugcaccaagcccagucaauugcagauucacaccugagacuuugaacuggaacuugugaagcagggagacuucagaacuccucuaguagugguggcauucaauguccaguguguuagguuuucuaacuagauuauuucuuaggcaugaauagcaucuuucugaagcuguucuucagccuucucauugagccugugagccaccugacagcuuuccaguaaauuuguuuucuacguaaguuauucagugucagcaacaaaaaccccucgcuuugguuuccuuaguucaaggaagcagucuucuagguacacagaacuggcacauuguacauacucagaaugaaugaaugaaugcaagcggucuucaagacuauuuaguguuauuuauuuauuuauuauuuuuaguagaaaugaggucuugcuauguuggccaggcuggucucaaauuccugggcucaagugauccuccugucuuggccuccaaaaguguugggauuacaggugugagccaacaugcccagccaauuuaaguuuuuaaaauuuuuauuuauuuauuuauucuuuaagacaaagucucacucugucaccaggcuggagugaaguggcaugaucucggcucauugcaaccucugccucccagguucaagcaauuuuccugccucagacuccugaguagcugggauuacaggcgcccaccaucacaccuggcuaauuuuuguauuuuuaauagugaugggguuucacuauuuuggccaggcuggucucgaacuccugaccccaagugauccaccuaccucagccucccaaagugcugggauuacaagcaugagccacagcaucuggccuagaguuuuuuuuaaauggugguccacagagguauucuuaggaauucuagaauaauauacauuuuuuucuugaagauuuuaaaaauucauauauaauaauuuuacauauuuguggggcaaaugcaauauuuugauacaugcauacaauguguaaugaucaaaucaggcuagucaucacuucaaacaauuaucauuucuuuguguugggagcauuucaaaucuuuucuucuagguauucugaaauauauaaaaacuguuguuaagcguagucacccuacugugcuauuagacacuagaacuuguuccuucuauuuaauuguauguuuguaccccugaauccaccucucuuucucgcccccucccccaucuccuuccuagccucugguaaccaugaaccuacucucuauuuucacgauaaccacuuuuuuagcuuccauaugugauugagaacaugugauauuugucuuuuuuuuuuuuuuuuuuuuuuuuuuuugagacggagucucgcucugucgcccgggccggacugcggacugcaguggcgcaaucucggcucacugcaagcuccgcuucccggguucgcgccauucuccugccucagccucccgaguagcugggacuacaggcgcccgccaccgcgcccggcuaauuuuuuguauuuuuaguagagacgggguuucaccuuguuagccaggauggucucgaucucuugaccucaugauccacccgccucggccucccaaagugcugggauuacaggcgugagccaccgcgcccggccgauauuugucuuacuaugucuggcuuauuucacuuaacaugacgucaaguuaagagaauacauauuuaacauuuuuugguuuuuaguuugauggcauuuucuaauaauuaaaauaagcauauuucauuuuaucugaaugccuauuuacaacagagauuaugguguguuuuuuuguuuguuuuuuuuuguuguuguuuguuuguuuuugagauggaguuucccucugucgcccaggcuggaguguaguggugaaaucucugcucacugcaaccuuugcuuccuggguuagagugauucuugugccucagccuccugaguagcugggauuauaggugcaugccaccaugcccggcuaauuuuuguauuuuuuuaaguagagaugggguuucaccauguuggucaggcuggucucgaacuccugaccuggugaucugcccauccuggccucucaaauugcugggauuacaggcgugagccaccacacgcggccccaagauuauguuuacaauuaaacuggcaccuacugaucuucuuaaagugacaauauuugacuucuaacgcauuauuucuaaaacuaggggaugggaaacaaauucuugggauugccuaagaaaucucauauuagcugggugcagcccaagaguucaaggcugccaugagcugugaucacaccacugcacuccagccuggggaacagagugagacucugucucaaaaacaaaaacaaaaacaaaaaaaccucauauuugaaaacauugaucuaguauacccuguuuccauuuuacagauauggaaauucaguccuauaguaggaaaaugauucuuccaagauuauauauuggugaguguauuuuucagcucugucugcaaaaccugaucacuacuuccaugacugacaugaggaaacacuggauuccucugggucuggcuggcagagcccuccacucccagauggcaggacagaaccuaauucuccacacucuuggaaaugccagucucuuggcugucugaucucucuuuuguauucaauauuuuuccuccucuuggccuugaagccuccuuagaccuuggaucagccauaggcaacuuugagcugcauagcuauuaucguuuaaaaugauuaucuccaauuaccacaccaggccuguguagaaagucauuaacuauacugagauugaacaaagcucagaccuuaauuauuacaaauuuuugaaguuuuauuucuaauguggaauucagagaggaauacuguucucauaucuaacaccuccagacuccacucugcacucugcuagcugggcgaggcaggccuggcuugaauuggaagaacaaggcuaauggugaccaugaaguugucuugguuuuucccacauucagugguaaauauggcacuugaaauuuuccuuucucugccugguuuuugcucuguccauguguguucccuugacgucuguuuccucuaaugcagguggccuuggauggcauugucacaccgugugcaagagucauuggcuccagucacuaaggucaaguccaauagucauaugcuuucucaauaucuucugaugaauucuauucugaagcuuaaauuaggaagaauuucagaucuugucuuauagauauaugugugggaaucaggguaagguuucauucuggggugagaguagaaucaagauaagccaguauugugggaaaaggucucuuauucuuucucuaugaucagacauggcccacuuaccauuuuuccuguggcaugugauggaaaucaggcccuuacugacaacugcugaauggggugcaggugcagacaagaagacugggcaggggguguagaagaaggaacaguuaguugugggucuagccaugucauugauagccaugggacaugauaauauuuugaaugcaauacuuucauauccucagccuugggucuugaucuccucuuucauggggauuaauagucuuguuucacucaagccuugggacuucaacuuaagagucugaccuucauucauacuuuugacaucaucaaagaccuuaacaggucaucagagauaauguaggucaucaggcugggcacuuaugccuguaaucccagcacuuggagagguugaggugggcagaucauuugaggccaggcauuauagaccagccuagccaacaaggaaaaacccugucucuacuaaaaauacaaaaauuagccagauguggccgggcgcgguggcucacgcuuguaaucccagcacuuugggaggccgaagcgugcggaucacgaggucaggagaucgagaccauccuggcuaacacagugaaaccccgucucuacuaaaaauacaaaaaaaaaaaaauuagccgggcgugauggugggcgccuguagucccagcuacucgggaggcugaggcaggagaauggcgugaacccgggaggcggagcuugcagugagcugagauugcgccacugcacucccgccugggccacagagcgagacuccgucucaaaaaaaaaaaaaaaaaaaaaauuagccagauguguuggugggcaccuguaaucccagcuauucgggaggcagaggcacgagaaucgcuugaacccaggagguacaggcugcagugagcugagaucaugucacugcacuccagucugggugacagagcgagacucugucucaaaaaaaaaaaaaaaaaaaaagauuaucuaggucaucaaagauuaaucuagacacccaaauuggaucugucuucaagaucaaacucaauucuuacucugucuauggagcccuuuccugaguguauuagccuguuuucaugcugcuaauaaagacauaccugagacuggguaauuuauaaagaaaaagaaguuuaauggauucacaguuccauguggcuggggaggccucacaaucaugguggaaggugaaaggcacgucuuacauggcagcagacaagagaaaauuugugcagggaaacucccccucauaaaaccaucagaucucgugagacuuauucacuaucaugagaacagcaagggaaagacccacccccaucauucaguuaccucccacugggucccucccaugacacaugggaauugugggagcuacaauucaagaugagauuuggguggggacacagccaaaccauaucacugagcauauuggguuuucucuucuauaaccuccagagcacuucauaauugagugcuuaauugucuucaccucacauuuggcaaacauccuauucagcucugggaucuucauuaacauugaguggaggggugcuuuauuugcuuuucuagauucuaagcuccaugaaggcagaugcuguuuaauguuaccacugucccuucccuaguagauuucaagugaucgguauauauccauucaugcuucaaguacaucgugggaaaacuacuaagugccagacaaugggguaaggagaaauuaaagcccuagcaauuagaagaucauugcagaggcaaugacauuucuuuucagagccuagaaagauccaauaaaaugcuuuaucagcacccuaucccaccagcuugucaguuccuugacacacggacagauccaguaaggaaaaaaggcuuugauggaccccagugauucuuggcaugagugguuuagacaaaaagucaguucugggaacccaccagcagugcaagguacaacugcugcacuuaaacuucaaaaccugugggacaucugagcugcugcccauuuggggaaaaugaaagacuuugaagggaagcagaacaagcccaggagcucuccaaucacuuugccagguaaggcaggcucuagaggcaacuaucaauguuuucuugagauuggauuuccuaccuucaaagcgcagccaaaauuagcagauuccaaagucggugucagauuugugucuccaauuuagcuaaacggcaaaaucaugcacugcuggacacaggcugggaagucaggagauuggguguugucuucccucuacccccuccaggguacuuacuugcugggggaagccaggccugacacuguugcacugacuguucugucgagugaggauccuuuuccgucuccuuuguuucagcaccacauagauucuggcauagacaaggacagucacuccaaagggcagguagaaggacaccacugaagaguagaugacaaaaucaggguuggagauggagcagacagugggguccccuguggaugagaagggggaagguaaagcaguuagcaaguaucagaacucaguaaggagcauaaaacacggcuccaugucacguguggugccugcacuuucugcugcacagggggugggaaggaugcagucucagauacguauacugucagguccuugaggguagaaggucuaauucaucuuugaguuucuuacagcuugcuuaaaauaaaaaguuaccaacaaucauacgccagacacuggggcuacaaagaugaaugagacaccaugucuucucucaagggagcaaacagucuagauagacagaugaucccuuucauaggaugucacaagugucacacagagacaugcagccugggaggcuggggagagcauuacagggcaacagggcagaggcucccaggagggaugcagcccucagaaaagggccugcuggugcggaggcauuggagaauuguuugaaugcaaugaaaggaagaagccuuauuugcugagaaugccaguucuccaauuuugaaucugggauggagggcagauggcggcugaauacaagacagagauuugauuuuucagggaaucccagcacuugucagaggugggaugggaaaaaggcagguaaugauauugugacauggagaaugugcacuuagaaggguccuugucccugcuuuauauccugaaauguuccugccauuucuccuugggaggucccucuagcuuugccuucuucauagcagaugcugagauuccuccaaggcccaagaugggccugaaacgugccccaucuugaaaaagaaaagaaaagcaaacuaauaucugccaggcgaugagccaagagcuuuguaccccuuaucccaccuaauaauuaaggcaacguuauaugagacaggugccauuauuacugucucucuuuucggaugagcagauuaaagcucagagagguucaguaaguagcccaaggcugcaccugaaaaauauguucuugcagccaguuuuaugcccaagccaauguucuuucuauaauuuuaacuccccaucccucuuuaccauugugacauggaacaucugugcuucauccagcacugugagcaacaacuguugguacacccggccagucuucauaaaggguuggggauucuccaaccucaaaguuggccuuggaagaugaagccucaggugugggcugguggggagagggcaguggccauguaggacccuuauucugcuucuuggucuucugagguagguggaagccagagagccuucagugugagauucaggucugcuauuuauuaacugugugaucuuggacacguuucuuuaauuaaucaauuaauuaauuuauuuauuuuuugagacggaauuuugcccuuguugcccaggcuggaauccaauggcucgaucucggcucaccgcaaccuccaucucccagguucaagcgauucuccugccucagccucccaaguagcugggauuacaggcaugggccgccaugcccagcuaauuuuuuuguauuuuuaguagagaagggguuucuccaugauggucaggcuggucucaaacuccccaccucaggugauccacccuccuuggccucccaaagugcugggauuacaggcgugaaccacugcacccagcugacacauuucuuaaauaugcaaagcuucaguuuuauuaccuguuaaaagaaaaagccuagaaauauuguauaguaguugugagaauuaaugagaauaaaugguagcuauucuuaauauuuauuuauuuauuauuuauuauuucucuccccugagccuuuugaacugaaagggaagguaacaucugaaaugggaauuuggagacagacuuauagggagcaauauuugugggagaaggaaggaaauaacagcuaagaacuaaaacgaaaagagugugcucagugaccagugaugcauuuuacugacaucuuugccacuagaaucuuuacaagcuacuccuaaauucucugguucucugaagaggagguaaaauucagguaaauuucauguuguuucaccaaagccuaugucaucauccuuuagaaaauggcuuauaggggccaggcaugguggcucacgccuguaaucccagcacuuugagaggccgaggcagguggaucacaaggucaggaguucgagacgagccugaccaacauggugaaaccacgucucuacuaaaaauacaaaaguuagccggugugguagcacacaccuguaaucccagcuacucaggaggcugaggcaggagaaccgcuugaacccaggaggcagaguugcagugagcugagaucgcgccauugcacuccagccugggcgauagagcgagacucucucucaaaaaaaaaaaaaaaaaaaaaaaaagaaaagaaaagaaaauggcucauaggcucuguguaguucaccaaauuggcaucugcugguauuugggggugauggaguuggggagagggauaggguggcagugcguggucuuucagaaucucuagggagccacguugguggugaucugcuccuucucugaagucagcuuuucuguugucagcaucugacuaugguuuuaaaaccugccugugauaaggaggcguuucacaugucucacgugugagaagaggccagugggguggcacugcccaucuuguugucauccuuggugucccggauauucccuguuggucccuccaccuaacuuucuaccuuuuccuacccacucuggguucugggaggcugaccucuaaauuuuauauaugagcuacuucuuuuaaaaagucagggucagauagggguaugguaugcuucuauuuguguaauaaugaauacacauacacauacauaaacauauuuguguauggacaugcacacuguugcaagcauuaucuugcaagaauauuaauguuuguuucuagggagggagaugggagaauguaguaaucugggguagaagggagaccuacauauaaguauguauguaucucaugggcaccuuaugaauguuuuaugugcaagcauuuauuucuccauuaaaaauauugaaagagagaguugagagggcauauagcuauuucagggucccuagucaacgaaggcucucacauauaaucacagaaccugcauugccaucucuuccuuccuccccuaucuaagcaaacagcuucccuuucuuagaucaagcauugcagccucuuccagaauguccccauugcaggcagagugacacuggagguggguggccaaugaguagggccugccccagcccccagcaggccuggcccuggguguguguccuguuggcagggcagagugaugcaccacacagcagcaguucugaaaccuucucugcuguguaccaaagagguaaggaaagcuguaaugccccccagaagcugacacuuccccaggagaugaggugccuuguuuugaugauuuaacugcaagaguguuguuuuguuagcacaauaguuauugagcaagugcauaaauaauaaauaaaugagcaaaauguacaaaugagcauuuuauauaaacacaugagcacucacugaccagaggauaauggagaaggccugugccgggggaggggagguuacuccuccucugagauuagagaugcuuaucccaacuaaucucaacauuucaggaagaaaggaugaugaugaagagucaucuauuuacucauucuacaaauuuuguggaguacguacuauguuuaaagcacugugcugggugaaaaagacaaaggcaucuaugaggcuuuugcaggcugucuugggaaacugagacccaccaugauguggacagcuuggcucagagcagguuuacuugaaagauucaugaacuucaaauucauugauggauuugaccccagcuugauuccaaagacaugcggugccaaugaaucugauuuuaggaugggccuguuauucuuuuaauuuugugcuucuacuauucucuuaacuuuuugugcaacuaagcucccccucccccaaccuagcuccagugcucugaaaacuaggugagauguucuauugaugaaaucaaauaaauagcacuccuccauuuccuucuuucaaaggaaaaucaagccagcugauagaguuuucuuaacuuuaaguuucuccucccuugaagauuucuuaaacucuuaucaucagcuuauucacucuuugcuuauucauucuagauuuuuaaaaauaacacaauagcuuucugauuuagcaggaauuuaaauacuaguuauuuuucuuaucuaugcaaugaaaggguugggcugcucauucaggcaucuucagaguuuccuuuggcaccagcacaccaugcucugcuguaucagggucuguugaugaugugauauuugccuagacugcugggccucugcugggaguuaaggcaacccuggccagccaggccccugccucggaacucucucacccaaaacccugccucauauugaccuuucaucugagaacaggagcaacuccaaguuggaagagacugaaguucaacuuuucuguaucuuauguucucuaauaauucacaauuucguguggcagcccauggcauuaaaagaagagcucugccagaaaguucuuuuuuuguguugcacuuauuagugaaaguccagcugcuuccaauaucagguguuauuggcaggauccugcccucucccccuugauuuuccacagaagguguagaaaaaaugacugagaagaguccuuuauauugggcuuucaaaugaaguugggaacuuccuuauagaugagagaauugcugcaggaacccacaucuaucaagauaaugaagcuguacagugaaggucagcuugaggcagaggaggacagcugggccugagcuucacuuacuaaauccccuaacuguguucuaggaaggggcgacugaucucuaaaaccaucagcagaacucuuacgacugcagauguauaguuacauuuugauguauaaacuuuuccaauaaauaauaacaaccauaacaccagcuaauaucuacugagcucuuacaauggaaccugacacuuuaacacaauauaugaauaauuggaaggcuugcuagagugcuauuaauaaacuuaaauguaaaagacagagcgauugugagagacgagagagaagugagagcgcacauacuaagucacaggccuuuucugccuucucaauucuauacuuaaaaauccuuuuggaaaaaacuuuccugaauuuuguuucuggaacaauaaugaucucacugggggcaacaacacugcaaauucaucauucuucuucacucuggaugucgacauuaaccgagaacucagucuaaugucagcuuuugagauuguuucaacuguuuccaguguggugugucugugagagugaauaagaccgccuccaccaagaaugagucaggggaaccacagucagcccagcagauguuggcagggauuugcuuuuggcuagaggguaagaagugccuuggucuagcaguggugaguuucccacacuagaauuuccaacuaagaaugcauuuucauauagaaacaagguuacagaaggugacuuaguuaucagacuaacucauaaagcacauuuagcauucacgaaaaaugauauuuuagugccacagagucagccucuguagcuguguuaagggauguugcuuuguacugggcaaugugugcauguuuguguguauaaagugucauucaguuaaaauaacaaaguaaugaaagguaaacaguaacgcaaagauaacaucaccauauuuugagaauagccuggguugaacaggcaaauauuuguugauaaguuggcuaguuacccuuuacuguggcagagaaacaagccagccuugaguaggcgguacgugcuuggcauauuuacauauguuaucccaauuuaauccucauuuaauggcaaaaaucucucugaagaaguuggaguggaguuauauguagucuuagauucuaaagucaauaaauaaagugaaaauuauauagacuccaaauuugccuugaaaaucugaaucacauguaaagauauacaugguuuuauuauaacccugcagaguaauaaguuguaugguacauauaguaauauaucauauauuguagaguuccuauggaacauauaauuuuagagaugaaauugcugggcucauuuguagggggucauauauaaaaauaaauauuaaaaaugucuuaacuaaauauguagaucaaguuuacuuauuuuaauucacucaaguguaugcuccacuguaauuuuaucccacauuuaccaaugaggaacucagagaaguuaaguaacuuguuuaaggagagacagcuaguaagucuggacuuugauuuggaguuuggacuuagauuuuacuuacuccagagccuauaccuaucuuccaaaauauauuuugauuucuaaaucauuguccagcaaaugacacuuggaagauuacuuaaaguuagaauuugccuguauuuauauguaauauguuacauauaauaucugcauacacacaagcacauggcuaugugacugguacauauauacuagacauuuacaaaccuggaauauaggcauugaaugaaucaauucaaauggacaaaauaagaaauccagaugaccacuggaacacuaaucaagcagcuuuuccuuagcacgcaguguauauugucaauacccaucauguuacuaugugguuuaauaccuuucauucgacacguuaaauuacugaggcuggccgaacgcgguggcucacacuuguaaucccagcauuuugggaggccgaggcgggcugaucacuugaggucaggaguuugagaccagccuggccaacaggguaaaauauaaaauuaguggggcgugguggugggugccuguaaucccagcuacuugggagucugaggcaggagaauugcuugaacccaggaggcagaaguugcagugagccuagauugugccauuggacuccagccugggugacagaaugagacuuggucucaaaaaaaaaaaaaaaagaaaaagaaaaagaaaaaaaauuagugaggcuaaaagauggacaugguacaaacacagaaggcacugauucaucugagguauuggugucaugcuuaaaaucccgagcauuucagacauauauauuguccauccauccauccacccaggagauguaccaugugccaaccaucauacccagaauuuuuauauuaaaaauagaaaauauacucuccaggaauuugggaaucuauacugguuaguucugaagaauuggaaauuauucuuauugaguaaaaaguuagaaguauauauccuacuauaagacuuuuacaauguguuauuuugcauuguaggucuguuaugaauuguuaucuuuuuauuagcaaaccuugccugaauuauuaauauauaucuugguuuuuuuaacugguacauuucugcaaaugaauacaaugacauuucuuucaaaauaaagaugagccagacuuuucauuaauuggggcagaacuuuacccccugugccaauaauugaugagguuuugcuuuauauuuuauuuauaacccacaaaggccaaagcuuugcauucuguggcauucucauuuaauugcaaaguacacugaccgggggucagaaauugcagggcugagcacaacucacagccagucauucagcugugcugugaaucacauggaugcuagaaaugaagccaucacuguuaccugugguauuaaagccaaacagaagagggcaggacacagcaaaggccaguacccagacggccgugaucaugagggccacgcgccgacaggagcucugucccgugccaugcugguagugaacgggcaugaccacugcaguguaccugaaaaagcaaggggagaggggauaggcauggugagauggaaugggguacuuuucuuucugcguuguuguuguuguuguuuuuggagacagggucucacucugucacccaggcagaagugcaguggcaugauuacuguucacugcaguucaacuccugggaucagauccuccuaccucagcuuccugaguaucuaggauaugccugugccgccaccacgccugccuaauuauuuuauuuuuuuguagagauggggucuuacuuuguugcccaggcuagucucaaagucuugggcucaagcaacucucuggcuucaagcaagucucuggccucagccucccaaaguguugggauuacaggcgugagccaccaaguccagugaggggaacuuuucaaaagaccagaugaaagaaguucguagagaaauaaucagguugauacauauagcaugagaaauauaauuuaguuagaggaagagagaaaagcagaaaggucaaaaauagcagaaagguugagauaagauaaaugaagaacuuacugagggagaugaacucagaaagggaagaauaaaaaaguuaacacaggaucacuggauugcuggagagcuucuuuaucgguucuaccugaucacccagcauaaccggccuuacugucacacacccuucacucugaacacucugggugcuggucugugugccuuuaccgucuccugcagguuuucagacaaugauagaacauaccuaaagaggauauuuaccuccugcuuguauccuaauauaaauuauaaccuucauugugacagcuccucuaaguaguagauguuuuaaaaauagaaaugaggaauguccagugaaggcuuauuuuaaaauccaguuuucauucuuuuacauaaccaaagcccaguuccuuacuauuauuggacaucuuuguguuuuuuuugugacaauucuucaccagcauuuccagcugcccguaggacuuagcuggacaaauguuccacagucaacucaaacucaagaugucuaaaacugaucuccccaacuccccaaaccucucaaucugguuucacugacugccuuucuugaagacauccagacccaguacuuagaccuuuugacucucccuggacccuuucauauaaguugcuugcuugcuuauuuauuuauuuauuuugagauggaaucucagucugucgcccaggcuggagugcaguggcgcgaucucaacucacugcaaccucugucucccagguucaagcaauucuccugccucagccucccgaguagcugggacuacaggcgccugccaacaugccuggcuaauuuuuuguauuuuagcagagaugggguuucaucauguugcccaggcuggucucgaacuccugaacucaggcaauccaccugccucggccucccaaagugcuaggauuauaggugugaggcacugugcucagccuuggucauuuauucauuuaaucuuuauucaauauuuauugagucccaacuauacgccaggccucauuccagguauucagaggugugcaaaaggcacauugucccuguucucuuugagcuuagaguuaaguggagugaaugaacaauaaaaaaggaaacaaauauguuaauauaaaaugaagaguaccaugaaagaaauacacugggugauguguuagagaaccagggaggagguaaaacuaacacagagugagcagggaagugagugauacgagagggagccagccaugaggucagacgggggaggaacauuccagguccuguaaauuuauccauugcaauaucuuccccauuuauuuauccaccuaucccuuuccugcuaccugauuucuaugauggcuacagccuccucguuggucuccugcugccagguuccaaaaauaaauuucaucacgucuccccaucuccccaccugaaaauuaucugagauaggcaggacucuaggauggccccaagauuucugccacguauaauccccuccguugaguguaggcugaaccugugacuauaaugcaauaucacuccugugaucagauuacugaucaguugagguuaaguuaaucaaaagggagauuaucuugagugggccugaccuaauuaggugagcccuuaaaggggacugagaaauuauccuuuuggccuugaaggagcaaacugcuauguuuuggagagggucauuuuuuaggagauggcaaaaggcuuacaggagcugagaacagcacugguugacagucagcuagaaaguagagaccucaguccugcaacugcaaggaacugaauacuccuaacaaccugagugaguguggaugaggaccucaggcuccagaugagaacacaacccagucuacaccuugauuucagcccugugagauccugagaagagaaccuaccuacacuguguacacagugcugacuuacagacucugcaagauaaaaauggguacaguucaagccucuaaauaugugauaauuuguuccacagcaauagaaaaugaauacacuguugauggcuccucuuucaccuauaaaccaagcucagccuucuccaacaugaccucaacuuacguugccaaucugaccucccacugauccugacacucacagcuccagccacacuggccugguaaugaguacucuucaauagucagagacuggugucuuuguucaauuaaucauuccuucuuccucccugggcaacucaaucuugcccuccauuaaucucagaugaacuuuccagccaccuucccacuucuuuccaucauguacagagacuucuaacuaugaacucuuagcacuucuaugcaaaucaauuacaaugcccuccugcaugcagcugucuugccucaugacugaauuugccucguggcuggagagagagagcuccauauaauuuuaguuacuucaggaucaaaucuucuuacaaccuugauauuuuccauagguccuuguacaaagaaaguaauaagaaacuguuaacugucugccucaugggucacgaaggccuccuuuccuguaagaggggaaggcuuccuucccuucuaauccuggccaggcucagggaucuaagguauaagcuggaucuaccaauggcucaacauuuuuugucuugucaguuuccaaggaaccuggagccuccuuaacccuuguugugcaccucaaggccugggauuaaggaaaggaaggacagaugcugggcucgaagggaucgggcaaggcuuccugaggcuccuccuguguguuuccccugcuccuaugcgccagcacugcccgaaucugccucuugugcaucuuguuguagaguaguaacauuugcauucccagaagggcagauuacaguuagcugugaguucugagaugaagguaaacugugcaggacuuggccuugacaccaugcuguaugacaaagguggcuucuuucucaaaagggaaaaauuugauaaagucaaauuaagauccugcuacccacuucuugggaggcuacaacaaccuaguucccuucaucugaugcaaguccucucuuaaauccccuccuugguuuauacaagagcaggucaaguagcagcugguguuucucuaggccucugacucuccucagagcuuuagacucugccgggggcuucuaguacaauaugucuacaagggccucgcuguuagugguaacuaugaggcaccuuggaggaggggcugagccuugaguccugcugcugccaugacugaacagcgaggggaaggaauacuguaacucacuuucuccaggccuuccacuugcauaauguccuuugauguaaaagagccugacccuucuguguauucaguggugugcugguaaauggcuaacaacaggcucuguaguuuacaaaaagcccuaauuuguauuauuugccaauuucuguggugucaauacucccaccauggccuauuuuaagcuaccaccaaagcuuuaauaacugaugcaaaaaguuucuaaaauuuugccaaucagcucucgcuagccaugauaagccggcuucagcagaccacugagaguuauauacuuuccuaaauaugcuauaauguucagcaacucccuggaggcuccauuaaugaagugggccaacaaguguagggaacccuggcucuaucccauaaaggaggaagcagagaugcaaggaugucaguuaugagcccaagguucugcagcaaauuguggcagagccaugucucccaccucugagguguguuucuccugagugcccuccucccucucgagggcaucgacagcucucugaguucuugugggggacaagggcuuccucagugaagucagcauggcaagggugguuaccgcuugcagagcacugcgugcgcccacaacugaguuuccucaauucgcucgauucuguuaauugccuggggguccuguuaaaaugcagaauaucaggcuuaguuucuggagauuuugauuuaguacuucugaaguggaacccagaaaugugcauuuuuguuucuucuuuuuugaaauuauuuuauuuuucgauaaguuauugggguacagguaguauuugguuacauaaguucuucguggugauucgcgagauccuggugcacccaucacccaagcaguauacacuguaccauauuuguagucuuuuaucccucaccccacuccccuucaucugaugcaaguccucucucgaaucccccuccuuggggauucuucccccaagucccaaaaguccauuguaucauucuuaugccuuugcauccucauagcuuagcucccacauaucagugagaacagaaauguguauuuuuaacaagcaagugcaucuuaugauuagacagguuuugagaaagucugcauuagggaaaacuucugugacaaagauuuuuguucacuuggauaagaaguaagagacaagacuacaauuuaacacuguuacaguaauuuuuuucuugcucuuuuuuaaacaugauuaaacuguuagaauaaaugaggcccccgcuugucauaagccgacugcgacagggaggcuguaccggaauuggccaucggagggcacuauaaugcagcaagaacucugccagcacggcuggggugagaaguucacugcucaccugggggcucuccaggcucuguggggaggcagagagggaaagcccggcgcccugcuuccuggaacccugcagggacccugcauucccacccaggccgaccgcuuagccucugacuuccucucggagcgauugcacgugaccgacugcaggcgagggccgcgccaaagcacccggagggcugggcugggcuuggccgggagagagaggcuuggcccagggccaccucugaacaucuggccgcugcgcucgcggcgguauucccagguccggaccugccagccucgcacugugcgcgccgccccugcagacccugagccagggacccuccccuugugucugagcucuuagcucccugggccguuucugguguggaugacuccgcugaccccagcacuggcagugugcuuggugauuaaguccgcgggcaugagaaacggacugaucagcucugaaucccggcucugccacugaacuguguagccaugggccagugguuuguuuuuucuaagauccaauuuucucaucuguacaauggggauaauaauuucugcccgaaaaggcuguaaugaauauugaaugauauuuucucuguaaaccuuuuuuuuuuuuaagucacagugcccagugauuaauacuaaacauucaaaagacgguauuauuauuguuauuguugucauaauuauugugcuagcucaagggaucagugauuguucauaucagugaguuuaugguugucuuccccuuccuccugauaucagguaauauuaaauuuguuuauuuauccaccaaaaauguacaugacacuuucuaugugacaggcacuauuugaagugcuuuacgaauauuaauucauuuaauccuccuaacaacccuuugagguaguuguuauuaucuccacuaaacagauaagagaacugaggcucugacagguuaauugacuugcccaaggucacauugcuauuaaacuguagagccuggauuuuuagccaggcagugugacucuauagcuagggagcccagagccagacucgcaccucagcaucucugaguaagggagugugcuguaauagacagaggcugccugaauccuuacucuugcaccacccaguugugugaucucggcaagcucaccuacccauucuagucucagcaccuuuauuuauauagugaggguauuacaucucucucucuggguugucgugaagguuagcaauaaugaaugaagaguucuuagugucuggcacauaguacaugcuaaauaaauguuaacuauuuuuauuauuguugcuuccagacucauguaaguuagcauuagcauagagguagccagggcauugaagacauaggugccccauccucaccuucaccaaugaaggugucacuuauuguaauagagugcugguggaaagucaggagauuccauuucuagucccacaccugugcuaagaggcugcagcacuucaugcaagcauuuagcauuuccacuuaaaugagauaacugugaugccccuucugacuucugguucuaugagcaggauguugccccuucugacuuccgguccuaugagcaggaucuauaugguuggucacuuacugaaggucucaguaccuugcagaauuugauuucaaucucagagcccugucccagggugggagauguguguguguguguguguguaugugugugugugugcugacaaggguugcucuuuaggaagcuagcaguccaggaggaaagaggccagccugggugggaaggccugacucuaacuccccgccuggguuuaaugagccccagaguucugugagggcugcuuuucaccaucuuuuauuuggucagacagggggcucaauauaucuuuaguucuguggacuccccuccuggaguuguugaaggagaaagcuuuuugcaaaugacuggaaagccuuuugcaaauauaaagugcuuauuuagaugcaaacuaaaaauccaaggugccugugacucaucugguaccuauugugcucgcugcaaagacgcggaggcuugccugugugaugggugccauuugagagccacuuaaagaacucccuggugaaugaauuuggcugcauuauuccugggcuccucucggaggacucuaauucucaccacuuggucguguccuccucuucugacacauucucagcccucucccugaguuaguuuggacccaggaugugaugggaggagggcuggcucccuggggaggcaaggagcuaaaggagugggggcuugugcuccgaggacuucccacucugcuuuuuaaaaacgaaauggcagcauuaauccaagcaucagagcuaugccuaagaaucuaaugacaauaguauuacuugcuuucaaaaacccuuuuaucauuuccuuuucuuucauaucucuuuccacagcauuauuauagaucagggcuucaugaccaaaaaauacugaauccauuugguuaaguuugucagauuggugacuggcauugugugaagaccaaaggucugcgugaaugacugcauuuuuaaugaauugaccagcuauuugucaucacaugaacagaauguaaugcaaacugcugugaagaauaaugaacccagcuuuuccaaggccuguuuucauuucuagaauaggagggggcuccauuuugaggcuuggugagaauucauuggcccauauagaacuaugagccaagaagggagcuucguuuucgcuugggaucuaaggcauggcuggucccuucagguagguaagugcuguguauucucggaguuuuccuauaugggacagaagccaauucaaaguuacucuuguugguugcguuuuaagugguaaaaacuagagguguguuuuaggcauggcugcuggccgcaaaauggugcucuugugcaaauuaaagaaaggcgcccucuccuggcuggcaaaucguagaaaagcacccucuucuggccaacucuaggcuuggaaaagggagugauagcugaauuucauuuccacacccuugcgcagggaacaaccugcacaaccucacccacagcccuaagugcauaagaauauagguggguggaguguauaggcacacucucaagagggaagagaggaggcucaggaacuacgagggcugagggggcucucuuuacacaguucucccucuucacaaagcgaacccucucccauucucugacguccuuuccgaaagccuccucccaaaagucaaaagccuccucccuuuccuccuuggaguucucucccucccacuuccccuuccgccucuucuccuucucccaauaauaucauccauccaucucauagcuccagcaggugacccaaauaagaucugccauuuauugagaauuuaucacauugugcuaagcuuugacacacauuaacucauuucaucuucacaauucuuagguacuguuguuaucuucaauuuccaacuucuuagaguauuuaaggaauuugccaaagccacaccauuaguacugggcggugccaggauuagaauucaugucuauuugacuccaaguuaguaaucuuaaacuuugugcuaaccucccuaaaucuccaacuacaucccugccuucuccccugaguuccagaucacauuacuuccuggauaguccacuuguuccuauuaugccagauguuaaaaaccaaaccauuaaagcaccaaaucgucucgacauggugaucucuucuugacagcaucuuucuccuggaaucuuguguucuguuugacuccuuucucuuccuaaucuuucauauucaagagguugguguuuacagaccuuuugccguuuuuuuuuucaaaauuuccccuacuuuuccuuucuuguuuccuccuauuuauuuuaggauccuaugaucccuuaccugaaauucugcugcacuuucuaacugguccuucauagcacuaucaaaaucauucccuuagaaguaaagccuuacucaaaaucccucagugccuccuuggccuauugaauaaaaguuagaauuaccuccacugccuggcauucaauguuuuccacaauauggcuugccugucuuucuuucuuucuuucuuucuuucuuuuucuuucuuucuuucuuucuuucuuucuuucuuucuuucuuucuuucuuucuuucucuuuucuuuuucuuucuuuuuucuuucuuucuuuccuuucuuucuuuucuuucuuucuuccuuucuuucuuuuucuuucucuuucuuuucuucucuuuucuuccuuccuucuuuccuuccuuccuuccuucucuuucuuucuuucuuccuuucuucuuuccuuccuuccuuccuucuuucuuucuuccuuucuuucucucucucucucucuuucuuucuuucuuucuuuuuuucuuucucuccuuuuuuuuucuuucuuucuuguuguuuugagucagacucuugcucuguugcccaggcuggagugcaauggugcagucucagcucacugcaaacuccaccucccggguucaagcgguucuccagccucugccuccugaguagcuggaauuacaggcacccaccaccauguccggcuaauuuuugcauuuuuaguagagauggguuuucaucauauuggccagccuggucucgaacuccugaccucaaacgauccucuugccucggccucccaaauugcugggauuacaggaguaagccaccgugccuggccucaaucccccuuuucaauuucaucucuucccagguugccccauacccuucucaugcuccaaagucuaucacaaugauccucuuuuccauaaagcccuuucacauucccacagucugauucagucacccuugaacuucacaaugcuuucucugucacuauguuguggcaucuccagccugcuuuuucuagaggucauagcacaggcccccucaauuggcccaguguugugcccucuguagcaacagccucacauuuccuuuuacaugcugaagugggaauuuugaacaauaaccaaaaaaaugaauaugaacacacuuugcucuggugauccugcaaaccaaucagcuaauuggaugauuuuuuauuuauaucacuugguuggcuagccaacugagaagaaagcuaaagaacauguccacaaugcugaaaauaauaccauuaaagaguguguuuaaaaaagagggguaggccaggcacaguggcucacacguguaaucccagcacuuugggaguuugaggcggguggaucaccugagguugggaguucgagaccagccugaccaacauggagaaaccucaucucuacuaaaaaugcaaaauuagccagaugugguggcucaugccuguaaucccagcuauuugggaggcugaggcagaagaaucacuugaacccgggagguggagguuacagugagccaagaucgugccauugcacuccagccuggacaacaaaagugaaacuccaucucaaaaaaagaaaaaagaaaaaaagagggguccagaugcaguaguaugugccaguaaucccagcuacuugggaggcuaagaugggaggguugcuugaguccaggaguuugagaccagccuggacaacauagcaggaccucaucucugcaaaaaagaaaaaaaaaaaaaggaauauaauugcauaagucuguaaacauaccaauauaacauugaauuacacacuuugaguggaugaauugugugguaugugaguuauaucuucauaaagcuguuuuaaaaagugaagaguuggggauuuuagaauauuuuuagcucuaauaucuaagucuuuuguguaauuucuagacauuuaguacacauuuucaggagugcauuauuugcagacauagaggacugcagcugguuugcuuuauuaucauuaccccaaacucuucuacaagaccuagcuccugaucaccugugaccuucccugcugugcccauuacagagucuugaacaaagaguauucagcugaauucaguggucccuguuugaagguagccaauguuuauaccauaaaauaacaguaccuaagauaauacauaagauaauaacaguaccuaagaauugugaagaugaaaugaguuaaugugugucaaagcuuagcacaaugugauaaauucucaauaaauggcagaucuuauuuggggucaccuguuggagcuaugagguggauggaugauauuacugggagaaggagaagaagcggaauggaaagugggagggagagaacucagagcaggaaugggaggaggcuuuugacuggcagcaagggccauaggcuugaaagugaccuccuuucccccagggcucucagugaggcuggugaugucccaggggagccaggcaaaucucaggcucaggcagaggaaaggggaaagaagagaggaagacaaaaggagaggggaagggagaaacagagggacccagagcaaggguggugaguccaggugcucucagggauagaaagcaauguuacucaggcagaacacacagagagaggagucaaaaucacagcaauucaccccagcaaccaaaauguaauuuuaaaaaacauacuauacuugcuucucuaagcucuaugagagaaacauauagaucacagccaugcuuucuaaaauugccuuucucccccacuucucuccucucucccccucaaaaauuaucccuacaccugccccucuuucuuucucuuucucucucccaccuucucuccaucucucccuucaacaaaaacaaacaaaacaacaacagaauuuccuaccaaccccagucagcucaccuuuccuccuucucccccucccuaaugggaagcuuuccuuccuauuaggaagaaaaaaaaaaccccaaaggaugguggaaaagcaaaaccagaauccucuucagggagcuggaggagaagaaaggccaggaaagcuuauagggucguuauuucccaccugucgcagggguuucuucucaccugcaaaccauacuuuaaaagaaaaagagaggaaagaaaauguuccagugucaaguucuacuuggaggugaccccaguacccucaagugcacaaucugucucuccccacuuccccagcuuuugggccaccuggaaggggaauugcagcccuaccugucuaugcugauggcacagagauuaaggaugcuggcuguacacaucaugacauccagggugacaaaaacaucacagcaaaugcggcugaaauuccagacuccaccugucaccuggguaucagagacaaggauguuaguguuuaccccagugaaggaacgacaacccaguuggcccuauuuucuuugcuuugcugccuaguguagauguuggcacuccuacucccuguguaccguuguucccacagggcagauggacaucaagggagugccaggcuauccaaaacugguugccuaaagaaaggacaaguucacagaauguuagaaugcuaaugcuggaagugaucuuccaagucaguuaguccagugauucucaaagugugguccacagugggguguuuauuaaagauguagauuucugaauccuuccuauaccuacugagucagaaucuuuggcucuuuggucuguaaaucuucuuuuuuauuuuuuuuaaauuuauuuuauuuuuugagauggaguuuugcucuuguugcccagguuggagugcaauggugcgaucucggcucaccacaaccuccaccuccccaguucaagugauucuccugccucagccucccaaguaguugggaauacaggcaugcgccaccaagcugggcuaaaaucuucauuuuuaaauaaacacuccuauacauaccaagguuugagaaucacuguugaaauucaaacucaggaggcaacuaaugcuccuugugguuaagugauaacuuccucauagaugcucagcuggugguaaaaggacuucggugacuacccgauguguacauugugccaaaacugucucucugaaguccuucacccaguagagagcucaucaugcacucaagaaauaagcuaagaacacauuuuucauaaaauuuaccuccaaaguaaaaaucuaucuggcuucagcuuguaaagcuuggaaacauucugaaacaacauuuaugggaaucuauguaaaauaagucugugccaaugugacugccuucaacacucucccuccccacccacaucccaaaaaccaaaaguggggaaaagggcuggauucucuccacuacucagaauucaugaggaugguuucaaccucaugcaucuaucuauacauguauuucaagcuccauaacauccucugaguaaugcuuacagucaggaauuuauauaauaucauuuauacucuaguauauuucuauuuauuuuugaaaccuuuacauacccuaauugaaucaggaagaugugucagggagauugacacuuuuaaaauguccaccaaaggccacucauggaccgcgaggcuuugugcaguuaccagcuucuuuccugggggggugggcugucauucuuggggacccuaguucucggggagaaaccugccaggcuuugugccucuggcuguagcugaguauucacaauaccgcuccugaacaggcccaauggccauuuaagaggaagaaagagugaaaaaugguacaguagccucugaaguagcuucccaauaagaaaacagauacugaccaaaugacugugcauaaagauagugcuauuccuucaucuggauuuucucauccaaggaucuucuuauaugaccaggucacuuuaguguucauuucuguuuuaucccaauaaaauaagguccuaaaaggccgucuuuccuucccugucccugauaacuucuucccauuggauuuauuucuuuuuuugcaucucauuuuauuccugugcuuggucaucuccagacuguuuugagaaacccugaccaaugauuuuuuguuuaaaagcaacaaugaaaauuaaaacuagugaagaagucaaauccaguuauggauuuacugucucucuuuuaguuugaccaauuggcucuauauaaauaaaggcugaauaugaauuuauaggaauucugagaauaaaaagcuuuuaaaagauugagacauaagaauuccgaucuaaagagucauaauaacacaaugauuuaggggaaccaagagaauaaaagaagguuuucuucauuacauaggacaguugcauacuguaaaagcgucuugcaaaagcugauuuuguauacuaaauuuuauuucaauauuauaucuacucugcaguuaauguuuuaaauuggguaaaaaaacacuuuuuggcauaauugugagcacauguuuguuuguguuuugggcuagaguaggugagaaaggauaguuaggauaacagcaaacuucaguguuugcuggauauucauucauucaugcacuuguagagcaaauacuugugaagcucuuaguacuugguuugcagcaguguaugucauguguguugagagguuuuacaaaauguacuacagggccuauccuuaaagaauuuacaagauaacuggagaaguaaggcauucaucaauaaaauacuagagaucaucaugauauccuaauauuguuaauaggaauuaacauuuauugagaauucacuguacauguguuaccaacccacaugacccauuccaggaauuucuauaacuuugaaacuucagacuuugaaaacugaauuuguuuuuauuguauguguucuuaaagcuuuuugaagacaaguuauacauuuacuugauaggggauggaguuauuguuacuuaaccaacaccaacaggagcaggaagauuuacuuguuugcugcugcacccccagcucccagagcagggcccaaccaugaaaauauauucugaaauaauaaaugaccucugacauaaucugucauaauaauagcuaacauuuauugaacgcuuacuaagugccugguguucugcaaagcacuuuacauacguggccucuauugccgauuauaauucuaugacagaggauuauuaucuucauugcagaggaagaaucuaaaagcuuagaaagaauaagcacuuuguccaaggucacagggcuaguacagggagacagagcauuggaauguagguuguuacacacccugcuauagggaaguguuaggugaggagggauaguuguuggaaaagggauggaaguggguagauacuaggggaaagaagaaaaccagguguuccucagggauuuuugugugacagaccauaucaucuccuuucuagggaaagagacacucuccugauugccucuaucccaggguucaaagaauagugcaagagacagugguaagugcugccuuugggguuggugaaaguacacagacaguuuuauuuaauaccccuccugcuuagcccccaaaggacaaagcccucaagcuguucucuggcuuccaggcccccaauggccugucaucccauucuggcuauccucuuuucuugucuccugauucugccaugaaaauucucauucucuccuugauuucagcuaagagucaagaagaaaacaaucugauuagcugauuaaaauaauucccacuaaggugccaucacuuagccuucccuggagcuuacucauuaaaaugagucucuaauuggugggacuuguaaugaauuuuuuuuuuucuauugacauccuccauaucaagcaacaaauaguaagggaucaauaaagugcaucuaggugccaagaauaugcugguaauucucacacauuuucucaucacaaccugaagagguaaaugugauuuuuaacuuauagguaaagaaauggagaccuggaaggguugaguaauuugccaaauggagaccuggaaggguugaguaauuugccuaaggacacauagcuuguaaaaggagcuaggauuuugaccccuuuauauuaccauuacucuuccugccucucaaaguauaguggcuugccucuucagagauguguacaauuuaacucuauucuaauaucauaggagguagaagaguugguguguguccauccauuaccccuauagccauggucuaaugagugcccaagauaugucugauacuuugcuugggcggguguauugaaacaaaccuguuuuuguucccaggaucucagaauacaaugugugccuauuaccagaagugaugugugaauggguaugggugaacugagggcccgggagauaaguacuuaaaaaacagcuaugaggcaaugugauaggcaccaaaggugagauagguacaaaguguuggaagauuaugaaaggcaaaaugauuuuugaaauuaaaacagauaaaagugaaaaaaggccuggugugguggcucccaccuguaaucccagcacuuugggaggcagguggauaacuugaggucaggaguucgagaccagccuggccaacguggugaaacccugucucuacuaaaaauacaaaaauuagcugggugugguggugggcgccuguuauccuaccuacuugggaagcugaggcacgagaauugcuugaacccgggaggcggagguuacagugagccgaaaucucaccacugcacuccagccugggugauagagcgagccucagucucaaaaaaaaaaaaaaaaaaaaaaaaaaaaaaaagugaaaaaaaucaaauugacuugaggcuuuuuagagacaugauucuuucuccugcauucuaaugaauaacucacuuuagaauuauacagcaaccaggugguguuacucuuacuugcuaaugaauguaaguaacucccuguggcaauacagaaguugaguaagcaggaaagugucuucagguacugaaauugucuauugauuuucaauagacacagccuagggcagcauuccccaaauuuacugauuauaaggcagcauuucccaaaucuccagacacucuuguuaaacaaaaugauucuuaggccucgcucagaguaauaagucccucaagugauucuuauugucuugguuugggaaacacuggucugggguuaaggggagcauaaaaugauccugagaaauuguuguuccuaaagcagguuuucuuaagcauucuuuauccuguggauuucguuagcuucaugauccccuucucagaagaaugcuuuucuucuuuuuauuuuucuguuuucuuuuuugagauggagucucgcgcugucgcccggcuggagugcaguggcacaaucucggcucacugcaaucuccaccucccggguucaagugauucuccugccucagccucccaaguagcuggauuauaggcucaugccaccaggcccagcuaauuuuuguauuuuuaguagagacgggguuucaccacauuggccaggcugguguugaacuccugaccucaggugauccacccaccucggccucccgaagugcugagauuacagguaugagccacugcgccuugccagaagaauguuuuuaaagcaugaaauaaauacagugguucauaaaggauaucaguuuuauugaaauauaauugucaaaguauuuaaaauauauguguuucuuuaauaauucauuaaauaacaagaucuaguggcagguccaaaauuccuauaauuucaaagaaaugaugaguauaagugauguuucaagauguccgcaacaaucauaaugugguuugaaaauauaaauaucaucagugugcaggaaggaggguuaaaaaguuaaacaaaauuugggaggcugaggcaggagaaucgcuugaacccggaagguggagguugcagugagcugagauugcgccacugcacuccagccugggcaacagagugagacuccauuucaaaagaaaaaaaaagaaaguuaaaaaaguuaagaaaaaaaaucugugauuucuacuggugacacuaaagauuucuucugcuguggguugauaccuacauuuggaauuaaaggaaauucuaaauuucaucucagggaaaauaaaggaguaguuuuauuuacauccaaguugaugaacuccccagauuaagaacuccaacucuaaagggaugaauuuuuaguuauuuggaaauaucuaagaggcaaagauagaaguacuucucuaauuagccucuucaguccauuuuuguuugccacauuuggaguauuucuuggugggaggguugcuguggggcaaaacagaauaauaaauaaggauuuuucacuucucugcaucuucauuucuccaucuaugaaauaggggguuuguagcuuauugguucccaaaugucguagcagaugacuagcugguugcacaagucacauaaggugggaguggggccuggggcuuacucuagacuuccagggcugcccuggaaaugcugguuugguagacccgagguagacccaacaguuuguauuuuuuuuuuuuuuuuuuuugagacagagucucuguugcccuagcuggagugcaguggcacaaucucggcucacugcaaccucugccucccggguucaagcgauucuucugccuuagccucccaaguaucugggauuacagguaccugccacuaugccuggcuaauuuuuguauuuucaguagagacgggguuuuaccguguuggccaggcuggucucaaacuccugaccucaggugguccacccaccucggccucccaaaguguggggauuacaggcgugagccaccguacccggccaacaguuuguauuuuuaacaagcagucucuccuucccuuaugcuauaaauugugucccccaaaaggcauguguuggaaacucaauccccagugcaacaguguugggagauggggucuaacgagaggugauuauccuugaggacucugcccucaugaguggauuaauguuguuuuugugagaguggguuccuuauaaaaggacaaguucauuccccuuuugccucucuucugcccucccaccuuccaccaugggaugacagcaugaaggcccuucccagauggaggccucuugaucuuagacuuccaagccuccagaacuguaagaaauaaauccguucuuuguaaauuauacagccucauguauucuguuguagcugcacaaaauggauuaacacacccccuaaugaacguuuagcucagagcugcucaaaguuuaggugcauaagaaguauggaggagcucauuuggauaugagacuccaagacucauccucagagaaaccaugucaguagaauauggccaggaauuuccugugguuggaucacacuguggaaaugauggcaaaaauaaucuccaagcccuuccagcuuuaauauucuaugacuuuuaucaaaauccagaguuuggugacgagaucgugagaaucuccugucuuuguuuuccaguagggaggucuuaaauuaucauuugggguuuuuugagcugugguaaaacuuuccuuuaaaaaaacccacuucuuuauuuuuaauaaucgauaucauuacaaaacucaaagauucuucccuucccaaaauuuugcuauucuuuucuuucaucacaguccgaccucgaucgcuuuuucuguggugcguuuccuugccugaacucauccuauucuaucuugcuugacuaccuuucuuaauccucaaguuuuuccuccugucuacacugggacccaaguagucugaguuuaguauuccaaauguuccccuggccgcuuauacugccuuucuauccugauaaaaguguuuuaaacaucacaaaaggugcuucacugaguggaacaaaaugagaaguuugugcuuggagaggaagcucuggagugcagacgguaaagcaggaaauuaaaaucuugagaggaaaucugagacagaacuauuugggaugguacagaaaaguugagaaaaugcugcaaacugaauuaagcagauagccaagccagaagcccucugaaauauaaucuucugugaggucaccugcuugguuuuuguccugaacuuaucugccaggcuugaggacagagaauacugaagcacgucagugacuggucccugugggcccccuuauauaugcccaagugaaggcuccugugugucuuaaagaugagaaugauaccaaugaaagcugacugugguucccacuuacugacuauccucuucuaucuuuucaauaaauagucccuagaugccacugugaaucuaugagaucgcugggcaguauccaaagaagaaacauauaaccuauguuaaaucaauuuuucaagcuggaacucaugugccacaagccaguccaaucagagcacaucuugauacuucuacuagaaauucuaagaaaaggauuuucucucuugcugugaauggugugguguggacaugugagaccuauagcuuagccuguugccugcagguaaggucaguauauggaaaaaggcagagcugagagaacuguagggaaauggagcuggugcccugauggaacugugccugcagcccacccuaccagaggacuuuauaaaguuccugguaugacagccaaugcauucuguuuuuucauuuaagccaauuggaguuaagcuguuuuaaacuuauaauuaaaagugucuuaagugagauauuuauagaucaaaaguuuugguuaucaaaauacucuaucaguugaugacagcugagucuaacaucagcucaggguggaaaauguuguugucaccuccauuuuaugcacuuaaauccaugucuucugacuccaaguucugagucuuuuucucacagcaugacacuguguugaaaugacauucaucccagugaauuccaauaaaggaaaugugauacuuuauugccuacgucagagcaauuccccaccccuacaucuuuuauaaauaaaacacacguuuucauuuuuucuuuuuuagcuuccuuugcagcuaaagguggccucaugacuaaguucuggccaauuaagcuuaugugaaaccucuuagaaacaugcuuuaagcuacuacagggaaagugcaugcucucucucucucucucucucucauuuccugcugucccuacccauccuauuuuugaauacugccauggugcugggggcuauggcaagauaaagaacuaagccagcuugccaaggauggugaagaggaaggauggaaaagucuggucugugaugacaccauggggcagcugaaccaacacaauaauucuuuuccuccagaauucugguuauuugaaaaacauuaaaugcaguuaaaccacaacuaaucaagguuuccaauauuuacagccaaaacauuccuaccucauaaauacuggugucuggcaaaaugagccaauuuuccuucgaagaagguggauguguucaaaucaaagcacaugcggcuaugaaucuggugaaucuuuuggaucccaaagugguguucuucucauguacaucuuaucuuccugggggcccucaagccuacagcagucucgguggucaacauugcacccuuuucuuuuccaaagggagcucuuagguauaauuaaguaauuaguagaguagcuacucaaacuguacuaucauuaggacaaguuagugagaauaauacuuugcuucuucuugaggaacauggauuuauguauucauagcccauauuuuaagggcucaaagugcucuuuucuuucauuaaggugccucauuugccucuaaggaaagauaggaaaacauuugagauuaagaaaaguauagacugauguaagauggagagacuugguccucuguauucuucacuggcuuuagggccucuuuuuggucuuaccaacucgcuucaagacauugacugggucuugaagcaaauugguaagaccaaaaagagguccuaaagccagugaggagacgucucugcuccccugaaucuuccuugugugaauauagauuuuaaaaaucaugcucuuauugcuucucagccuuuugguuaagaucaaauguaaaaauuaugaucuugaucacugaauaccuacaugaaauaaccuguuggacagagggcauaguauuaugguuuuuauggggagaaaccaaaaacuucaucagagcuguucucauggaagaaaaccuauauguacuacuacagugauuucuuuaaggccuuuggcaagauuuccugucauuuucuauagucucaccugcccuucuaugcucaguaguagaauaggagcaccaguauaucagaagguauggcuagaaggggugccauggauuucuaguguggaaaagucacaaugucuaucuccuaaaccaguacauacagauguuuuccaguaugguccaaccagaguccuagaaauaaucacaaauacauagccaacaaaugccccugaguggcuuuguuacagacaccaaaagccugguuuuaucuuagagggaauaaaaaugcucauuagagugaagguccacugccuacauuucuuccugccauucauccuucuggaggacuuaacauuccuuggaacacauagaaauggacaaaaacauuuuaggaagaugaugacagugcuaugaguuauugaccaauucauauuggcugguugcaccuaaagcgccucauucuugaacagaaauaucacaugcuucgaaauuuuuucaggcucauuauuguuggauguaaaauaacaaauagcucguccccaaaaguccucuccccaaaaagucugaguguaacaauagauagagaggcagaugguauuagcaggaauagcccauauaaugcauacauuacagagaagauucauuucaucauucauauaucaaauguuauagcaguuagcauguauuuugugccagguaguauguuuaggcuacaggagaugaagaguaaagaucuagucucugacuucaagguugacucagacuaauuggguugacagaaaaaucaagauaauuauaagacccuucacccucccaacuaggauuauccuaacugggaagaauaaaugcauauuuuuuccucaaguauucccuuagccuuuagaucuacacagccuaguuguuuuucuucuuuuccuuuuauuucucuguuuucuuuuuuucucucuuuaugucucccccuugagaucauaagucuaauuuuaguucccagccaucuuuaacaaagguauuagcacaggcagucuauguacaagguuuuugcucucccgugauaugucauacuuaauuaacugucacuuuuacuaucaauauuaacugagauauuaauuugaugaaucuuaauuucucuuaaucauagcaucauuuugauccuucauuggauaccucuuuaaaaugacacacagugcagaggagaaauauuaauaguauacucagguuuuuuuaaaaaaacauaucuuaaguaauugcauguuuuccugguaagaauaucuguuucuugaacagauauggucacccugauuucuuuguuagcaaauggguguuuugucuugaccacccccuggcucuguuuugcacucccaauugaaaauacuuucaaauuuaauaaauguuucuccccaaaagaauucaccaggaucugcugcacuaucucucuggcaaaggcucuguacuauucauggacacauggaaaauauacauuugaggguuuugucuguuccuuugguagcagagucuauggagaacugguacccaggaggaaagagcaaagagggacugagccaucgaaagaagucugaucuguucgcuggucauucuuucuaucuucccuuacauucacuaauuuuuuuuuucuauaauuccuuuuuccuccuggccucacaucccuccugcacacccucacccucauauacauuaaacacuggugaagaggucuucuggacugcuucacccagcccaccaugucauugagacaugucuggcacagagaauaaacucuaggccauauuaggaagagucccgucacucaaauccagucaccugaacacuggagacccaugaacagaaucauucucagcuccuugguucugauguggaugagggacaggauggugacuguuuuccagagcuuuaacucucucauuacagggagaaugagagcucuccuuccuuccucaguuccugacugucuggggagucuuuugagccccaaaggccagaacucagggaagacaaguacuagcacagucauagagacaacaugcaccugaagucuacucaccuccagguauaccacccagggcaucaccaagguggccaccagcaagucugccacagccaggcucacuacuaaguaguuggugguagucugcagggcccgcuccuucagcacagccaugcacaccaggccauugccgaagacgauggccaggaugagcgcgcaguaggagagggcauaguaggcaugugggcgggccuggcuggcaccuguggaguucucugccccacagguguaguucagguggccacucagcuggcucagagaugccauagcccagagggaggugcgugaugccaaggggcuuccugugaggagacagaaaacaauauuaauaaaaucagacucuuuggggcuugguugcuuaguuacauuuuuuuauuuauugcaucagcaaauauuuauugagcauuuucuauauaguaggcacuguugugagaguuggagauagagcaaugaacaaaacagauaaaaucuuaauuccuucccuuugaagcucccauucuagaggagaagacagauaauaaacaagauaaauaaaagaugugguguguucaauaaugauacguauauuggagacaaaucagagaggcagguaaguaacgggugaagauugugcguaugugagugaguaucugaguauaaucaggaacuccucauggagaaaucagcaauugagucuugaccuggaggagaucaggaagcagaccaugcaguuaucagaugugauagcagucugagcagugagaacaacacgggccagcaggaagggcuagcacauagaagucauaggagggagucuggugaggcuggagccaagugaggcaggaguagaauaggagggugugagguagacagauugugcagggcuauugaaaguaccaugcuuggacucugagugagaugggaagcuguugcaggauuacaaucccagcucugcugcuuccuaacucugggaccuuaugcauauuacuuuaccucucugagcuccagauucuucccauguaaaaugugggaauaaugaaacccaucuaucuuaguccauuuuggguugcuauaacagaacaccugagucuggguaauuuauaaagagcagaaauuuguugucucacaguucugaaggcuaggggaagacauaaggccugugacuuagggaguaacccugaaacccaagcaaaagugacucuugccccaagcucuagaggaggugcuauagaggaguccacucuggucuucugcuguggucucgguguuugugucucccuaaauucauauguagaaauccuaauucccaauaugaugguauuaggaggugggggucuuugagaggugauuagguuaugaggacagagcccucaugaauaagauuagugcuuuuauaaaagagacccagagagcuagcuaaucucuuucaccaugggaagacauagugaaaagacagccaucuaugaaccagaaagcaggcccucaccagacacugaaucuucuggugccuugaucuuggacuucccagccuucagaacugucaaaaauagauaucuguuguuuauaaacuacucaguuuaugguauuuugugauagcagcccaaaaggacuaaggcacccucuacugguuaugccucuaaccucuauagaaugauguuguaaccucccacagugccaaggagaagguccacuaaguuuacaacccugucuagaccacacucagggaauucucuacccaacugcucagagccuguuuccaagacaucacgggucucauucuaaaucucucacucugacgggagacugugccauaaauguguaggguuccuggggccaagugguggcuuucaguuagagcucagacaaauagauucuauguagccugagguugggagagaagaggccagggucccugaagcagauuaggggugggggcccagcuucuccuguaugaucacauuuuguauggaauuuugaaagguccaggaaucuuaaauucaaacuuggccuuccauguuguuacgaagguguauuugucaaggugggaggaugaaacauuuuacucaauggcuuguugguuacaacuuuaaaauauuuaagcaugguacauauagaccuuuaugggaacucucucuucaggccuuggcaaaaguagaggcugacuugguggccagaauuugcccucaagccagguaucuguagcucucccuugauuaggagaccggccuaaucauggcugucauuuuguaccucacuuugaaauguuucagccugaaauaugaaagaguuaaaaugaacaaauacuugggaaagggugacaaacuuggaaugaauuuagagaauuguuuaaaaaaauuguccuuuaucuuggcacacuguuugcacucaauguauuuuaaaacauaauaauaauucuugauaauaauuauaauuuucucauuauucagaggagggcagccgcuacccuggagauagcaccgcugcugccaagagcuuuuggaaaaauacaaugcuuucugauuguucaaggauauucccacuuuuaaggcaggcugaggcccaaaugucuucccuuucacaacugggccacuuuggaacacaguggccagaaucccucuuuucuggggucugcaacuggugaauaaugucuuagccuccucucaccugccacguaagagggaggcauaaaaccuuaggauacuuguuacucuuuugcuggacuuuuuacucugccaagagguuugacagcuaccuaaaaauaguauagcugaaugccaguggcuaauuauacgaagggaaacccucaacucugaaaaucaauucugagccugauguuggaaucacaguugcauggauuucugauuucauauuuauuuuuuccacaucugaucuuagauccuuuauagcagcagguggguuaaaccgugauuguucagguaguuucugaugaguuguggaugugggagaugaaagcaaagaugagugagaugcuagauuacucucuaucccucagcuaauuguuucaacuuccucccugcuuagauuuuuuuuuuuuuuuucaaaccagaguugcuuauauaacacagaacugagcugggcuuucuucuuucuuuuccccucuguuagauaugcuaacagauaggaaacgggucucagguaagaagaagcaaagagccuagagaauucauuaacucaaucacucucuaaguaauuuacaaugauaggcugguuuccucaucagcaaaauggagauaaucauauccauuccauaagguuauuaugaagacuaaaugagauuauauacaugaaguuuggcacuacugacaauuugggcugaauaauucuuuguugaggagguuguccugugcauugugggggguuuaacagcauccuuuacauauacccacuagaugccaguagcauaccccuccccacaaguugggacaauaaaaaaugcuucuagacauugccacauauccuggagcgggggugcaaauugcucuccccaugaagaaucaucacucuagcauaaugucuggcacauagcacuagaaauauaguugcuuuuauuguuaagaggaaagugggaauaggugaagaguuaaauaagcugcaauuguaaaguaucuagugaacuuggaaaugaugacugacauucaugguggcauucaugcuuaaacauucaugaagacauucuuaaugucaucaugucaacauucaugaugacaugcuuaaacauucaggacgauauucaugauggcauucaugcuuacaaaaucuaagcagggaggaaguugaaacaauuagcugagagacagagaguaaucuagcaucucacucauuuuugcuuucaucucccacauccacaacucaucagaaacuaccugaacaaucacgguuuaacccaccuucugcuauaaaggaucuaagaucagauguggaaaaaauaaauaugaaaucagaaauccaugcaacugugauuccaacaucaggcucagaauugauuuucagaguugaggguuucccuuuguauaauuagccacuggcauucagcuauacuauuuuuagguagcugucaaaccucuuggcagaggaaaaaguccagcaaacaguguuaggaguuaaaaguggauaggagguaaaagaauagagaaggcagagaaauagaagauuacucuuggcgucagucuuuuaagauucauuacauauaacacuacuuacacauuuuaaugagcuuuuaaaugccuuacaaaguauugauuuaucuuggucuuuauaguuuguucuggcaucucuuagagugagugcauaaccuauuuaaaaaggcaggggaacagagaguugucagguccccaucaguuaugacauuuguccugcuuugcugauguucaaucccucagugcugaauaacagucuuccugaaacauucgugggguuccuccuuagcaccucauuaagacuuacagaguuuuaauuauuuguucucuuucuguaagaaaacaaaugaagaugaagacaacuacaucugggcuacuacuguguggcaaguaugaguacuuuacaugcauuuuaauacuuauagcagcauggaaguugacguuagucauucccagcccugcuugggggcucauuccuguaaucccagcacuuugggaggcugagauggaaggaucacuugaggccaggaguuugagaucagccugggcaacauagugagacuccaucuuugcaaaaauaaaagaaaagaaaaauuagcugcgugugaugccaugugccuguauucccagcuacucgaaagacugaggcaggaagauugcuugaguccaggaguuagaggcugcagugaacuauaauugugccacugcacuccagccugggugacagagcaagauccugucucaaaguaaaaaaaaacccacaaaacugucauucccgaguugagauggauuuuacucaacccagaacaaaacgcuucaguaacaggguuccaugaccacaucuucacucauuucacagaucucuggcuguugcuacaucuaaucuuuuacucagacgacuccugaccaccagucgccagagcuuuucuggucugggcuguaauucggacuugcuauauugccugauaaaauuaauaauuauagcuaaaauuuauaagcauuaucaucauucaaccucacaacaaccugaugaagaagguaagcacuauuauccuaucaaguuuucuagauaaaaaaggugagucacagagagguuaaauaucuugcugagaucacaaaccaguaaaugauggaguugauucaacccaagauuugucugauuccagagcucauguucuuaacuaugccacuuaacuaugccacuuuuuggggugaggcagacaaaugugaaauggguacuaauuuuacaaucucacuuguucagaguaugugaacaugucacaucaucugacuaggcuuggugaaguaaugcaggugcacacugcucauagagccagugggaguuacauuguuauuauuauuagagauagucuuuagcauuucuaugcuacuuucuucuugcaaauugcugccuauuuuccugaaaaagauucacaaauggauugcaauacauagcauauuuauguauuugggcacauuuacauuguugguaaauguacagagaaaaacuauugcugguuacugaguagcuaagauaacaguuuuuuccccucauuaaaccugacuaguaaagcagagcauacucacuuuccuucacaaccucuagagacugagcauccuaccauucuaaucagagauaaaauggggaacucagcaaauaaaucaaucaauaagcaaauauuaauugaugacaaacuucaaugcauuagaaauugaaucugauauugaguagaaacuguucgguauuugcuuuaauguauauuccauaacaaauagccuucuguauggaugcuuuaauauuaggcacccauuuggauacugucaguauuuuccuugcucaauacccuugcucacugcuagccauacagacccuugaaaauauucaacuacaaauaaaugagugccgaguaagaaucuuucucacauugucucuacuucuccuugacuauaagacauccuaaugccaugucaagcagugguucuucacucuuaucuaaggacagauauuuuacagaccuuuuaguaucaguaagcaaaggcuucaccuauaaagugaaauagucaugcacaaugaguuuagaauccaaguuucacuuugcuauugcugcauuauuauucaugcauguauuuugaugguauucaauuaaacuaaaugcaugaacuggaacaaauaccuaauugcaaugacuucuguugccccaguaagcuacagcaaguaauggaagucucacaauuaaauaacaauacccuaaaaaucauauaccaucaucaaaggaaacauacacaaucaucaucucaaguacuacauaucucugcugggaauaauuggauucugacuuagaaacagccugacuuuaaauagaccauugaaaauagugccucuccaaaccuucagcucugaauugccagggugcugaauugaggaguuuaaaauaacagacccuuacaauuaaguaaaauccuuaagaggaauacaaucaacuuccauacaaauccuagaaauaauaacagcuuuuuguuuucuaucuuuuaauucuuccuugauauagcuucuagagcccacaaggauacaauuuugggggaaaaaauaaaagaaaaaggaauauaaaagguuucugcuguccaaccacuuagaagaaaaagaaaaccauuuccucagggcuuugguuuuuaaauaagaguggauauugaguuuuaaugcauauuuuuagagauccacagaaccccaagcugauuaaauaaccuugaggaaaauacuauguccuaaauuagaaacgaaaagaaaaauuacuuacccuaaaauuuucuucugauuucuggagaccgaggaguuuaccacuucggcuccugcagccauuuacugacagcagacauacccaagcaaagcaaacuuugccuuucucaggacucagaaacuaugaaaugaacagaaagaaaucacccauuuuugccucuaaggugaaauuacuugagugcugcuuuuccagcuucccuauuagaccuuagugcauguuucauagcugcuuucgaauguauccguuuucuuuagaggauuugggagggacccuaaacugagcguugcuugggucagccgcucagagguucuguccuuggugcugaaagagggauggaguaggcauaggcaguauccguuuucuaccucgcucucuuuuccucuuugucucucuauc

SEQ ID NO: 192634 - RNA, 29814 nt, Homo sapiens
gcgccggcgcgcgaggggcggggugaaaggucacagcgcggcagcgggucuggcuggcggcagcggcgggagggagccgagagacccgagugcacguguggagaagcggcggcacaagcgcggcggcgggagacacucccgcccccaccagacucaagcccucacucgacucucgcggccuucguugcucgcacagcucccugcccaggcuaggaggccggcuugcgggguugaguggcccgagcuaagggugcggagaccuaagggcggcgacuacgacggcguugauaucggugguaacgacggccucagcaggcggggaagaugaaagggugaggaagggcagccgggcagggcccggccggugggguagaaggguccgggcccauguagagggggagagccgcaaaggcgaggagagauucagggcgaagacgggcggagggagauuucucugcuucucaguucccucggcucccggagggggcggaggcgaggcucgggcuguuggcgggcugaagggccagcggaggcaagacccggggggcuucaggguuucgguucggagacgaguguggguuguugaguggggagaagcgaccgaguggggcaacauggaaaggcuauugugaagcgcccggggccuccuucccgggagcggaccgcugagccacgccggcccgcagcuccagguggagugguuugguugucuuccaccuccagacucaacucuggaacugcgguguuugacaccuuucaguuuaauucacgcuugggagcugugcagaaccuucuggaggaagaagaaauuggaauaaagagcacggggaugaguauuaagagcuagugacucaacuagauuuggguugggucacagcgaguggaggagggggagagagcgcgaucacuguagacuuggggugccaacauauuuaaggaaguauaggguggaucaguagguggagcuguugcuucaguaguucacuauugccccugagugcugaggcgguccuggguaguucuaccacgcugcuccuuucaggugauuggcaaaguuaauguucggucuuucaccguuugccucuuacguaaaauuaggaauuauuuuggaucgacugguuaaguuuuuaugaaaugucuccuuaccauuaaguuguauaguuuuaauguauuaauuacguaacauuuuuccgaagcauugucucaagccguuuuggagcuugucuuuacccucaaagagaugaagcucauaaacguuaaaaagcucucugcgaugccauaguuuguuguuguaagucgauuaagaagucguaacuauguuuuaaguuaacgaagucauuccaacuauucaauagcacuuuugaggaugaaauaaaagucacuuucaacguaaucucauacugccccaaacaaggaccuaaauauuaccucuguguaucgguauuugagguuccugaagagauuccaagaaaguuuaauuuggucuuaggucuguaacauguuuccuuacuuuaauuuuccuuuaaauacuggauauuuauucuaauguugaauuguauguuuuguacuaauaaucuuuaaaguuuaagaaccaugaacuauucacaguaccugcauuguuucacaucaaguuguaaagaguuccaguuagggaaauauaauugacggguauaggaaguauuugcuccacuugaaucaugaucuuggaaguuuggcuauuucagauacaauccaacauauuuggagaauguuguuuuucugcuauacugcacuccuuuuguuuuguucuuuucauuuuuuuuuuuuuaaugaggcagggucuggcucuguugcccaggcuggagugcaguggcgcuaucucggcccacugcaaccuuugccuccccagcucaagcaauccucccgccucagccuuccgagucggugggaccucaggcgcgcaccaccacgccuugcuaauuuuuuguauauuuuguagagacgggggucugacuauguuggccaggcuggucucaaacuccugagcucaagcgauccacccaccucugccucccaaagugcugggauuacaggugugagccacugaacgcggcauauacugcacuucuugaacaugguugcugacucuuacucauuuuuguacucauugucaggcacucaguacuuguuugucauguucuguuaaguaagaaaaaugaggcugaagaguucccaguguugaaauugccauggauuuacgaagggguugccaggaaauuauucuguauguuuagauccaaaaucuucaaucuaguucagucuccauaggcugugauguucuuucugauacauaacuuggcgauagaaaugaagcugaacagucauauuauucacaaucuaccuugaauuaauauauucauggagcaauuaucucuguuuaaaauggguauuuacauguaaccugaugaaggcagaucccuagaaauaacuggccgaauuuagaggaaacuuacaacuauugaaucuguaccuuuaugccaguaacuaugccagugaaguuccuauuacuucuuaugauugggagcuuagaauuguguucuuuacuguaaaccuuuaagaugauuucacaggaauaaucccuuuaacuuaacaaaugaacuaacucccagaugagaugaaacuuuuuaauuuuuuuugcuucuaagucuguauuuaagacacucaacaaaugaguugugugaaucuuacuugugcuuguucggauacugaaccuacaacaguauagguuuaaaauaaguuaagcgccuugaguuccaaaacuuguaccacagugcacaguguggucgauuuuaaaguccugacucuuaauuuggaauggccuguaaaaacgaaacagugguccugguuauguggcuuuuguaugaaauuuuauuugcuaaguauucuauuguauauugagguaaguaaacaguaaauugaaauaucuaaaauuggaaacugcggaagucccaacacgaagccagucaaauauuuaaaauuguacacuguugccuauguugccuaucauauugaaacuuaaaacuuagcugguuuuucuucauauuuuuaccaugaguauuuuuauuaguaguagcaguaggacuuuccauuguauuggcaugucuuuccuccauagaagauaaauuuccgguuauuaacuacugaauguaauuuauaugcacauguagaaguuugagauauacuaggaaauguugcuuacuuuugagguuggcuguuuuuaugaaccagggacauuguaguuugaauuugugggugauauuuuuaucuguucuucucuagggaaggcgauuucaagcaagaagguaugccacagauaaccaugacugagguggcaauguaauuaggcaguguaauggaaaguauaauaaaaccaaaucauuuagccuucaauuguaguaaagaggugcaaauuaguucuaauaaaaaaugucuuuaacaaaaugugaauacgugacuaagaugggaaaguagguagcaguaauauaaauauggaacaauguugacuacuaauuggaauaguaaagggagccauuuuaccaaauaaaauuaaaauguaagauucugcagucagaaacaaaacuuuaaaaacuccgaacagugguuaccucugacagcauauggacugggaaggggcaaaaggaaugcuuuuugcaucucagcauagugagaccuugucucuacaaacaauaaagcagccaggagaaucaccugaaccuggcagguggagguuguagugagcugagaucgugccacugcauuccugccugggcgacagagugagacucugucucaaaaaaaaaaaaaaaaaagccaggcaugcuggugcaagucuguaguuccagcuacuugggaggcugaggcaggaggaucacuugagcccaggaguucaaggcugcagagagccaugaucuugucacuauauuucagccugggcaacagagcgaaaacuggucuuaaaaaacaaaacaaaacaaaacuuuuuuuaaagguuuauugcuguuuuguuuuucagcaaaaccaaaagcuagucaggcugacguagcauuugacaccuuuuauaaaccuacaguuuauacuucuuccuucugugaaacaauuugugguuuguugauugagauagugaauuuuaacaaauacuuuguaaugugcccuugcuguguugagaugaauucauauaaaauauaaccuuacaccauaaguuuuuuuaaaaaaucaauguacuguucucucuaauauaaaagaaaaauaaaagggaaguaauuuauaauaaaauuuauuucaguauuuaaugauguggcacaacuaugccauaaagcauaagaucaaguguuugcaucuaucuguaaauagaaucaucguguaauuuagaaaguaugucugcugccuauacaguugugugcauuguugacucauguuguguugccauuagugguguaauuucuuccugaaauugcagacaacucuuaggaaagcucuaaacaaagaauaaucaauacuuucugaguuggaaaagauuuuuuaaagucacuuaguaguccaagcacucaucuuauugaaucaagauauauucccuguuuaucauaauuucaaagauccuuacuucuguugugugaauauuauugcacaugugaucaguagagugggaaguguuacugggacuccuaauuuuuucuuccagguauugcuuauggcuuucagcugugugauaucugaagcgauacucuuucucaauuauucaaaugauuggccuucaucuuuuuuuaaaugcagccugcaguaaccaauagaauaccaguaguaaccaguagacacauucuucccaucgugaacgugagagcuauauuuaagucuauucaaugccuaacuuaauggcacaauuuuauuguucugucuaguacagucgugacuagcuacaguuggcgauugagcaguugaaauguaccuuguggucuguggcacaguugccauuucccggguaagaugucugcagucuguguacugaggaccuggagcaggaaugcugggcagcugauuuguuucacuguuuuccaacauguaguaauguucauguuuugaagccaaauuauguguguuucuuugauuauccuucauucaaguauagucauccacauaacuuucugaaaacaauuaaugcuguauguggacagcuuguucaguucagauucucagacacugaagaagggauuagaaaaguaacuguuaauguuauguaaaagaaggagauacagugucucaguuugauaacaucgguaaaguucaaagugauaaagcuucuguuaccaucgcuaguccuuaugauggagucauugaaaacucuagcauagucuagaugauauugccuauguggggaagccauuaguaaacauagaaacagaagcuuuaaaggguacuguuaauuuguuuuaccaaauugauuauuguccaccuuuugucauugggucucaauuaaaagugaccuuuaaaaaaaaaaaaagaaaaaaugugccuuguaugacagaacuaaauuuuaaauuuuaaagugugaaagcucggauucucagcuggguacuguggcucacacucguaaucccgacacuuugggaagccaaagcaggaggaucacuugagcccaggaguucaagaccagccugggcuauaacauagugagaccucaucucuacaaaaaaauaguaaucauaauuagcugggguaugguggugugugccuguagucccagcuacuugggaagucaaguugggaaaaucacuugagcuuaggagguugaagcugcacugcaucgaggcaugauaaugucacugcacucuagccugggugacagagggagacccugucucaaaaagaaaaaacucacaguuauugguccguuuuuauguuugaaacaacuuagauauguggaucuacugcagauuuugugaaauguaaauacagaucaaauauuucuaaggaaaaugaguaguugaauugggccaugcuguaaguguaguaaacuggauuuuaaagacuuggaauaaaaaaaauuuuuaagguaaaauaaguuuuauuuugacuacauguugaaaugauuucuuccccuuguaaauguggaugcuaaacuugaaugaaaaaaaacuucuaagggaaaauaaguuuuauuuugacuacauguuuaaaugauuucucccucuuguaaauguggauacuaaacuugaaugaaaaaguuuuuaagguaaaauaaguuuuauuuugauuacauguugaaaugauuucuuccccuuguaaaugugaauacuaaacuuuuuuuuguuauaucaaggaagucuucccaagauauuaaacauuuuaaaauuuuguaugucacuuguauaucuguuggacgguccugugcuaaacccauaaaaaagccaaaguuguauaaaacaggaucuuuucccuuagaaucuacuucccaucccagaugguagauauuucuaaauguuucaacuugugggccaacagaaaguuuauggcuguuuauaccucuguguugaaggauuuugaggcgaaucugguuuuuugguuaaaguguugccauucagucacuuggucugcugugaaaggguagggaagagauaauuggaaguauucaucuuucuugagcuagugcaagcuauauucugccucugucagaaacuuguucuccaacuccagaggcuucuuaccucaguccccuauagugcuguagugaaugcuuguucauaaaacuaccugacacacauccuuaauuacuucuuuuggauaauuuccuaagaaugaauuuucuggaucaaaagguacugacauuuuuaaagcucugguguuucuugccaguugaccuccaaaaagauaguagcaauuuauucugucagcaauguaugagaauguccuucucuuuccaagggcuaacgaaagggaagggcacguggaaaaaccucaggaaaacauauuguggcugacauuucagccaugaaugguauaaauuuucuuugcgaugcguucaauacauuuaaauacauuaaaaugauagaaauaacuaauagcuuccuuacaaguugucuuugaguaaauauucacauuuugcuuuaacucuacuuuuacuuugcugauuaggugauaaacggcauuuccuuuuuuaaagauuugaugauuauuuagugaaguuuggacauauaccauuuuuacuggucauuuugugacguaaguuguuuauaacuuacccaguuauuaauugggaugaugauugccuuaacuucaaauuguaaaacaaagaugauauucuuuagagaguaggggugagacauuagggcccaggucauuugaaauaaaaauuuuuagaggugaaacuugguaaacaaggauaagcaaggaaaauauuuuguacuuaggagcacuucaaacacuucuuuuuccagaaaauuaggguauauuuaaagguauguuuggguuccccugcuucuaguguauauaauuuguuacuuauuuuaaaggaaacuuacuauaaugcaaaaagcauugaacuaaaagcaaccaaguuuuaguuuuauguaccacaaaugauagcuagcaguagggucacuaauaaagguguuucaaccucugggccuugguugucuuuuaagggaauggcuugaaucugaauaggaauggccaaagauucuagcuugugugccaguucuauuuuguagguaucuggggaagcagaauuaacagagauuaaaauaggacauaaagaauacauagaaaacuaaauuucucuauuggaugaacggugggcucuucauagauuguagagguaguucuaauuucuuauggaaagugaugcugucucuuuuggauguguugaauuugagauucuuguagagaucaccaguaaccagucagaaauauuggcuuggauucagagauuuggaaauaaaaacauuaacauuuagauggcagugaaagaaaagccauaagcuggcaaggagcuuucuuaacugaauauguggaugacaguggaaacaauuuuccacagaauaauuugauucuuuuuagguuauauucuugagcagauugugcccauguguguauuuagcauuaguaaccgaccauauaauugcugagauuuuuauaccucugauacuugcaggcauacaguuuggagagcugauccaccccaccuucgcuuuuuucaaagaaauagagucaggguuuugccauguugcccaggcuggucucgaacuccuggacucaaaggaucugcccacuuuggcuucccaaaaugcugggauuacaggccugagcuaccaugcccagccccuuuuacuuuuaaaauuacugccaaaccucuagaucaguaacugccaacuagggcaaccccccacccccucuucccaauuauugguaaugucugaagacacuuuugguuguccuaacaggauguaggagaguucuggcacccaguggguaaaaucuagggaugcugcugaguauucugcaguguaccagaaaggcccuuuacaacaaagaauaauguagccccaaaugcuaauguugagauugagaaacccugcuguaaaaucuagguaagauggaacuuacuaaaaguaauuuaguaauucccugaaauaaucugagauccugcccuaagucuuauaguuuuauagaagagguaagauacaagaauaaauguuuguagcagggcagaggugccuuguaaggacagaaacgguaauauaguucauaugagguagaaaucucagugggugacagguuaagaccucaugagcaguuaguguugaaacugugugauaaauucugaaugggcuuacuuucagguugaaggaauuuauuuuccagaggaaucacucuuucauguaauuuacuacaggguaagaguuuagaaacauuacugcuagcaaagaaaaaauuaccucccuucuaaccccuugacauuuuuaaaucaaaggaccauuugauccuaacuaaaagaugcuuugaguuuuaugcaaaugcaccuuuaucaguauacgucagaaaaauguuuaccaauagaucucucucccuuuuuuuaaaaagugaccuugagggguaaaggucauuccuuugacagaaauuguugugacugaucuugugcuacaauggaaauuaagagacauaggcuugauucuggcuuuauccauaacugucuguauaacuauagguacauuugucucuuggggguuuaguuucaucaucuguaaaaugaagggggaguagauccaguccagaucaaauacucugcacaacaaaugaacaggcaguuaaaauuaugugccaagguacucuuaauacucacuaaaaguauaaacaggcuuuaagcuuucucuauacuucauuuucacuuuuuguuauauaacuuaaaaagucacacuuugagccugguguggugauguggugccuguugucccaauagcucaggaggcugaggcuggaagaucacuuaagcccagcaguucaaggccccugggcaauauagugaaaccauccuucuuaaaaaaaccacuuuuuaccgagacccacuuuuguggagucauauccccaucuuguggccuuucagaauauugcuacuaaauguuuuuacaauuaugagcauaauuggcaauggguugaauagcuaaaaacauuugcguccauaauaucugacaucgcugugccaaaauuuaaugugcauuaacucaucacacugcuugauuuauaggccaaggguaaaguuuucuuacuagcauagucuaacccagaaguuauguacgugaaauuauaaucuuguggcacaaauuaauagccgaugggagucuauaaagaggcagauaaguaacugcauuuuucacauuuaaggacuuaauauaaaguaucuguaggcacuuuggcaguagcgguuucuuauuuacaucacagucugucccacuuuuccuuagucuaaaaauucugguaugaaaaugccuugggguuugauuguuaugaaucugaaaaacaagaaaaagcacaucacaccaguuuacuugagcugagagaguaauuuaguguauuuaauaacaacugucuucaauuuucuacagguagggcuguaaacucuacugccaacaggaaccacauaaaguagaucaguaaagcaagagaagcugcaauuugagacuuuauguaaaaucguuucauuuaaauauuagcaucgaacuuaauguaaaaaccagaaacaaaaaggaaaaacugugaaucaggccaggcacgguggcuugcgccuguaaucccagcacuuucgggggccgaggugagagaccaggaauucgagaccagcaguuggagaccagccuggccaacauggcgaaacccugucucuacuaaaaaugcaaaaauuagcugggcaugguggcgggcaccguagucccagcuacucgguaggcugaggcaugagaaucgcuugaaccugggaggcagagguugcaguaagcugagauugagccacugcacucuagccugagcuucugagggagacugucucaaaaaccaaacaaacaaaaaaccugugggucaaauaguugugaccacauggcugauuuaacucuuaggcuggcaauuugugucuuauauacagaguaaaggucuuaaacuacugauaaauuaagauagucuacauuguuacaucauauuacauucuuaacagaaguaagcaaacaauucaugauccguugugaucauauaggauaguuuuuccaaugacccguucucuaugcccauccuuagcccuuguuucccucagcagauuucucagauuuaggaauuuacgcacaugccgugggaaauuuaauuuagauggguguuaaauuuggaugaugauuuacauaacaagcuuaauuacaaaaguaaagcugccaagguggaauuugagaaucugaauuuuuaacuggcaagaugauucugguauauaaccagguuugggauccauucuuugauuuuguaacacuacucacucuccagguuuuuuccucccuucucuugaacauuguuucuuggacaucuuuguagguuccuguucuuuuacgucuaaaauucaaguguuucuuacauucuuuucuuugaccuucuuacuacagacauccuugguagucucauauagucccauaaucaaagguuauaugcuaugaauuaguuauguuucaggaaauagcugucaaagcaauguguuauaaaagagaauucuuucauuuaaaaaguccaagugcauuucccuuuacuaccuaguuuuuauuuaacauuagcauugcuucagucucauuggguaacauuuagacugcauuauauaaaucauuuuuaaaauugcccauucauaccuuaaaagcguuugacacuaguuuugauggaaaaaaaaacuaucagaacauguauuuauagguguuuauuccaaaagcaaagaugauaacagacugucuggacacugcugaaauuuggaagagugaucugguacuuaaauggaaggcucacucauucagcucucauucaauuucuguucuauauaaacugaagccuugugcagcuggggauugagaaaucguguuuuaaauguuugaaggucuugccuccuuuuacuuguucauauaguaagaaauaaacgaggaaucauuuacuuucuacuuugaguuuuaguaucaaaaauaacaugccuggaaaguacugcaguuuguuguaccuuauauaaugaguaauguuuguauuuuauuuaauuuuuuguuagggauucuuuuucagcuuuuaucuuagauccaggggguacauguaccgguuuguuacguggguguguugcaugaugcugagguuuaguguacaauugaucuugucaccuggguagugagcaugauacccagcagguaguuuuucaccucuugccccucccucccuucucccucuucuaguaguccccaguaucuguuguucccaucuuuauguucauauguacccaguguucagcucccacauauaagugagaacaugcaguauugaguguucuguuacuuuaauuuacuuaggauaauggccuccagcugcauccauauugcugcaaagaaugugauuuuguucuuuuuuaugguuauguaguauuccaugguguauguguggaaaucuuuaaacauuuaugaaaugaaacaguagaaugagccccaucaaucaacuacaguaaguaggaucgauucccauuuuauuucaucuuuguuugaccuauacuuuucccuuuuccuuuuuugcuggggcacuuccaaaagaaacucuagauguaguauccuuuuccaaaucucuaaauacuuuaauauuuaauaugaauauuuuuucugucuuuuuuuuuuuuuuuuuuuuuuuggagacagagucuugcucugucacccaggcuggagugcagcaucgugaucucagcucacugaaaccuccaccucccagguucaaacgauucuccugccucagccuccugaguagcugggauuacaggugugcgccaccacaccuggcuaauuuuugguacuuuuaguagagaugggguuucgccauguuggccaggcuggucuuaaacucccuaacucaggugauucaccugccucagccgcccaaagugcugggauuacaggcaugagccaccaugccuggccuuuaauaucuuuaauaugaaucuuuaacagagaaggauuuuuuaaacaauuacaauaccuuauauuaucuuaugaucugauauccaguuuguacuuauuuucugucuuguaaaugucuuuuaaaaauagauuuuuuuucacauuagaauccagaaagguucacaaauugcaguuggcugaaaugccuuaucucuuacgcuaauaguuccuccacuaauuaaaaaaaaaaauugaguaguuuuagauuuuuagaaaaauugcaaagaugcuauaaagaauucccaguuuucucauauuacuaacaccuuacauuaguaugauaccgugguaagaaaaugaaaagacaagcuacaauugagauuaguugcaaaaucaucugucugauaaaggacuuguauccagaauauauaaagaacucuuacaacucacuaagacaagcaauccaauguaaaagcaggaguacaaaauuaguguaaaaaauucuagguuuauucucagggcuaaaccaugggcaagagauuuaaagagugauuuuacaaaaaaaaaaaaaaauggcuaauagccauacaaaaacauacucaacaucauuagucaguagagaaauacguccaaugagauaucacaucacaccaguagaauggcuauuaacagaaaggcaauaaaagguauagagaaacuggaacccugauacauuacugauggaaauauaaacgucacagccacaguuuagagguuaaaugucugaaauggguuucacugggcuaaaaucaagguguuggcagacagagugauuuuaaauaguguccuucaaaaauuauuaucuaucuggaaccucagcaugugagcuaaguuagaaauagggucuuugcagauauaauugaguucauaugaauuagagcagguccugaauguaaugacuagcguccuuauaagaagaguaaaggaaacagacacaccacaaagacaaugugaagauggagguaggcugccccaagcguggggccaccgaagcuggaaggggcaaggaaagauuccuagaguuuugagaacauggcccugcugacagcuugauuuuggacuucuagccuccuguacuauaagagaauaaguuuguugcuucaagccacugaguuugugguaauuuuuaaagauagcccuaggauacuaauacaguaggauuguguuucuccuagaggcccuugagaagaaucuuuccuuggcucuuccagcuucuauaggcaaccugcauuccuuagcuccuggcucuuccuucaucuucaaagccagccauagagcaucuuaaaaucuuuuuugucugaauaguauucuguugucauaucuccucuguuuauuaaggacuuaugugauuauauuaggcccgucuggauaaucaugguugaucuucacaucucaagaucuuaaucacaucugcaaagucuguucuuccauguaaaguaagauauucaagauuccugggauuaugacauguacauccuuugguugggggugaggggcauuauuguaccuaccacagacaguuuuuuuaaaagcuaaaaauauuugucauacaaccuagcaaucccacuuccaguuaucuaccagaaaaaaaacuaaggcguauguccacacgcagacuuuuaugcaauauucauagcagcauuauaauagucaagaugcacauacagcccaaauauccaucagcuggugaaugaauaaacaaaaugugguauaaacuauaccaaaauagaauacuauucagcaauaaaaagaucagacugcugacguguuaaaacagaggugaacgucaaaaucaugccacaugaaagaagccuagugcaaaagaucacuuuucuugugugcuuccauuuauauuaaaugucuaguaaaggcacauuuguagaaagagaaaguagauuuaguggcugucuagggguaggaaaggggauugauugcggaugcaccuaaggaauuuugagacuguaaugagaauguuccaaaacugaauugcaaugauaguugcacaacuuuauaguaaaaaaaucacugaagugugcacuuaaaacauggcuuuuaugguauauaaauuauaccucaagaaggcugcuuaaggagaaagaaaugagggggauuuaagaaagagggaguucauacaccuaaauguaaaaugucuagagaaaacauaaaaaucuuugugaucuugaguuaggcauauuucuugaauacaacucagaaauaaauccaugaaauaaauuugucaaaauguaaaacuuucccaaaaacaauaagaaaaugaaaaaagccauagacugguaaaaauucuuugcaacauacauaacuuacaaaugacaaguauccauaauacacccaaaacucaagaaaaaccaguuuuuaaaaaauugacaagaaaucugaacuaauuaauuuaucaaagaugauaacaugaauggcaaagaaauacaugaaaagaugcucacuucauuuauuauuuagggggaugcaaauuaaaaaccacaauaaauugucacuacauaccuguuagcauaaauuuuaaaaguuaacaaugccaaaugcugaugaagauucagaacaguagaacuccuauacacuuaagaccuagcauucccacuccuagguauuuacuaagagaaauaagaacuuauguucauaccaaaacuuauauguaaauguuuauaggaauuuuacuugcaguuaccuaaaauuguaaacaacugcucuucaacaagaggauaaauuuacaguacauccacauaauggaauaccauucagcauuaacaaggaaugagcuauugauaugcacaacaccggggugagucucagacauuaugcuaaaugaaagaaaccaaacaagcagcuauguauuuugugauuccauuuaugugacauucuugaaaaggcaaaacuuuggggaacagaaaagagauuuguggcugcuugggaguugaacuuuaaagggucaugugggagguuuugggaguaauuaaauuguauauuuugguaaugguuacaugauuauauguauuuguaaaaacucagaacuauacaccaaaaagaugaauuuaauuuuauguaagcuuuaaaaaguuuuuuuuuuucuuuuuuuuuuccgaaagccaaggaaucaaucaaaacugaugcccauaaaaggcaggaaaaugaagaacaguuaauacuugguacaaauagaaaauugcaagcugauggacuugaaucaacuaaaucaguaauucaauaauuacauuaaaucuuuuuuugaacagucucacucugucacucaggcuggagugcagugguggcgaucucggcucacugcaaccucugcccuuggguucaagcaauucuccugccucagccucucaaguagcugggacuaaaggcacgcgccaccacaccuggcuaauuuuuuguauuuuuaguagagacaggguuucaccauguuggccaggccaguguugaacuccuggcuucaagugauccacccgagucagccuuccaaagugcugggauugcaggugugagccacugugccuggcccauuaaaucuuaauggaccagauacuccaauugucagauuaaaagaauaagauccaacuauaugcuauuuacacacacuuuaaauauaaggacacaaggaaaaguaaaaagaaaaagguaaaagauagaacaugaaacuuugauuugaaggaagcuguaaagccaggccugguggcucaucccuguaaucccagcacuuugggaggcugaggcagguggauugcuugaguucaggaguucaagaccagccugagcaacauggugaaauccugucucuaccaaaaauacaaaaacaaaacaaaacaaaaauagcugaaagugguggcaugcauuugaggucucagcuacuuggaaggcugaggcaggaggauccccugagcccguaggcggagcuugcagcaagccaagacugugcuacugcacucuagccugggcaacagaguugagacccucaucucaaaaaaaaaaaaagaaagaaagaaaacugcguauuaaugaacaaaguagacuuuaaaacaaggaguauugccagcaaaaaggauauuucaaaaugauaaaagcgucaaauuaucaacaguaguccuaaauauuugugcacuuucuaauuugaaaauaccugaagcuuucuuuuauugauugaaugaaacagcagaaaggaagaaacacuuccaaacuuucuuugaggccaagauaacccugauaagaaaacauaucaagaauauuacaagggcugggugcaguggcucacgccuauaaucccaacacuuugggaggccagggugggcgagccuaucacuugaggccauaauuucaagaccagccuggccaacauggugaaaccccaucucuacuaaaaauacaaaaauuaguuaggagugguggcacaugcuuguaaugacagcuguuuaggaggcugaggcaggaggauugcuugaacccaggaugcggagguugcaauaagcugagauugcaccgcuacacuccagccugagcaacagagggagacuccgucucaaaaaaaaaaaaaaagaaaaggaaaaaaguguaucaagaguaagccuuuuugagauaccaugugaacaaagacuuggaguuaacauauacugcagccaaggauggagaggccaucaauugacaggaaaaacugcaagcaaagcagauuuuggaacaaagauuugaaauuguuugcaguauguucacuuugaagugucugcuggagauugcuuggaucuaggaauguagaguucaggagugaacuauaggcuagagacagaaauuuggaaauuggcagcauuaaagccacacaacuacaagauugaaugagaucaccaagagaauaauuauagagaagauaaccaaaugcguccauauacgaggccgucauaaaauugguucuuuuucagcuuccgcauuuauacacaagcauacuugauguuuuagccauaucaaacugacugauuuucggacuacaucacugcuguuuuguucauguuuuauuagacugcaucucuugcccuuccacaggauaagcuagucguucuucaaaauguuucccauugucaccuucauucuaguauuauuuuuguacuauauguacauacacuguuaguagcacauuguauauaccugucuuuccuaccagauguaaacaccuuugcauuccagaugcauaacacauagauacucaaauauuuauugaaauauaauugauuuaugcuuuaggcaacucuauuauguucauaagaacuuuagaaaaauuuagauugacagaauuuuuuaaaucuccauuagguuaguuuuuuaauagagaauuuggacuuuuaacuuaauuuuuuauagguuauucuaacuaaaaccuuuuugguuguuuacauucaaguaauguuauuuucuugacaugucuacauaucccuuaugcuuaugccuuuuuuuuuuuuuaacuccguguuccuugcuaacuuauauuuacaaguugauuauaguacuuugauauauuuagaaaauccaugucuuaaaauaauuuggagcuaagugaucaggauuacagaaguauuccauuucagucagacauaucauguuaaugagaguuaaacuauauuugaagcucaguuuugcugacaagguuacauuaagugaacauuuugaaauuuuucuagcauauuuguuucuugcaaaaaucaaauuaauuucucaaaaacagcuuaauuuuuccaacagcuaccaaacaauacuuaaaucucaaauuuguuuaaagcguguauauacauauauauaacgcgcauagaaaaauauuggaagacuaucagcaaacuuauuucuggccauauuauugcaggauauuuucccuuucuacgucauuucuauggugugcuuuaaaaaaaaaaaaggcauguauuuuuuuaauuaguuaggggaagauuaagcugccuauuuccuaaugguucaauauuguuuucucuauuuaggcuuuaucuggccacccuaauggaaacuuuuuuuaguaguuaacuuuuauuagacucauuguagcacagugcacuauaaccacuuuuucuucuuguaugaagucaagaaauaccugguauuauucuuugaaaacuguaaguaugcuugaagccuaguuacuaccuacaaaugauuccuaaaguuuuaaaaaccucaaguucuuucauuuauacuuuagaagcuugacuuuguagguucuuaaguuacuauuauuguugauacuucaacuucauaauguaauuuuaaaucacuuuuuaaauacuaagacuuuuuuuuaaaugagaugcucuaaauuaauacaaacuguauauaaaaaaauuacuacacccaacuuguggcacuaugguaaguuaaacaggagacaguguagguaagaugugaucccugucagcuacugcauuuuuaaaggauccuauauuuuggccaggcacaguggcucacgccuguaggcccagcacuuugguaggccaaggugggcggaucacuugagcucaggaacuguagaccagccugggcaacauggugaaacccugucucuacaaaaaauucaaaaaucagcugggcgugguggcaugugccuuccucagcuacucguuaggcugaggugggaagaucacuugagccugagaagcggaggcugcugugaccuguaauuaugccugggcaacagagcaacccugucucaaaaaaagaaaaauaaaggauucuauaguuuacaggauaacaguauccacagauuuuucuuucuuucuuucuuuuuuuuuuuuuugaggcggagucuugcucucucgcccaggcuggaguacaguggugcgaucuuggcucacugcaaccucugccuccuggguuccagugauucuucugccucagccucccggguagcugugacuacaggcacgugccaccacaccgggcuaauuuuuguauuuuuaguagagacagaguuucaccauauuggccaggcuggucucaaacucuugaccuuaugaucugcccaccuuggccucccaauuuuuuuuuuuuuuuaugugaaugguagauaguggggaaagugagcccaguagauuuuagucagaaaaguguuaugaagagggggaguucugugaaugagauguaaucuacuuaaagaaaacaugaauuucauacagggaauucauuauaguugucaaauacuugggaugagaaaagacuauacuuaagugacuagaaguuggaagagacuauaacaagaaaaugucuauuuuuuuauuuuuacuuuuuuaaacuuccuauggugcugagggguuuuuuaaauauauaaaucucuuacccuuuuacuaacauguuuguuuauuuaaucugugugguugcuaagaaacuauguucagauuuuaggaagacauacaagacaugaaaagaucauugguugcaacaaauaauacagauuagugguauaaaaaauaaucaaggcaggaaggauaaaguuccaaaugagcuaagccuuucaaaacugcuaaguaugacagaaacgaugcuuuaugcugucuuuuguguucuucauacagacuacuuaaauaggggguaaaagucucuuguuuuugccucuaacuccuuaccaaguagaauguucuccaaacugggcauuauagaguaauacaucuuagagaacuuuguacuauaagauaaaauauuacaucauauuccucuccagauaaaucaaauuuagaaauuucuuuuuuuaucuguaauuauugcuguuuuuuguuuuguuuuugagacagucugucacccaggcuggaaugcaaugguacacaaucauagcuuacugcagccucgaccuuccaggcucaagcaguccucucacuucagccuucuaaguagcugggaccauaggugcacgccaccacaccugguuaaguuuuuuuaaaaaaauuucuuacaaaguuuugcuauaugcccagguuggucuugaacuccagggcucaaaggauccucucaccccggucucccaaagugcugggauuacaggccuucaugcccagcuguuuuuuuuuguuucuguuuuuguuuuuuugcauuuuaaucuaaauuuuaacauuucaaaauacaguuuuuaaaauuacaauuucuacuacaaauuaaaauccuuucaagcauguuuuuguauauguuaacaaaaguccguuguuaaauauaguugaaaugugcuuuuucucuacaaaacacaauaugcuacaacaucuuuuugggcaaauaauacggauggagcaaaaaaauuguagaaugcugucagguuugccuuaucacauuugauccaccuuuaacaguauugaaguucacuucagcuauuaaaaauucuuuguuuacagcucugcaggcagaauaccuuugauacuuuguuagaaauuggaacugaaaauuuuucgcuuuaaucuuuuccauggacccaauuguuuugauuacaagugguuucuuaggaaugcuccuuuuauuaguccuuucucaugcugcuaauaaagacauacccgagacuggguaauuuauaaaggaaagagguuuaauugacucacaguugcgcagggauagggaggucucaggaaaccuauaaacaugguggaaggggaagcaaacacaucauucuucacaugguggcaggaaggagaaaugagagcgaagugaaggaaagccuccuuauaaaaccaucagaucuugugagaacucacuaucacgagaacagcaugagggcaaccgcccccaugauucgccgggucccucucacaacaugggaauuaugggaacuacaagaugaaauuuggauggggacacagccaaaccauaucacuccuguugcuuucuuaauggauaguuuucauccuggggugauuuucaagaugguggauuccuuuguuucguuuccagcaacucugguucugaaaaugggguauguguauccaggaaugugaauuuugcauaucaccucugugacucugauguagguaguucauagaccacgguuuucaugaauagaaugugcaugguauugcauaccuccauuguuuucuuagaauaaauuacuagaaguaauaagauacuugggcaaaggaacuguaauuuuaccagaaauagguguaucuaaauuuuucugaacuaugaacuacaaggaaaauuuugacacuugcagaauguuauucuggccuuuguaguagucguuguguaccauauuugucccugaauguauguaauuauaugaaagcuaugaguagaauuuguauugaaugacugucaaaauuugcuuauaaaugauaauuugcuuauaaaucaacucugaaagaguuggauuuaucaaucauguaaaaaagacuugguaccccuuucauauguucauauuaacaaauggggcuaauuauguuuuauugaguacauuuugauuuguuccaguagccggaucgagcugggagaugugacaccacacaauauuaaacaguugaaaagauugaaucaggucaucuuuccagucagcuacaaugacaaguucuacaaggaugugcuggagguuggcgagcuagcaaaacuugguauaauauaguuuuuuuuuuguccucccuucuuuucuuucuuuuuguucuugaacccuaguuuuuuauagagcagaagaaguuaacuaauuuaguuuguuuauuuuauaagugaggaaaugggaguggucuagguugugagaaaaaucucagagaaaucaguugaauaaaacaguugaauuuuaaaaagaaaugcuuaguguucuuaguguauaccuguguguuuucacuuuaagcuauacucuagaggaggcuuaaacuuccuaagauggcauaagagcuuugagaucauugauauucaugaaauaguugaugaaauuuaauguugauaggaacaguguaguccuuuaaaagggaaaaagauuaaauguguuauucugucuguucaacauuauaucuuuauguuuuccuuggcagccuauuucaaugauauugcuguaggugcaguaugcuguaggguggaucauucacagaaucagaagagacuuuacaucaugacacuaggaugucuggcaccuuaccgaaggcuaggaauagguaaaaaauugugguuuuuuuacuucuucagagaagcauaaacauauuauuuguuaaugugucugaccuaguaaguuaauuugggucuuuuuaaggaauacugagaaaggguuacugaauuauguaaaauauggugaaaaauaacuaguguuuauuaacauaauucuauuggaagcccuacauagauuugcuguuuacguccccuucugcuuuuucuguuuuucuucuacccggaagugcuuguuuaaaaagguuagucuucugcuaacaguuuuaaacauacguagcuauuguagagagagaacacaacuuuggaaaauaaggauaucuaguguauaccucauaaauucuuuuaggacucaauaaguaguucagauggcaaguggauagauacauaauuuaaagguugauuuaugaagucacguguuuguuauuuauuuuauuaacaggaacuaaaauguuaaaucaugucuuaaacaucugugaaaaagaugguacuuuugacaacauuuaucuguaaguaaaauaauauuuaauguucuuaucaaagggguuuaauuggcaggagaaaucuuuacuagaaacuuuaaaaucuggucacuuauugugccuuuggaaacacuguggaaguaguuguuacaaaguauucgaguaguuguuaguuuuguuuaguuuuguuuuauuaauaauaguagauuaggaaccugagauagaacacauugcuuuauuauauuaggaugagagcaccaaagucacagggaugaaaucaggauuaaaacucaggccuucagaauucaagacuauuaauacuacuuuucucaugcaaaaccuuguguguuuuguucaaggcuauguugauagcuuugaacauuguaguagaucauuuguaguagaguuuaauaaucaaaaucagagauuaccuagcugagauuguacuugaaucucaagaggcuguagauaaagaguuaugacuaagaucacagucauggauguucauaauuuaguuuggccaugugagagauugaauuauacaguguuauuuugggaguaauugagaaagcuugcguuuuuaauuuuuaaaacauaccauguauuuuaucaaucagaaggaagauauaucuucaagcuuugagacccuaguuuuuuauuuuucaucauuuuuuuucuguguguuaauagggccuuuuaauaauuuauccucuuacagugaaaaaauuuugauagcugugguacuuuucccuuuguugacuacaagaauaaacacugagccuucuaaucucagccagcugucuuacaaauguaaaaauuagauuaaaaguguaaaauugucaucaaaagguuuuagguaagcaugccuaacccuuguugauuacugguaguuguaaagagaauguaacagauguuuggagcuaucuguggagaaugcuuaaaacuugaugaaaccuuaauuuuaauuuuuuuucugauacucucuuauaucucaggcauguccagaucagcaaugagucggcaauugacuucuacaggaaguuuggcuuugagauuauugagacaaagaagaacuacuauaagaggauagagcccgcagaugcucaugugcugcagaaaaaccucaaaguuccuucuggucagaaugcagaugugcaaaagacagacaacugaacaaauuacaaaugaacuuucuugcacuugcuugucgccaaauaaaagagaggcccauugauuccucccccaccccaacacuuuucuuuuaaagcuuuucucccuccuuguucuuguuuuucuuucuuccuuuccuuuucucugagaguuuuaauacuuucaaggacuuuaaaaaaauaaucauguuugaauuguuuucucuuauuuuugugaggugguuugaaggaaggacaagguagaucuguuuaguuuugcaguugaaguuagaugguccuaaacauuuaauugucaaauaauuucaaauuuaauguccugcuuucacauugaagggcagagccuacaaaacauuguauauuucaaaagacaaaaagaagcagcagcaguaucuuguucucuaauucauagacaaguugaguguguuugugguacuuuggguuuuuaaacacuuugggauacuaaucccuagacauugccuucacuccaccuuuaguccuucugagcacucucucgggaguuggaacauuguuauccuuguaagaaauacuaagcuuauguugauuuuuaaguaauuauaucuucucuucuugcugguggguggggcaguuugguuuaguguuauacuuuggucuaaguauuugaguuaaacugcuuuuuugcuaaugagugggcugguuguuagcagguuuguuuuuccugcuguugauuguuacuaguggcauuaacuuuuagaauuugggcuggugagauuaauuuuuuuuaauaucccagcuagagauauggccuuuaacugaccuaaagagguguguugugauuuaauuuuuucccguuccuuuuucuucaguaaacccaacaauagucuaaccuuaaaaauugaguugauguccuuauaggucacuaccccuaaauaaaccugaagcagguguuuucucuuggacauacuaaaaaauaccuaaaaggaagcuuagaugggcugugacacaaaaaauucaauuacugucaucuaaugccagcuguuaaaaguguggccacugagcauuugauuuuauaggaaaaaauaguauuuuugagaauaacauagcugugcuauugcacaucuguuggaggacaucccagauuugcuuauacucagugccugugauauugaguuuaaggauuugaggcagggguaauuauuaaacauauugcuucuauucuuggaaaaauagaaguguaaaauguuaauaauacaaaugucacugugaccuccuccacugagaggacugguuuaugccagaucauuuuccggcacacacggaguggcuuugacagauugauaacuuuguaagaugggagacaucugaaauauucauguuuuccuuuuguagucccaucuccacuauuuagaaauguucucagacuuuaaaauaaugcacagggcuugagcuuucugucauuugacuuuaaaaggaaguuucauucauauuuauccucuuauguaaaauugcgguauaaagucucauuuccaaauauguuaaaugacaaaauuauuuuauaaaauguuuaugcacacuuuauaaccuuaaguuuuuauuugagaaugugaaaguacaaagugcaguagacuucaacaaucuugagugccaagaauaauacagaaaaagaagacaguugaugaaugaguuuauaggguucuaaucuuaagaugguaaaaauguagaaagaccuugcugguuuuuuggggguauucguuucuuaaacaauccaaaucuaagcuuagaagaaaaguuuagcguuaagcaccuuuaucuucaugaauaagcuucagcuugcucuuggcaagagaagagugcuugaguuacagaaggcauaaguaguuugaagaaugcagcagccuuuuuguaaacuucccagauaucaaaauagacuuugauauauaaaugguuuucugagaugacacugccucuauuucuauaaccauuucaccuggacuaucuaaucaguccuaugaauguaucccuaaaugugguuauugaaaaccuaauagcugccucaugacaaguacauguuauuuaaggaggaaaaaauauuaaauuuugaauugaguguguaggcucccuaucauuauauauagaguuucuuuuuccacgguagucagugacuuaaccugaauuguaaauguuuguaaaggguuaauuguccuacaucaaacuuaguuaaauaauuccauccacuuauggaggaggaggagaauguggaagagguaaaaagcugggcacaaguucauaugccuaugagucaguaaagacugaaguaauguccuauguugagcugguuauuuugauauaugauaauaauuaucuuugaaguagaacaauucuguuaacuggaaaaucacaggauauauccaucauauuuuucaggacagauaguuuuuacuguggggcaaauagguuaaaauuacacuauguuaguugcauuuagguuuuaaagcaaagaaucuguagagaaaucuaugcaauauauaguuuguccagauuagcuuucauuuggggaaugaaguucugaaauaucuaaagcaguuuacucaucaauugaaaaguccuccaaaaagagaacuauugggaaaccaugguguggugguggaaaagaaaagcucccucaguuuuuuggagggaauaacuuaaaaaaauacuuaaauggcuaaguuuacuuggugcaguuaagaauuaaacuugucaauuuuaacauugcuguuacaucugaaauaaacuuaugugauguucugguagugaucugugauaucuguaaaugucaaaacuguauuguugaauucugcagccagcaaccguacauacucauuguguaguguuucccuuacugcuuuuauuuacuuucacauuuaagaucuaauuuuaaaaucauuaaaauaggccaaguguaauuaaggcauccuaauucagaucuucugugacuugcuagguacagugcccaauaucuacaauucaguuccaaugagagggaaaaaguaagauccaaggaacugucuugcugcuguauuuuuaauguaauuauuagaaauacuugacacuuuaggcugcaaucuaguuaguaauguuuauuggcuacagacaacauauucagguguuuuguuuuucuuccuuguaaggaaggaguacgguaguucaaugaguugggaauuggcuuuuaagcuuuuuaucaaacaugaauuuaagauuuuuucuuuaacagaauucaguauuuaauauuucuagucaaaauuguuauaauuagauuuuugcuuuuuucauuuaagaagcaaugagugauccuugucuagugugucucaguuauuacuguaguuuaaaacaacaaacaaguauuaccuuccacaguucuggaucaggaaucuaggagcugcuuaacugggugguucugucuugagaucucagaagguugcagucaagcuguuagccaggacuguaccaucuugaagcuugacaaggcuagaggagccauuuccaagaugucuugcuuacguggcucuugggcuucuguuccucacuguguggguaucacacacagugccugaugcucacguggcucuugggcuucaguuccuugggcaccaguugccugguggacaacugguauguggcuuccccuagagcaggugauauaagaaagugagcagaaaccauacuuuuuuaugacguagccucaggugacauuauuucugccauauuccaugagucacacagaccaaccauugaaucagcuugguauagugugggaggggacugcacaaggaugugaauacugggagguggauaucauugggcccucuaggagacuggcuaucacugcucagagaagaugcugggcuucguugacucccaaggucaggguaguuuugguuagguuguguuuuauuagucucuaaaaggaguaguuuucuaaaugaggguuauaaagcacugcacuuuacaguuauucgggauauaaaagaaauagugggucuaaaggcugugcucuugugguuggguuuucaguggggaggggagacuagucugucucagacugaugcuguucucacugauuugaauauuucugggaaauuggauacuacagucacaaauaggaacaguaagccuauagaaguuuuucagggaguaaauauuuucuauggcaguguccugaauugguucucccuugcaagacugaacuguaggaacuuaguccuaguuuaugauacagccaaguaacauagucacaugggaaaaagagcuugagucagauuucuuaauguguguuguuaacuugguagaacauugagaauuauuuaagucagagaacgaucuguuacuggggcagaaauucucaaccuuuucaguucuccaaaauuuaagauacuugauuucuuagguaaaauguuuuuguuuuuguuuuggagacagagucucgcucugucgcccaggcuggagugcaguggcgcgaucuuggcucacugcaaacuccgccucccagauucaagcaauucugccugagccucccaaguagcugcgacuagaaagcgcaugccaccacgccuggcuaauuuuuuguauuuuaguagagauggggguuucaccguguugcccaggcuggucucaaacuccugagcuuaggcaauccuccuggggcagccucccaaagugcuaggauuacaggcgagccauggcgccuggccaguaaaauguuuucuaucuagaaugaaucaagguauuuuccuugcucaguagcuucuagaauaagaaaaaaauagcagcaagaucugauucagaaauaguugggagcagaaaguuaauaugaaggaguugcuacuuguuaacagccuagaguugagaucuagaagaauuauuaccuuuuuaaauuugugaugaaagcuuaaauccagcauuugggaaguuacucuauuggcugaacuauuuuggaguuuguaagcuuuguauuagauauuccugauuuaacugaaacuaauuugccacauagcuuuaauuucaucccaguuuuacuuguuuuacuguccucaaaaacucaagacaucugaacucaaaggaucuaagcaguauaaauuaaagcacauguugaaucacuguagcuuucguaggacaucugauuauaaugcuuuucuuuguuucuuuguccauacugaacuugucuaguuuaucuuugagaaacauuugcuaguaucaaaaaucuucuguaaagauuugaacaaucuugaauucuccuugucacuagccaucucuuccccuaaaguauaauaaaacugucagguacua

SEQ ID NO: 192635 - RNA, 22730 nt, Homo sapiens
agcccuuuguuuauggccugaucuagcuaaggcuucuagacuucaggagcuuaagaaucguccggagggcugggcguggcggugcaggccuguagucccacccacuccgaaggcugcggagggaggaucaacuugagucugggaacucagccaggaauucaagaccagccugggcaacacagugaggcccccuacccacauccucuccguccccgcaaucuccuuccaucccaggucuccucucuacaaaaaauuuaaauauuagcggggcgugguggcgcgggccuguaaucccaacuacuggaguguggggggaggggcgggggugggacggcaugggcuguagugggaagaucgcuugaguccaggaggucgaggcugcagugagcuaugaucgcgccaccgcacuccagccugggcgucagagccugucuaaaaaaagaaaaaaagaaaaaauuaccuggagggcuuguggaagcacagauuccucagccccucagccucacccuccaugaucugauucaggaugucuuggguggugggguggggccucauaauuuauuuuuccaaucaguuccucaguaaacugaagcugagcuuuuucagacuacauuuuuuucuuuuguaaauuuauuuauuuauuuauuuauucauagagaugaggucucacuauauugcccaggcuggucucgaacuucuggacucaaguggucguccuuccucggccucccaaaggccucccaaaggauuacagacaugagccaccgugccagguccagacaauauuuugaauguguuaaauacacuaguaacuuaaauggaccauggucacccuggguccugagauuaauggaccaaaucauuuucccagggacagaaaaagcccauuguaaagguacuugguuguccagugcugccauauuauuggugaaugaaauuuccuuuaguugcucuggcuucuuagagugaccuaugagaacaccugcuucauauuuugccacauuccguguccaacauuaggcuccagcaauuccuaagugcaucguuccuucugccuucguuacuccaccacuugccuugguguuuuggcucuuguugcuauucugaacagccaaauccuucuccuccaaccagcucaauauuauugcaggcuuaauauuuguauuuagaacuagaucgaagagagauuauguuauccaacccccacaauuuaaaucuggaaucuuucagugaguaacauacccccgugcauaaaucagguauaaaauaccugcguaaaaugcucugaaucuuuuuuccauucccuucguaauaaguaauuuguuaccaauaucgucuuauaacuguucuaaaacauucuguucauuccauuggaacuugucaacaaguguuugucauuuucaguuuucuuucaaguuucaccuauuuuuuuuucuucuuucuuuccuucuuucacuuguugagacagagucucgcgaagcuggagugcaguggugcgaucucggaucgcuguaaccugcgccuccugggcucaagcaguccucccaccaaccccucccgaguaggugggauuacaggcgcucgccacaacgcccgccuaauuuuuguguuuuuuuguagaaaugggggucucgccauguuucccaggcugaucucgaacuccuggacucaaucgauccgcccccccugggccucccaaagugcugggauuacaggcaugagccaucgcacccagccuaauuuuuaaaaaaacauugucacugaauggacaagacaggguauaaaauugauaaaauuaucccauuaccagaaaaugagggagggcaaaaagaggaggaaaggaaaacaagagcucaucuggguaacaggaaguagaaggaaacauuugcuuauaaaaggagaaagcagguuaagagaaguaaacuaccauauccuuaacauugcuguccuugccuuccccaggguguugcugaaaaugucagaugcaaauuuggauagcagcaagaagguaaguuucauucuaauagaauuacuuuucucacagucgcuuuucagagucuuucuaggucucccuuauguuucucuuuuaccacaaaucuucauuccuggauguaagaaaucuccaucuugaaaccuccucuucuuugcaaauagauuguuaguuuucuuucaugugauugugcuuuuaugugcauuuggaugagaguaaaaagaaguaaaauuuucuccucuuaguccaaaggaaaauauuucuuugguaggaaagaugagaagugcuauagcuggacaagauaaaaaugguaaaaauaaauaaauaaaaauggcauggagaauaauaauauuagagaaaagauaauuaaaaauuaaaaauaaguuuuuuuuuaaaagcaaaggugaaaagaaagugaaggcgguaauguggauaaagucauaaaguaaagugaccaauugguuacuuucuuucagaguaggaaauaucuacucccaguggccuugguaccaaaugaguuucaagauuaggcuuggguaguccuggcucuaugagaaacuagaggaggugucauaguguauuuacaggcaucacuguacccguccucuggcuaaaggacugaauuggccaauauuagcuauaugauuauggggaagucacauagcugcuuugagccccuacuuuucucuguaauagaguaguauucccuaaauaaugucaguguuauuuugaaguaaacuaagaguaaugggaaacuacugaagagguuaaauaggagacaggaguguggcaucagcacuagaagagaauauugcaauaggacuggaauggaguuuauucacccuuggauuugagaagaaaagcuaacuucagaaccauacucaagccuguguuacucuauggcauugcucauuuaguuuccucauuuguaaagcaggaaaauuaauaaauuacuacaaguauacuaugagaauuaaauuugagaaauaaagaacaccuagcauagugccuguguacuguagagaaccaguaaauguuaguuucuuucuaucuaccugcuuuucuacuuuaucuuuuauucaucagaucauaaaaacaacauugaaugccuacucuguguagacugcuguguuucugugaaagcaacagagaguaaaacagauacacucuccucaggucuuggagcugaaaugagcccaguguggcuggagcucagaaagcucagaggucaugagcuggagaggcaggcagggaccagacuguuggagaauuuguaagcuacacagcucugugagcuaauuugaguuuugucauuaaccagaauaacaaugacaagccauugaauaauuuucaacaagcauggaacaaucggugcagaaauagcagaguuacaguggauuuggggauaacaggagguuauugcuugugcugugaaauuugauaugggaauugggaaucuugggaaucaugugauagaagauggaaaggcaggaacacacuccauacagauuuaggagacuuaaugaaaguauuuuguguuuuggcugaugaggaggaaggcccugagggaaauaauucucuaaacccaagcccuacccuucuauuuucucuuucauuaacaccuacauguaaauuggcuuuugcccguuuuuuuccauguuuccuuuauuuaauaaagggucugcuaaucaacaucacauucuaggaaucccaguaauucuuuucuccauccaccuacugucuucucaguuccuuauucaugacuuuugccuugaaagcaagcaguuuaguuguaccgcaucaaaugaaaaucagugacugacuucucuuuccagaauuucuuggagggggaaguagaugaugaggaaagugugauuuugacacuggugccaguuaaagaugacgcaaauauggaacaaauggaaccaagcguuucuucaacuucugaugucaaacuggagaagccuaagaaauacaauccagguaugaggacagggauugcucaguuaguuacuccuacaacucugggaagcccaggaaaaaguaagauuugucuuuccuauccucugacuauacaacacccagcuuaaaucucaccuuguuaaucuguguuaagaaauuuugcaaacucucauacuucucgcuugcuaagcccaauguacugccauacuuuaauuaauuuauuuauuuuuuggagauggagucucaccgugucacccagguuggagugcaguggcgcagucuuggcucacugcaaccuccgccuucugagcucaagcgauucuccugccucagccuuccaagucacugggauuacaggcaugggccaccaagccuggcuaauuuuuguauuuuuaguagagacgggcuuucaccauguuggccaggcuggucucgaacuccugaccucaagugaugugcccgccucagucucccaaaguacaggcauuagccaccacgccuggccuguacugccuuacuuuuaagacacaaaauaagcauggggagcgcuuuggacagagagugcucuucuggaccagcuccacaugaguucaaauucccaacacauaaagcucaaucuccucuucuauaaaaacgagaugaauacauauuugccuccuacgaagauuaaauaauuuuggaaaacaucugguauuuugcuuagcaaguaauuacgaauagcagcucuuaaaaucaugacccuuuguaucugugcucagugucuuagugcuuccuauaaaagcaucaaauaaguguuuuuuuucuuuuuuuuuuuaaauuuuucuggagacggaguuuuguucuuguugcaaaggcuggagugcauuggugcagucuuggcucacugcaaccuccgccuccuggguucaagcgauucuccugccucagccucccuaguaccuguaauuacaggcgcccaccaccacgcccagcuaauguuuguauuuuuaauagagauggaguuuugccacguuguccaggcuggucucaaacuucugaccucaggugauccacccaccuuggccucccaaagugcugggauuacaggcgugagccacugcgaccggcccaaauaaguauuuucagaaggauuuuaucuucuaggccaauaaugaggauuucaagaugaaguaaauaaugauggguuagagcuaagcagagugaggugaaauggggagcuguagagaaaaaugauucaggcugacagaaugauguggaccauuguugauuggggauagacaaugugaugguuucuuugauuucuauaggaagagcugauauuuugugguccaaaaucuagacauuuuggaggauaaauccaacauaauguucuauucaguugguuguugagggcaacagaaaauaacaggcugcuauauguagcauaaaagaaacguggauuuuagaauccaaacauagguuugaggccggacaugauggcuuacaccuauaaucccagugcuuugggaggccaaggagggcugaucacuugaggccagggguucaagaccaaccuggccaacauggagaaacccugucucuacaaaaaauacaaacauuauccaggcaugguggcacaagccuguagucccagcuacugaggaggcugaggcaugauaaucacuugaaccuggaagguggagguugcagugagccgagaucgcaccacugcacuccagccuaggugacagagcaagacccugucucaaaacaaaacaaagcaagcugggugcgguggcucaugccuguaaucccagcacuuugggcggccaaggagggcagaucacaaggucaggcguucgagaccagccuggccaacauagugaaacaccgucucuacuaaaaauacaaaaauuagcugggcaugguggcgcgugccuguagucccaccuacucgggaggcugaggcaggagaauugcuugaaccuaggaggcggagguugcagugagcugagaucgcgccacugcacuccagccugggcaauagagcgaaacuccgucucaaaaaaaaacaacaaaaaaaaccuacauagguuugagucccaggucugcuauuauaaugggcaagucuuuaaauaccugaaucucuuaccucccuuuuuuuuuuuuuuuuuuuuuugagacagagucucacuguauugcccaggcuggagugcuguggugugaucucagcucgcugccgccucugccuccuggguucaagcaauucuccugccucagccuccugaguagcuggagcugggauugcaggugugcacccccaugcccagguaauuuuucuuuuuuuuuuuuuuuuuugagacggaguuuuacucuuguugcccaggcuggagugcaauggcgcgaucuuggcucaccacaaccuccgccucccagguucaagcgauucuccugccucagccucccuaguagcugggauuacaggcaugugccaccacaccuggcuaauuuugaauuuuuuuuuuuaguagagacaggguuccuccauauuggucaggcuggucucaaacucccaggugauccacccaccucggccucccaaagugcugggauuacaggcaugagccaccaugccuggccauaugcccagguaauuuuucuauuuuuaguagagacgggguuuuaccauguuggccgggcuggucucgaucuccugaccucaaguaauuugggcgaauuugccucagccucccaaaguucugggauuauaggugugagccaccgugcccggccuuguuaccucauuuuuaauaugagaaauaaaaauugauauguguauaugcaaauuggguugugagaaaugugaaaagaucuuuguaaaauuuuuuuuuugagacgagacggagucuuguucugucgcccaggcuggagugcaguggcaugaucuuggcucacugcaaacccuaccucccggguucaugccauucuccugccucagccucccaaguagcugggacuacaggcgcccgccagcacgcccggcuaaguuuuuuguauuuuuuuaguagagacgggguuucaccauguuagccaggauggucucgaucuccugaccucgugaucugccuaccucggccucccaaagugcugggauuacaggcgugagccaccgugcccgacccuagaucuuuguaaaauuuuaaaauaaucuugccaacuuuaaauuauuacuacuuugguuccauucuugucuuaggucaucuacuucaaacaaaugagcaauuuacagcuccacaaaaagcuagaugcaaaauaccagcccuucccuugccgaccauuuugccucccauuaauaaggugugucgggacacuuugcgggacuggugucaacaacucgguuugaguacuaauggcaagguuaguacacuugggugaauaucugcugcugggaauaauuaugggagucuuugucaacuuuuaacuuaaucucucucuucauuuccuaagaaaaucgaaguuuaucugaggcuucauaggcaugcuuacccugaacaacggcaagugaguaaugaguguguugauggugugaagguggguucugaucaugauucguccggucccuaccgucgcaccauaucuauguguuguaccucuaaggcaggguuucuucacuguggcauuauugauauuucggaacaaauaauuuuuuguuuguuuugggggcugcccuguacauuguaguauguuuugcagcauccccagccucuaccagcuggaugucaguugcaaccuuuccucccccugcacaguuucaacaacccaaaauuucucccaguggagaauuuacaguuuaugggaacuaauauuccgaaacccuucccacauugacauacauguucaggucaguacaaagaauaauaaaauuggccgggugugguggcucaugccuguaaucccagcacuuugggaggccgaggcggguggauuaccugaggucaggaguucgagaccggccugaccaacauggagaaaccccgucuuuacuaaaaaugcaaaauuagccggacaugguggcacaugccuauaaucccagcuacuagggaggcugaggcaggagaauagcuugaaccugggaggcggagguugcggugagccgagaucgugccauugcacuccagccugggcaacaagagcgagacuccgucucaaaaaaaaaaagaauaauaaaauugacccaaaaguccuuacagcccuagcgguuuacugaauacucaucgugaauuucauuugcaggauaugccugaaaugucacaagagaccagauuacagcgauguucgaggaaacgcaaggcagugaccaagagagcaaggcuucagagaaguuaugagaugaaugagagagcagaagagaccaauacaguugaagugauaacuucagcaccgggagccauguuggcaucaugggcaagaauugcugcaagagcuguucagccuaaggcuuugaauucauguuccauuccuguuucuguugaggccuuuuugaugcaagccucugguaagaucaaccuuaaagugugagucccacuccagaggacaagguuaacuuuuauuaguccaagacugaaacguggucaaagggaaggcauuugcuaaaauaucugaagauuagaaauuggauucacaugggacaucuuucuucuaucugucauauugauggauagucauguugugucuggaugggucucuaaaucaggugacugaguaguggcccuuuuccaucacuaagcauaaccugauaaucuuggaccacagucugaggucuuccccuuuucuuucucucuuccuuaaggcauuuaugacauagugaauaagaggaauguguugguucaaauucuugcuuuaccauuuccuggauaugugacauuggcaaguuacuuacuuuaagccuuaguauccuguucuuuuuuuuuuuuuuuuuuuuuugagauggaguuucgcucuuguugcccaggcuggagugcaauggcgcgaucuuggcucacugcaaccucugccucccaguuucaagcaauucuccugccucagccuccugaguagcuggaauuacaggcacccaccaccacgcccagcuaauuuuuuguauuuuuaguagagaggggguuucacuauguuggccaggcuggucucgaaccccugaccucagaccauccacccaccucggccucccaaaguguugggauuacaggugugagccacugcucccggccaaguauccuguuauauaaaaugaagauuuacauguuucauagaauaguaguggcugagcuugguggcucaugccuguaugccuauaacuuugggaggccgaggugggaggauugcuagagcuccugaguuagagaccagccuggguaacauggugaaauacccugucuacaaaaaauacgaaaaaaagccgggcaugguggugugugccuguagucccagcuacucaggaggcuggggugggagaguggcuugagcccagaagguagagguugcagugagcugagauugugccauggcacucuggccugacagacagauccagacucugucuuuaaaaaaaaaaucuuggccgggcacaguggcucacgcuuuuaaucccagcacuuugagaggccaaggcacgugaaucaccugaggucacagguucaagcaauuuucuugccucagccucccgaguagcugggauuacagucaugcgccaccaugccuggcuaauuuuguauuuuuuuuuuuucaguagaggcgagauuucuccauguuggucaggcuggucucgaacucccaaccucaggugauccaccugccuuggccuccuaaagugcugggauuacaggcgugagcuaccgcgccuggggcccucuaagaaaucuugaggauaacuuaacuccacuuuucuccaacuccugcucuucuuuucuugcuauugcuuuuauuuccagggucugcuaucucaagucaccuuccuuuuuggcuugaauccuuuuuuuacucccccauuuucccauuuccagaaguauucuagauccuauuuuauuccagcuaacuaguaugguaggacacauuauucaucauacaaggaaaccagccagaaggaagacuugaaguugaaauuggcauauccucugcucuucaagcuacauucguuuauguggggacagugggcaccuuuuaauaauuugugcaaaggcauuguccagccauaaagcugugugccugggggcacugccuucccaaagaggacaccucuuucuaauuuuuaauaauaugcuguaugaguuacuauuaucccacagugacuuaucauuuuauauuucucuucauucugcaauuguuaagcaucugcugugguccagagguaugucuagcugcuggguauauacugugcuaaacacacacaucuucucuuguuucacagucuaaucggggagcuaucacacuacauguacugcuuauuuacagauauguaaauucacugugacugcuccuuucccucaauuucagacguuccaugaguguaccacuuauuuucuugcaaauaucccgucuccuuaauuaaauuguuccuuacacuuuuaaacagacacuugucuguuuccuguagcugaggcaguacaauguagugguuagguaaaugggcuguaggucuuucagaauacugacuuucucucaauuucagacguuccauaagaguacugcuuguuuucuugcaaauaucacaucucccuacuuaaauuguuccuuacgcguuuuuuuuuuuuuuuuuugagauggaguuucacucuuguuguccaggcuggagugcaauggcgugaucucagcucacugcaaccucugccucccagguucaggcgauucuccugccucagccuccugaguagcugggauuacaggcgcgugccaccacacccagcuaauuuuguauuuuuaguagagaugggguuucgccauguuggucaggcuggucucgaacuccugaccucaggugauccacccaccuaugccucccaaagugcugggauuacaggcguaagccaccacgcccagccuguuccuuacacuuuuaaacagacgcuugucuguuuccuauagcugaggcaguacaauguagugguuagguaaauggacuguaagucagucagaauaccuggauccaugacuuggcucugaguaacuuaugauauuuaacaccauaagcuucguuuaucucaccugugaauaagaaauaauaagaaaagcaaauagaagguaaauauuaauaguguacuuaagaguaaauguauuaauacacauaaaucaccuagcaaaauauuggacacaaaacaagcauuucaaaauggcaaccauuauuuuuuauuuuauuuuauuuuauuauuauuaguauuauuauuuuuugagauggaguuuugcucuugucacccaggcuggagugcaguggugugaucucagcucaccacaaccucugccuuccggguucaagcuauucucuugccucagccucccgaguagcugggauuacaggcaugugccaccaugcccagcuaauuuugcauuuuuaguagagaugagguuucuccacauuggucaggcuggucucaaacuccccaccuuagaugauccucccgccucaaccucccaaagugcugggauuacaggcgugagccaccgcgccuagccagcaacaauuacuauucuuuguguuauguaacuugugaaauuagaucauagugucauguggucuagguuuucaugcaucucauucaauugauuugugagcagaauacaagagcaaauucaagagugacuugcugagagguuguguuggggugcuaucuugauuuuugcugucuauauuuguuuuuccuuuccaggcgucagguggugugugguccauggcagacuucucucggcagacacaaaggguuggguacgccugcaguuucaugcaggucaggccugggugccuaccacucacaggaggaugauuucucucuucuuguuaccugccugcauuuucccauccccaggcauagaagauaauauguuaugccccgacugugcuaagagguaacccuuauguaucuuguuaagcauggcacacagaaaaguagguguauagauggauuucuaaauaauuuaacaguagaaagcagagggcgaacaugcugucuucuuaauuugccacauagaucaggcaaaaauaggaugcaagaagaacucacuagugaauuacaacucaauaaauguggcuaguucuuuuuuuuuuuugagauggaguuuugcucuucucgcccaggcugcagugcaguggcaugaucucagcucacugcaaccucugccuccuggguucaagcgauucuccugccucagccucccgagucucagcugggauuacaggcaugcaccaccacgcccagcuaauuuuuguauuuuuaguagagaaaggguuucaccauguuggucaggcugguuucaaacuccugaccucaugauccgcccgccucggccucccaaagugcugggauaacaggugugagccaccgugcccggcuaauuucuguauuuuuaguagagacaggguuucaguauguuggccaggcuggucucaagcuccugaccucaggacauccacccaacucggccucccaaaguacugguauuaagggcaugagccaccgugcugugccuaaauguggcuaguucuuagccuuaacaaagcaucugacaagucaggaccugauuucugccucaauuuuagagacuuguucuaaaggaaaaaaacacacauuugaguuuuuaauacaugucagauacucaccuuggaaugcaaaaacaaaauccaucuagccuacucaacuaaaaaugaguaagaaggccaggcgcgguggcucaugccuguaaucccagcaguuugggaggccgaggcgggcggaucaccugaggucgggaguucgagaccagccugaccaauauggagaaaccccgucucuacuaaaaauacaaaauuagcugggcgugguggcacaugccuguaaucccagcuacucgggagacugaggcagaagaaucgcugaacccgggaggcagagguugcggugagcugagauugugccauugcacuccagccugggcaacaagagugaaacuccgucucaaaaaaaaaaaaaaagaguaagaaaagcuaugaaaauauaugggaagaaucuauauuggaauagcuuagggaaacuuaagagaagauuacacguucugaggaagagcuuaccaguuguggaagucgucaguacaaacacagggaaauaaaaaauaugauggccaguugcaguggcucaugccuguauucccagcaccuggggaggccaaggugggcagaucaucugagguuaggacuucaagaccagccuggccaacauggugaaacccuguuucuacuaaaaauaaauaaagaauauaauauauuuagaaacugccaguuagucaaugugauugaagcuuauauugagaaaugaguuuggggaguggaggagcagaccaugaaagauuuuaugucuacauuauccuguaagucaucaucucccaguaacuuuugggacauggacuuguuugagaauauaaugauaacuaugugcucuccaggaaaauauacaugcacauaaacacugcuuuagacuauagaauucccgauguccauccaugaguaaaaauuucagcuuuuggugauaaaauuggguggaagugagaugagagagguguggagauaaauuaagggcuuuuuuuuuuuuuuuuuguaagugggcuaaaucggcucacaccuguaaucccagcacuuugggagaccgaggcgggcggaucacgaggucaggaguuugagaccagccugaccaauaugaugaaaccccgucucuacuaaaaacacaaaaauuagcugggcguaguggcaugugccuguaaucccagcuacuugggaggcugaggcaggagaaucguuugaauacgggaggcggagguugcagugaggcaagaucgcaccacugcucuccagcuugggcaacaggagcgaaacuccgucucaaaaacaaaagaaaaagaaaagaaagugggcuaaaucuuagaugggaguauaaauaagagauuaguaauucagaaagagauaauucauuacacugacaaagcauuuaaggaggaaugagacgaauguaagauguaggaguaaugagagcaagaugcugucuuagaaguggaggaaacauagaaguccaauucaguggagaagaaucuaugguguuugggacaaguucuagaguucugagagaaguaugaguuagagcuaaacaucuuugggagucaucagcacauacauuguggauaagaguauguaggaaggaacugagggaggaacccuaaagauaaucagcguaucaguggaagguggacagcgaagacagaacacaguuagagguuagcagaugagugaguaaagggagcaauggacagagucuuagaaggaaauaaugguuggcagcaagauggccauguaagguaaugaugaauguggugcucuugggacuggcuguuuaggacacugcugauggccuuuuugaaaguagauugagaggaucaguagaagccaaaauaugauuucaguaacuuagaguagaacaugugcagaacuagaagcaggacauguugaucaccgucauuagcugagccuggcaggaagagagagcaguuaguugaggcaguaaccucaagggagguuccuuucuuuucgucucucucugucuuuuucuuucucuuuuuucccucccucacugacucucgucauucuucccuucuucccauuuuucuucuuucuuucucucuuuuccuuuuuaaauuuuuuuuuuauuugagauggagucuggcucugucaaccaggcuggaguauaguggcaugaucucugcucacugcaaccucugccucccagguucaagcgauucuccugccucagccuccggaguagcugggauuacaggcaugcaccaccacacccagcuaauuuuuguauuuuuaguggagaugggguuucaccauguuggccaggcuggucuggaacgccugaccucaagugauccacucgccucagccucccaaagugcuaggauuacaggaguaagccaccgcacccagccuuaaauuuuuuuaaaugaaaaaaccauaagcauuuaugaauggggaggagcugcaugaagagaggggaauggagaguauaaagaugaaggaagccgggcaugguggcucacaacugcaauccuagcacuuugggaggccaaggugggcagaugacuugagcuuaggaguuugagacuggccugagaaacauagugaaacccugucucuauauaaaaaaauuagccaggugugguggcaugcaccuguggucccaacuacuggggaggcugaggugggaggaucaccucagcccuggaagucaaggcugcagugaacugugauagugccacugcacuccagccugggcagcagagugagaaccugucuuaaaaaaaaaaaaaaaagaugugagauccauugcaguauguggaauguaagcccugagaguaagugaacaacccuuuuccuuuauuuaguacauaaagucuuuuugugcaccauuccuagguuuuagggcaaaugacucaggaacuccagaagugcauucuuuuuuuuuuuuuuuuuuuuugagacugagucucgcucugucaccuaggcugaaguucaguggcuuggucucggcucacugcaaccucugccucccauacucaaacaauuauccggucucagccuccugaguagcugggacuacaggccugugccaccaugaccggcuaauuuuuguaauuuuagcagacacaggguuucaccauauuggucaggcuggucucaaacuccugaccucaggugaucugcccuccucagccucccacagugcuaggauuacaggcgugagccaccacacccggcccagaagugcaugcuuuauuuuauuggucauuuuaaagggauugguaagggaugguuuaccuugcuguagcaauauuucacaguucuuuucuacuugccuuacaggaauaagaagaugaugaaaagauuaaugacaguagagaaguagcagcaaccuguuugaauacaauguaagagaugagaauaugccaccucaaaauaaguauuauuuugauuugaaggcaauugaaaagagucacauacaagagaaacucucugccuucccccuauucacuaaaaaacaggacauaaauguaucaaagucucuugucugcugucuaccaggaaguacaaaugguggcgcgucuguagauaacuugcaucccaaucauugcugugcuguguccugaccaucuuugguaucuccugaugccuugaguacugacuuacuaaauaguuagcugcacagaauacaauuugguuuuguuuuaauuaauggacucuuuuuugaaaaugaaaacuugagugaaaaguauaggguucccauguauucccauguacacggugcuucacacccccuccauuuuccucuguuaguaacuugcauuagugugcuacauuuuuuacaauugaugaggcagggcugggcauggugguagucaccuguagucccagcuaccgggaaggcuaagucaggaggaucacuugcacccaggaggaguucaagguuguaguucucugugaucacaccugugaauugccacugcacuccagccugggcaacauagucucuaaaaaaaaaaaaaaacuaaugagucaauauugauacauuauucuuuuuucuuuuucuuuuucuuuuucuuuuuuuuuuuuuugagacggggucucauucuugucgcccaggcuggaguacaaugaugagaucucagcucacugcaaccccugccucccagguucaagcaauucgccugccuccgccucccaaguagcugggauuacaggugcacaccaccacgcccagcuaaauuuuuauuuuauuuuuuuugagacagagucucacucuguugcccaggcuggagugcaguggcgugaucucagcucacugcaaccuccgccucccaccucccggguucaagcaacucuccugcuucagccucccgaguagcugggauuacaggcaugugccaccacacccggcuaauuuuuuuguauuaguagaaacgggguuuugccauauuggccaggcuugucucgaacuccuaaucuugggauccacccgcuucgguuucccaaagugcugggauuacaggcgggagccaccgcacccagcccccagucaauuuuuuuuuuuuuuuuugguauguuuaguagagucgggguuucaccauuuuggccaggcugaucuggaacuccugaccucaggugauccaccugccucagccucccagugcuaggauuacaggcgugagccaccgugcccggccucuuuuucuuucuuaaaaauuuguuuauuuuugagacagggucuggcucugucacccaggcuggagugcaguggcacgaucucagcucacugcaaccucugccuuccguguucaagccauccucucaccucagccucccaaguagcugggacuacagacacacaccauaaugcccagcuaauuuuuuuuaauuuuugguagaggacggguuucaccguguugcucaggugaacagccugguucaagaccauugaacuccugagcucaagcaauccacucgcuuaaucuuccaaagugcagggauuacaggcgugagccacugugccuggcuauuuuauuauuauuauuauuauuauuauuuuuagacagaaucauacuuuaucaccaggcuggagugcagugacgccgaucucagcucacuggaaccuccgccucccagguucaagcgauucuccugccucagccuuccgaguagcugggauuacaggcacccgccacuaugcccagcuaauuuuuuguauuuuuuuaguagagaugggguuucaccauguuggccaggcuggucuugagcuccugaccucgugauucacccgccuugggcucccaaagggcugggauuacaggcgugagccaccgugcccggcuauuuuauuauuuuuuuauagagauggggucucaccauguuucucaggcuagucaaacuucugggcuccagcaguccucccaccucaggcucccugaguucagggauuacaggugugagccucuacaccgagcagauaccuuauuauuaacuaaacucuauaguucauauuagguuuuauuauucguguuguacauucuaugguuuugacaaauguaaaaugacauuuauccaacauagugucauacagaauaguuucacuaccuuagaaaucccuuguguugcaccaauucaucccuccccgcaagcccauacacuggaaaccauagaucuuuuugcucagucacccaggcuggagugcaauggugcagucauagcucauugcagccuugaacuccuaggcucaagggauucuccuggcccagccuucugagacacugggacuacaggugugugccaccguacccagcuaguuuuauuuuuuaauuuuuaguagagaugggucucacuguguuggcgagauuggucucaaacuucuggccucaagcuguccuucugccuuagccucccaaagugcugggauuacaggcauaagccagugugccuggccuaucauagcuuugccauuuccagaauguuguguauacuuagaauuauacaguguguagccuuuucauauuggcuuucagauagcaauauguagugaagauuccuccauguguugucauggccugauagcucauuucugccaaacugucuuuaaaaguggcuguagcauuuugcauuccuaccagcaaugaaugagaguucuuguugcaccauaucuuucuuaguauuucguauuguuuggauuuuagccauucuaauaggcgugccacaguauuucagugcuuuuuuuuuuuuugagacagacucucucagagagugcagucacccaggcuggagugcaguggcgugaucucaguucacugcaaccuuugccuccuggguucaagugauuauccugccucugccucccaaguagcugggaccacaggcacacgcuaccaugacugguuaauuuuuguauuuucaguagagauggggucucgccauguuggccagacugaucuaaaacuccugaccucaggugaucugcccaccuuggccucugaaagugcugggauuacaggcaugagccacugugcccagccaguaucacauuuuuuuaaauuuggaauuccuuaaugauaugaaguagagcaucuuuuuauauguuuauuucucaucuguguaucuucuuugguguggugucuuuucaggucuucugcacaauuuuuauuuuuuaacuuacuauuuauuuuuuauugagagaaugucuugcucuuucacccaggcuggagugcaguggugugaucauggcgcacugcagccuugaccuucugggcucaagcaagauucucccaccucaguauccuacugggacuacaggugcacauuaccaugccuggcuaauuuuucuauuuuuuuuuguagagaugggguuuugccauguugcccaggcuggucucgaacuccuggcucaagugauccaucagccucagccucucaaagugcuaggauuuugccuggccuuuuugcacauuuuuuaauuggguuguuuuauuauugaguuuuaagaggucuuuguauauuuugaauaacaguccucuaucagauauaucuuuugcagauaauuuucucauuucuuuccuuccuuuuuuuuuuauuauuuuuuuugagacagaguuuuugcucuuguuuucccagcuggagcgcaauggcgcgaucuuggcucucugcaaccuccaccuccuggguucaaacaauucuccugucucagccucccaagcagcugggauuacaggcaugugccacgacacccagcuaauuuuuguauuuuuaguagagacaguguuucuccauguuggucaggcuggucucaaacuucugaccucaggugauccaucugccuuagccucccaaaguuuugggauuacaggcgugagccaccacgcccagcuuuguuuccuucuuuuuaaauaucacuuuacucucuucuuguuuguaaggcuuacggagagaaguccaauguaauucuuaccuuuguuccuuuacaguuaagguguuuuuuucucuuacuuuuacgauuuucuauuugucuuuguuuuucugcaguuugaguaugauaugccuagguguugaauuuuugguguuuauccuacuuccuaucucugagcuuccuggaucucugguuuuguaugucauuaauuuugggauauuuucagucauugcuucacaacuuucuauuccuuucucucuucugguauuuucauuacauguugaaaccuuuuuguaauugccucgcaauucuuggauauucaguucuuuuuaaaaagauuuuucauuuugcuuuucaguuuuggagguuucuauugacauuuguuuaagcccucugauucuuuuguuggcaguccagcuauagaugaguccaugaaggcaguuuucauuucuguuaguauuuucuucuaauuucuaucauuuuauuuugauucuuggaauuuccaucuucccacuugcauuacucaucuguuuuguaucuuguccacuuuuucuguuagagcccuuagcauauuaaucaacacuguuuuaaauuccuggucugguaauuucaacaucucugccauaucuuagucuugaucugaugcuuccuuugucuacaaaucaugcuuuuugucucuuucuguauauauauaugcuauuugucucucuaucuauauguaaauauagauauuauaucuguguauauagauauauacguauaaguauauauuuauaaaucagacuuguauuguauaaaagaaaaccaggggccuggcaugauggcuugcaucuguaaucccagcacuuugagaggccgagguggguggaucauuugaggucaggaguuugagaccagccuggccaacaugguaaaaccccaccucuacuaaaaauacaaaaauuagccgggcaugguggcagucaccuguauuuuuaguagagacgauuguacuuucaguagagacgagguuucuccauguuggccaggcuggucucgaacuccugaccucaggcgaucugccugccucagccucccaaagugcugggauuacaggugugagccaccacaccuggccaauaauuuguucuuauuccaaaaagaaaauuauacaaauaccaaauagaaacaaucuuaauuuuguuacuuaaaauauuaaugugaacaauuauuuaauuauuacaacagaucaaauaauggaguucucaauuugaauugaauuuggcaauagcuuucaaaaccugacauuuguaucaaaaacuaauaaacaguuuuuugguuuuuuguuuguuuugagauggaguuucgcucuuguuguccaggcuggaguacaguggugcaaucuuggcucacagcaaccuccaccuccuggcuuuaagcgauucuccagccucagccucuuaaguagcugggauuacaggcacuggccaccaugcccgacuaauuuuguauuuuuaguagagacaggguuucacuguauuggccaggcugcucuugaacuccugaccucgugauccacccaccucgguuucccaaagugcugagauuacaggcaugagccgccgcgcccagcuaauaaacaguuuuucuacagaaccuucugaaugaaggcuaauuuaguaauuuauccucuuaguucucagcucugugcagaaagggaagaagggcaguuaaggaagauguuaugguccaaguaagcacuucaccucacccuuuacacuuaacugcuuacauuuagaacucugcgagcuugagaauaugugugcuugugacuugcaguauauucuguggaauuaaaacaaggcucuccugaacucagccuauugauggcuaauggcacaguuguccaguaggcagacuguuuuagaaugagcccaaacuuacacggagaauagaacagaaaaauuuccacauuguacaucacauggaagccaucccaguugagugcuuagucaggcucucaaaaugcuauagcaucugccuucugaaaguaucauuaaucaauggucuucuaguauaaacaugucuugccuaaagacuggccugaagaccaacacaggauuggaaaacaugguaucauuagucuuugaaauaacuaagaagggguccaauucaguaacccaaaggaaaccaauucugacuauacacuauugucuaguauuuccaucugccauucuuucucuauuaaaaguuacguuuguuccauuucuuuuccucuugcagugcacaaaacacccuaacucucuugaccccaaacucugcguauagcucaaagcggcucuuaaauauaccauuucaaauuugcuucuagguacuaaaggagggauguacuuucagaucauguaaccuauuacgaaggaguggaagaggagacaauuugaaugaauccucaugaucuacaaaacaaaaucauagugacuaggacuccacagugaagaugguugacuagugacacagccccaucuaaagaaucccuuucuguaugucugaaaacccauuaaaauaaagucacugcaauuggccuugua

SEQ ID NO: 192636 - RNA, 159907 nt, Homo sapiens
gggcgugggagugggcgcgggcgcaggcgaacggcugccggucagguguccuuguccccuugaguugcgcgggucguguucgagggcauggacgacagguacccugcgcuucagcgggcccagcugcgucuggauuucauccacgccaacucgugagugccgagguggggucggggucggggagggucucugcgcccgccaugaagaaagguuuugcccguccccugaggaauacucagcaagugaacuugauuuauggauuuauuuauuuauuugagcuguauaggcuuuuuuuaaaacgaugaaagcauaauaaagauauauucugggccaggcugaacccuuuaggugcucuucagugaacaccaagugguuggaaggcccuacauuuaucauuuaacacaacuguuuaauuguuggucagcagaacugugauucuaccaauccugccuaaccuuagucugccuaacacacugacaauuuaaacauuaaaguugcccuucaaacagaguaauuugcauauauugauuucaaacucuauggccuccugagucuuuucaaaaauguaaccucucuaaggauaggaaucucaccuuuuaguuauuuggucauuucuucuucucugccaugccugucugccuuuuagagcuucucaggugucauuucagauagucagauugcagaggggaaugacagagguuuuuucucucaucugccauuucccauacagcaaauuauagcaguuagugcuauuuaauucacaguggaacguccggguuuuucuuuauguuucuuuuuuuuuuuuuuuuuuuuuugacaucuuuugguaauuuggauuuacuaaauauaggaacagauaucagggauguaccaaauuugaaaccacagaaauggagguauaaagaaagccagggaaggccacccuugcucugugggacagacuguauaauuuuaacauagcagaguuaaacaggcaauauucagcagauacucaguuuucaucucucuuuagagaaugaugucaagcuggaaaagguggaacaaaaaguuaaaagguagcugagguggaagacaaaugaagaaauaauaguuucgagugaguuuaagaaaaaugcucagggcagugcuggaaggacugugaauuuuaucucagaaaaauuccucagccucaguuuuauauggauuuuguggcuacugcuucacaaccuccauucccccaaaccacccugugguagccacuuccccaguaccauuuucaacuggugguguaguaacuuaacaagugacagugacauggaguaacaacaaaauuagauacaaauggaagacuucucagcuccuccagcuagauugguugguuggauuuggagacagggucuugcucuguggcccaggcugggaugcagugauaugaucauaguucucuguagccuugaacuccagggcucaagugauccuccagccucagccuuccgaguagcugggacuacacgcaugcaccccuaugcccggcuaauucuuuuuuuaaaaaaauuuuuaguagagauggggucuggcuauguugcucaggcuggccuugaacuccugagcucaggugauccucccacuucggccucccggagugcugggauuacagucaugagccacugagcucugcccagguagauuuuuguuugagacuuccuacugcaaaaggagugauuuuuaaauuucucccuuuaccucuauguccaauccagagugcaugcuuucucuaaauauguuucaaaucauccauuucucucugucuccacugccacugacuuuaguccaagccaccacugucccuuguccagacuacuccagacagccucuuaacuggguucuuugcuucccauucuggcugcuagaugguccauuuuccuggaaagcugccagagugagcuuuuuaaaauguaaaccaacuuacgccccuuuucuuaaaacacuacagugguuuccaguuguaugucagccaaguacaagcucuucucugugggcuaggaagcccugcaugacccagccaugcccucauuucaaccuguucuccccauuuuaccauaagcggagcucacuggucuccuuagcucuuuuucugcuucgagggucuuuguaucucuugcucuugguaaaaaguuucuaccguacucugcaagggagugaauucucucauccuucaggacucaguuuaaauaccuuuuaccaagaggugcuuucccuaccaccaugccccuccucaccaguuacucuuucccaucacuacuaugaaguuagcacucagucaaaaucuguaauaucauccucauaaguuuguuuacuuguguguuuuccguguaccccaccagcuugagcuccaggacauccaagacccugccuguacacauuggcacaugguaggcagucagugacaaucucuugaaugagcuagugcagaaauucauaugacauuuuuggucagaauuacugcaguugcuuuucuaaaggauuguuuauguauugaauuuuuguauauugaaucauguacuuuaaauuuccuagaagggcuugugauuuaaaguccugauuuuguaaagcauaucguauuucucuuuuacacuauuuuacauuuuuauaauggcuuucuuuugggugaaggacaucuuuuuguaacaauaacauuuuaguaguuuuuuuucuuaauuacaaaauuuaaagcuuacuugacucaugagacuuuuaaucauccucuguguuugaaacuccaaaauguggggauauauucucucucucuguguguguguguguguguguguguguguguuuuaaaaauacauuuuaaacuaaaguguuguccuguggccugagguugcagaugaugcuuucucuuguauagaagagcagauguauuuuugauaaaugaggcucucuugcuucuguuaccuguuuacuaaauauagaaagaaaauugcaugcugaauauucccuuaaugcugugauaagguugcugauugaaauaugccucaucaggacaugagaagcaagcaugggagccuuaagcuagugugauuccacccucagauaacugugcacccuccaaacuguuguaaauacugaaggcugucuggagcauucuguuaccgaggaccuggcauucgaggguacaggagaaagugaccugaggccauuuuuaagguuauguaaggagcaggcuuuucagcgguggaaagauucugcagaaaaauacagauuggugaggcacgcaagggcuuccugccaguuccuuugccugcacauggagccuuauggccuuuuaguaggcaaggauuuugaucaguauucuucagaaauaucuugucuuuaaauaauacaauuuuaaugaaaaauccucugggaaaaaccucacuugaaaacaugcuuauaaaguaauauuaaaaggucaaaguuuauuucaaugauagauacuaaggcccuuaaauuuuuauuuuauuagaaguggacaggauauuuuggcaaaaguguuuuuaacccucgcuucauaauggaggguaucuaguuccgaaucuugaccgugcugagagaguuguuucuagaguaacuucuuaauucacuagaugucuggaacuggagaacguuugucugcaagaaucuuaaagcuuuuacauugauuacacaccugguuuaacuuuuuguuuucucuuuauuucuucaucagcaccacucacaguuuccuuuuuggagcacuggcugaauugcuggacaaugcaagguaagguuuaucuguaaacaacaguuacugagggaauuucaugacauaacucuugucuaauuacaugggaagauaaaaagaucaugucauauuuucccaucuggaauguuuugugacuugauuuccuauaaaaucaagguguucuaggaaaaaggauaguugagagaaauaauuauucaccuuuauuuaauuuuaauuuaugaucaaacuugaagucuguuuuuauguuaauaaccauuuaauuguacauauucauuuagauauuuuuugaauuauaugucaguguauacuugucuugagaauuuacacauguauuugggcauuuauugaagucugcguagaagcaaauuguauaguuaagaaaauagcuaacuuauugaucucuuacuauauaucagacauacauaagcacuuuauauaugagcauuaugucaugcauccuuauaucuacacucugagaugggaauuaauauccuaguucuacauguguggaaauugaugcauagagagauuagaugauuuauucaaagucacauaauucauauuuggcagagcuggcauucaaauuugggcagucuggcugcagaaccucacugucguauuuuacugucucuaauaaauguauuaaugauuaaggaacccguuaaacaguuuaaguucugcucaguaguguauuugugggagcuugugaggggcuucauuuuuuuuuuuuucaguuaaauugaauaaagcauuugacguguuuuauauugguauuccccauaacagaagauuuuuuccuaccuuuugcuuagaaagcaaaguccauccaggaaguaaugugcaguuguuagaucaaggaucucaguaggagccuaaauucccugccacugguugauaacaguguuuuagcuuuuuuugcauuuguuccccauuuuuugccuuagaugggagaugacccuucugagagugugaccacaaaguguagucaauuaaccagccauccagaaauuccugcccugcacuaaguagaaagucguuaucuccuccuuuuaggaaacucucucuguugagcuaauggaaucauaaaaagggagggaaguagagaaaaagaauaaagucuuguucagagccaugaacucagcuuggaaggagcuaauaaggaugaagccaagaaagauaaacacuuuugauuagcuucccuaaaggagcuuaggguugcuacuguugcugcugcucaaagcuuggaagcaaggcuccuccuaugucaucgguccugccuccuacugaaugggcccacuuucagcaacuugacaucugcaagucugaaagaacacauuuaucuauuuuuccaacugucuuuucuccuuugaaguuguuucuuucauucauucaacaaaggaggacaaguaaaaucagaauguggaagaaguagaauaaaagaaacauuuuauguaguagagguugauugggaaagaaagauugacuucagacucaggggacugagagaaaugugaucgauaaacuaauucuuagagcagcauuuguaagcuggcagccccuugaccagguccagccugucuuauguguguuuggcuuauagugaaaguuugcacaguguuuauaaagaaaaggaagggagaaaaaaggaauuguuuauaagguuuaagauauuggagauaccaaauaaaaaauuugggcccucugccuuccuugaaagauuaggagaaguagcaaccucaaggccacauuccuccacgggaucaggggcuggaggugaguagcaggugcucucuugggaccagcccaugccuucagcuuugccucauuuccaguuuucccccguggacagccucaacccuucagucccucuuucuucauggacguuugaguuuuccaccauugcuuagaugcuaguaguugacaucaaaagaagcuauuuaacagacuuaagauacugaguuggucuuacgaaggagaacuuuaugaaguccccauguuauucuaagaaauucuuuuauaucauuguauucaauauuuuaaugauuuccuguaguuuuaaaaauuagaacugaaagauauuaaaagaauauuguagagagagaagaagaauguguggugauauaggaaggauuuguuaggguccucuuccuaauacaauagcucuucagaaaggaaguauccugggcuaaagaacaaagauuauuauaaaaugucuuaauauaugauaaaggugaauuauuuuaugccuuaauccguggaagugcugcaugaaaaaacuaccucuuuaaaaacuuacauuucaguacaguggcauuuauuaaacauuuauuguguacaugguacuuuguauaaugcaugauuauauaauggagauauugauaccuauguguuauggaacuaugguaaggaucggaagagaauuuucaaaaauacaccauucagugcuuacuugauacaugggaggugcucaagaaauggcagugguaacuccagagugucuauauagggagggcugagaagcagcaauuggcuagaggaaggagcuauaugggacuaacuucuaggccuguggagcaaguacaguguaccuacucagauuugucugggaguuuuggguuuagaacugauggaacuuuggagagacgcucagguuuccccaccagaguuacauaguugcuguuguugcacugagcuuccuuuuagacuccucccugccuuaacuuaccuucuuccucaucagcuaagucuuccuugccuaugccuuccuccuuucucucacacccucgauauugaagccagagucuucuggccuuuucuucuuuucuauuaaaaauuuuacuuuuaaaaauaauuguaaaaaaauacaaaaauaauaucugugaauuuuagaaaauggagaauuuuuuuuaaaacagucuucaucaguacucucaucaccuagaagaggagucagcauccuuuucuguaaaagaccagauggcaaauauuuucaccucugugggauacggggucuccuuugaaacuacucaacucugccacuguagugcugaggcaaccuuagauacuauguaaugaaugggcaugauuguguuccaauaacacuuuauuuacaaacaguugaugggccauuuugguccguggcuauaguuuuccaaccucuaacaaagagaaaacuccuauuaacauguugauuucuuuccuuccauguauguucuuuaaaaugucuucuuauaguacacuauuaccuaguaauuugauuuuucuuuuuuuuuugaacuaaaauaugaaaaacauuccaugacuucuggauuauuugccagccagcuuuuuuuguuuuuuuuuuuuuuuuuuaaauuauauccauuuuguuaguuuuuuguguaauucccacuaaauuccaucucuucuuucacauuucugaguugcagucuuuuucauauucucaaauuaugacuaaucauaggucuuaugauauaauagcacggugaaacguuuuagaaauugauuuugaagcaauuuaaguggauuuuuguauuguuugauaucugacaauagguuauaccuuauguaagcaauucauuucauauugaagaaauaauauuuuuguauuguuuccagagaugcaggggcugaaagacuugaugucuuuucaggugagcagauuugcuuucuucuuuuauuuucuucuaauggaaagacuguaguuauuuugcuuguauuuuauuucaugaaauaaaaccacauucuauagaauuuuaauguaaucuaagugcuuuguggguacagugacccuguggggagccagggugaggagaguauacucugagagucaaauugugugcuaaaggacccauuuacaaaauuaggucuuccagaguuuugugaauguaucagagugauuuggagcacucaauuugccugccaugagaaacaguuuuauuuuuaaaaaguauauuaaauuaacgguuauucauaauuaagcauacaucauucccaacuuaguaguuucaaaguguguacgugaaugugcgguaugagggcuagaaaauccaaaccaaaucuguuuucuuugcugacuuuauucguagucaucaaguauuuauugcacucacuaguuaucucauuagacuaugaugcuaaugaaguuagguucugugauccagcucuguagaguaaugcccagguagucacgcagcaucccuaccacauuucugucagcuguucugcaauauuggcuacuggucacgggugagaggauaugcuccaugaucuaaauccauaucucuguuuaaaaagcaccucaguuaacugaguguucugagucagaggagugcuuacgcuucaugagagagauagacguggaccucuugagauaacugaggaaacaauaaaugacacucuucaucuccuucuccucuccagguccugaaaaacuugagaaauagaaaaagagucagccuuuauugcugauaaauguuaggcuggaguauguagcuuagugugagagagcaaauggacuugcaggucagaccccgggaucacguggacucacccgcccaguggaguugggcuuccucugaaacucuuuugcccugggacaagggaucaggacucacgcucucugcaggcagcucucuccuaggaggaaaaugcagggucagaacugagccuccccaguuuauucuucccuaagugaccaguaggugagugagcuaaccuccacaggggaaaagugagugaaggcacagaauagggccuuucuagugagaaaaagucaucuucccuuccauauccaauagaguaaaauaagaugaacacucuugcauaggagagacucagaguauggugggaacacagggaaagaagaaauuaugccucauauuaaggggcuagagcuugaaauaugaaugugauuuuugucagauacuccaggaagaaaagaauauuccugucuagguaauaauuaugagaaaacaaauggagauaggcuaguucacagauucauuaauuuauucaguaauaauuuguugucuauuauucuagguacuggggauagugcacugagaaaaauguugaggucuuuguuccccuggaacauauauccuaauggggagagauagacaauacagaaaugaacaaauauguaauauacaaggcaaugauaagugcuaaaagggaaaaaaauaaagcaggauaagagaacagagagccauggaagggguauacagcuuuucauggguggucuaagaggguuucuuuaaauagcuaacacacaagcaaagaccugaaugaugaaagggagggagccacacagaugucuggugaaaaagcacucagggaacaaugcugaggcucgguugacucgcacuaagugucagaaccaaaugaaugagcaucuucaauaccauaccaagguuuuuucugcagucaguggaccacugaagaacuuugagcagugucaguuuucuaaguagacauguggucuuuuuuuuuuuuuuuugugagacggagucucgcucugucgcccaggcuggagugcaguggcgcgagcucggcucacugcaagcucugccucccagguucacaccauucuccugccucagccuaccgaguagcugggacuacaugugcccgccaccaugcccggcuaauuuuuuuuuguauuuuuaguagagccgggguuucaccauguuagccaggauggucuugaucuccugaccuugugauccgcccgccucggccucgcaaagugcuggcauuacaggcuugagccaccgcgccuggcugagcucuuuucuuuuuuaaagaaagauacucauuccagaaauaccuuacaagagagucuggagaaguaugaaagcaaggauagcagggagguauggcuaugggaauuaccuaggcaagauuucaugagaauuauaauagggcaguaguacuagaaauggaggaggagagacagauguaagcugccuuucauucagagcacaugcacaauugauggaggauugagaagacuuauccauagucacaaaauauaacaaauguaaucagaauccacgcauuauguucuuugggguuugugacuggagaccagcagggaaugagaguguuuauuucacccuacuuucucuaaguacucaguuuaucuucauaaacaaacaaaauaagaucuugaccaaguugagauuaaaguggcacuucuccuuuuuuuucgagauggagucucacucuguugcccaggcuggagugcaguggcaccaucucggcucauugcaaccuccgcuucccagguucaagcaauucuccugccucugccuuuccaguagcugggauuacaggcacacacccggcuaaguuuuguauuuuuaguagagacgggauuucaucauguuggccaggcuggucucaaacuccugaccucaagugauucccucugccucagccucccaaagugcugggauuacuggcaugagccaccaggcauggcuggcacuuacuucuuuuuuguguuuauguauauuuugugaaaaacugaacuuauaguucaguuuagcuuaaaauuaccuauucauguuuuuauugauuuaccuguucauuuuuuauugaggcaagccaucuuauggcuaucaaccuagcaaacugauuuucuuaaaaaaauggauaaaaaaagcagggacaaugcuuaugcaucaauacauaggauuauucuggggauacaaaguuaaucuaagauuggacuaguuuucagauuauuuacuguggccucgaauuauugucaaucuuaaauuucugucaacuaauuaauuugaaggcuauaaaauucaaaugaaauauguuucccgugguguuuuauacguuuguguguauuaguuccaguaaacauggauaugcauucgguacuuuuuuuuagugcuuacuaaaugccaggcacugggcuaggugcugcguuuacacucuuaagaaauuggcauuuuaguguggagcccaugaaaaauguaguauguagcuguacuuugguggguagaggguccauagcuuuccuuauaucucugagguaacuguguuccaaaaaaguguaggaaccauugguccaaaagacaaauagauacacgaacagguauuuuaauauacuacaaagguacaaaaacagagauaaaggggucauuaauuaugggcacuaaugacauggaaggauuaggaaaggcuuccuaaaagaagucugauaugaacuaauugaaagagaaaauagacauucgccuggugagugaagcguggaaaggguggaagggcauuaugugcagcaacuggaauauggagagaauguagaaaaaauguuugagauguuuaagauuuguucaaggggaguguuugugcaggaguggaagguggcaguaugggcaggugagggaaagacaagaaaugagcuuggagaguuauccagauggcccggucauggagggcaaacaagauuuguuaggugguuggauuuuauccugagagcauugggaagccauggagagguuugaagcaggagagcagugaaaugcacgacugauggaagacuggcugcacccugugacuguagggagagcaagaagguagggcgcuguugugauccagaaaggagauggugucuguauccccaggcaguauacuggggauagagaaaguggucaaaugggagucauuaaggcagugaaauugagaggaccagaugguugcccgugugaggggugaggagauggagaacauaaugaugauccgagguuuugacuugcacagcugaagccuaggggcagggugaugccauuuauugaacaggaaacgaggaggaggagaaagucuaacgugggaggagguguuuguuuuguuuuggacacgcguaauuaacaagugauaaaauauaccugaaauucauaguuuuaaggaauugaaauaaacaaggccagguuucagaguggauaaugggggauuauuaaauuuugaggcuauacuuauuugucucuaauuccuaauauggauuuacaaaaaaaggagauacuguaguauaugucugaugggaaucuuuggucuuucccagccguuuacugaaggaauacccuucuuucugcaagcuccuucuaggagaaauauuuacaaagaagugcaaaucagcuguggcuaccaugcagagcugcccgaggcugaacgugguuuugcaucaggugauucccaauccuggaugaacauuagaauaacugagggaaauuuuacgagaaaauaccaauuucugaacccuauccaagaccaguuacauuagaauaucucuaguugauuucaaugugcaaccaagauugagagcuacugccuuaugcagagaacucaacaggguuggauuccccucauuaaacagugaggaaauaucagccuuugagggaggacuaaacagaacaaguacuuuaaagggggagaggaggaauguccugacacagaaguugagguaagcagaccauaggacuagguagagagaaggaacugggaaaaugaaaugguaguccggauccuaaaaguuuacagacaaagaaguaaauuggagagaagaggggauuagaagcgggcacaucaccaugaaauuauaaacccagaaagauuaaguauguuuuauaaguauguauucaugggcugucuugaaacuuacuuacuuuuuaaaauauuaauucuaggugacuuuuuuuuuuuuuuuugagacagggucucucucuguugcccaggcuggagugcaguggugugaucauagcuuacugcaaacuugaaguccuaggcucaagugauccuccuguuccagccucccaaguggccaagucuagaggcaugugccaccaugccuggcuauuuuuuuugagauggaguuucgcucugucgcccaggcuggagugcaguggugcgauuugggcucacugcaaccuccgccucccggguucaagagauucucuugccuuagccuccagaguagcugggacuacaggcacacgccaccacacccagcuaauuuuuguauuuuuaguagagacaggguuucaccauguuggccaggauggucucaaucucucgaccucgugauccgcccaccuuggccucccgaagugcugggauuacaggcaugagccaccgugcccagccuauuuuuuuauuuuuaauuuuuaguggccauaaggucucacuauguuggccaggcuggucuugaacuccugggcucaagccauccucccuccuuggccucccaaagugcugggauuacaggcgugagcuaccacauccagucucuaagugacuuuugaacagagaaguugacuuaauaaaugugcuggaaaugaaucuauggggacagaaagcauaucagugauugcuugaggguaaggugagggugaugggacguggaaggguccuaaggaaggauuuacaaagggucaggaggaaacauuugagguguggauauguucgcugcugugacugugguuaugauuucauacguguguguguguguguguguguguguuaaaauuugucaaauugugcacuuuaaacaugugcaguuuauugugcauaaauuauuccugaauaacacugucauuuaagaaagagaaaugugcuagaacuccuauguccaacuacugaaaucauuuucagggccaguuuacaaacugggcacuaaaauuagucucauuaguuuuaguuacagcuuuaacuuuauuaauuuauuuuagagacaaagucuuacuaccuugggcaggcuggucuugaaccccuggccucaagugauccucuugccuuagccucccaaaguucugcgauuauaggcauaagucaccacacccagccuaccuccaacauuuuuguaaaccaaauauuauguuauguaauuuaaugauaucuucaaaucauuaaaauugauuucaaauaacuuagccauuuucaaaaauuaagugcgucuugaagagguaaguauuugcucccaugaagaugcacucacaaauggcucuuaugagaauuaacuacuuagaagggagccugauggauuuaauaagaauggccuagauuuauuuuauaauugugcuuugguggaagggcacagagguuggucaguuugagcaaaggauccuggggucacuucaccauuuaccuuuuucccuccccacagagaggaaaugccugacauuuaaaggacuaguccaguugcagagcagaacauguccugcuguauacauaauuuuuucacauguagauguuuuguguuaauuuaaagccuuuauguugcaugauuauuuuuccccugcaguuucuugugaagcuguagccaagacuccacucuaggcuccaucuuugugccauaacucugucacucuguggcugcauuggaggaagacgaauaauuauucuagcagcaugacuuucugacuaacaaauuaagcccgauauuuauuaguaauaacugcuuucucuuacaguggauaaugaaaaacugcaggggggauucauguuguguuuccuggaugauggauguggcaugagcccugguaaguuaauuaucuagauaccuaacuggcuguuaaaggaaacagucugaaaaccuacaaaauaaauaaauugagcuaucuaugcaaaaacagguauggagcuauuaaagaaaguaagccccagacuuuuuguugaacuuuuuagguuuaaguaucccagcuggcagaguaaauuuauuguaaccaucuaaaccaagacaaaaaguaaauguauauuaauauugucagaaaaaugaaaggcaaauguuacugauuguaagaaauaagcaucugggaaugaauggaaaacaaauagucacugaauagacucugagauuguuuuuagcucauccuuuagguauugcuugugagagccccaggcaguuuccugugccuguaggcuauuuuuaauuuugcuuaaccucgagguagagguuuccucuccuuguuuuuagccuuguuuuuuccucugcauuuugaaagcuuuacuugcuucaaaugaauguucccaucauaaagaauacaucuacaauauauuucaugacuuaucuuuguguauucaagguuagcacaaagccagcacauuauggguauacagugucugugugcugugaaauugaaaugugauuccaucugagggcauuggguuguuuuagguauuguauuucugaauucuuuaaacaugguguguuccacaagccaggguuuuugaccacuagauuuaaaaaauggugagaguucaguaauauggaacugccauggucaguuccacaacugaggaaaggaugcaucaguaugcucaaauauugauuugcugauagaagcugaagauaugagguauggcaaauaucuuauuucagcucugaaguuuccccuuggucugaauaguugaagaguauuagcaaguuuagaaagacuguuucacccaguuuuguucugacuucggauaauuuugauuuuuccaggucauuuugauuaaaaguauucuuggucuuuuauuguuuaaaugagaaagaagaguuuguaacaacaacagaaaaaacccaugcugaaaaaaguaauuuuucacuucuagccugaauauuaaguucauuuuuuugaauuccuaaaauaaaugacagaauauaugugauauauucuaagggaauuccuuaugaaaagaagcaacucuuuuuauaugggucaugaacaaaauguuugaaacacagacaagugacggauauucagaccuucagaaggaacucacacuucaguuacauaguagcaucaacuaguaauaaaguagaaggaagaugacuaaaaguagaaucuauccguuguucaaacggagcuagaucaaucuugacccauagaaaaugacuacaguacuuuccggguuuuuaaaaaauucucuagucuugccccuuuauaguccauuccccacacagcauccugagugauuuucuuucuuuuaauguacauuuuccugcugaaaauguacauuaauaucauuuuccugcugaaaacccucagugguuuuccauuacuuaauacaauuuguacucucagcaucucuuccaagaccuuacauuauuuggcccuaugcaccucuuuggccuuuucuuguucuucccacuuccucccuuagaacacuccacccacacauggcugaccccucaucguuugaauccaucucauguuaaccaucugccaguggccuucccugaucauucugucugcaggccacguuccuguuaauucucuaucgcauuacccugguuuuguuuucuucacuuaauacucagucagaaaugaucuuauuuauuaguuuacuuucaaucuguuucuccuaccaugacauaguguuguccaaggcaggagccaugccuggccuguucagugguuuauucccaugcucagaaccggguaaccaugcacgugaguucauguaguguguaaugaacacaugggauuugguucagagcuauaccaugucuguaccaagacuuagaacuuuggguuauaauccuagcuguacccucuaucagcucugugaccuugggcagguuuuuaaaacuccuuagacuuacauuugcucaucugugacaugcaggucauaguaauaauaccuuucuuguuuuguuauaaauauuaaauaagcugugcauguaaguauaaacauaguaccuagcauauacuaaacaaucaauaaguguuagcuaagauugucauuauggauauccuuaccuaaugccuaaccccucauaggaacauaucauaggagguccaguuaguuucagagaagcagaauguuugguggcuuuuacacaccucauaccaugugccacugaacuauagcauaucuguacccagacugacagaggguccucaggacaauucuucagcauguauucagguaggccaacaagaagaacauucuugguucuggagauugguauuaauauauucugaaguccagaggauuacugucuagaauuccagaauaccuggagaggucgggagaaugauuuggaacgucugaaaugguuagccuucuuucccagguaguaucagagcagaggucauccugccccucuuagucucacaugggccugguuaagggcuaaauucguggggaaauuacuagugguacaaguaauuauaacacuuguaauuugguaacacccaccaagugccaaguuuuguguucaggauuucacaaauacaucaucucauuucauuuguuucauuuaucuucaucagcaacaccgugauauaaguauuacguaguugccucuuacaccacauggaaauuaaggcucagacuuuuaaacucuaccuaaggccacaugguuaggucugucucaucucuuucaguauacaguuguuucuuaguaucuguagggaauggauuccaggaccuuucuaggauaccaaaagcuguggaaagaagauggcacgguauuuccguauaaccuauauauauccuccuguauacuuuaaaucuuuuccagguuccuuauaauacccaaugcaguguaaaugcuauuaaauaguuguuauacuuuguuguuuagagaauaaugacaaaaaaaaagucuguacguggucaguccagacgcaauuuauuuuuuucugaauauuuucaguccaagauuaguugagucuaugaauguggagccugccguaccuugggcugacuguaauaccauuaagacccuugucagagacuguggauucugaugaaaauccuugucucugggcugacccaagagcuauggguuuguccugauguucugaggaaugugagguccugacagcugggccucaggccagugucaaagagucuuccuaaccaccuuaaaagucacugucaauuacagaggaagcuucagacaucauuuacuuuggacgauccaaaaaacggcugucaaccuugaaguucauagggcaauacggcaauggucuuaaaaggugagaauuuuuuuucccuuaagacauauauuauugauacugggaacacuguuuauaaagcaauuuacacagaaugaugcaggcauguaaagcuuuaaaaaauauauaaacuugaggcaggggugaccuacuuuguguuggaaucuccauauacaaaacugacuuuuuuuuuuugagacagauucucacucugucacccuggcuggagugcaguggugcgaucuuggcucacugcaaccuccgccuccuggguucaagugauucuccugccucagccuccugggcagcugggauuacaggcaugagccaccaugcucagcuaauuuuuguauuuuuguagagacagaguuucaccauguuggccaggcuagucucgaacuccugaccucaaguaaucagcccgccucggccucccaaaguacuggaauuacaggcaugagccaccacgcccggcccauaacugacuuuuaucuuuacaacauuuuagguuaauucucccaaauaauaaaauaaauccucuuucaaagauuccugaagcgguaccccuguacuuuagugcuuuguugcaucucuauguucuguuguuucccaaagcauauuuuaaccuaggugcugugucugcagcucuuuguuuuaguaugcugcauugaaaggucaggacaugaggcucacuuguacggcuccuaccugagacagaugauuguucuuuugagcccugaauggacccuuuccccugcagccaaaccucaagcaagaguguggagcuggcuuaguucaaauucuucugcuuuacuuugaaaaaaaaaaaauuguacccucuugaugacgggucagcagaacagaguguuggaaagaacauccuguuacaguacacggugauaacagucugccuguuucuuccuuuuuaguauuugagguguaaaacaugauguucuucauuuuuaauauaguggguccaugagaauuggaaaagacuuuauucuuuuuacgaagaaggaagaaacgaugaccuguguguuuuuuucucagacauucugugaagaagaaagucuuagugagguaagaguugaaguuuuccuucuguucccauagcaaugauguugcuuucauuuacucucucaggaggugaagucuugucauggguucuuucugauauuauuuagaaacuuaggaauauguuugggaaauggagagaagguaucaagacauucuggggacaucaaagaccuguccucuugacccuuuccugagaacuucauuuucauuauccaugugcucaaaucucccaaaguaagaggcucccuuagacaugaugagcuuuuuagaagaaaccugcaaaaucuuuccaccauauaugccauaaauugauuaucauuuuaaaaauaaauaaaauauuggagucaaagacuuggaauacaaaauguaaagaaauuaaugcaaaauagacuuaaaacuguaacucuggugaccauaauuucaacuccauuugcugauccagaggcauuuuauuaauuaccagugccugaguuuuauuauuauggcugucaguuauaauucaauauaacaaauacauguugaggaacuacucucugccuaguacuggauagacucuaugaagguagaaaagaagcagaaggucauauggccaucuaagagucuucagcuuuaucacaaaauaagguagacacauaugaauuggauaaaaaagugaggguauuuaaaaagaaugcuccucaaugagucuguguggcuacuguuaccagauuaucaaaagcaaugauauggauggagagauagagggccucgagugcccaaugaggguuuuauggagagaguacaacuugcagccggaaaagcugguacuggagauuaauggccucagcaagucucagaccuggagaugcauauggaguuuggauggacgguguaggacugugagacugccaguggguggagcugggugacaggagcagucugcagguaaaaaggaguaagccgugugggagccugaccugaggaaaagugaugcuguaagcauuuauguugcauguuauguguguaaagggcauggaaaauugggcuaacccuuaauuauagcuuucuuaaaaugggccauucccuuuuuuaaaaaaaacuaaaaacagcaaccacuucccauuucuacuuccacagagacaaccucuuaacaacaauauuaacaaguucuagcugggcacgguggagugcaucuguagucccagcuacucaggaggcugaagagggaggaucacuugagcccaguaguuugaggccagccugagcaacauagugagacccugucucaaaaaaauaaaauaaaaauaaaaauaaauggccuguucuuuugauauuuaccuauguaucucuaaauagcaugccuguauugcuacuucuugauuuuaucuaggcauuaucuauuaaccucccacuauaaaagaggauuuaccuaccuuuuuucucugcuucuaucauauaaucguagucuucucaucccccgcccucaacauagcuuuauuguaauuuuagcuaugacaauauucaguguuuacuuuauaagacuuuauaaacacuguucaaauuauaccaagccaucaacuauuauuuuuccuuuucauguacaacuuauuuccccuaaaauuaaucauugacugcuuaguuuuuuauguguauuacugucacugaauauuugcuugguuuucuguguucgugucacuguguuaaccccagucucaaagugcuguccucucagucccaucuuccugaugaagucugcucagggcuuucuccugugcugcagcucacacuccugcuuccauggugguguucagcugccauccugugaucugcccuugcccucgucuuggugauucccuuccccucucuucugugucaucucugagauccuagaucucacaucuucuuccauagcuugcucucucuccuugguacagcauguucuccagugacuucuugagcaaaggaacauagggggcaaaauaucuggagaccucacaugcauuaaaagguuuuuauucuacccuaacacuuaaugguaguugggcuugauauuauuucuagguuggaauuuauuuucuuucaggauuucgaagguuuugcuucauuaucuaguuucuaguguuguuauugagcagucucaagccauuuaauuacuuaaucuuauaugugacccauucguuuuuuguuuguuuguuugcuugccuuuacucuuugaaggucaaaauaaucuucuuugucucaguauucugauuucaaguguuuugccuuugcguggucuauuuacacccauugugcuggucacuugcugggucuuuuugauuuggaaacucauauucuucaauucugggauaguuucuuguaauagcugaugauuuucuucuauucauauucucuuuucuauccuuuuguaacuccuguuuuuuagcuauuguauucuggaagugguucucuaauuuucuuagccuuuccuuccuguuuucugaguuuuauauuuuugcuuuauuuucugggaguuguucuaauauuuauuuuugaacccuuuuguuaccagaaaggggucugaucccagaccccaagagagaguucuuggaccuugugcaagaaggaauucagggcgaguucauagagugaagugaaagcaguuuauuaagaaaaaaguagaggaauaagagaaugauuacuccauaggcagagcaguggccugggcugcucaacugaguauacuuauaguuacuucuugauuauauaugcuaaacuagggguugauuauucaugaauuuuccaggaauagggugggcaauuccaggaagugagguuuccucccauuuuuagaccauauagggcaacuuccugacauucccauggcacuuguaaacugucauggcacugguaggggugccuuuuagcaugcugauacauuauaauuagcauauaaugagcagugaggaugaccagaggucaccaucuugguuuuggugggauuuggccagcuucuuagugaagcugggucagcagggucuuugugaccuguaucuugugcccaccuccuaucccauccugugacuaagaaugccuaacaugaacaugcagcccaguaggucucagccuuauuugacccagccccuguucaagauggagucacucugauucagacaccucugacacuuucacugaauuuuuuucuguaaucauauucuuaauuuccaagaagucuuucuuauucucugaauguuucuuuuucaaaaauaucucguucuuguuucauggauacaguauuuucucuuauaacucugaagauauuaacaauaauugauuuuugccuuguugaaguuuucaucuuuuuaugguuucuguuuucacugaguuacuuuguuuauaauuauuuguucucuauuaucauauuagaggcuuuucuuagauggccguuacuccugaauacuuuaaagauaaguccaguaaaaugacgagugcaagcucugagacugugaguggggccuggcugcuaugauugucacaauaaugugaucuaacugagcuuuuuuuuuuauuggggaauccuuaauguaauugucuuugugucuuuccuucuggguuggucagauuuuucaaggaagacuccuagucuucugccuacagaccuaccugucagcuucugggagacaaaugggaacgagaucugaagaucucagcaucugcuaaguauacuuucacucggucuaucuaaucucaguaaggugcccacaagagcagugccugguaugucuuccagucuagaaauccauuguucuacucuuuccagaggguaaauauccagacccuggggguugaggaggagcuguugcugauggggaucuaaaugcuacuuauaguucucuucucccccuaccccaacucuagaguuaacuccugccaucagucccugagaauuacaguguaggaauucugaauugcaagucaggcuggcucugcuuucuggcuugggcuuuagauugcuuuucuugcgugugcugucaucugcuuuucaacuuuuaaaaugcugauucuguuguuuccucugccauucuacccuucaagagggaguugaaguacacuccaucuguucccauauuccacaauggaguauuuuaaaauacaauccugucuauacacauuuguuaugugucucuuauacaacuagauuauaggaggaaaaugaacuuuuaacuuaguguuuuguaauuugucuagaugaagaguggaaugaaauagauaagacaaaagaauaauguuuuuuguguauuucauaguaaauugauguguuuuuuuuuaaauagguuguaguuccaaugcccucaugguuaauaagaaccagagaaucugucacagaugauccccagaaauuugcaauggaauuaucuauaauuuauaaauacuccccauuuaaaacugaagcagaauugaugcagcaguuugaugugaucuauggaaaaugugguaagaucaucaaaacucugacaauuugauggaaguauuuguuuucagugucuuaucaaagacacuguacauauguuuucauuuuuuuuguucuuauaaucucauguggauucacacuggggacagucauuuauuuuauccauaugagcuuugucuuaagagcauccaaacaaauuacuguaaaucccugacacugggagaaggauguguacuugcaugagcuuggugaaacuggguaagaagaggaugauacaggcuaugaccacagggacuccacagucgcugcacuagauagcaaaguuaggagacacuuauugcaucauuugagauagagugauaacagguauguaagagaguuagcaacuuauaaaauaacgaauuaaugucucuguggcaaagaguuagcaaaaguauugcagacauucuucuccagauuaacagaucuuuuccccauucuuuccaccuccaccaacuuucuguucaacacgucgaaugcacugugucuacuggcacaguugauccaggauuuagacacagccauuuagcccauguucuuagcuacuaugcuauucucccuuguguuuaagaacuaccaaaaaguauaauuaguuguccucuuaauuacucuaaugauccuguuugacuuuguaucauaaucaacuggaaauaauuuggacuuuuuuuguuaaucaugccuuggagcaggggucagcaaauuauggucucgggucaaauguggccccauaccuguucuuguaaauaaagauuuauuggaacgcaaccacacucauucauuuauguauucuccauugcugcuuucaugcuucaguggcagagcuacauugugaauaguugcaacagagaccguauggccugcaaagccuaaaauauuuacuaucuggcccuuuauggaaaaaauuuaccagcaccugcuauaguguaugaaaacaauauuucuuauuuguacaauguuuaaaaacccuucuuuguuuuuauguguguuaaauucaguacuaccaaugagagcuuuaccuauaacacaagcuuggcucaggcucuuaacaaauuucauaaugcaaauuaugaaaagagugccaaaguuuaaaaauccacauugaaagacuuguaaugaauugaauuauaauaagaggcaccauacuguagaaacucagcacucuuuggcagggagugaaacuugcuagaagacauaucuuggcuuagccaaagaguuagccaaacauacuauuuacugaaguacaaaagaaaauuuuauagcagacucaguuccauagaugaaaugauagcacaaugacuagcauuuaguguauuuaaaauacugacaagucaaacaucuauuuuucuaccagguacuuugcugguuauuuauaacuugaagcuucugcuuaauggagaaccagaguuggauguuaaaacugacaaagaagauauacugauggcuggagcucuggaggaguauguguguguuugacagaauguuuuucaacaaugguggugagcuagaguuaggagcccugcauccuggcuccaggucugaggucacuggguuuuagcacugggacaauucaucuuacccuaguuacuaguaaaguugggcuaggucagugguuuccaaacuuuaagcuucagagugcccugggauguuucuugagaaguacagggucuggggccucaucuugaccugcugagucagaauguccagauaccaagccuaggaaucagucuuuuucaaauguuccccagaugauucagaggugccagcauauuuagggaccacuggaauauaagacuucuaaagcuuucuaauaccuugacuccuaauuuguagauauuaaaacugaaaaaaaccugcagaguuuauuauucauuacagaucauuaaaaauggacagacauuaggauagugugaagcaaaaaggaauaugaccaaguggcaauuuaaucauuauuuucugcaugaaaaagcguggagaaagaaugaaauagcaacaaaagcuagguuucucuaaaauaacaguguuacuuacaacuuagcucgagccugcaguuuuuuagucucagaauacuacagcuagaagagauuguaaagguaauuuaauccagugcgauuuauuuuguauuucaguguuguacaauagaaauauaaugagagccacaacgagggacauauuuaaucuuaaauuuucuaguagccauguuaagaaaaguaaaaagaauaggugaaauuaauuuuaauaaugauuuuauuuaauccaauauaucuaaaauauugucauuuaaauuucaauaugaaaaauauugaugauauuuuguauuuuuuuuuaaauccaaagucuuugaauccaguguguguguugcaacauacagcacauaugaauuuggacuaaugcccaauagccacagguggccaguagcuaccauauguuuuuagacuaagguguuaagacccaaguagacaugucagguuacagagaacuucuuuugcuuuucccaaugaggugaaauuuagaaauuucuuuccacaguuagcaaauagcuauuugauaacacacuuuuagauuaccuucucuccuuauugcuguuguauguuuuuucucguauuccaacauguagaauuccuaauauacacauaaauggagggauuuuuuuucuuuuggaaaaaaauauucagccuaauggcuguuccacaaaugcugggaaccacugugccagcauuaauaugccggugucagaaaggagucccagaauuuucagcaucucuauuacuaucuuccccuuuuccugcugccucugcccuucuaguugccagcugguuccaaaaccgauauuucaugcuauuuaaaagcauuuugaaacaguuaucugucagagugccuuggcauuucuacacuggcauuagaaaacaauacauuguuagagggauaauuugacagcuacaucuuuggaaagauguucuugcuguuuccagauuguguaaugaagccagagcuucucuagccauuuaggcaguuaauuacaaaauaaagaaaaugaaucagaccuaaaacauguacacuuucacuuuggcacauagaucacacuggauuuucuaauuuguuuuucagcaaaaauuuuuuuuuaguuuaaucacaagaaaagccuuuaaagacagggcuaggauuuuauaaggaggaaucacuguaaagaggauucauaguuucugaacugaggacgcgauauauuucauggccucugacacgaguacugugauggugccaagaagggauaguaucaccaccuccucggggguagcagugccucuguaguuuuuuucuguaaaagauuugcccuuaauuccacuucauuguugauuuugaccuacugucuccuccccaucacucccaagcucccuuuaaacuuagaacauacuuuuuauuuauuuauuuauuuauuuauuuauuuauuuuuuuagauggagucucacccuguugcccaggcuggagugcaguggugccaucuuggcucacugcaaccucugccuccuggguucaagcgauucucaucccucagccucccaaguagcugggauuacaggcaugugccacccugcccggcuaauuuuuuguauuuuuaguagagacgggguuucaccauguuggccaggcuggucuugaacuccugacuucaggugaucuacucccccagccugccaaagugcugggauuacaggcaugagccaccgcaccuggccaacauacauguauuuuuaacuuguuaaaaaaugguacauaguuuaccacacaagguuauggauaaugguguggucccauggguucuaacauuaauauccaauuacucuucaguaagagacuagaaaagacauaaauucuuaguccuaaaggauuaguucugguccaaggugggucuuuuuucugaguccucuuucauuuauggcuucugauauuugaaccucuaaucuggugcaguuuauaauauaacacauuuuuuaccauuucuuuuccuggugauuauuguauccccuuaucucuacuggguaggauuguacagcuguccaaaacaauuuucaaaucuugaaacuauguaauuuucagguuuggucuuagauauuagaguccugcugauucugaaaauaauuuaauuuucuguguaggaaugugaaaauucaaacuuucaagccguauuggccucagggaagagguguuuuggcauuauuuauuucacauaguccuugugaacauuugacaucguguuuuuuuuuuuuuuuuuuuuuugagacggaguuuugcucuuguugcccaggcuggaguucaguggugcagucucggcucacugcaacuucugccuccuggguucaaaugauucucccaccccagccucccaaguagcugggauuacaagcaugugccacuacuccaggcuaauuguuuuguauuuuuaguagagaugggguuucaccauguugguuaggcuggucuugaacuccuaaccucaggugauccacccaccucggccucccaaagugcugggauuacaggugugagucacugcgcccggcuuugacaacaguuuuaaacauaggauucaaaaccuuuuaucauucugcuuugggcugaggcacuaacagcaguaaucagaccaguggcaggguuuucuuucaagaugacaaucacgucaagagaauuucaguagaagugauguucaagcacaugaacagugguggccugugguuuggcaauaucaguuuaaaggugaccuguuuccacuuaaauuaaaaaaaauuuuuccaauagauagcagucaucagaauuucagaaugcacaugauacacaagucugcauuuuaugugugaaauauuaaauugaauuuugaaauugugaauaugacuuacggagagugccagggaaucauacauagguuccagggcuauaugcagaaagugaguugaauuugcaggguaaaaauuaucuuaaauuuauaugucgccguaaacuuaggcaguguuuucugaaagggaagaagauacaaaaaauaacuuuguaaaaaaucaaaagaaaaucaagaguuugaaacaaaggguggggguaaugacaagaauacugaacagugaagaaaaugaaagugggcuaaugacagaaaacaagauguuucuucagggcugggcuagguguguuuacuaauuuauguugugguaauuuuuuggaacucuggacccaaaucccacaucucaaacuuuuguagauguuuucuuccauuaaaucgcauuuuuuucucuuuaaauaguccauuugugcaaaacaaaauccuuaguuaauucuuucccucuaucuuauugguggcuuuuaguaagcuucauuuacagucauacagaugauuaaaguuuagagucauuuucagaaguccuuuauugaguggguacagaaguuaacaggcuaguggagaguuuuaaaaugaaucacugcccaucaugaccuccuaugugguuaguauggauucucaucugugaaaucuguaggacuguaauucuacuuuggcauuccuuacauagagaucuuauuucauucauaggacauagaccucuuuauguggauaccaggauggaaucuuaauauggauuuuaaaauuacauguaagauaugccacugaauuggaucuaagcauuacuuuucuuuuagacuuuuauuuuagguucagggguacacauguagguuuguuauguagguaaacucaugucacagagguuuguuuuacagauuauuucaucacucagguauuaagcccaauagccaacaguuaccuuuucugcuccuuucccuccucccacccuccaugcucaagaccccagugucuauuguuuccuucaguguguccauguguucucauuauuuagcuugcacuuguaagugagaaccugcaguauuuaguuuucuguuccuguguuaguuugcuaaaaauaacagccuccagcucuauccauauuccugcaaaagacaugaucucguucuuuuauauggcagcauaguauuccaugguauauguaccacauuuucuuuauccaaucugucauuuauggacauuuagguuccauaucuuugcuauugugauauaguaaauagugcuacagugagcauuugcaugcaugugucuucaugacagaaugcuuuauauuauucuggguauauacccaguaaugggguuccuggguugaacgguaguucuacuuuuuagcucuuugaggaauugccauaguacuuuccacaaugguugaacuaguacacucccacuaacaguguauaaguauucccuuuucucugcagccucuccaacauuuguaauuuuucaacauuuuaauaauugccauucugacuggugugagaugguagguuuugauuugcauuucucuaaugaucagugauauugagguuuuuuaaauaugcuuguuggcuguauguauguuuucuuuugaaaaauaucuguucauguccuuugcccauuuuuuaauggguuguuucuuuuucucuuguaaguuuagguuucuuacagaugcucgauauuagaccuuugucagaugcauaguuugcaaauacuuucucccauccuguagguugucuguuuacuuuguugauaguuucuuuugcugugcagaaacucuuaaguuuaauuagaucccacuugucaauuuuugcuuuuguuguaauagcuuuugguaucuugucaugaaaucugugccuguuccuauguccaggaugguauuaccuagguugucuuccaggguuuuuauaguuuuggguuuuacauuuaagucuuuaauucguccugaguuaauuuuuguaugugguauaaggaaggggucccgcuucaaucuucugcauauggcuagccaguuaucccagcaccauuuauugaagagggagucuuuucccauugcuucuuuuugucagcuuuguugaugaucagaugguuguaggugugcagccuuauuucugggcucucuuuucuguuucauugaucuaugugucuguuuuuguaccaguaccaugcuguuuugguuacuguaccccuuuaguauaauuugaagucggguaauguggugccuccagcuuuguucuuuuugcuuaggauugcuuuggcuagucaggcucuuuuuuugguucuguaugaauuuuaagauaauuuuuucuaguucugugaagaaugucauugguaguuugacaggaauagcauugaaucuguaaauugcuuugggcaguaaggucauuuuaaugauauugauucuuccuauacaggagcaugugauguuuuuccauuuguuugugucuucucugauuuauuugagcaguguuuuguaauucuccuuguggaaaucuuucaccucccuguuuaggcauauuucuagguauuuuauucuuuuuguggcaauugugaaugagauugccuuccugauuuggcucuuggcuuggcuguuguuaauguauaggaauauuagugacuuuuguacauugauuuuguaucuguaacuuugcuaaaguuguuuauuagccgaaggagcuuuugggcugagacuaugggguuuucuagauauagagucaugucguuugcaaacacacguagucuggcuuccucucuuccuauuuggaugccuuuuauuucuuucucuugccugauugccaagcaauaguuuucuuuacuucucauauaccucacucucccuuguuugccaggugguucagcaccuguucaagaggcauuaauuuggggggcagaggauggagugggaaugaagggaggagcuucaauuaguauuacaaauauuaacucauugaaaaauauuuaaacuuucauaaacagguaaagcaauguaaaagugcguccucauuuuccaccucagcucccccagucucucuucuacuguagaaauuauuuugcuacuugggauuuaaaucuaucuucuagauauuuauuaucugucacuuuauauuagauauaacuuaccauuuuuaaaauuuugaaauaauuugacuuuucaaaguuuuaaagauaauacagaaaauucccauguaucuuucauccagauuucccaaauguugauauuuuaccaacaucugaaaaauuagaaauuugaaacaugccugucccaagcauuucagauaagggaugguccaccuguacaucaguacuucucuguuggugggcauucagguugauuuuaauuuuucacuuuugggaacaaugucagucuuuauacuuaaauuguuagacauuuagacaaguauuuauuuacuguugauucucagaaauacuauuacuggguuaagugguuguaauuuccucaaugguggcguuuugcgaaaccaagguacaauaugauaaccaggacgcgaaccagggcaugaacacaauccaucagguuugauagaaauccaccaaugcaucucuacaaauauccccuauauuacccuuuauaauuauacacacuuccuccuuucuccaucaacucgacuuaaaaaaauaacuuuaaaagaguauauugguaaauaauagauauacauauuuucaggguauaugauacauucauauaauuuguaaaguuaaaauagagguaauugggauauucauccccuuaaauauuucuuuucuuuaugcuacaaacauucuaauuauucucuucuagcuauuuugaauuguaccacagaugauuguuaacuauaguuacccuauugaucuguugaacaguaggucuuauuucuucuauuuaacuguauauuucaucccauuaaaucaaccuuucuucauccccauccuauuaccuugccucugguaacuaccauucuacucucuaucuuaaugagauucacuuuuuaagcuccuacauaugaaugagaacauguuauauuagucauucugugcuuggcuuauuucacuuaacguaaugaccuccaauuucauccauguugcuacagugacaggauuucauacuuuuuuauggcugaguaguauucuguuguguauauguacaacauuucuuuaugcauucauccacuaugggcacuuagguugauuccguauuuuggcuauguugaauagugcugcaguaaacaugggaauacagauaucucuuugauagauucaguuucuuuccaguaauggaauugcuggaucauauaguaguucuauuuuuaguuuuuugaggagccuucauacuauucuccaaaauggcuguacuaauuuacauuccuaccaacagcauccgaggguuccccuuucuccacauccucaccaguauccauuauucccugucuuuggauaaaagccauuuuaauuggggugagaugauaucucauugugguuuugguuuacauuucugugaugauuagugauguugagcauuuuuccauauaccuuuggcuauuuguauguugucuuuugagaaaugucuauucgggucuuuugcccauuuuaaaauaagauuauuugguauuuugccauugaguuguuugagcuucuuauauauucuggauauuaaucuucugucagguggauaguuugcaaauauuuucuccuauucugcagguugucucaucacuuuguugacuaucuucuuugcuuugcagaaacuuuuuagcuugauguaaugccauuugucuauuuuuguuuuaauuaccuuugcuuuugaguucuuacacacacacagacacauacacagacagacacacacacacagacacauacacagauagacacacacacacagacacauacacagacagacagacagauagacacagacacaccccuuugcccagaucaauuuccuggagaguuuccccaauguuuucuagcuagcuuucuaguaguuucauaguuuuuggucuuacauuuaagucuuuaauucacuuugauuugauguuuguauaugaugagagauaggggucuaguuucauucuucugcauauguauauucaauuuuccccgcaccguuuguugaggaaacuguccuuuccccuuugcacauuuuugauggcuuugucaaaaaugaguuggcuauaaauguguggauuuauaucuggguugugucuucuucuguuccauuguucugugucuguuuuugugccaguaccaugcugauuugguuacuauaauuucguaguguauuuuggagucauguagugugauguucuuugguuuuuuuugaucaggauugcuuuggcuauucagugucuucugugguuccauauaaauuuuaggauuguucuucuauuucugugaagaauaccacugguauuuugauauucuauugaauguguaaauugcuuugggugguauuuaauauuuaacaacauuaauucuuccaauucaugagugaggaauaucuccauuauguuucaaauucucuucaguuucuuucauaaguauuuuauaauuuucuuuguauagaucuuucacuucuuuggcuaaauugacuucuagguguuuuauauucuuuguagcuauuauaaaugggauugcuuucuugauuucuuuuuuagauuguuugcugguggcauauagaaaugcuacuaauuguaugcagcuuuuguauucugccacuuuacugaauuaauuuaucaguucuaacaguuugcugguggugucuuuaguuuuuuguaaauauaaggucacaucauucugaaacaaggcuaauuugacuucuuucuuucugguuugaaugccccauauuucuuucucuuggcuaauugcuaugaccagaacuuucaguauuaugaauaaaaguggugacagugggugucccugucuuauuucagaucuuagaggaaaggcuuucaauuucuccucauucaguauaauguuaacuauguguuuaucauacauaguuuuuauuauuuugagguauauuacuucuuuacacaguuuauuaaggguuuuuaucauaaagggauguggaauuuucuugaaugauuuuucaucaucaauugaaaugauccuaggguuuucuccuugauucuguuaaugugauguuucacguuuauuuauuugcauauguucaagcauccuuccaucccugggaugaaucucauuugauaaagaugaaugaucuuuuuaauguguugaugaauucgauuugcuuguauuuuauugaggauuuuuacaucuguguucgucagugacauuggccuguaguuuuccuuuuugguuguauuugucugguuuugguaucagggcaaugcuggccuuguggaaugaguuugaaagaauuccuuccucuucaguuuuuuugaagaguuugaguagaauugguauuaguucuucuuuaaauguuugguacaauucagcagugaagacaucagguccugggauuuucuuugaugggcaccuucuuauuacaggcgugagccacugcgcccagcacuauauuacuaucucuuaacagguugcuguagauauuauuguuuuugauagauuugucuuuuggguuucauacuagcauaaugaguagauuguacaccacaauuauaguauucuggguuuguucauguaauuaauuuuaccaguggaucuuguaucucgaaaagguuuuuuuuuuucuuuaccuuaguauuuuguuuuuuucagauugaaaaaauacuuuuagcauuucuuguaagaugggucugguggugaugaauuuuguuugucuaggaaaugcuguaucugucuuuuauauuugaaggauagcuuugcuggaugcaguguucuugaauagcagcauuuuuuucagcacuuugaaaauauuguuucacugucuacuguccuguaugauuuccauugaaaaguauauugcuagacgaauuggagcuccuuuauguguuacuugcuucuuuccucuugcugcuuuuaggauucucucuuugucuuugacuguugagaguuugauucuuauaugcauugggguagucuuauuuggguuggaucuguuugguauuuucugagcuuccauaccuggauauuggucucuuucucaaguuugggaaaauuuucuguuauuauuucuuugaguaagcuuucuaacccuugcucuugcuuuauucccucuugaacaccaguaauucuuagauuggucuuucgagguaauuuucuguaucuuguaggcaucuuuguuucuuucauuuuuuuuuacuuuuugcuccucuguguauuuucaaauaaccuaucuuugagcucacagauuauuuccucuacuugaucuauucuguugugcagagccuugaaugaauuuuuuaguucaguaaguauauuucucaguuccaagauuuguuugauuuuuaaguuauuucaaucacuuuauuaaauuucuuuaauuacugaauuacuuuuuuguguuacuuuggagaccacugaguuuccuuaaaacuauuauuuuuaauucuuuauccgagagcucacauauugcuuuuucacuagggucagucacugauuccuugcuuuguuugggcagguccugcuucucuguuugcuguuguuucuuguggauguacaucuaugucuuugcacugaaggauuaaugaccucucccagucuucucugucugguuuuuguuuuguuuuguuuucacuggguauguuugcuugaagauuauucguaauuuaccuggugguuuuuuuuuuuuuaaauuuuucuccuagguugcugccuucuuuucggcacuagguggugcuauaacccagguuggccuuggcucuaguaaaucaucagagcacugcccuguccuaaauagggaaaguccuaagggggauuccccagcagugugggaagguuggcuggggguuugugcccaagggaccuguggaacauacuuccugcagugugaugcugcugaacggccacuugauuugucugaguuaccuagcacaguuuccagggcugaggacaguaguuuccuacuguccucaaggacguuucucccuccagacacuugugaggcuucucguggauugaagcagggacagaucuccugcuggggaacccaggauaguggggaagcugguuguucaccuugcucucacuuuuucugguauagaaacugugagucaggaggaaauuuucugcauauuagaagaugggcagauugggggaaagaucaucauggguaugaaaguucaauucuuggcugggcgcaguggcucacgccuguaaucccagcacuuugggaggccgaggcaggcagaucacgaggucaggaguucgagaccagccuggccaacauacugaaacccugucucuaguaaauauacaaaacuuagcugggugugguggcacaugccuguaguccuagcuauucagaggcugaggugggagaaucacuugaaccugggagguggagguugcagugagccaagaccgugccacugcacuccagcuugggugacagagugagacucugucucaaaaaaaaaaaaaaaaaaaaguuuaauucuuguaccaucugcuaagaauuuuuucauuucacuaugcucuggaaacuuucccauccugauauuugaguucugugguauugcugguauuaauuuuggcacugucuauuuguuuuugguuuucuguuguggggaaugugaagccagcuugcuucuacuucugcaccaccauuuuggaagcagaagucucucaaucugacuuucagcauuguuauuugucuuauaaaauuuuucaauuuuuuugagcuuguaucugucaacauuuuucuuuguuuuucuuauuuuguaauuuucagcucaaaaaugcuuuccuuaaccaugauuuagauguauucucuuauaauuuacucuaagaaucuuaguuuauuucuuuauagucuuuuaaucuaucuugauuguuuuugaauauggugcaaaguguguguacauggagggugaaggauuaauuuaauauuguucuaauaaaucuauauuuaugaaauaguucagccuuuuccacuuaugugaaauaaaucaguacuauaaacuaaauuuuuaucauacaugguucuguuucuggaugaacuauuccuuuucauugauauauuuuucacuuccugccccauuagaacuuaauugcuacagccuuuauaauguauuuuaauauuuagaagggcaaauaccaagccuuucuuucacuguucuuuuaaaaaucauuauuugcuauucuugcaaauauucuuuuuuuaucugaauuuuaaaaaucagcuuuucaaguuuuauuauaaaaugcucuugggauuuugauugguaguuccuugaauuuauaauuaaaugggagagaacuggcacacuuauacguugguucuuauuccaaucuucuuuuauauaauugaauggaguuuuauaacaucauaauauaucauaguaauuaaauacaggaguuugaaggacugucuggguucaguuuauaguucuauaagcuguauuauuauggugauaguuuggcuguguccccacccagaucucaucuugaaaucccauauguugugggaggaaccuggugggagguaauugaaucaugggggcaagucuuugcugugguguucuugugauaguaaguccaacaagaugugaugguuuuaaaaagaggaauuccccugcauaaacucucucucucuuuaccugcugccauccauguaagacgugacuugcuccuccuugccuucugccaugauugugaggcuuccccagccauguggaacuguaaguccaauuaaaccucuuucuuuuguaaauugcccagucucagguaugucuuuaucagcagugugaaaauggacuaauacaugauaugggaaaggaauuuagccucacaggaccucaguuuauuuaucugaaaauaauguugauaaaaauaauaguauuauauccagggguuguugagaagauuaagugauuuaugacaugaaaagugcuuaggacacuaccugacacauaauauguacucagugauuguuagcuguuauuacuucuucauauaguucuaguauauuucuuguuagguauauuuuuggguauuuuaugacucuucuugguauucauauaagauuuuuuuccuccguugcuuuucuaauuauucauuuguuaaaaaccauugauguuugccuguugauuuuauaucugaccacuuacugaacucuuuuauucuaauaguuuucauuagauuuucuguauagucuuaucaucugcaaauaaggacagcuuugugauuuugugucuucuguugcucauccuuuuucuuuuuucuuaauuuaguuggcuaguuaaauagaagugguaauaguagguaugcuucuuugcuuuguuuuugucuuaauggcauuuuuuauguuugacuauuauaugugauauuuauucuaguuacuauucuuuuuaaucaauggcuuuugugaaauugagaaauguauuuucaguuuauagaguacauuuuguuuuauuuauuuuuuugugugaggaaaugugauucuuauucuuuucugcauaauagcuguauucuacagguuucaauuuuaaugcuuuuugacaucuguugaagugauuuaguuuuguuuuucuccuuuaaaguaguguuuuauuaugagagaguuuaugauguugagugaucuuugcauuccucagauaaacccaacaagaucaugauguauuauucuuuuacaugacuguguucauuuuguugauccuuuaaauuuuuugcuuuuauguuugcacaugagacuggcuguaacugugcuuuuauuaucauuuccuuauuuaguauugauugguauauagauuaugguagccucauagaaugaguugggaauuucuucccccauuucuauuauuuggaagaguuuacguaaagugagucuuuugucugcccauagauuuuuuagaacuuccuugaaaaucugguugccuuauuacuuuauuucuuuuauuacuuuuuaauggugcuaagacuguuauucuauucagauuuuggaauuuuggggcuuaaauuugucauuuauaauuucuuauaaaaacauucauuuuauuuauauuuuccaguuuguugacauggaguuuuuauaaaauuuauguuuuccucugauagauuuuguucacuuuuucuucuuauaucauguauucucccaucucucuuucuuggccaaagaaauuuauuucaauugacuuuaaaaauaaaacaguuuuggauuuuuaaaauuaagucugcugggauuacuuuuauuuuacauuucuuuauuuucuuauaucuuuuuuggauuuguuuauuuuucuuuuucuacuuccuugagguauguguuuuauucauugacuuuaaauuucauuuucuaaucuaaacaauaagguucuuauuucuccucugcguuauauaauagcuguauucuacagguuucaaaauauagaacucuuacuguuguuuauuucuaaauagcuuauaauuuuauuuugauuuccucuuauucaagaguugcuuuuuaaaaauguuuuaaaucuacuagugcauauguuugcuuuuuggagagaggagucagauaucuuuuuauuguugcucuaauuguaugguggucagagaaucuagccuguauuauaucugcucuuugaaaucuguucagauuuucuuaugggcuuaugucuuaaacauuuuuuuaaaagugaaucucugauaaggacagagcucuauccauuucauuugcauacauauuuuaauuaaguauucaaaucuuccaugucuuuuuuucuucuucauugcucgguuucugagagcaguauguuagaaucuucuacaauauuuauugcuauguacauacauuuuguauuucuacuaguuuuuguuaucuauuugucugagucauuagauugugacuuauguguaaucuuaagugaagcucuuauuaauacauaaugcccgucugugucuguuauuucccccacuucguuucuuuuuugucuaauauuaaucucucuagacuugcuuuuucuugguuaacauuuuccuacuguguauuuugccaccacuuucuuuccagcagugauauuuugauuuugauuugucuguuacaaacagcauauaacuagauuuuuuuuuugcuuauucuaacugcuucugucuuuuagcuaauucacacuuacugugacaucugcuauggcuggacuugcucugccugcuuauacguuguauuugccuugcuucuuuuguuguuauuugagcuuucuuauuuuuuaauuuauuuuauucugcuuuauuuuuucucuccccacuuuuugauaauaauugaguugugguuuuuuucccaaaaggaaaaguuuauuuuuuuucuauucuaaugauuugcaaauuaguugcuccauuauauacuuucaguggauuaguuuuacauuuuuaauaaacaugucuaaacuuaugauuuuauuuucaaacuguagaguuaauuaguauguauuucauuucacaaauaagauauggucuuaguauguauuuaucuuucuuccuuuccaguuccaccuuuuaaaauuauuuuuuguaggauuuuaauuacacauuuuuauuacaucagacaugaacaauuauuuagacuaaauuagaagauuuguuuuuuguguguuuguuuacuacuauaucuuccauccuguaucuucuuucuuggauuuauuagucaauuugcuuuauuauaucccgaaaugauucuuucagagucuguuggaagcuuuguaucucuacaagugucuuuauuuuucccuuccacuucaauauuuguuuaaaugguuauagaaauauugguucaaaaauaguuucccuuagaacuauuugcuucuuugacuucuugaauacauguuguugaucagaagucugauagaaaugugauuaccaaauuauuguaaauuacuuauuuuuuuccucuggagaacuuucaggauuuucucuuaacuuuuuuuuuuuuuuuaauacuuuaaguucugggauacaugugcagaacuugcagguuuguuacauagguauacacaugccauggugguuugcugcacccaucaaccugucaucuacauuagguauuucuccuaaugcuaucccuccccuaguccccgaucccccgccaggcccuggugugugauguuccccucccuguguccaugcguucucauuguccagcucccacuuaugagugagaacaugugguauuugguuuucuguuucuguguuaguuugcugaggaugaugguuuccagcuucauccaugucccugcaaaggacaugaacucauccuuucuuauggcugcauaguauuccaugguguauaugugccacauuuucuuuauccagucugucauugauaagcaucuggguuuguuccaagucuuugcuauugugaauagugcugcaauaaacauacgugugcacgugucuuuauaguaguauaauuuauaauuauuuggguguauacccaguaaugggauugcugggucaaaugguauuucugguucuagauucuugaggaauugccacacugucuuccacaaugguugaacuaauuuacagucucaccaacaguguaaaaguguuccuauuucuccccauccucuccaguaucuguuuccugacuuuuuaaugauugccauucuaccuggcgugagaugguaucucuuugugguuuugauuugcauuucucuaaugaccagugaugaugagcuuuuuuucauacguuuguuggccacauaaaugucuucuuuugagaagugucuguucauaucuuuugcccacuuuuugaugggguuguuuuuuucuaguaaauuuguuucaguuccuuguagauucuggauaguagcccuuugucagauagauagauugcaaaaauuuccccccauucuguagguugccuguucacucugaugauaguuucuuuugcugugcagaaacucuuuaguuuaauuagaucccauuugucaauuuuggcuuuugucgccauugcuuuugguguuuucauuccaugcucauggauaggaagaaucaauaucaugaaaauggccauacugcccaauguaauuuauagauucaaugcuauccccaucaagcuaccauugacuuucuucacagaauaaaaaaaaaacuauuuuaaauuccauauggaaccaaaaaaagagcccauauagccaagacaauccuaggcaaaaagaacaauggaggcaucaugcuaccugacuucaaacuauacuacaaggcuacaguaaccaaaacagcaugguacugguaccaaaacagauauauagaccaguggaacagaacagaggccucaggaauaaugucacacaucuacaaccaucugaucuuugacaaaccugacaaaaacaggcaauguggaaaggauucccuauuuaauaaaugauguugggaaaauuggcuagccauaugcggaaaacugaaacuggaccccuuucuuacaccuuauauaaaaauuaagauggauuaaagacuuaaacauaagaccuaaagccauaaaaacucuagaggaaaaccuaggcaauaccauucaggacguaggcaugggcaaauauuuucucuuaacuuuuaauaauucccauugugugucugucagugggucauauaguuuucuuauucuucacacuauuaauagucuuccuugaauuucagcaggagaauaauauguauucuuagucuacuagccugauucuguaaaugucuucauuuuuccaaaaggauauucuuuuacauaauggcaugaucuaucagcagagacauuagguguaauugaauggcugggagauauugauugucuacugccauaugacuuauuuuguacagugacguauguauagaacuagaaaacauggacaucagaucuuugaauucaguucuguaggagcaaauugaagagaccagaacucuagguugauaugccaucgagugacuugaguucuguugggagagcuuuaauucuaguggcaaguuaucuucagucuccaaaauucucuguucccaucuauaaaauaaggcuauaacaucaucuacuucauauggaagcuguuuaaauagaacaggcacaguaccaggcaaauggaaaaucucuguacauuuuaguaauccccacaauuccccucauucuacuuuuuccuacaacaccucuuucuagcuuacuaucaugcuguggaaaguaagucagugucugguacauagcaaauaaaaaaugaauuacauucaaguaaauugauuugaaugucaaugucuagauaauuuucuaaggacaugacaaaugcuuucacuguaagguguuuagacucucgaugucaguuccauuguccuucauccuuaaagaucauuggagaucuucauuagggugagagagggaauuuaaaagauuuuguaaaguacuucuguuaccuuugaaaucucuuucaaguuccaaacugugaaggccagaucaccccuuauaucaucuuucuugauuccuuuuuuggaggugaggaccauguguccauuucaccuugucucuuuuucauauuauuuuugugugcucauguugcuuucagugacuuaacuaucuucaaaacauuacaaauauuaaucacucaacuuuguaagaaacuagaaaaaagcacagccccuaguaaaaaaggcaugccaugcaauuggcugucaucaaaggggcuugccacaucccugaaauccgccauggcucgggaucgaucucaggcagcuagaaaaacccauccaaaaaacagcucugagagugaugauauaauacagaguaaugcaguugaaauuuugugcuaaguaauguuuuaaaauuaggugccacguugccagcauguuucuaaauugacagucauugggcagcauuccaugucucuacuuuuuaugucuuaacugagcugcccaggaacacaucaaaaguuauagcuucaaauuguucuaaugugcugcuugccauacugugguugucacaaaagaaacacuuucauuacuuuguguagcuuauaacuuuuuuaaaaaaauuaccucuucgaguugacauuucucauagguuuaaucuacccuaauauuaaauuugguuacccccuucaaaguucagaauuuaaacuaguuaaaaaucuuuaugcacuuguuuauauucaagauaauacaaacccuguuaauuucaacuucaaaaagucuucagagauuuuguaaggacuugaguaauuuagaaaacaauuuugguuauguaauauuuucacgaauaaaaauauggcacuucugagauauugcaaaagggaccuaauguagucugcaguuuagagucauuuucucaauccaggaaaaguagcccaguuguugggcuagaugggggucuguugucugugugcccagugugaauaauggaggaguuguauuucucagcucgugucuagguccaaacaccugugagagacuguucuccuccccucuuuguggcaaccugccuuacauacuacccuguccacuaggucagguaggcagugguguccaaucaaaguggcagaaucaaaggaaucaccuggguagcuuuaaaaaccucacguuuccagacuccagccacagagaaucugaaucagcagauaaggagcuauggccuuagccacagaacauuaguuucuggcuccuucacugcccuuaacacaguuugaugacugcaacacauugauccacccaugaugcauggcacauggagcagcauuuaaaacagcagcagaauacuguggacagauugggagaagcaagaggccacacagaaagcacagccacagguaggggcuaaauuagagacuguuaagaauacccagugcugagcaggggacaaaagcauugauucuacuccaugcccuccuauuauauccacagacuaugaagccaguuucugccuugaaauacucuccucuuuccccacaucuguccugugacuguguguguguguguguguauguguguguguguguguguguguguguguguugagggagauuguucugucucuuccuuucuucaguuucuuaucguagccaguuacauagaaaaugagagagaaagauagagauauggacacuucugacaaaguguaaggagacaggaaacaaagguauuuagaaggaaacaggaagaaauacucuugaagaauacauggaaacaguuccuggugaguguggaguaauaguauuuuuuccuuucaucuucugaagauauccugacgauuuagcauguuuuuaucucccuuuccuaaguggacggcuuuauuuguaaagagugguagcauugccauugaagauaauccgucauacauaaggaaccucuguuguuuauuccaaauuaagccagggaaguccugaaugauugucauuuauucaacauauuuuuauugaugagagcgcuagcuucauggaucucacagccaguuggggaugcagaugcauagacagaggaugacagcacugaguggcaggugccuugacggcgggaaguacagaaggaggggagcacaaaggagagcacuucaucucucucggggcugagggaaggcuucgaaaggaagugcaguuucaaguuguauaccgcagggugaaaaggggugcgccaagcaagaguggcugaagaacugaauaugccagccuuggggauaagaaagccugauugcauggcuggagaacugagaaugguccuaaauggccaggcugaagacaagagaugagacuggagaauuaagcgggggucagaccaugaaggaucuuaugcaucacauuaaaaaguuugacguuuauaaugacguggcccauuucacuuacagguuuuauauuuagcccucuuugccuucuuuuuauuaaaagcaucacaaauaagagguaguacccuucuuuuugucacaaauaaacaggaacuucuaaaaguaggcaugugagagaaaaggguuaacauagcaggugucuauucuuagaaaggcuugcuugcaaaauuggucuguggccagcuuuugggaacuugccugguaaacaguuuccuacaaugacauaaaaccuuuccuagcugauaacaguggcuugcugugucuagauaugcaaaccauauggcuuauaugcaaaccuccucuccuucugggacucuggaacuucgcuacaugcugggcugaaggugccuguguggcuagcuucccaauaaaaaccuuggaugcuaagucucuaauaagcuauccuagauggaaacaucacacacauguugcugcauuuuuauagcuuugagaaaauuaugcuguaugugaacuuucaugagaaggagagaauguaggaaagcuagcagacagauuccuccagacuccaccuauuuuuuuucccuugucagccacuguguguccucacugcagcacugugaugucgaaggcaugaguacaauugugugcuaaggcccaugaguccuuccagugaaucuccuaacauaggggagaccuugaagauccccaacaugcaugcuaugaauauuuaccuauaacuaguuacugaaugagugaauaaauugagcuauuaaaagguagaaguauuaguguucauguauauauauacacacauauauguguguguguauauauauguuuagcugguuuuaucucucaccauauuucucaaauucucaaaguuggcucugaauuacuuuugacuuuuuuaccuucaaaugauaaagacguaucaguuuugaagagagucagaagaaagagcuacaagagcaauuuaacaucaggagauccagaaaggauuuaaacaauggcaagcaucccaagguaacuucuuuccguuucuuuuaucaggugaggacauacuuaauugugcaguucuggguauacuaaaagcagccacauuauuguauuuguagugcaacacucgaauacagacagccuaucuuguuacauuaaaaaauacacuaguauuaauauuuagggaauaagagugauggacuagauacuaauauguaauuuauacugggaaaauucugcucaagacuuauuuaagagaauuuccuuuggaacaauuaagaugaauuccugacuuuuuaaugagcuucagauccugccugaaggaacuuaaaaccaaccaggcaauucuugaauuucuuauggcuucaucuucauuuucgaaaauuccuuggagcucugccugucuuacugaguuacuggcaauaauguuaaccuguugaguaguuccccuuuagacgggcuucacauuuuuuuuuuucccaucaucuuugucuuauucuggacugagauacaaguguaaaaaugauggguuuacugcuuucugcuuuccauuugaccuuguggaguagccuuuucugugaccgaguaguaaagagcaucgcuucuucagcauggcugggcuuguuguggaucuuuauuuccuaucuuauuggagaggauuuacaguucauaaacggacuuuaauauagaaguucccuggaguuauaaguauacaaugacauggcgauuucccaaaaugcagcuuuacaaggguaguuuucuucauaggcuauuuauguugguuuugcuuccguuuuauugccuuccgauucuuuauuuuucucuuuucuccuuuuucauuaucguguggucagaugcuuccccucagcuggccauaaauacuuauuuuaauacuuauugcacuuauggaaugaaguuuuauguuucuuguucauaauuuugaaagcaaaugaaacauuuuuacuguauuucucuguuuauaaggacuuaaugggaaugcuuuuuauucaugugagccuagauucuuuuuguuauguuugaacgagggauuguuuuguugauuugacuugacuuuguucuccuaggucaacagcuuuaauggaaaguauauuuuagauugcuguuauaagucuacuuagaauaaguugguugccaacaaaaguucaguuguaaccaaaguguagguuauuuguguugggccuuguguuuagaggccuccuuaaugaagugaguguugugauauuugcugguguuuguggugucauuaguuuuagaagaaaaguucuugaagcuucuuguaguaacaauaauaaccugauagucugauguuauuucuucucaaagagauguaguuguuguguccucuguauugugacauuuuguauuuucuauuucaguuucccagcgagguggucauucagagccuacacaucuguucuguauuuuaacccauggaugagaauauucauucaagccaagagaguuaaaacuaaacaucuuugcuauugccucuacagacccagguaacucaucuuucuucaguuaucuucacagaguuuuuauuuauaaaauugauaugcuccccaaaguugucaaagugaggacauugacuuugauaguaagauuuuuacauuguaaacaaaauuuaaaccacauccaggaagggaugcuaaagaguaauuggaugugaacaaauauuuggcaguaauagaaacauacugcagugagcaugcuaaguuagaucaucaccccgaguagaaauuuguuuuuuacuucagugaauuuuagguacuaugacagugauuaguuccacuaaaugaucacaguucacguauaucuucuguuuacacaauacauuugaacuauuaaaccauauauauacauauuuauauuauacauauagaaugaauauauuuauaaauauguaucugguugauuuauauuuuguguguuuuuuuacuuuaacauaaauguuuucaagguuuuguuguuguuguuuugagacagagucucucuugucacccaggcuggagugcaguggcacaaucuugguucagugcaaccucugccucccugguucaugugauucuccugucucagccuccccaguagcugggauuacaggcgugcaccaccacgccuggccaauuuuuguauuuuuagcagagaugagguuucaccauguugaccaggcuggucucaaacuccugaccucaacugauccaccugccuuggccucccaaagugcugggauugcaggcgugagccacugcacuuggccacccaccaggcccggccuuuaaguuuauauuuacauauuauaauauccauuuuuuccaaccaugcaugccaucagaauggucauuuucuugaugugguuucuggguagucuuucauuuacacaccaaacauuuaucagauuuuucugugaguuugagauuagaggaaaagaaguuauuugaagaagauacuugcacaugcauguuuauagcaccacaauucacaauggcaaaaucauggagccaacccaaaugcccaucagucaacagguggauaaagacacugugguauauauauauacacacaauggaaugcuacucagcaguaaaaaggaaugaauuaacagcauuugcaaugaccuagaugagauuggagacuauuauucuaagugaaguaacucaggaauggaaaaucaaauaucuuauguucucacugauaugugggagcuaagcuaugagaaugcaaaggcauaagaaugauacaauggacuuuggggacuugagggggaagagugggagaggggcaagggauaaaagacaacauauugugcaguguauacuguuugagugauagaugcaccaggaucucacagauuaccacuaaagaacuuccucauguaaccaaacaccaccuguaccccaauaacuuauggaaaaauagaaaaaagauaagauuaauucuuguuuugaggaccuugauaucuauugggagaaacauuuaauuuguguacacuacuuauauaugugccuuuuugccugaacuauuucauuugauuucugcaguaacacuguguguuagguuaucaucaccauuuuagagauaaggaaauguuaaaacuagaaaagaacucaaaccuucuggcucuaaauucuuuaccaauccaaauucaauguuucuucuccuauaccacauuaacucuuuauuauaugucugcauuugucaucuugucuuauuuucaugaaacugcaguuacuguccugaguagggccuugcuaucacucauaaagauauuaauacuaaaaauuauagaucucugcaucauacucccugaccacgcaccaauggauuucgcaaaagcuuuacuuuugaucucuaauuauacugcccaucaucuuuugaaaauaaaauauaccaauccugagacuuucccuauaaaucaguccauucauuuccuaauaaauaucaaagcaauguuuccuuuucaucagucucauucuucugggaagcgccaagugucuccuggaucaaucaauauagccgaucuuuucacauuaaauuucucucgugaguuuggguaaaaaauaguuuaaguccauggaaaauguggauuugucucuauuuucugagggaguuuuaguaaauugaguguaaucuaccuaaauuacuuauauccagugauggcugcuucccauucgaguauauugcaauggaagggacucccacccaagauguguacaaauuugucucuggaggagucuagaucauagaauaaauuauuacuuuggaaaaaauuucuaggugauuucucaggucucuuaaacauuuuauaagucuauaauucuuggagucuuaaaauauuguuuauauaauaaagacaaguuauuauaugguuguguuacuugauuuuaggcaacaaacauucuucauuaacauugcuuaaccauagacccauaaugcugaaaggagcccaaaugaguugggauggguguuacugugcauucauaggaaccgcaugguccuuuuuaaguuauucugggacauuaacgcuauguucucuuguugaauacucugcaacacuaugcuucugaaacagaauucauuauuuagggaugcuuuccauaugcuaacaccccacccaccuaucagacuaguaauuuuugaacagugauucuuuuguacaccaugcauccauuuuugaauuuuuacaaugcugaauuauuuaaucuuuuauuacaguaugauaauuggaagcgaaauguggauuagccaaaucuggauuugaauuuagguuuugucauuuacuaguuguggaccuuuggcaauuacuugagucuuacucuucuccacugugaauugggaauuccucugccacugagguuauuaugagggcuaaaauaaaacaguguuuuauguuaaacauaaaaacagcaagguuucugaaaaguuuguuaaccaauaguaguuguuauuauacaaaugcguaagagcaaguggauggaaugaccacuaugugcaaggcugucuuguaggcauuggacauuuggcaaaagcaaaaagagaaaauuccugggcugggugcaguggcucacgccuguaucccagcacucugggaggccgaggcaggcagaucaccugaggucaggaguuugagaccagccuggccaagaaggugaaaccccaucucuacuaaaaauacaaaaacauagccaggcgugguggcaugcaccuguaaucccagcuauuccagaggcugaggcaggagacucacuugaacccaggagguggagguugcagugaacugagaucaugccacugcacuccagccugggcgacugagugaaacucugucucagaaaaaaaaaaaaagaaaaaaagagaaaauuccugcucucauggagcuuacauucuagugggggaggaaaaacaacauguaaauuaaaauugaugauaaaauaucagguaauucuuuuuuuuaaauuucaacuuuuagauacaggagguacaugugcagguuuuuuacauggguauauugugugaugcugacguuugggguauggauccugucacccagcuaaugagcaugguacccaauagggaucauuucuacccaugcccccaucccugccucccucucccccgucuuguauuccccagugucuguuguucucauguuuauguccaugugugcucaguguguagcucccacuuauaaaugggacuaugagguacuuguuuuucuguuucuguguuaauuuacuuaagaugauggucuccacugcauuaugucacugcaaagaacauuauuuuauucuuuuuuauggcuguguagucuucuauaguguauauguaccacuuuuuaaaaaauccaauccaccauugaugggcaccuagaccaauuccaugucuuugcgauugugaauaaugugucaauaaacauaugagugugugugucuuuuggggcaaguuaguuccucuuaacaaaggccauugcauagguccaccugaguauuuucaugacauaauggcugacuucuaucagagugagcaauucaagagaagaaaguagaacuugcaacuuuuuagaacccaucuuuaaaagugacagaccaucacuuuugccaugccacagcucagccuagauuugaccaguguuggggugugggggcaccacacauaggcauuaauaccaggaggaaaaaaaacacaggagauaucuuggaugguggguagcacagugaguuaugcaauaauuuugugggaagaugguucuagaaggaggggacaguaagugcaaagacaggaaucaaaggcuagucuagcuagaacacagaaaacagaucgaaguagauugggcagaucagguaaggccugaaggaacaugacaagaagaaguggcuguauugagaauggaaugacuugagcagaggaguggcauuacuugaccuauguuuuuaaaagauuauucuagcuguugaguggagaauugauuucaugggacaagaagaaaggagggaaguugagguaggauagauacuauuacuguauucuaggagagaaaugagcuugaacucaggugguaauaguggaagggaugaaaagugucuggauuacagauauguugugaagguaaagccagcaagacuugccaguggauuggauaugggguggagagaaaaugaggaguccagaaggccuucugaguuuuuauccugaacaaaaucuucagaaugauagaggaggugcaaguguagagguuaggaggaaugguggcuggaguucucuucauaucauaguaggcacacuaaauuugggaggucuauucaacguccacaucucuaccuaucaauauuauacgaaccagaaaauuauugauccugccuaauuacauguuguaaagaauaauuaaggauuagaauuauuuuuacaauauaacuaaaccagguaaacucuuauaacuuaaauaauaaugauugaauacuccaaugcaguuaugauuuacaacugggggcuaauuuuuucuguguuaauaaaaguucagaacuguaguuuacuugaaguguguuuuuuuuucaacuuaaauuuuaaaauacuauauuugauuuuggccagaguauuuugaacaaauguuuuaagugugaaaauuaaagucaaugaaaguuuaaauuucugcaaguuguucugaucaaaccagucacccaaaaugcuguauuaagucaugcucuauacuucugcagcacaaagccuugaaagguacuuaguguuucuucauauuuuuauuucucuugauggagaaggguucuauuuuccucauaaaaauaguaaaauuaauaaaaauuuauacaauacagaauuagauaugggggaaaaaucaaauaaccaaaagccccuuuuaccaguugugauucauuaugugcuauagcaaucuauaauguuccccaaaggagaaucucuguuagaaguuuaauaaauaucuuuccagauuguuuucuauacauuauauauauguacacacgcaugcauacacacacagguuuuuuuaaacauaaaauuauguacaacuuauuuucucuuacaguuaaaucuuggagacuuugucauuguuaaauauauugcauagcacuaugauuuauuuaaguuuucuuauugauguacauuuaggguuuacagagcuuugaggauucucaaaccaaauauuauucuagaauuuuucucucuaugaugauuuaaaccaauguuuaaaagcccgguuccaggaauuuucuauaacaggugcacauacuuucaacuguauucagagaaccucagguucuguagagcuuuucucaccuaugcuuuguucucuuugaguuuauggauauauauauguauguauauuuuuuuccuuuauuguucuagagcaucuuugccaucacuaaaacaauggaccuugaaaacagguuucucuaucaguaaagcagaaaaugugcuuuuaguaauuuaaaaugauacaugaauguguguuucucagcaucgcaguuagagauaauuguuuugggacuaggagaaguaguuuauccagugucgaucauaaucugaguaagagggcuaugcauauuaaccagaaacuuugauaagggaacaacuucauagaauuuuuuaaagaaaauuauccuauuuuagaugucuaagugaacauuugugugggcagauuuucuuaucgcucucaugaaguuuccuuaaaaaaacaacauuucuaaguagugaaaggcaaggaaauucacuuagguauaaaguuugcuaauuuaccagcuggaugcaacucacucgaugaaucuuucuuaauaauuauguaucucuggagcauauagucuuacuaaagaauauugucuuauguauuuuaaaaugauaaucugacuugauuauguucuuuuuguuucuuuccagaaaguaucuuuaugucacaucuucuuuuaaaggagcauuuaaagaugaaguuaaaaaggcagaagaagcaguaaagauugguaugcgauuaccuguagccuacaucauuguuguucagucauucagcaaauguuaauugugcacuuauuuugagacauacauugcucuaggcauuguaggagcuacuacaauuaauuaaauguaguuucugucucuauggaacuucaaaacacauucuuuccaucucugaguuuguuuacucaugauauuaauuauuauuauaaguaugauccugaacacacuucaaacuagauugauauuuguuagaaaccuuguuugucugucugggcaugguggcucacaccuauaauucaagcacuuugggaggacaagaugggagaauuacuugaggccaagaguucaagaccagccugggcaacauagcgagacugugucucuauuuuaaaaaauaaaauaaacuaagaaacccugcuugucauagcacuguguuaggucauuuuagaucccugcacugcauccgcuuuaagaaggauguucucaaggcgggcggaucacgaggucaggagauugauaccauccuggcuaacacggugaaacccugucucuacuaaaaauacaaaaaguuagccgggugugguggugggcgccuguagucccagcuacucaggaggcugaggcaggagaauggcgugaaccugggagggggaguuugcagugagcugagaucgcgccacugcacuccagccugggugauagagcgagacucugucucaaaaaaaaaaaaaaaagaaggauguucuacauauucacuccuccuacugcaggaacaaaacucucuucccuaguaucugggagugaguaguagcucuauauccauauuuuguggauuuuaaagcauuuucugucagcuaaaaacucaugacuucugaauuuauauuuguauauuuauguccuguaaauugucauaccuaaaugaaaccccaauagaaggaaaauuuaacauguguaaaaguuauaagaggaacauaggguuuucucagaucauggucuguaugccuuuuucacuggucaugcuacauguauagaaaauacucacuuaaaauugcuugaaauaauuuugcuguguuauaacuauuuggcuucuacuuccagcugaauccauauugaaagaagcacaaaucaaaguaaaccagugugacagaaccucuuuaucuucugccaagguacgacauguaaagagaguagucuuauuaaauggcaaauugugucauuugcuuuuuccugugcauaguugucucuuaucaucuacuuccuaaacuuuuaagcacagauaagcucagaagauuaaguugauuuuaacucagguaaacagaauagaugaguucagagaaaggagaggaaacucagcaagucggggcaaggcugaggcagagagaaaagaugaacagaacauggggugaauuugaaaugguggggaacagcaucacaacccauuucuuuaaaauggaaaggaaaguaacaggagaaagggaaaaaauaaugaaaagccagcagaagaaaaaacuagccuaucgagucuccuugaaaauaucuauucaaauuagagcucccuguggaccuaaauaaauggggaaaggaaggaaaggucuaacaagcaauccuucuuucuagugcuaggaauuauauacuguaauuaugaauauuaauaagaaugcuuccagcuuacaaagcucuuuuauuaugaguuucuccacacaguucauaaacauucuuuguaauucuuaacaauaugcccaugaguaagauaaguuaaaaagaacuauuauuaauuauaaugcauugcaacuaagagaaaaagaauauugcuacaagacauguaaguuugcuaacuuuuaccaaaaauaugguaugaagcuuuaaaugauggugaaugauuaagcaacauauuuauuugcuuacauacaaagggauaaguaggaauauggagguaaaaugccuuacuucaccuucucuucauccucuucuacagacugaauauaugaauccuuucagugauuuugccauuugacuuuccaggaccaaggcugugucugauaaagaccuuucauaucuaagguccugaguaagggaugacaucaaagaguagcucgugguaaugccccaaaguuaauucuauccauggcuugccccaaauucucuuaguuuuuuuuuuucauuuuuuuuuaaauuaaggguaaaccuaucuuauuguuauugaucauugauuuuuaauaguuuaagcuuuuuaaaauuuuguuuuuaagaaaucauuucccuuugcuuuguauguuugagaguccagaaaaagacuaaugggucaggaccuugcuuccuuuuugccuucugcuguuucuucucccugccucuguucugugcucugggggcacugccaggcaggguggggaaguccuugaccaauuuguccuguugcucugaugcacucugguuucuuuaaggcagagaagagagcaaagcagaaugaccugaacuuuugacgucuuaaauucuuaugggaagaugaauuuuaaauggaauacuugccaaccauuuuccacuuucuuuuacuugaaauucagugaaaauaguguucauucaguaguaugccauacaucaaaagacauacccaccuuucaccucaggugaaugaagcauguuaagaggcuauucuuaugccugagaacaacaauaaugaauuauuccucuucugcuugguuagagggagcauaccagauuuagaguagugaaugaguugguauaucaaaucaaaaguuuaauaagaaagguaacugggcaugggguauccuauaaagggaaaguuugagaaauauuagagguauccagaauucgauaugaaggagauauuuucuguuggcuacuaacaaaauuucucaauuaucuuuuuuuuuuuuccugcaaaaacacuucguggucacauaauugagcauuuauuguucucacaaacaaaagucagagccuggguacacuaaauaacucacccaaguuuucauguaguuuuugucaaagccguugugucauuauagagaauaaacuuucuuucucuaaaaggcagagaggauaucuggauauguacaaaagagaauaguggguuaggauuugguuuaucuucuaaaguauuggaacugaauaauuuaucaaguauugagaaucuaugaugguagaauugcauuagguaaugugagcuauuguuacccuugaaacauuuggauaauaggauaauaucaacuugcuuuuuguuaauucaguggcauuauguucucucccaaccaaugcauuucuccaggauguauuacagagagcuuuggaagauguagaagcaaagcaaaagaaucuuaaagagaaacaaagguaagacacaagguuuucuguuugcaggaauccucuguacucuguuaaaacaaauucugguuucuaaguaggcagauuuagugguuauugugacaauuuuuuuucagcuugugacaucuuauaaucugaaaccuaauauagucaaguucccacaaccaagauaagcaauguaaaacauugauaaaguauauauuugcacguacacgugugucuacauaauguuaaaacuuccaaaaaaaaagugaaaaauuaguucagcauuuaauugggcuagaugaaaaugucuggaugaggaagugaaagugaacugcccggaggaacagcugauaacucacuuuccuucugugucauuugccauuuaaauucuggagaguugguuccaguuucuucccuuugucuaguagcuuaaaauuuaagauaggaaauaauguuucacgugaauguauugcuuauauaucgcuaaaaaugaaaauaggaaggauauguuaacaaaaccaaauauuuacauuuguaagaugaacuugcucuccaacucaaaugcugaagaaguuaaacuuaaaauaaucacugcugcccacauaagaucagacuuugaaagcugugauaccuuugugaaacuauuuuuaagggaaauaugauuaguucuuaacauuauuuuucgugaaccaugcacugacauucaaccauaacuuuccucaaaacuuaaauuuuaaauguaaauuuugcauuuaucaaaauaaauaaaugugaaauguuacuuaugcauuuacuagaaaaauguaaauaaaugucauagaaauuguaauuuaaaaacaaagcccucucuaaggucuuuagaaauaaaaaccuucuugaaacaaguucacuguaugagaugguucauacagugaaauguuugaaaagugaccaaucaacacuucauuaauaauaaugccaguugccaugaacuuguuuuaauggcaaaaugcuggguuuuuuuuaauagaagaauaucaguauauccuuuaauauuguagagugacuaugucguauccuguaauacccuauuuagguaucccuuauacagucaguacuuuuguugaauauccuuuugggaucucauuacugaguagugauuuuugagaaaaaguuugauuccuauauauuuaaccuuagauauacauguguuuaauaaauauauaguauauuaacucaugucuuauguucuauauauauauaucauauccacauggaaggacugauagaacuuuaucauuguucuuuaaugauagaugcauuuaauuaguccaauaaguauauuaugucaauuauaauagcacguggucauaagccugaaaacaaaaggccaaguuuguggagagaggggagcuacaggguaagugcaggagaauuauuuuuggugucauucuugauuggguaaagaaaauaaugauuguuauauaccuaaucuguuccaggcuuauauuuaacauuauuucuuuuaguucuuaugacaucacaaguggcuagguagguauuacucccauuuuucaaaugagacagaaaguuuaagaggcaccauccauggucacaugguuauuacaaagacaggcuuguauuugaaaccaggugugccucucacauccaggcauuuucauagcuuccagcagccucugauauuacagguguuuauaucauaacuccuuaccauagcuguuuuuaucacauuuugguauuucucaauuucuauuuuacacuuuuaauagaaaacucacacaaaacauaauauagaaggucagucagaaaaacaggagcucaucucuguugcccuuguaaacuugcuuuauuauaauaacuuauuuaccuuguauuuuggaaaggguuagagaggaagccagagaauaucuuuuggcacauuccaaucuauguaggauaucuggagacuugagaacaugcugaaauuuagaaaucacaucuacuguuagaaauaccuaaaauuuaaaauagccaagucaucauuuuguaaaaaaugcugcaauguaccuauacgacccguuaauauuucagaacucuuuuagcauuuucuaguucuuguaaauuuaaauuggcagauguguuuuugaaucaguaaauccuuuguuugacuggcauaguuacuggcaucacguuuaugcagaauacuuggcuauacagagacaacugagugugccuaccagguuuugcaaaauauuuggauauaugccuuugacguuaaccuucuaguuuaauuauuagcaguuuccuaaacuguguauguuuauuuaauaaacaacuuuuuaaacuuuuuaaauguaacucuagagaauuaaaaacagcaagaacgcucucccuguucuauggagugaacguagaaaaccgaagccaagcuggaauguucauuuacaguaauaaccguuugaucaaaaugcaugaaaaagugggcucacaguugaaacugaaguccuugugaguauguuuuugcuuucagagauauaagcagagaaagggauguuacaguaagauucugucuguggagugagaugagugacuaaucacaaugggagcaagugucauagucucuguucacccuuccuguugaagugcaggcauuaaucugccucauugauaguaucagugaaucugcaugcaugcucuaaggaaaaagcacacuuugggaaauuuuuuucaaugcauuuauugaacaacuugauguggggccauuccuugugccaccucuuugccauaaauuuuuaaugcuuuaccaauuuaaaaauaauacgagcuuauuaaauacauuuuagaagagaaggaaaagaaaaauccauagucuuguaaagcaacccuacauguaugaguucaugccaguuagcuucaugaucauauguuauuaaaacucucuagccuauuuggauuuuagcguaauacauucuugugcuuucccaauggucugaaacuucucaagcugcuuucaucaaugauguagaguccugaagagacgcacagaaaaggacagggucagacaagguaaucaugaccaauagaaugggucagggagcauuuacuaucuugcuuccucacucucaaggaauuagcaauucauucauuguuuauuuaacaagcaccuauagugcagcauuguaugccaggcacuauacuaagcucugcugauaaaugcuccuuuugcuaaggaauguauaguccagugaaaaggacaagcauauaaaugcauauuuuuuauauuguaugaaaauaacaagaaugaucuuauaaaaccuagauuauggcugggcucaguggcucacgccuguaaucccagcgcuuugggagcccgaggugggcggaucacgaggucaggagaucaagaccauccuggcuagcacggugaaaccccgucucuacuagaaauacagaaaauuagccaggugugguggcgggcaccuguggucucagcuacucgggaggcugaggcaggagaauggcaugaacccgggaggcagagcuugcagugagccaagauugugccacugcacuccagccugggugacagagcgagacucugucucaaaaaauaaauaaauaaauaaaaccuagauuaguuggauuucuugcuuaaaucccaguguacucagaauagaacugcuugccaugggcuuccaguuaucuggccucugauuggcugugggaccucacccccuacuaauacccuacccucucugcauuuccuguuucucagaccuccuaagcucacuucugcauugagaccuugggacaugccauuuccuuggccuugaaucuucuguucucagauuuucuuacugcuggcccuaacaugccauucagccaugagccuaaaguauucuccacaggaaggucuuccuugacugucuaauuaaaacugguccauuuccuuccccaccaccugucacucuucacauaucacagcaccugcauuauguuccucaccccacuuaucaccaucugaaaugaucuuguauauuuaucuguuuauuagcuucaugccugccacccuucgguaaaagagaaacuucaaagccagggggaaccuguauuucugguucucaccauauucuuaguuccuggaacagggcuuggugcugagcuugaaugaaugaaugaauguuauguuagaggugagcauccagugcaaaaagagcauuuaggaggggcaguagagcaaacuggagaagucaauuuaggccuucuagaagaaugaagcccaaauuuagacuuagagaaugaauagugaaaggaaagcaagguggaagagugaagugguaagaaaacacuauaggcagggaccccaaauugugaggcuuugacacaugugccgugcaaaaggcaguggggagcccuaaaggcuuagacagugguaugcucuuugccaaagcagguuaugucaccaaccagauuuccagugagauccucauggauaagccaacucugugauuccuucauagaauucacugagcaccccaaggaccucugcaaugaagaggagaaauccaaucuguuagaugaaaugcggagaaagaaagggguucucuggccacugucauuuagaagaucaugcccuuuauugcaguaaggcaccaugguuuuuaaugucaaaaggccuugccuucccacccacccucacucuccacguaaggcgauagauuuguaaaacgagucguauuaacucuguaacauugugcuaaagugauuuuuuuauuaugggaccaaacauguugggaucaccacagacuuaugauaacauaauuagcuaacuuguuaaacuuugacaugguccagaucaacagaaugaauuuauuuuugaaaaaaaaaaugauuucaaaugaccagaauauauuugauuuuuuucuuuagccaaauuuucaaaauuuaaauaugcauauauuuucucagacuuggcgcaggcgugguuggaauuguuaauauacccuuggaggucauggaaccaucccauaauaaacaggaauuucucaauguccaagaguauaaucaucuacuaaaagucaugggacaguacuugguccaguacuguaaggacaccggcaucagugaguauucaauagucauaguaggagauacuuacagagggauuacuuucugugauuucuuuaagcugacaugauuaucugaauucagauuaccagcaacugaaaacucugaaagggagcuccugcuuuaaaaacaggagugagaagggagcccauuucagaaucuuucccagacugucgugaaaaacaaagcagcagauuagaaauugcaagggaauggcaaucagagaacagagugagguggcagcugaccaugguggaaggaagcagaagauugcuccaaauagacugagaaacccugcucugggcacugggacuccacugugugagagcacauagucccaugcagaccuuaguagcucuuauaauguuguuaugucauaccauggaguaaaaacuacugacccuggguaauuguagauauguuaaacuuuuuuuuuuuuuuuugagauggagucuuguucuguugcccaggcuggagugcagugaugcaaucucggcucacugcaaccucuaucucccugguucaagcaauucucugccucagccucccgaguggcugggauuacaggcaccugccaccacgcccgccuaauuuuuguauuuuuaguagagacagaguuuuaccaucuuggccaggcuggucuugaacuccugaccucgugauccacccuccucggccucccaaagugcugggauuacaggccugagccaccacgccugggcagauauguuagacuuuguuuugcauaguuaaaaauucuugaguauguuaauuccagaaagauuucaauuaaaaauuucuaaaauaaauacaucuggaaacuuaaaaagauaaacuuuaguuaucugaaaaaugugauuuauuuagaucaccucacuccucagagacaccugaacaaugagauuaugugcuguguauuaauuaaacuucuuuuuguuuuucaacauauauuuuagaaucaagguguacauguacaagguuguuacagagguauauuuugugaugcugagguuugggauaugacuaaacuugucacccugguguugagcauaguacccaauagguaguuuuucagcccuugucucccuuccucuccucuuuuauauuccucagugucuauuguuuccaucuuuauguucauguuuacccaguguuuagcucccacuuauaagugagaauaugugguauuugguuuuuuuuuucugcauuaguuugcuuaggauaacggccucuagcugcauccauguugcugcaaaggacacaauuucauucuuuuuuauggcuguguaguauuccauggcauaugugugccacauuuucuuuauccaguccacuguuguuggacaccuggguugauuccgugucuuugcuauuggaaauaacacuguaaugaacauacaugugggugcauguguccuuucgguagaacaacugaguuuccuuugaguauauacccaguaauaggauugcuggguugaaugguaguugaaaucuuaguuuuuaaagaaaucuccagacugguuuccauaguggcgagacaaauuuacauucccaccaacauuguguaagugucccuuucucuccacagccugaccaacauuuuuuuuuuuuuuuuuuacuuuauaacaaaagccauucugacuggugugagaugguauuucauugugguuuugauuugcauuucucuggugauuugugauguggaccauuuuuuuucauguuuguuggcugcauguaugucuucuucugagaaguaucuguuuguguucuuugcucacuuuuuaaugggguuaucuuuugcuuguugauuucuuuaaguuccuuauagauucuggguauuagaccuuugucagaggaauaguuugugaauauuuucucccauucuauaggucgucuguaaauaaacuuacuuuuaaauuaggcagacauagggcuccauuuaugucaagaaauagaauaucauguauucaaugauuugggugaaguauguguaauucauguacauuaaaaauaugucucuacccuugagucaacuuaaaaucuucacuugaaguuguaauuuuagaauauuuucuuuccauuuguauccauccugccguaccuaaaacuuucucaccagcaaaacggaaaagcguaggaacucagugggaaauuaugaaaggggaaaugagguugaggggacagauuuccugccgaagcugaguuuucaugucauggucuaaaacauacucagaguguguucugugcacuaauauuaucaacaucaccuggaacuuguuagaaaugcagaaucccaggccccaccugagacccacugaauuaaaaucugcauuuuuacaagaucuccaggugauuuauauucacaaucaaauuugagaagcacugcucugaagaguauaccuauguaauuuuuccugggauaggcauaucuuuuuccacauguauuuuuuuuucagagacauguaugaaguuaugcuaaacaugagacucauuacauuguuuggcaagguuugcuuaaagcuguagaaaacguguaagguauaaauaucaacauaaacauagugagguuuaacucaaacaucuacucucuggucuuuaacugcuaguaugacaugguacaaaaggaaaacauuaagcauuugaaaaucaugaaccuccccauacuccucuugucuucgcuguaauccguuccuugucuucauccuuagaagaaagaauuaagucuucagaaagagguaggcauuagauuuaaaggucauaaaaauuauuuccaucuaggucacacuuaggagagucauacucaguccucuuuguggguggagcucucucgaagccccuuugcuugguguguggguacccucccaacaguuguacucccaacuacaggguaucauuugcuagcccccacuccuuaccuaauucccuguccuuaucuaauuguuucucaccuucuaccuaauuguuucuaucuaccuguuucuuaaccuuuucaacagauauaauaggguuugaaauaaauauauuuguguuuuuauuauuauuguuugauaacauauuguuuucccaauuccauaguuaucuaugaauugauagagggcuagaggauacugucacaaaagauguuccucuagaaggaagguagagaguagaggaaggauagcaggcauguguauuuauucacauauuucacuucauccucaaacuucauuaucaaacuaaaucaaguaaucaaggucagaauugguaguuuuaguaauuuguaaggagaaugaccuucaaggucuuugcccauuaacucccacaggaauaaccaaaguuauauaauauuugacuaucugaaaaccaguauuacagggcacacaguuuuaaugaaaaguauuuagguagauuuuuuugccuuguaaauaaaagaugcagucuuaauauuugcugaaagucugauguguuuuuagggaaaauuggguccuuguaaaaaucgaaucagcaaaaagagaaauggagagguaaugacuuugugucauuuaucaaaucuacauuuacuuuuggcccagcugaugcuaacaaucucagaaauauuuuccuugucucuaagucugacuucaccucacugucugcuacuauguuuucugaagcuuuauacauccuuacaauaaaauagaaauauuaaucaucagcuuuggggaguagggagagaaggauaaauaaaaaguggggagaaacaaaugaaauuuggguuugaacaggagcaauuaugaaaaauuuauuauuaaacuuuuccaaaauggaucagaauugagcugauguuucccagaagaauucaaaucauaguucuucaguuggcaaagaggguaaaauucauuuagccuagucaccuuuaauccgcucacucucacugccguuuuaagacugaaugcaggccacccgugaaaggaaaacugcucccucuugaggcagcccaugaauuugcacaacacuauuaaaaaaauacauaaaucuucauauuaaauccaaauccauaucucauggguucuuucauucaacuaugcuaggcacaaguguucuaggaccaacaaaucagacauggucugucuucucugagaacuuacagucuaggguggugcuauggucugaauguuuaugucucuccugcaaauucauguguugaaaaucugacccccaggaugaugguauuagcaacugggacuuuacgggggugaugagaucaugagagcagagccuucgugauuggcauuaguguauuuauaaaggagguccaagagagaccccuuauccccuucuccaugugauguucaagugagagacagccaucuaagaaccaggaagcaagcccucaccagacucagaaucuggcugugccuugaacucggacuucccagucuccagaacugugagaaauaaauguguuauuuauaagccacuuagucuauaguauuuuguuaaaagcaacugaauggacuaagacacaggcuaacacgauuugacaauuagaaauaggauuagugcccaacagagaagaaugaaaacugcagaaaccaguggccaggagcccacagucuguaggccggggaaggccucccugaggaagugauauuccuaaagguuggggagggguuagcugggucuccugaguucuuccugcuuggggcccaggaggauaggccuaaagcuuuuccaaauggcagcccccccagguauuugaagacaagauuaugucucucuucagucuuuguuuaaucuugacuaacacuuccaaguucaagaauaguaauuauucuucauuugacaugguauuaaauauauuuaccguccuaguauuguauuuuaaaguguaucaucuggaaacaaaaugugccagaugaaaccugaacagccuugacugaaaugggauccucaucuuucuuuugaguuguuggaaucuuauugguacaccuaauaauaugugaacucuccguaaacacauuauugacccucagugucccccuuaccauuaaaguuuuuaacaaaaauauuaauauguguucuuguaaagccauaccucucuuuucuuauuuuuuccaguaagugguuuugagcccuaguguagaaucauacauuuaucccucguaaaguuuaucgccuuauuaggccucauucuuucagguuguaaugaccuuuuuuuuggaaucuaaugcuaacuucuaacuaauguguuauauucccagauuuacguaaagucuggcuaguauuuucucuaugacuucauguaaacccuguugcauaggacaggaaaaucagacccuggccuucuaucagugaucuccacugaguaaaaguggguaccuugggacauguuuuccugauuaugcuaucaccuaacccuugucaauuacccaguuugugcauaauuuugaaagugagaaauaauauuuguuacaugaauauuuuccuuaaaacauagacaaugcuguaguaccuggauguagcuaguugcucacaacagaauuuuguuuuccauaugaugcaauuuagucucuaagaucucagaaagggacuaccaggaaaaugaauauaacagcuuugcuaaggauacacgucgagugaugaagcaaauauuaaaaggugagaauaugagacaaguuuauuugcagauguagucugagaaacaguucauaucuuuuuaauucaguuuuugaaguuaaagauuuuauguauguacccguuuuacuuaaaaauauuaucaauauuauauuuuauauuacuuuuaaauuuauuaugguguuauaggcugaauuguauuccuuucaaauucauaaguugaagcccuagcucccaguagcucgggcuguauuuggagauagggccuuuaagaaauaguuaauuuaaaauggagucguuugggugggcccuaaugcagucugacuaguguccucauaagaagaggaaauucauacacaaagagacauaccagggauaggugcacacaaagaaaaaaacaugugaggacacagggagaaggugaccaucuguaagcaaaguagggaagccucagaagaaaccaagccugccaauaccuugaucuugggcuuccagccuccagaauagugagaaaauaaauaaacuucuguuguuuaggccgcccagucugugguauuuuuucacggcagcccuagcaaacuaauacauaugggagauuucaaaauuagaauuaaagagaauauuauaaugaaacucuauaaacccaucagccagccucagugaucaacuuguaggugaacugguuucaucuguagcccaacuauucccccacaacuggauuaugaaggcagucucagacccuguauaauuauaucccuaaguauuuuagcauucauuucuaaaaguaaguacuguuuaaaaaccacauuacaaauaucauuaccuaaaaguuauuaccuucuuaauauaauaaaauauccagucuguuguucauauuucuaauuaucuccugucauaaacugcaagguucuuucucuaucgcugucucacacucucucccucuuccacuccccuccucucuguucuuccuuaaguuuauuuguaagaaaaccagauugguugucuuauaguuaucacacagucuagauuuugcucacugcauuacuaggaguaguucaacagguucuuccauuguguucauuuuuauuuaaauugguagacuagcagcuugcccauucagauguggcuuuuugucaagauguuucauaggugguaguguguucuuccauugugaggcugauugucucucuuuuaaugauauuagcagucaugaucaaugcguagauuccuuaggaguucaaaaaauuauauucucauucuauuauguuuucuucaucagcucuaauacuucuauaaggaaaaacugucuuucaucuacuacuugguuacccuuguugguauuuuuacuguuuaacagaagcaacugaacucuauacugcuaaagaauugcuuuggauaaaagcuugaugugaaaagaguaagagacaauuaaaagauuaaaauaugauauagacauuuugccuaauugauuuacaugacauaaauauguacucuguuuaaaauaauuacuucaugucagcucccagcaaauaaaaagaugguucaggaguucaucaaauugacuguuggaaaaaaaaaaccacauucuuagauuuaauucauuuacauugcuuucagcugguaauugaaauuacuaccauugaaagcacuuaugcuuccuuucugacuguaccuguauuaucaugauaaugacauuuuuuacaucuacaaugaaguuuuuugcuaaaauaucuccgaggaucucagccguauugcaaauaaaauacuaaaaaguuuaggacccuuauucuuucuggaauucaauaaaauuugauucuuauaguuugauuuuucccugccauaccuaaaggaagaccucaaaacucuccucaucagccugcuuaagaagaguaaguuauauuuaaugagucugaauuuaaaacugcaaucagaaaccuaauguacaauaugaggacuguagguaauacaguuguacuguauaugggaguuugugguuugguaaacaguucacuucccuguaauaaagcagcucacaaugcaucuuugaaguaauaugcugagauucaucuuuuaaacguguacauguaaacucuuuccauuauggcuuuaaacacaaugguaaggaaugucuuugaaaaucauguuuuaaacacuugcuuaugaaguucacaguuugcuaaaugguucauuucacuauaauaaagcagcucacaaugcaucuuugaagaaaaaaaaguacuguauaugggacuuacacugaguagguuuuagcugcucuugcuacaaaaacaagaaaaauagguagcugugugaaauggauauauuaauuuauuucacuguaguaacccuuuuacuaucuguauguauccuauaacacauguuguauacuuuaaauacacacaauaaaguuuauuuuaaaauauuccucuaauccauuaaaaauaaaauaauguagacaauuaagcauacauuguauuaauaaaaaucaaauaugggucuuuaggcuuuuaggagcauuaguuuagucaguaggcuucauguauaucuugaguaaggagaguucuaguagaaagguagucuaacccagguauuggggacacauacagagcugacuaggcuauugcccaugauaacacagaauuccuuaggaauacacuuuggacuugauuuuuaugucuaguuuugauuuccacauuuuagagggaaacuggaauauauccaaaggagagcagugacaaugacuaaauaaaaauauaaccuaaaaaaagaaggucaaauuuauuucuucuugaagaaagaaccaggagaaacauaauuuuccccaguguuguuuuugaagauuugccguaaugaggccuguagcccucucccuucuagucuccacgcacagcaucaugugguucccaacugggagccaaaaugcccuagggaaucucagaguauaccagggaguccaugaauuccuaagucuacaaauaauugucuaagauggcguuaugccucauacaucuauaugcuauagauuuuuauauguauagagauguaguuguggguaguaaaauauaaaauuacucaguguuauuaaauucauaauuuguuuauuuuuugucaucauauauuuucuuagguugaggguggggguucuaaaaguuucuugcagcauacggagguccucacacuuaagaagguggguaaccagugauacggaacuagagaaaaugaugcuacauggccaugucaaaugaggaagcugacauuuggagugaauugggccagcugcagacuacuggaguuuugcaggggagcguacugugcuuacaguagaguggagaaguggaaauguucugacagcagcugccacauaacuuuugccacugacuggacucauaacaugagacuagcacaaccgcaugccaccauacccaggagccaagagaaagggaagaaggacuguagcaucuucaccaccacugaauauaucuugucuugcuuuuuuucacuucaaguagaccaccuugggaagugaaaaacaaacagggauagcaaauaggccucaauuacccuugcaccacacacuaaaucaucauggcaauucuuccugauaaacggcaguuggccucaugguucuucucaacaguguaccaggcaucauuaccaacugauuggaguugacauuaucaauugaaaccaguuugucaucccuaauccagagcuuucauuaagaacaaagaugauaagcgaucccaccuuggaccagauuaggaagggucugaugccuggcuguuacauuagcuuuaaaugagagggguaaugacaaacaggacaguauucaacagaggaggaagagugauuuaacuguucccugagaaaagguaugaaauuucgaucucaggagaucuuuagaauauaaucaucuauuuagaugcagaaccaccugaaagugggaacugauuuaacauucuccagguauaccauuuuucuggugcuuugaguuuauaaacuguuucaggccuccuuauuuugauggagaccaucaaagcuuugcugugguaguuuacuauugaauuugauugagucucuccuaggcucacugauucccugaaugucauuguauguucuaugaacagauacaaaacugacaucuaagaggauguuguauuucuuuuucuuuuuuuuuuuuuuuugagacagagucucacucuguugccuaggcuggagugcaguggcaugaucuccgcucacugcaaccuccaccuccuggcuucaagcaauucuccugccuaagccucccaaguagcugggauuacagaugcccgccaccacaccuggcuaauuuuuuguguuuuaguagagacagaguuucaccauguuggucaggcuggucuugaacuccugaccuugaaugagcugcucaccucagcuucccaaagugcugggauuacaggcaugagccaccaugccccacacauuucucuuauuuuuaagaggcaaaauaugugucagcugcucuuguaguuacugguuuuuggcaaauuuucaguaaauuauugcaguauuuccuuuuuuuuuuugagguggagucucgcucuguugcccaggcuggagugcaguggcgugauaucggcucacugcaagcucugccuccuggguucacgccauucuccugccucagccucccaaguagcugggacuacaggugcccgccaccaugccuggcuaauuuuuuguauuuuuaguagagaugggguuucacuguguuagccaggauggucuggaucuccugaccucgcgauccgcccgccucagccucccaaagugcugggauuacaaguauuucccuuuuuuuuuuccccaggugcuugguuuaaagaggcuccugaacaauucauuagauuaauuuaaauauuaggaaucuacugaauaaaguauuccauacauagcuggcaguaaauuaaccuuucaguuuuuuucucacagauacuucuucuagaaauugagaauuuaauucugugugcauuaaucccggauuauccuauuaauuuaaugagcuuauugguucuucauacaaaagucuuaagauauguacucuuuuauaauuuugaaaauuagcugugugcuuucagccaucuacucuuuguaguaguaaacugaauuuuuuaaucgaccuaucuugaggauguuaaaauaauuuauaauuuuggaguuaaugaauuugggguuaucugcauggcucuuuuuauagguggauagaaauauuuugguuaauguuuuuuggaagagacauuauuccacuuucauuuuauuucagacaacauauuaaugaggcauuuugucaagaauagcagcaacguugguugagggcuuguuaggugcaggaugccgaccuacaaguugaagacaugcagaauuauaaagcacacuuccuccuuuggaaaagugcagugcucauggagaaguaacuuuuaaagaggaaaaauacgugacaacagcaaacuuaaauuucugcagggcucuuuuguguuuuuuuucuuuuuuuuucauuaugaugaaauacauauaacaugaaauuuaccaucuuaaccacuuuuaaguguacaguugaguaauguuaaggacauuuaaaugcuguacaacugucacuaccauccaucucuaaaacucuuuucaucuugcacaacuaaaaugcuauacccaugaaacaauagcucccaauuccccgcuuuuccauccucugacaaccaccauucuacuuucugucucuaugauuuugacuacucuaaguaccucauguaaguggaacaauacaguauuuauccuuuucugacuggcuuauuucacuuagcauaauguccucaaaguucauccauguuauagcauaugucaaauucccuucauuuuuaaggcugaauaauauucuguuauacacacccccccccccccacauuuugccacauuuugcuuauccauucaucuguggauagacacuugaguugcuuccauguuuuagcuauugugaauaauguuacuaugaagauggguauacacauuucucuucaaggcccuguguuuuuuaaaagcaauuuucaaguacauaacauauuguuauuaauuauagucacaaugauguacaauagaucuucugaacuuauuuauccugccuaacuaaaauuguguauccuuuuaccaacaucuccccaacccccucccccagccucugguaaccaucauucuacucugugcuucuaugaguuugacuuuuuaagauuucacauauaaaugaaauauacaguauuugucuuucagugccuggcuuauuucacuuaacguaauguucaccagguucauucauggcuuugcaaaugacauuuccuucuuuuaaaaggcuaaauaguauuccauuguauagguaccacauguucugaaacccuuuaucuauugauggacauguagauugaucccauaucuuagcuauuuauaaauagugcugcaaugaauaugggugugcagguaucucuuuaacauacugauuucauuuccuuuggauaaauauacagaagaggacaugcuggaucauauaguaguucuauuuuuaauuuuugaaggaaacuccauauuauuuuucauaauggcuacacuaauucauacucuugccaccaguguuaggguuuguuucuauccgcauccuugccaacacuuaccuuucaugucuuugguaauagucauucuaacagguaugaggugauaucucccugugguuuuaauuuguauuucccaggugcuuagucacauggagcauuuaaaaaauauauacguguuggccacuuauaugucuucuuuugaaaauugagacccugcuuuaaguucuuuuguguauauacccagcaguggaauugccagaucacaugguaauucuauuuuuaauuuuuugaggaacuaccauauucuuuuccacaguggccacaccauuuuacuucccaccgacuggguucuuucccacaaaauaauccuaauccuaaugaguaggauucuaaugaguauaaagugguaucucauugcaguuuauuugaauagucucucccuuucuuucucucauuucuucuaggguuuccauaagguguauaauggcuuacuugaugaugucuaguucuuaggcucuguucacuuuuauucaauuuuuuuuuuuuugagauggagucucacucuguugcccaggcuggaguguaguggcacaaucucggcucacugcaaccucuaccuccuggguucaaacaauucucaugcuuugagauagagucuuagucugucaccaggcuggagugcaauggcacgaucucagcucauugcaaccuccgccuucugguucaagcaauucuccugccucagccuccugagucgcugggacuacagguaugcgccaccacacccagcuaacuuuuguauuuuuaguagagacgugguuucgccauguuagccagguuggucuugaucucuugaccucaugagcugcccgccuuggccucugaaagugcugggauuacaggcuugagccauggcgcccgggcuaauuuuuuugcauuuuuaguagagaugggguuuaccauguuggccaggcuggucuugaacuccugaucucaggugauccgcccaccucggccucccaaagugcuagaauuacaggugugagccacugugccuggccacuuuuauucaauauuuuuuuguuguuguucauuagacuuaguuuucauuauucuguauuaaaguucacuucuguguucagauuuucucuucugcuuucucuuuuuuuucuuuuuuuuugagauggagucuuugucugucgcccaggcuggagugcaguggcgcgaucucggcucacugcaagcucugccucccagauucacgccauuuuccugcuucagccuccugaguagcugggacuacaggcgcccgccaccacgccuggcuauuuuuuuguauuuuuaguagagacgggguuucaccauguuggccaggauggucuugaucucuggaccuugugauccacccaccuuggccucccaaagugcugggauuacaggcgugagccaccacaccugguggcucuucucuucugcuuucucaaaucugacucuguaucccucuagugauuuuuaaauuucaguuacaguauuuuuucagcuccauaauuucuauuuucuuuuuaaguucuauauuucuuuaugauauuuacauuuuguucauacaucauuuucuugacuuuuucacauuucuuucuuucuuuuuuuuuuuuuuuuuuuuugacacagaguuuuacucugucagccagucuggagugcaguggcacaaucugugcucacugcaaccucugccucccaguuucaagagauucucaugccucagccacccagguaguugggauuacaggugugugccaccacaccuggcuaauuuuuguauuuuuaguagagaugggguuucaccauguugaucaggcugaucucaaacuccugaccccagguaauccaccugccucagcuucccacagugcugggauuacaggcaugagccacugugccuggccuucuuuuuucuuucuuuauuucuuuguuucuuucuuccuuccuuccuuucuuuucuuuccuuucuuucuuucuuucuuucuuucuuucuuucuuucuuucuuucuuucuuucuuucuuuccuuccuuccuuccuuccuuccuucucuuucuuucuuucuuucuuucuuucuuucuuucuuucuuucuuucuuucaguucuuugagugucuuugagacagucauuuuaaggucuuugucugguagaucugccaucagguguuuuucaggcacaauuucuguugauucauucuuuugcuuggaaugugccauacuuuccuguuucuacguaugacuugugauuucuuuuuuugccgaaaacuggacauuugaaucuaacaguguuguauuuccggaaaucagagucucuuccuucucuaagacuuacuguuuuuuguuguuguuguuguuuaaauuguuguaggcucucucugugcagaucagccugagcuauacacuuaagguuuucuuggguuuuucugagccugagccugugccuuugccuggacacgugcagugacuuccuaauuuccucucuacauguagcagcuuuuggaugcacuagucuucaaugucugguuuccauaaggugaaaaggagauaaaugaaaggagguaaaaaaaagacaccagucccuuaaauccccuggaauucacuccagcuagaaggggaggggcuugcaaccaugagggagaggcauaacaaaaauggccuucaccucuucaucuauacuucugugaucauagccaguaaucagugaucagagcaggaguccccauuauuuggaggacagggucuuuuuuucuccccacccuaauuucagcaagcugugugaaagaucuuccgggaacauggaguguaggauggguagcuacuacuggcugagagcugaaaugacggaaauuaacugcaauuuaauauccaucccuuccccugaaaguuguaagccuucaguagacuccagaguucccaaauaguuacaugagauucugccagugcaguuuuugucuagguggugaaacagacuucugaugcuuccuacucuaucuucuucccagaauccuccaaguuuuauaguuuuuagugugccuucacauuuauucuuugugauaaauuugcaaggcagguuacugcagucacucacuugauagaugagaaaguuuaguggcuugcccacaacuauacaacuaauauguaacagaaccagcacucaaauccauguuucuuuuaaucuacagcacccucugcuuugauauaguaaauacuaaauaguuaauguagaaaucagagaagcaggcggggcacgguggcucacgccuguaauccuagcacuuugggaggcugaggcggguggaucacuucaggucaggaguucaagaccaaccuggccaacauggugaaguccaucucuacuaaaaauacaaaaauuagccaggcauuaugcuucacaccuguaaucccagcuauucaggaggcugagucaugagaauugcuugaacccaggaggcagagguugcagugagccaagaucacaccacugcacuucagccugagugaaggagugagacucugucuuaacaaaaaaagagccuguauagccaagacaauccuaagcaaaaagaacaaagcuggaggcaucgcgcuaccugacuucaaacuauacuacaaggcuacaguaaccaaaacagcaugguacugguaccaaaacagauauauagaccaauggaacagaacagaguccucagaaauaacaccacacaucugcaaccaucuggucuuugacaaaccugacaaaaacaagaaauggggaaaggauucccuauuuaauaaauagugcugggaaaacuggcuagccauaugaagaaagccgaaaguggaucccuuccuuacacccuuuacaaaaauuaacucaagauggauuaaagacuuaaacguaagaccuaaaaccauaaaaacccuagaagaaaaccuaggcaauaccauucaggacauaggcauggacaaaggcuucaugacuaaaacacaaaaagcaauggcaacaaaagccaaaauagacaaaugggaucuaauuaaacugaagagcuucagcacagcaaaagaaacuaccaucagagugaacaggcaaccugcagaaugggagaaaauguuugcaaucuacccaucuggcaaaggacuaauaucagaaucuacaaagaauuuaaacaaauuuacaaaaaaaaaaaaccccaucaacaagugggcaaaggauaugaacagacauuucucaaaagaagacauuuaugcagacaacagacaaaugaaaaaaugcucaucaucacugcucaucagagaaaugcaaaucagaaccacagugagauaccaucucauaccaguuaaaauggugaucauuaaaaagucaugaaacaacacacacuggagaggauguggagaaauaggaaugcuuuuacacuguuggugggaguguaaauuaguucaaccauuguggaagacaguguggcaauuccucaaggaucuagggcuagaaauaccauuugacccagcaaucccauuacuggguauauacccaaaggauuagaaaucaugcugcuauaaagacacaugcacauguauguuuacugaggaacuauucacaauagcaaagacuuggaaccaacccaaauguccaucaaugauagacuagauaaagaaaauguggcgcauauacaccauggaauacuaugcugccauaaaaaaggaugaguucauauccuuugcagggacauggaugaagccagaaacuaucauucugagcaaacuauaacaaggacagaaaaccaaacaccucauguucucacucauaggugggaauugaacaaugagaacacuuggacacagggaggggaacauaacacaccagggccugucagggggugggggagcugggagagagauaguauuaggagaaauaccuaauguaaacgacgaguugaugggugcagcaaaccaacauggcacauguaugccuacguaacaaaccugcacguugugcacauguacccuagaacuuaaaguauaauuaaaaacacacaaacacauagaaagaaaucagagaagcaaaaccucaucaacccuucuagauaccagggaguaguacaucaggagcugguguacagagaagaagaguaugagaugaaccaagacaguuccacuguuaacaaguccaugugacgcuacccucaaaggcuaaggaagcugagaggccgaagaaagaggcugacaaauccaguuucuuagaaagaaacauuuaauagggucuuaggaacaaaagcuaugucuuaggcuguggugagauaagaaugguggaucccugugccauuaacccccagacccaggacuuaaaaaccguagggaaagaauguguaggacaauugaagucaaccccucagugaauuguaagaaugcaaugugaaucuaccuaauuccagguuuuauggucaaggguuguuuugaccuaagggaaggauuuacaguaacaguagauaaaguagaaauuuuagaggcauuuccagaacagggguuaaucauaagucaacacggcagauuaguauuuaagauggaauugcuugauucuccacaaaaaccaaauacugggccaagagaagaaacugaaagucugaauuaaaagccccaaaagccaaauccaaaggaaaauuuggagcaagagcagcuggggauuuugugaagagacaagagggcagaccugagaauuugugaggucugcuuagcccagcccaacugugaagacccuuuugaaagcugaguucuuucucugcugaucucuaagccccauagcacccugagccaaaauuuuaacaggaauaauaaaguguuaggucauuuauuugcauuuuucauggauuacauagccguauguuaagguuguuguaaggcugguaccaugguuagugguuaucauauuggacaaaacagucaaacauggauucuuuuuuuuucuuuaaauuuuauaugcacauguacagauacucaaagugcuaagaaaaauaaaaagugaaaaguaaaaguauuuucccuugccuuccucuccaccucucuuucugcucuaaagauauccacuguuaaaacuuucuuuuguauccauucaggaaaaugugcaucgcaauuuuauauggacaggcuuuucauacauuacauaaagugauuacacuagggauacucuuugauauauauauauuuuuaaaaaauuaaaacuuuaacuuggagaucuugaugcaacacuacauuuagcucuacuuccuccguuuuaaagguuucccacuguuccauuuuuggggaacagaauuugucaguucuuuauucauaugcuuuuacauuaucuccaacuuuuuacuagucgagcaaugcuauaauauacauggcaacuuauguauguguguaaggauaauuccuaacaguauaauugcuggaucaaagaauaagaacaaaacgacucucuaacaguccuccaugaugaguaguguuuucaagcaaggaggaaauacacaauuuggggauaggauagugcauaaacaauaaagacuggagagaaaaggaaccagagauaaaauaaagauuaaaaaccccaccucugucugugagauaagaaagauaaauauuucuaucaauaauuuuaagagugcccuuuaaaguuuaaucaguacagucuuuccugggaaugcuuaagaacaaugcuuuaaaugucaauauguuuuauugcauaaacacauaacuuuuaaaauacaugcuauuuauuuuuauuauaaagauauugcagauuuacugcauauaauuuggaaaauguaaaaagacuaaagcagaaaauaguuuucacucaucauaucacuauucagagacaaccaauauugauauuuuaaucucuuauuucuguauauguauuaauacuuacacaguugagaucauauuguauauacaaacuucccuuugccaauuguuuugauuuuaaugauuuuuuuuuguuauucuuugccugcuuuuuuuuuuaaaagauaauagaaauuuaacauuguuuugcaaugaauuuggauaccagaaugacaucgauguggagaaaccuuuaaauucuuuucaauaucaaagaagacaagccauggguaucccauucaucauacaauguggugaguguugaaguccauuauaauuaccaaauguuaagggcucuuaaauaugcaagucauuguguuaagaaaugagggaugagggagacaaagguaagacaucuugcuuuccaggaguuuacagucuggaagaaaguuauaagugugaaaauaauuguaauacagggaaaaauaagguaagugauauacuagagacaaauaauuauuugaggguucaaagaaaaggaugggggaguagaggcaagauucuaugauggaguagcauuugugauagucuuuaaacuaguuucaggccaggcaugguggcucaugccuauaauccuagcacuuagggaggcugagguggguagauugcuugagcucaggaguuugauaccagccuaugcaacauggcaaaaccccaccccuacaaaaaauacaaaaauuagccaggcaugauagugcacaccuguggucgcagcuacuugagaggcugaagugggaggaucgcuugagccugggagguugaggcuguggugagcugugauugugccucugcacuccacccugggcaacacagugagucccugucucaaaaaaauaaauuaauuaauuaaaauagaauuuugauaggcagagaugaagaguagagaaaugugaauuaauaucagguguacacuucagcuaaaauguuugugaaauaguaauagaaagagccaucuuucuauuuuuaauauguaacacuauuuaauacauaguaggaauuuaguaacugacaacugaaucacugaacaaugaauaaauaauaagacaaaaguauuagguuggguaaagguguuagagauucuugaaugucaggauaagguuuuacuuugauaagcaagcaggagguauuggaauuuuuuccauaggaggauaauuacauucagcacuuacugauauguuuucuagccacuacacaaaggggcagggaguuaaagacagucucuaauaucuguaacuaacagcucaguagagaaaaacagacgagcaaacaaaaaagcagccuauaguguguaaaacucuguagaaguauuuauacagcucucggggagcaccuccgcagccuuuugccuaggaguauuccaaggaagaccugacuggucagagguaacuuguaguuaaaguuguucuggcagcucagugaaggaugacuuggugaagggcuagaacaggagacuauuguuguaaucuaggauccaggugacgaauuauaaaugucugaaugaagguguggcagugagaguuaaaagacaguuacuuagaagguauaauugaggaaauugaugacaguaugugacagccugucacaugcuaauaauaauggauaacaguuacugugauuuugauuuguaccagguacuguuagaauccaaucuccaguacucaagagcuauacaaaauugggcaaauuguuuaacuucuuuaagucucaguuucuucuuuuaugaaaugagauuaguacuuguagcuacauuauagaguuuugagaauaaugugaauuaauaaaguuuacuaagugcuaaggauagugucuagcaguguugguuuuuaugaugaugaugaggaggaggaugucauuucauucucaguaacuuuuagauaaguacuaauauaauauuaaucuuuuaauagauaaugauacugaaauauaagcaguuaaauaauuuguccaagaucauagaggugguaagagguggagcuguucaaguucuuaaccuuuguguguacugacucucucugccuuagaugaaagggacaaguguuaaccuacgagccguuagcagugugucuggagggaauucaggauuaaauguaaguguagccuggagagggaagugugccuucguccuaaaggcaaggaaggacuguuuuggaaagugggugaagaaaucagaaacuauagacuggagaggggaauaagaacagaagaaaguacagaagaaaauguguauaugguucaaaaaacuaacuucccuuccuuccuuccuuccuuccuuccuuccuuccuuccuuccuuccuuccuuccuuccuccuuucuugcuuuccuucuuucuuucuuucaguuuaauuuuauacuaguugagaucaugguuuuccuucuuauguuaaucauguaguuggagacagaaagugguauugucagcagacagguaguaggucagagaaaaugggagagucaagucacugaaauuauuaauuugguuuuagaagaggugaaguggauguauuauuuaagguucuuuuggcugaaaguagcagaaacuaacuggagggaacugagauaauaauaauaauaacuuguugguggggucuugaaguagcucauagaacccuagaauagaugugucaucaagaauaaugguauaugaugaaggauucaguugucuuuggauugagagauaccucauacuuuugauaugugcaaacugacaucuuacuaugauagauucauuucugaucucuuuucugugucauuuuguuuugauugucagaucuuugucuuaaauggagagucuugccuuccucuacuaauuaucaggaaaaagaauuuuuugacauuuggauuugugcuaauaaucccaaccgcuuggaaaacagguauuuuugauuauuuucuaaaauucuuuauucauuuuuaauuucuaaaguucauauguaugaaccuugaaaaugucaaucuauaauauagauuuuagcuuaguaucugguaucucuucaaacucuuucuaaugcccugcuaccugugcaaagauuauuucauuggcgugcuuuuccaucaaguaauagaaaucuggguguaacuaucugaagacguuggggugagcagcucugcacuuccacccaugggagaccacaaccugguacuuaagaguucuuccuuccaguucauuuucauacaacauauguccuuauuguacaggaguguuacucagagagugucuccaggggcauuaaacuguuagaccguaugcuuuuucugcuuaaaucauauauugauuucauugcuuuacacucuuggaggaaaaaguucagacuaaaacaggaaaaagacugauuaaauauugaaggaugucaauguuauuacaagcccuuuuagacuaauauuuucccccauagggaaaaugguuaguauuccccuuuaacaaaagcaccccuaagucaagcauugcuuuuccaugcagucuguucuaaguccuuugagcuggauacgugaaucaauauuuuuaauauagacauuaggguaauaacuccuguuugguuauuuuuuuaucuagcucugaaaaagaagagcaaaaagauaaaagaaaaagaaaacauuuggaaacugcugcuaaaaccccuuucaucuagaguccucagguuauuuauauuuagagacugaagaaaaaugucagagguggcaaagggucuuagauuucucauggcccagguuuuuucguaucccuuucuuguuuugcaaugcaaccuuguuuuucccaaauaaaaacuugucacagaacccaaaaauaaguagauaaaugcaaaacuguccugauugaauuagaggcugggaaccuaagguauccacuuuuuauuucuguucccuacucugcagaaagccuagagcuccagggaccgugauuauaaaacacuguucuauucuucuuuauuuuggaaaaaugagaauuaaaacgcaaauccaggcuaagaaaccuauguaugaagccacuggccaagaucuucuguuuccuaaccugcguucauccccaacuugggacuuaaauaucucccaaauaggaacaaaguguuggcucaguuucaauauuaagaauaguuaaucauaugaacuuaccaugaacuaagaacuuucauauagucuaggauuguauuuagaguucagacucuggagacagacugccuggguuugacuccugguucuauuagcugugaaaucucagaaauuacauaaccucccuuuaacuaagcuucccauacacuggaaugugguauaauuauaggaucuuuaugcaucuucucuggauccagcuaagccccauaguuaggacaaucugcugaaagucccuggucacuagaggcccuugaucccagaauuuaggcuacuucccacagauguaacccuaucccuaggauuucuuagaccagucuugggcacucucagaccuacagaacugggaagcugucgucugcaguuucccuuaccuucaacuuacuguugucccugcauuggcacagacucacccccuucugaaaaguaacaguaccaccucagagcauuguaaaauugguuucaaagcuguauuaauucugucucucuuuaaaaauuuaauuuuuaauuuguaugaguacaugauauguauauauauuugugaguauaugagauacuuugauaaggcauauaguauguaauaaucacaucgggguaaauagagguauucaucacuucaagcauuuaucauuucuuuguguuagaauguuucaaauaauacuuuuaguuauaaaauguauaauaagcuauugcugauuguagucaccuugcgcuaucaaauacaagaucuuauugauuuaauucugucucuuuuacacguaaaaacagugccacuugugaugaguggcuagauaaauuuagccauguugacagaaaacugauggaccuuaaaggucuaaagugcaaaaaaguuuucuuauauuuauaauuuucuuaaguccuugauucuuuaaauauacugacaugauauuaaccaucuguguuuuauuuucacugaaaagauugugacaaaaauaugcuuaaaguggcagcaagaaauuuaggggagauguaaagcaaaauugauuaaaagggcaguuaauugagauuuggcacuuccuucaugggagcuccuuaacagugauguagauaugaugauucccagggagggggaagaaauuguucugaugaccuugcucaguucuuugauucaaaaugguaggaugggccaucuauaccuugagaauaugcuucaaaauacauuauugcuaggcaaaaccccugacauaugugccauuggacuuggauagaaucacuuaaaauaaguguauuaaagugaugacaaguauaauuauuuauuagggaauagucugugaguagcaggacggaguaauggggugaaaagugucauugucuauauuuacagaaaauacgguuucuugucaguaguuauuugccaauugucagcaaggccauuaccaacagacagcauuugaaugaacaauguguaacuagaacuugggcuggaaacauaguaauaacuuucucuuacuuugcaauuauauaugcucauuccauuuuuauaaaaggccuaugaacuuuccccauuucucagagaagaaaauagagaggcuaagaaaggauuagugacuugcccagaauucuucacuacagcugaaacuggaagccaaguuucugaugcaaaaccuguacucuuccugccuuaucacauugucuguuggaaggcauccuucuccauuucaggaagccuaguuucauucagauacuuuuuaguggacaaaauacaucuuacaaaugguaguauucaguaauacccggagaggguaagguggagccauucuuuuuucaaaccacuggagccugguuuuguuuuccacuucaagcacagagggaggcuauacauuuuugacacaguaucugagaaauagccaucaguuugcuuccauuacauucauaccaugcacuuaucugcauugaaaauagggauuaccagcagagaaaaaaugaugccuauuacuuggcugaaccaaaaaugucugaauuuugaaaaggauguuaaaaaauauuuauggauuguauugcauauuaaaguguaauucauuuccaaacaucuuuaaaugaagacaguugaaugaauugcauucuaauaaaaugcuugagguuucuuccuucugaauaaaaacuuaauguugucacagguucuuuucugaaaugaaguagaagccuguauagaugccaccccacagaugucuucaaaucaacacuguggguugcuguauauauagaaguugucccuagaauuuguuuaccuaacaccuuucuuugaaaauaacgauaauaacaaacaccauauguggguggaauuaaguguuuuuucacaguaguaccugaauuugauuguaguuccuaacucuucucuguugguauggggcgagaaaaauauaugcugcagcccugaagaacagagaagugaugggucucaucugccucccuuuucccucacuguuucagaugggagaaaguccucucucgauccucagccuccuccucccuugccuggccuaacacccauguauuuucuguggacuuugucccuccucuuuuugguagcucaguggaacuccuccccucccuaccccuaaucaauaauagaaaacucugugaccuagagugggcucgaagaacugaccucagcgucuuacgacacuacugcguguuccuuccccuccaugcccugaaucaaagcuaugcccagugggagcugaacuucuugucuguaucaagccuugauaccgaagugaacaaaauaauaucuuauuuuuucagcaguuuggcugacucaguuccccaguacauaaccacaaaaacaaaaguaagaaaaggaaaaauggccucaaaccuuccaaaccauaugcuuugaggguuauuaguauuuuuuuguaauuuuaacaaggaaugugcucauccauagccuguuuauuguucauuuacaaaucauccuacauuauuauguauuuacuaacccacaaguuauuagaacagcauaucuguaaggcuggaaagcagauacucuuacgacagcagagcacuugggcaggaugcugccaucaggaccagugggcgauuuggggaaggggcuuuaacgcaucucauuaccucccaaggcuauugcugaauccuacaucacaucacggguagucacgggucuucacagugauccugggguuauuaaacagauaauccauauguuucagaggcauaauuauuugcuauauuuuaaagagacauauauauuucgcuaccuuuuuuggggggggaaauggcagugaugagauaagcucagugaucuaaaauaauuuuugcaaaaggccucauuuuaugauaauguagaauaagugaagcauuagcaauauaauugaugcuuucccauccucguuaauauaugguacuguccacauuuuuuauuaggcuguuuuccaugcaaauuggagauguaagguuauuuguuaucgaaagccacggauacaaugcuuuuccuuccuauuugaauuuuggauauaugacauaaagaguaacuccuuguagaaguaaaucgucuuuuacagacaguaaguaguuuuauauuucuccugauguuaaucuuguacuuguugauucugaaguugucaucagguagaaugucuaccuuccaucccacugggcaccaugagcacaauaucaccaucaaaaaaugagaaagagaagcaacuuagagagucggucauaaaguaucaaaauagacuggcagaacagcagccacaggugaguugugauuaauuccucccuaauucuacugugacucuuuaacuguugguuucauaugugcaaauugacuaaagugguuuacacaauaaaauguguauaaucuuuuuccuguccuuuuugacaucuuuuaauuuuggaucuaagaccuguucuagagggugaguuuuguaaaaaaaaaaaaaauacuguauaugugauaucuaagcccaucuauacgacaaugcaugugagaaauagggacauuuauuucuacuccacagcugcacauagaaccuuauagagucagucagcauguccaaggucauguggucaaggcgcaacacaaauuuguguaacuccaaagguuaggcuguuuuuauuucauucuucccugagggaggguuuuaagguaaagaguucuuuuaaaaaacauuaaccuauuaacuuagaaagucaaagcauauuuaauuguuaagaaaauucaauaaauaaaacauuacuaucaaucaacauagguaaccaugacaauuucgaguguaagaaaauguggcauguagaaaaauuauuuuauuuucuugacuaauaauuaaaccucuauagauuuagcacauaaauucaucauuuuuuaaaugugaagccuguuggcuuccucaaauagcaguuguagcauauguccaaauguguggacacuucuauagaugucaggaaauaaaaugcuuauuaaaauagaaaauucaaugaugaagugggauuuaagcuccccagcuguagcagcuuauaguaaguguuuuccugggcucauagaagauuacucuuuuaccucacuuagcuugcuaggguucugcagugcaagucagauaccaccugagauuacaaccaaagaaaccagagcuuuccuuuuuacccuggagucuuagggucucucuuggaaagauacugagagucacuuuggaaacacauucuccuaagcacuccccaccuccaaaaaguagcucaacuuucuacaguuuuuaaggccuuuagucaugguuucuugucagacaaaagucagaaauaaagguuucacagacuuuuaauaaauaauuagguacauucagaucuuuuuguuaugaaauauuuuaauuuuguuucuuauuuaccacacuugguagcuuugugaaggcauucagcacauuaugaauugauugcaucuuuauugccaucucuggacauuguuuuucuuuucuauagcagugauagccaaccccaguauacuaauaaugccaaucaucaagacuuaauuagcuuguuguuuguuuagaauuggauguuguguucaucauugagguagagaaucugauggcagcugguggaauagcagauuugggccaacaguucuguuuauucuuuuuuguugguaguugauuuuuuuucauaagauuuaagccaagguuauagauccaguuuguuucaaauguaaacaaagaaauuuagcaguacuuauauagaaauucacugccaguacuucaaaggacauaagaauccacuccauccuccuuuuuccuuuugcaaaaggaagauuuuacaaaaucuuuuugugaaaagauuccuaacaucuuuuacauacuuucugguacucagggcuuguaacugacccugcuuuugugguaaccaaggaaagcuuuggguugugguucacugaaccaaaggcaaccaguuaauuuugaggugaucauugagcacauacuugcccucaggucugucccaggcugggaauuaugggaaauacagaguaucuguaauaccaaaauguaaguucugugagagcagggguaguguugguuuuacuuacugugaaucuguauuaaccaaaacagugccuggcauauaccagguacucaauagguaguugaaucaauaaguaaaacaugccgucagauauuauacagucuuuuuguggaucaagucuaacagcuauuuaaaaaugagcaaccacuauaaaguaauauuaauucacauguguuuucuuauuguaacugacacugcaauagaaguuuacugcaggagauagugagggcagcuucaaucaaagaaaguuauauagggguguugggcaugguggcucacaccuguaaucccagcacuuugggaggcugagaugggcagaucacuugaggucaggaguuugagaccagccuggccaacauggugaaacaucaucucuacagaaaauacaaaaaauuagcugggugugguggcucacgccuguaaucccagcuacuucagaggcugaggugggagaauccuuugaaccugggaggcagaaguugcagugagcccacgccacugcauuccagccugggggaaagaugagacucugucucaaaaaaaaaaaaaaaaaaaaaaaaaagaaaaaagaaaaagaaaccaaagaaaguuauauaggggaagugauacuuguaucuugaagucuauuuaggauaaauagagggaaaaggauagggcauuucaggugagaaaaacaaccuaaaggaacacuuggagcugaacacugauuuguucuuucauggaaccagucacuuaaauuacauguuaagcuuucauauuuuaaaaauuaaacucaguauuuguguggcaucucucuuuuaaaaauggugugacuuguuacaaugaugcaacucccauauaguuauaauaugguaauuacugaacagaagaccucugaaagaugaccuugauuccuccuuucacaaaaauaauccaugaacauguucagaaacuauguuuuggugauauuuaucugaugucaaaacuaagacuaaaaaccaugcaauguucaguguaaauuuccuguccucauucuaaaacccuuuagaaguaguuuuggaaugugagauaagaaaggaugggaaagcuagaaaaacaggccaucauuggccccauucaguuucaaauauaggcuagacaucacugaaaaaaucaagaacuggcuaguuuauuacuaugauucacuguaugucuauuuuugguguccauucacccauucaguaucacagaaucauacaauauaugccauguaauuauuauuugcccaccuccuguuuucucuuccuccaucccacucccaaugaccacuuauccauugaccagaccuguguagugaauauaaaaaugaccuaaaccugcacacccuaucucuuaacucucuugcauuucagcuuuaaugguagcaggcaucuugaucuggaaaaugaaagguugaccagguaaaucaaaaaucuuucuggauuuuagguucuauggguaucuaaugauuagaugguaagagaguuauccuaauuauuagauguugucccauaggagaaaaugaaguagcuagaucuaaagguaucguuuccacaugguaucuuauuuaauuccuacaacauuccagcuaguuauaucuauuuuaacaaagaggaaagugaaauccaaaaaaguuaaaaauaauuuuaaucaaagcacguaacuuuaaauggugaaguuggaauuuauuuccuuuuugcccaauuccagcaccauauuucucgcagucuuauaggaaaaauacagacaaaaaggacauaagaacauuuacaguagcaacaaacuuauauauugcaaaucauauuuguuaagggaaauaccuaaguucaguaaaccuaauaggagagcucaaauucaagaucugucaccuguggugcauuuuauagacuaaagggguuguccuccauguaauugauaagcuaugucaacaagccaagauccuuguuauaaauugugcuucugaauacaacccauccccaucuuuauccuuuugaauagaugaauaaguaaucuguuucuaacuacuuucagcuucauuccacauuaccugcuguuuucuauaccgagugacaagugccaccugcuggccaagugaugaagcuuuuauuucuauuguuucacuggauugcucaguuguaauuggcauauuagcuggauaauuguuauuuuuugguaaaccuaggcaauaauuuaaaaaccauaauguuauaaaauaaauuucucuguauuucaggaccucuccguucucaaauuugccucuuucucagauuuaacuuaaaauuucucuucuaccuucuauugugugacaaggaugauugugucauuaucaugcacacagaaucuaguuuuaguuacacuuuauucaggauuuuaugguaccaucuaaaauccacuuaauacccucaaucauuaaaagacagaucauaccuuucucccugaauuaagcuacccuauauuuaccccuuuauaccuaaguaauguuaaugaguaguguauuugcauaaucaauauauuucugcaaugugugaugaauugcuuauguguccccuaggucuuucugaauuaaucuuuuguauuuacuauacauuucuuggccuacagcccaggcugucuauaaucugacacuaguugccuuucuauuaauauaauagcauucguuucuuucacucuguauggugcugcuacugagcuucuccauauuucuuacaaguguucacuuccauguggcucugcaggccuuuguuugugcauucuugucuggagcagccucugguccuucuccaguccuucaagauccaaaacuauugccaaucccuguaugauuuaccuacuuagaaaaguaucuccuucauuucauuuaccuacuuggaaaaguaucuccuucauuuaccuacuuagaaaaguaucuuucauuuaccuacuuagaaaaguaccuucuuccuuccaguucccuuugucccaugugguuuuucuuagagcauguuuuacuucuaccugguauuauagucacuuuaugucuaauauuauaguuacuuaugugucucaucugucugccauaucagacuauaugcuuuuugaaauaaaggacuauuucucuucaucuuugcauucccaauaguaccuaggccugcagcuuucauguaauagguauuuagcaaacaaugaaggauggaaagaauaauuugauuuaugcagaauuccugaaaggugaauauuuuauauuugauuggauugguugacucuacauagguuaggcugaccaacuucugcauauauuacugaagaccaaaauguucuuauaccuggucacaauaaacuguuguauuuggauuggaguacagagacugcauuuggauuucauucgucauguucauagucaucccaucaaauauauagcauuuauaagacuucaugccuggugagaagaaacuccagcaauagaauucuguucuucuucagugcucauguggacacacauacagacagaaaugaaauaguauaaucuggcaauucccacauugauuguuuuagcaguaaaugcauaacaaagaaggcuugccgaacuuuuagcuguguuuuucagauugaauggcguaucugaguacagcuuuguaugaagaaugugaaugcauuuuuccauguagaacuuaaucuuuuuaaugugucauuauuguguaggcugcugagguuucaaaucucuauaacuauagugacagaugccauagaaaauauauuuauucuucaagagugcuuuucagccuccuuauauaaacugucaugaucuaaaauuugugacaccuaaaggcccuugucuaacaagaggcuauucuaguuauuguagaugaaauauuuuacuuuauuacucuuacuacaaagaucucauuucucuauggugauguauugcuuuucgaagagggauaaugcaugauauauucacacuuguggguccuaugcccuguguucauggcauaccaaaugagacauuaaacaaauugccuuaugauuaacuaguguacaaguccuuugaaggcagguaucaucuguugcuuucuucuguguaccuccuacuaccacaccuggugcaaugcugggcacaguagaugucuaacaggaguucaacuccuuaacuugcacugcuucuccaaauuauuuucuuacucauccuuuuuggagaagcugacaucauacuuccugauggaacagcauuugugguuuacuaaacagacccggacagcacuaaugauuaaagggcaucagaacagccuggcauuguggcauagcauggugcagggaacucaggauauucucagcuccuggcuucauaagcaacuuuauuuugccaugggguugacacugaggaaugccauccauuguugucuacuccuggguuucacagaagugaccaaaugcugucgucaaaggccaagaggaguuugaguccagagggaacacauuuuuccucccagaaggacagcaauagcuuugacaguugcaggcagucuugccacauuacaucccucuguuugcaugcuagucagugauuccuguucacaucagcagagauggagagaggaguagagguucagauguguugccugaaaugauuuucacugcagggaauacugauuuggguuuuaaugcaaauacaccuauuugaucucuacccuacaaaaacuccuuaagcaucuaaacucuagguacaaccaguccccaguuagugugcauguuaaucagggacuaucagaggcugucuggcgucugggguacaccucagggccuguucccugacugugcucagaguaagauacaagucuuuggcuuccuuccgcagcaggcugcucgcugcuccccugucaaggaagucugugccuccacgccuguacccucugggcaccagcccaccugagucuuccucucucagcuugaauccuguuuuucaauuugcuugacccaauuuccuucuuacuuaggaccuaacuuuacauuuugaauucaguuuggggaauuguguuucaugacuguuguucugauuuugaacuuaaaccuuguaucuuguaccccugauucaaccucauucaauccuugucaccugaccauauuugugaucugaaucugcucccuuccucugucucaauuccuggaggcuggaguaaaauucauaccuaaucuuuuuuuuuuuugagacagagucucacugugucgcccaggcuggagugcagugacgcaaacucggcucacugcaagcucugcccccggguucacaccauucuccugccucagccucccgaguagcugggaccacaggcacccgccaccacacccggcuaauuuuuuguauuuuuaguagagacgggguuucaccguguuagccaggauggucucgaucuccugaccucgugauccacccgccucggccucccaaagugcugggauuacaggcucauacuuaaucuuaacuggggucuauuuuuuaccuuguacuuuaccaacaugugauuuaaccucuccacuccuucaguuagucuucccccaccaaguccagcauucuaaccaggguguaaggucuccugacacaucagggauuugcauugaguccugaagaacuaacugacguuaguccaugaacuuugcuucacaagggucuagaauaacuuuuccuccacuuggcgggaccccccuuguaggcacaagccaagaccacuaggaauaauuucuggcauuugaaaauaaaaugaaguauuacuuaaaaugcaucugaacaggagcagaucuaguuuuguuuuguuuuguuuuguuugagccugagguucauacaauuuuugggaucccuuuuaaaacagaaaauaccaaacuauaaauaugaaguuaggacagcgccauggaagaggcuuuguaagggagggauguugccacuuaagcuacauauacuucaugguucacccaccauuuguuuuugcauguauuauaccauguggucacugcaggguuuuuuuguaauaaaggagaauuacauauuuuucauauuuccaauucccuucucuccaaucucucccccaagauuuccauaauuaucuauacuuuuggugaauucuaaaacuaccuaauuccuguaacuguaggaaccuaacgagaagaaaccuaacgagaaggaugaauggaggggugaaaugauaauaacacuuagaaugugccucuaucagcagugcuguaaauucacugacauuuaauccuuauuacaaugcuaugauuguuaugauuccuauuuuguggaugaggaaacugagucacagagaaauaaucugccaaagauggaguuaggaaacugcagaaccaugauuucagccaacgcagacugguuccagaccccucauucuauuacuaaauuauauugccccucuggccaacgugacguaaacaauguaagaauagggguagaucugaaauguaggauugauucuuaguucaaagcuguucaaacgacucugcuuuucuauuuucaguuuggcucaguagcucuucuguguaagagaaguugagaaauuaacugcuaauuguaaacauaauuucuuuuucugaguagcucugucuauagugggcagguuuggaaggcaaagugacuuuggaaagcuuuacagaaggggcaaugcuuacgagcucuuugaagaaggagaugcaagcagcaggaugugguggacagcauuggccuggcguuaggaucccugccuucaggucccagcucuguuguucauaagccaagugaccucaggccugucuggugucuguaguccuugaucugaguaccaccaggccggugaaaagaagaagauuaagacuguauuuucagggaucaugucuauaggucauuucuagagaagcuucucugaacauuuagggcacaggaaaccacgaggaggcgcagcauucucuccugagcauggaaccgguguugcuucacugcaacuggccguucauuugcucuuggugaucauuccucucuuccuuugggagaggaauagggagaggacacagucgaggaguuccuguuuuaacaaguaaaaaagguggaggugaggaauuaagcuagauguuugcaaagacccauucaaauuuuagaacccgugaauaucaguugccaaucuucuaucacaagcaguuauguuugaaauaucuauauuuacuaauaccauuuugaauauaaacaugauauuucuggagcagagcaaaguauuauauauaacacaaggaaucacccuuugcucugguuuuuaccccuggagcaauggauugggugagagucagaucagaugauaucuuacaauuuguacugcaggcaaagaacuccuaagaaaauguaucuggacauuucuguaugagaguggcaaccacccucuccacauucuuuugcucuuugggaagggcccugaguuguaacucuuacccuuuggaauauaaacagaucucuggggguaggggaagaugagacuaguuucuccagcuuuacaauucuggucuugucucuguggucccagauuuuauuccucccuuaaaauguaaacacauauuuccagggagguaaaugucucuggaggcaaaucucuucacaugcccucuccacuaauaaucaguugcagauuaaauucuaagauuuguucuuuuaguccaggucccaagugaaguaaauuuaaucagaaaauccuaacuguacagaaacauaaaaguauuuucucuauagucccacaaagaauugauagaaaauuagaaaggagcauucuuuacuuuccagggcugugagucuaagauuaugggacugucuguuugaaaacaaugucacaauuuuauagaaauauucacuccugagaucuacaccagacggacuaaacaagaaucucuuggucuggugcuuuggaaucuccauuucugcugcuucccagauguaugcaccaccaauauucacuucuuuauuccugguuuaaggauucuucaguguuucuacuuccagagacaguucaucuuaugcagcucucacugauucagugugugauuugcgggacuuucugaacucauaaagaaauguaauagucuugcugggagaaguuauaagugucauuuaaaaaugaauacugauauuuucaagcuuucuaggguaaugauucuucuuugaaaucugaaaagaugaugaugaugauaaaaaaagaugcuaucauugguaaacagcuacucauuaaguaacucagauuuugaaguagguuaacuguguuauucagauuucuauuuuacaaaaauucaaucaaagauguaagaaugcauuccucaaaaaaaguacauaugugauuuuaaaaaaauguauuuuuaaaacuauaggccagccccaaaacugaugcugaaaaucuucaucuauuaguugaaauguaucuauuaguggaaaucucuaucucuaauuagaaccagaaggaaaacuuuuaggggaacuauuuacauuuuucguuuaggucaacuucauuuaguacacuuaacaugugcaaauuuagugcacuaauuuuauguauaucgcucuuuccacagaagaugcuucaaaagauaaaccaaaaguauccuacuuuuugucuuaaugcuuuagaaaacuuucuccugaucuuguguuuuacuauuuugcuuugacuuuuucacuucaauuccauuagauuauuaaauuaaguaugcaaguauuuccuuuauaucuauuaugaucuaagcaucgugcuaaguccauugggccuuauaacagaaaggcgauugauugccaagcucagcaagauaaguuucagagggaaagccaggugggaugaggggaaguagugaauggaaaguaaagaaauagacgccauggguaauaagcuguguuaggaaguuuuguacuaaaggagcaaagaaacaugggguuacagcuagagcauuagguaggguugagguaaauucaugguuaggagagauuagacaauguuucuggaguaagaggaaaaagccaguaaaauugaagaaauacagcacacaggugugaugggaccuuuuccuuuuuucuuucuuuucuuuuuucuuuuuuugagauggaguuuugcucugucacccagucuggaaugcaguggugcgaucucagcucacugcaaccuccgccucccaggauuuaagcgauucuccugccucagcuuccccaguagcugggauuacaggcgcccgccaccaugccugguuaauuuuuguauuuuuuaguagagacaggguuucaccauguugaucaggcuggucuugaacuccugaccucaagucaucugcgcaccucggccucccaaagugcugggauuacaggcaugagccacugcgcccggccugggaccuuuuucauguagagaguccagcaaggacaggaaguaaggauuaugaggaccccggugcaggguuuaaguuagggcaggaagagggacauuuuuuccucugagauuguagaaaagaaguuaaggguguucacacacaccuaaaaaucuuaacuuuuuuuuccuuccuauaaagaggagucagggucaucugagugaaagaggcaggcuuuauauggaggguacaguaaagauuuggaacaaucuuuguggagauggauacagaagcuaguuagggacaagugaaaagauuguccagaagaguaugagaauuaugcauauuucuuguaguguggauucagugguuauauauaguuuaagcaucacugaucugaaaauuugaaauucaaaauaauccaaaauuuaaaauuuuuucagugugauacaacacuacaagaggaaaauucaucugguuuaugugacagguugcagucaaaacagucaaaacguuguuucaugcacaaaaguauuuaaaauauuguauaaaauuaccuugagacuguguguaugagguguauaugaaacauaaaugguuuucauguucagacuuggguucccuagauaacuaauuauauauaugcaaauauuccaaaauucaaaaagucccaaaucugauucccagacagacuguccugggaaucacuucuguccccaggcauuuuggauaagagauacucaacuugcacaaauuuuagcagcuuggaauuucugcaaagauggaaaaugaugucauugauccaagauugaggauuaugcguggcagagcauagcugaugugauggacuguuuuucucaggcagaauugggaauggacuggaagucaagagggguauaguaaauucagagaaagaacugugggaaaagaaguuucuaugcauaugaagaacauugauaauaauccugaaagaauuagaagaacuauaaauuauaaagaagagaaaagcauuucagagguagauaaguuuuaagagaugaaaagacugaccaguguaaguuccucaaagugacugaauuucagcuaccccuggaguuacaaagugaaaguagcaugugauagaauuaaagaagaugagcagaacucagaugggugggaggaauagacccaacauucuuaaggauauggugcacuuuacuaaagauacaguuaaaauguaacccacucauugacuaugguauaaucuucuagguauagaucuaagguagaaaaggugcucagugcagcugucuuugaauucuuccccuaucucuugcuguguucuuccaauugugagugaauuuuugccuucacccuguuacuggaggucauugcuaugucuguucuugcuucuguacuaccuuaaaacguuucauuuggggcugggugugguggcucccgccuguaauccuagcacuuugggaggcaaaggagggcggaucacuugaggucaggaguucgaaaccuggcuaacauggugaaaccccgucucuacuaaaaauacgaacaaauuagcugggcgugguggcaggugccuguaaccccagcuacucgggaggcugaggcaggagaaucgcuugaacccaggaggcagagguugcagugagccgagauuacgccacugcacuccagccugggugacagagugagacucugucucaaaaaacaaacaaguuuuauuugacauaauuauuaaugucuuucuacucaaaauguaguugagacauacaucuuugcuguguuuuucuauaauaucuuaaguucuuuuuuagaagcaacucugauguuaaaaugaaagaguguaauuuauagaacuuauaaaauuuuuauuuacucaaaauucuguuuagugaugugauuaauaguucaggucaaaauccauuacaauaaaacuagcacgaaauaauuaucuucaagcuagcaccuaaaauauuacaaacccaaauaauuuaagagaaucauacauugugaaauccauuuugcuguaucaggaacaagacucaucccagagugauucaaacacuggaagagaguauacacuggaauuuaauauaaagcaucugaaugguguaauaagcucccacaaguaguggagaaauaaccaccuuuugaauguagaguagacuugugguacuguuuuggcuaugaaagaggugagcagugggcucuagaagcaucuguuuauccugccaaucaucaacauuuuguugagaaccuauaauacucaaaaucuuguaugagguacuacagauaaaaacaaauaauugggaguuuacaauuuauugaaagagauccacaugucaacauguaacuauuagacauugugauauguacaaugauaaagguagguaaaguguuauaggggacuuuugguauaaauauggcuauauagauuuagcauuuccccauuuucugaaagucuucuaagagcaacacagaaaauggaagacaaaaaugcaaacugaaauuuuagucaaacuaggaaacugucuuagucucuuuugugauacuauaacaaaauaccaaagauuggguaauuuauaaagaaaagaaauuuauuucucacaguucuagaggcugggaaguucaauaucaaggugccaguaucuugucagggccuucuugcuguguaaucccauggcagaaagcaagggagggaaagaaggcaagagagagagagauugaacuugcagucucaaauccuguaauaauuggcauuaauccauucaugagaauggaauccucauaaccuaaacaccucccuuuaggccccaccucccaacacuguugcauugcagauuaaguuuccaguacaugcuuuuggggggacacauucaagccauagcauagauguauaucaacauauuucucagggcugcucaaagcaaucaagaugaugcaggagcuccacaggaagaauagaagagaaaucuaaggaagagcccagcgguagcauaucaaaagaauccauacaaauacacuuacugaagaaggacacaucuagagauggaaaagcuauagccguuaucugcaauagccagcaggcaacaggaacccuacuggaccaacuuugauucacauuaguagaaaaugugaaaugcacaugaaaggacucaaauaagucacaauuugcagaagcaguauuuuuuguagagaucagaggaaaagaagcuaggcuugugaaaaauaacuugccuagaaauuugcccuccacuuaacgcuuucuauagaaagcucuggcaaagagcugguccuggaaaauccaacuuuuauaaugacauguuuaaaaaaacaaacuaguguagcaucuaaacagauacacuaaaaaaacaaagauuccaguaaaaugucaauaagaaaccauauaauuauauaacauaaauaaaauacugcaagaaaaacguuaaagaauucuagcaaaauauaaaugacaaaaaagaagcaacuauagccauuccugauaaaauuuucagaaaaucaggaauagaagaaaacucucucaacugauaaagggcaucuacaaaacacuugcagcuaaaaucuugcuuauuagugaaagaaucaauguucucccacuaaggucaggaaugaggcaagggaguuucacucucaccccuccaguuccacauuguacaagagguucuagauggugugaaaagagagaaaaagaaagaaaaggcacucagauuacagaagaagagguaaaaguuuuuuuucuuucaagauuugauaguuuauguagaaaacagauaauauuuacagaaaguuacuagaacuacugaaaugagcuuuagcaagguugcaggacacaaaaucaauauauaaaaauuaacuuuuucuauauauuagcaaacaguuggaaauugaaauugaaaaauaccauuuccaauagcauuaaaauauaugaacuacuuacagauaacguugacgaaauacauguaagaccuguacacugaaagcuguagaacacugcugaaaacauuaaauaaaacacauaaaugaagacagauuccaugucaugaguuugaagagucaacauugcuaagaugucuauucuccccaguuggcaucaauuaaaauucaaacaaguauuuugauagauacuaaaaacugauucuaaaauuuauauggcaugcaaagaauuuagaaaaaauaaccuuaaaaaagaacaaagauggaggaaucauacuaccuaauuuuaauacucauaauaaaacuguaauuaagucagugugguauugguguaaaaagagacaaauauagcaaugaaauggaauagagaguuuagaaauagacccacauguauauagccagcugauuuucaacuaagggaucaagacauuuuaaugagagaauaagaaucuuuucaacaaauggaaccaaaacauuuggauagccauauaucccccaaaauaacaaacauugauucuuaccuccugucauauacaacauuauuuugaaauagaucauagggcuaaauguaaaagauaaccuagaagaaaauauaggaagaaauuuuagugaccugauauuuggcauauauuucuaaaaaaugacacauaaugcaugaucuauaaaaagaaaauuuuuuaaauuguaccucaucaaaauuaaugacuuuugcucuucaaaagacauuguuaagaaauugaaaagucaagcuacagacugggagaaaauauuugcaaaauaauaccugacaguggacuuguaucuggaguauggagagaacuuuuaaaacucggcugggcucaguggcucacgccuguaauccuagcacuuugggaggccaaggugggcggaucaccugacguugggaguucaagaccagccugaccaacauggagaaaccccgucucugcuaaaaauacaaaauuagccaggcgugguggcgcaugccuguaaucauagcuacucuggaggcugaagcaguagaauugcuugaaccugggaggcggagguugcggugagcucagauugugccauugcacuucagccugggcagcaagagcgaaacuccaucucaaaaaaaaaaaaaacaaaaacaaagcacaaaaacaauaauaagacaaugcaguuaaaaaauagacacauuuaagcagguacuuaaucaaaggagacaugcagauagccaauaaacacaugaaaagucaauuucguuaaucauuaagggaacugcaaauuaaaaccacaaugagauaaccacuacacacucacuacgauggauaaaguuaaaaugauuacgcuauguugaccuaggauagagagcaaccauugaaaaugcaaaaugguaaagugacauaggaaaacaguuuggcaggguuuuuuuuguuuugguuuuuguuuuuugagauguggucucacuguguugcccaugcuggagugcaguggcacaauuauagcucacagcagucucaaacuccuagccucaagugauccuccugccuuggccucccaaaggguugggauuauaggaguaagccuaguuuggcaguuuuuuaaaaaguuaaagauauaccuaucauaugacccagauauuccacuccuagguauuagucaagagaaauguaagcauauauccaccgcaaaacuuguacaugugugcuuauacuaaguagcuuuguaauugccaaaaccuggaaaacauccagaugaccaucaaaaggcgaaaggacaaauuauggcauguccauucaguggaaagcuacuuaguaacaggaaggagugcacucuugauucacacagcaauauggaugaguuuuuaaauaauuauucuaagugaaagaagucaagauuacauacugugugauuucacuuaauauaaaacuccagaagauacagcuaauugacagcaagagaaagcagaucagugguugguuagggauggggcaggguuggaagaggugguggggagacaaggaaacuuuuggggaugaucaguauguuaauuaucuugauuauuauacauauaucaaaaucuuucaaauuauguauuugaauuuugugcuguuauuuguucgucaacuauaucucacuaaagcuguaaauuagagaaaagaaaaauuaaaaugcacaucagaaggaaauuaaacauacacauuuauacauacauuuuuaaaaacccaaugaaaaaaaucauuuuuaugaaagaagauucugaaacaaauauaaggauuuaugaagagaugcugagacuauacgagacaaugaaauaaaacauaauuugcagaacuuaaacagaagaaaugaaaucauacaauuggaaaaaacacaaggcaaauuaucauuuugguaagcauaguggggauauagagcaaaggucaccaacuauuaccuaugggccaaaucuaguccuguucauuuauggcccacaagcugaaaaugacuuuuacauuuguagaugguaaagagagaaagagggagaagagagagagagaaaagaauacacaacagagacuguaugugaccugcaaaacuauuuacuaucuagccuuuuacagaaaaaguuugcuguccccugguauagaagauaaaaguaaaaagcaaauaaaauaauagaaauuaggaaagaauugcuuacaauuaguuacacagaaaaugaucaugaaugauagcaguaagaaggagacacaauauuugaacaauuugaauacccagggaaaacagaguaauggaagaacacauuuuuaaagguauaaaucaggcacacuuuucaggaaaacgguaaaacuugaagcuacguguuugaaaugguaugcuccacaauagggaaaaacuguccccagaauagucaacaguaagacauauauuauaauaaaauuacuccacuguaaaaaaaaaauauagauuccuuugaccaagagguauaaacaucaagucaccuauagggacaaaacaguucacuuuggcuucaaacuucucuaaaaaaaaucagcuucaggugaugaaguaaaaacuguaagauccucauggaaaggaaguguaaaccaagacuuuuauauucaccaaauuacucuucacauaaaaagccuacagcuaaauagauuuaaaaguaggaaagggccaggcgugguggcucacgccuguaaucccagcacuuugggaggcugaggugggcggaucaugaggucaagagauggagaccauccuggccaacauggugaaacccugucucuacuaaaaauacaaaaauuagcugggcgugguggcaugcgccuguagucccagcuacuugggaggcugaggcaggaggaucacucgaacccaggagguggagguugcggugagcagagauugcgccacugcacuccagccuggugacagagcaagacucugucucaaaaaaaaaaaaaaaaacaacaaaaaacguaaaaauaggaaagaacucaggaaauauucucauggucucuuuuugaggaaacuacuagggaucaaacuucaaccagcaagagaugucugaaaauucuacaucaaaggacugaauguaagcauugacuguauuuaauuaaagcaaaaagccuaaaacaaaugugacauuagacaccaaacugaauguaaauacccuggcaauguaaaaauaauucggcuaaccaaaaaggaaagucaagggugauagaaggggaaaaguaguuugacguuugccucaacuguaauaggagaccaagaggugucauuuauuugauuuuagcauacuucuuaguacuaagguaaacacugagaaggaucauacuguugauaaauaucaggggaagaaaacggggaagaaaaaauaaacaaauuuugccacuguucagaguaggaaauacauagauccugucuaaagacagagaaagcuaaaaauauuauauauaguuaucaucauaauggaggucaccagaaaaaaagaaaauacaauguaucauuaaaaacuuaaauuauaaaaguaaaggauaaaauaaaaugauugaacuaaugucaaacauguauaugacaucaauaaagcaauaauuacaagugauacaugaaaaaagagacaaucauacuaguaauaggaaacuuuaacuuacucucagcucagggauaccuaaacaaucaauaauaauaauagcaauauacauauaauuauauauauauauauacucugcacucucaaaauagaguauguaaguauguauuucucuucaaguacccuuggaauaaucguauauacuaggccuauaugcuaggccaccaaaaagccugguggagaaauuuagcagugucuauccaaauuauaaaugcauguaccuguugacccagaaaugucacuuuuggaaauugauuauauggacauauucacccaaaugugaaauuaccuauuuacaagguuguuuguauaguaaaagauugagaagauccaaaugucugucaauagaccugguuaaauacacuuuuuuacaacaauacacuggaauauaauacagcuguaaaagaauaagaagcucuuuauacacuaaagagaaaaaccucuaggauauauccuucgaugaaaaggcacgauucaacaauucagaccauguguauaauaugcuaccauauuucccuaccacaaaaagugggaaaaauuuguauauauauguauacacacacacacacacacacacauauauaugugcuuauauaugcuauauaaacacaucuccagaaagauuaagcgagacagugguaucaguggucacauauuaauggaauaugaauuagacaaguggagaaugaaguaguaaagaggcuucauuuuaauauacuucuaaacauguguugucauaugugacuauauuaccuccauaaacaugugaagagaaacaaugccaugacggcauagaagauaaagcaauuaguucucccuuggggaauuggaggagaccuucaggauagauaauuuaacugagacuugaagggugaguggaauuugacaaauggacaagguugggaaagucauuucaggccaaaguauggaaacaugaaaauaagccugaggaauaguaaaugugauugggcauugagugcguuaaggacacagucgaggccaguuuacccucaagaguccauugaagcugacaccuagagcucugaacuagauagugcuacugccuaaggucagaauuccuuccagacccuguacucuguagguggggaacagagucuugagagaaaagagacaagggcuguggaggcuggaaacgagacccaguucaacagagcagugccuuguucauaacacauuugauccauaaugcuucaacaaaccauuggauuuucuugcacugucuugucacuacuaaucagaacauuacuacaggauaucuaaacuuaaaugcacuccuugaacaauuauucaugaggguuugcuaucuugacccuucuuuaagaaauggagaaugcugaauuauuacccuaugccaguugaagcuuauuuuuacuuacauuugccuuaaugguuugcuuucccauaaagccucaauuuauaccaguggacgaaaucacugucacuuccaccugccuaacuucagcacauaaggugaguaauuaauauaggauuaagcaauuugugucauguuuuaaccaugugaaggagaagccuuaucaagggccaacugucaucaugguuuaugagguucacauagugaagcacuaguagauuuuaacugccauuuuauucuuguuagaguaauacauguuuauuagggauaaguuagaaaguaaaauauaaauaaaauuuaaaucacccauuaucuuacuuccugcacauaaaaaccuuuuuaaauaauguauuucuuuccaauacuuucuagggauauauacauauauauuuuuugucuauggaugugaauuugccuagaaauauguuguauauauaguuccuauaucauuucuuguguuugcuaaaugucauguuacguuauauuccucaaaugucuguucuuauguagaauuuaaaauuuagagaggaacauuuuugagccuuuaguuagagcuucucaguuauaucagucacacacaaaaauauggaacucuuuauaauuuuaauuauucacauuucuuaacaggcagacgaugggauuuauaaacucagacaaccuuuaaauaaauagauuucugauauacauaauguauuuuguaucuuuggcauuucuuuacuauucacuuuaaauauuggaacaguuguuuccaugcuaucuucuuaguuuguguuuguguuuuuuaaauuugcaccuucugcuaguauaucaaggaaucagagaccaaugaacccagaaauaaguuggagcugguauagucuuauaauccaacucccuccuuuuauaguaauuuaucuaagaucaccacauaccugaauugcagaaccagacuuagaaccuacccguuuuguaauaaauuaucaccagagucugagagcaagaugaagaaagggauucuucuggaguggagagcaguaaaaaucaccugcaaguaauuugccaugggaaauagauuguaacaugucaucguaaguccucuguaauaauaacauugucucaugccuugagauuugacuuagccaugaacaaacuaguauacacaacuguaucauaacuuuacaaaauguuggugguuuaugugaaggaaaaugagagcuaaagaguuucguugagcccucagcacuguugcggagaggguuacuugacuaguggacacuaauacuauggaggauaaugauaugcuuaggauaacuagagugucacuugguggucugcccucaacuccuguccuucuaauaguuauuuuugguuucuuacaaaagagaguaggcucuaacaagcaggcacauguauucuagaucucuuagcaaauacaucuuucauuggcugcaguagcagcuagcaaggggcaggaagcaggaugugaauguggguagggaugacgaccagccuuguuugcagcggggagccaaaggcaagcgaaccucuauugggggaaagucagaaugcacaguauguucucaauugcugggcuuuuuauuccucaaaaucagauuucuugacccagcacaacuuugcagcuauuuaugaaucaaauucuuaaugagccauuguggcauuauacauuauuaaaguuguuucuaagcuucugauuuaaaaacuuuuuaguaguaauaagaaauaccuauuauaaugagguuaugagagaaguggugauuaauuauaaauaggcuaucuaccaaaaaauaaaaacauguucuuuguuauuuaaggaaaauaccaaaacccagaaaaucaggcuuuugggcgaugacuugaagcaugaaucucuuucauccuuugagcuuucagcgagccguagaggacagaaaagaaacauagaagagacagacucugauguagaguauauuucagaaacaaaaauuaugaaaaagucuauggaggagaaaaugaacucucaacagcagagaauuccaguagcucugccagaaaaugucaaacuagcugagagaucccagguauuauuauuguuucuuauucacaaaacaauucacucauucuggaaauagcauucagucaagguuuugcuucauuuucacauuuuaagacacuuuaauuauaaaauauacauugcaaucuguguuuccuggacaaggucccaauuucuaauuuuuuuuucuguauucucuguuuugaaagagaagucagauugcuaauauuaccacugucuggagagcucaaccaacugaagggugccugaagaaugcccaggugggaaaaggcuuuuaaauuuguauuuaagggagaaauauucauauaggauaaaccuuuaaucuuuaaguuuugcauucaaugcuuuauaggaaaaaugcuuaacuaaaucauacauauuguuacccuguaaucaagguucugaaaaaacugggauauaauguuaauguauuacuaaguguugagagucauguuaacaaaugcacaacucuagaauuuucauguguccaaaugaguuuacuucuuugaaaagaaucacaacacauuuauucuuacagaguugccauuauuuaauucuuuuuuuuugagaauuugcccucagauucagcuuauaacaauauuaaugccuacaauugaaugggcauuuacccugugcuaggugcagugcugaaugauuauagacaucaucucaauaacuuucauuuuauaucuucuuaagccaaaauuuacugccuaguuuaucuaccuuguccaucacauuugacuucuaaugcccuuuuacuauuuccacaaauuaaauucgaccuuaaagagucgauauuguucaccauagaaaauauucaaaugaacugcuauaggcucugaaagccauaaacuuauuuaauuagcaaauaucugcugaguucugcccaguguaagacaguggguagucauggugggaguguagucauggagggaggcaagauauuuuaugcauggucuuuucaaaaggaauuauucuuauucuuauucuuauucuuauuuuuuuugagacgaagucucgcucugucgcccaggcuggagugcaguggcgugaucucagcucacugcaagcuucaaaaggaauuauuuugaauaguaguuacauuauagaaaucucucacacauuccuuuauaauauauucggcaaaugguauacagacucucugaaaaucuuuaguaaaaauccuuaccuccuaaggcagccuuuccuuaauaccauuuuugggcugcucauccucuuaaaguauuucaaguccauuuuccuaugauuuugaaauuuuugcccaaaucuuuucuugagacuauaugagccaagcugaaucuguuuacaaccuacagaauuucagguuuuuuguugauuugaauuauguauuguacuugaauguaaaguuuuauauauucagauauucaacccuugcuguguucgaacuccugcauguuaucacuuuauaaucauaucucuuuuaacuuggaauuccagaaaaacucauuagcugugcaguuucaagauuuaggauuugucaguuuauuguauagauauguugcaugcucuaaaaacauacaguccauugagaaguugggaguguguccaaguauuagagcaaaacauuuuagacauuaaauacagggacucaguaugcaugcgugugugugugugugugugugugugugugugugugugugcauacacauauaauauguaaagcuaugugaagcaauauacacacacuucauguagauauauauacacauauauguauacauauaccaauguaaacauagaugugucuguguguguauauauauauauauguauaauuuuacugugugccauucaguaugccagucacaggagauuugcuaauaaaaccacauaugguuuuugccaccaucaaacuuacagucuagugauagagacagacacccaauaauuacagagacaaacgucaacugcuacuauggcaguuuuuaugacacaguagcaugacuguuuauaauaaggguuuuugacucugauaggacaggaacaucuucccagaaaauaugguaacuagccuuuuaggauugaaauguaauuacauugguagaaggggaggaaaagcacuucuaagcaaugagaacagcauuugcuaaagagggaauauggugaauacaaagaacuuuaaaaagacaaguaaucuauggcagggaaaagagauggaaauggacuguggugugaaggaguagggcagguacuauaggccagucauaagggguuuugcauuuauccuauaaguaaugggaaaccauugaagaguuucaagcagggaagugacaugaccagaguuuucuuuaguaaagauugcuuuggccgaguauagaagaaagguuaguagagagcagaguuguugggaaagacagucucagggguauagccuuuuagccuccacuuugaugcauaaagauggaccuugagccugggacucuuucuuaccgagagauaaagagcacacauggccuaugcuggguuuuuugccuugugcagaaauaucuuucucuguugcaagcccaguguaugcucuucuauacugcuuaaaugcgugugucacaugaaaccuuggucaaccccacugcuauaucugucuuccuuggggagggaacacagcaucugucuccuguagcaugagaagggugcauguagccaauugcccaacauuggcugauggaggaggcugcugggccaugggggacugauacacacuucugaggcugaucuugcuuuaucucuucucuaugugaguaaagcauuguuccaucuagugccugacugcguuguguuuucuuuggcaacuccaauaaccaagauacuauaggcagaaguuaugagacuccuccucuggaacugauaaccaguacaugguauuucuguuucacagauaaugcuuaacaaaagugaaugugggcagagcaguuaggagacuugaccaugcucugauggagagaucacagugguguaggcuaggaugauggugauggaggagguaacucugcccuuuccuggaggcagucuuuauuggauauagaggaucauguagaggaaaauggcagaaugacuacagaauuuugaguucuuucaccagguugaauggugauuccauuaauugaaauugggaauuguagaaggugacugggcuuguggagaacagcaugaguucagcuuacauaauuugaggcuuccaagaggaugugccaagagaaaagucauauacaugagucuggauuucagaggugagguuuaaauaggagacagucuugugagguauuuacauaccuaaggaugagugagguugaauggguaagaagaaaagaaggacuagacagaagcuugaggaauuuuagcauuuuguggcuagcuacgagaguauagaugugcacagagauugugaaggaauugccagagcaguaagagaagaaaccaggaauuuauuauuucauuaaagccaaaaugggggaaaagggugauuugaagagagacugucacgaaggcuaaauucuguugagaagccaacucaacuggccaaaggccuaaaaauugucuguuggcuuaaugauuuagagguaagagggaugaucucaggaguauuuuuguuguuggaguagaaaggguagaaacaagauuauagauucgugcaaaaguaauugcuguuuuugccauuaaaaguaaugaauuuacugcuaaguggaagaugaagaaauggugacagauuguauaucagcucuuagaaagauaagcuaauuucccaggcgugguggugggcaccuguaaucucagcuguucuagagacugagguaggauaauugcuugaaacuggaagguggagguugcagugagccaagaucacaccacugcacuccagccugggugaaagagcgaaacuccaucucaaaaaaaauaaaaauaaaaagaaagauaagcuaauuucacuccagaagacauuauaucuuuaagaaaaucuagaaaacccaauuuucuccuggauaaaucaggagauugugaaauucuuuauaagcacuugaaaaaugaauuuaaucagauuuuaaacuguaauugaaacaacauuugauuacucgaagauuacuuguaguaaauuucuaauauccuguccaauaaacacacuaggcauuaccacuaacagagaaggugcaggaaauauaauuaauuuuaauauuaaccuaagcagcauggcauuaggaaggcagauaugcucuaagucuuaucaagcgcuuaucauacacaaagaucggaaauugaauuuucgcuauauauccuacaaaagucugcaguaaguagaggcagaaugaagagugaagguaguuuaguauguaccauugauugccacuaauccuuguauuuuuuuuguuaauuccuuguuauaggccgcuucuugggaaaugaaaaggaagcagagucugaacuuuguagaggaauguaagguauugacugaagaugagaacacgagugauucagauauaauccuggugagauaaacuauacacuaaaugacaccuugagauuuucauauucacaaagauuagagggaucuguuagugucucaaaguaguggaaacauuuaguuggaaaaccuaguuuugagaugaagaaauaagacucagaaaaguuuaaguuacuugcucaaggcuacauaaacuaguagggauauaucuggaacuuacacaucuccaccccuaguccacggcaccuuucuguuuuaguuaucuggguaagaaagccuuaauauauauguaaauaggcaaaaauauacaaaaguuauauauauaacuugaaggucauugugaaaacucauucccaaauccgaagaauaugaaccuuucuguaauuuguaauuuggacucucaccagaagguuuaauucugaauugacuuaaauuaggcagagaaaaguguauucaaggauuauuggcaugcuccccauuuucuccuuuaaauaauauguucguauuucuaacuugauaguugauaucaaagaauacauaucugggcuucuguagaaucgaguugcuuugccuucacugaaccaaguguaaaaagcccuugguguuuaggaggaaaugauucaaggacugacuauauaagaaaugcuucaucugugaagccaugguguucauuauguuauauaguguccuuucuguuaaaaaaaacucacuaaaaguaauuuacacauuagaauuuaaugucagggaaaaaucuauuugguauuuucuuuuaucugaauauaaauuuuauuacucauuauaguuucauuuuuaccuugauugccaagaagcuuauagcuaaacuuuaacccgcguaagaguaacuacaguagccuaggugguucuauuauugacaugauaagugagaguauuuagaaaaggaccuggccucuuuggacgugucuuuaggguaaggucccucaaaaugcuauauagauuuguggauuagguuuaaauugcacuugugccaaugagagacauaucauuucuucugacuuuagcuuaacuuaugauaauguccuucaccagaaaguuauugucacaagguaccugauguaacuauaaugaaaguuuuauuuaaaaauuuuuucauuuuggaaaauuuuaaacauagugcaaccaacuccugugugcccauuucccagcuccaguguuuaccaacuuguggccagccuuguuucauccauauucccucccugcccccauuauucccagacaucauaugauuucaugcauaaauuguaauuauuugaaguagcccuuugaagggauguuaaaaaggugcagacauaauuugugaaugggaacagaaauagccucacuauuaacaauaaagaacaacuaaaugaaaaaaguaaacaccaaaguauuuucaaaaggaaaagggucaaaauuuaaucggaggcuagaaagaaagacaaaacugcaacugguguuguaaauaaugccgccucucuugaccucuucaaagcaaaauguaauauaauuguaccugugaauauuacuguucaccacuugcuuuucagaaguuucaaagucugugugaguuuuucauggagcccuuacuuugucaccucucucagcuuugcacacagcuuuuggcaagugccuuuucaggaauuagagaugauguuuauauuuaaaauauugucuuuuuagguaauaguucucaaguucuuacauuacuuguguguagcuaugugguaugauuuauuagugucucugugauccuagcaggaugucuguuuucauacucauggugucuaauuaacuuggauaaacacguauuauccagagaugcacauuaauuucuguuuggcuguaguugcaauaauucaaguaggaaauaauugcuccucaaaguugucugucuguacuuucuuaaaccuagaaauuaaaaaaagaucaucccaucccccgugcuccuuccuaauuaucuucuaauuauagcaugugucugugugcacgugugaguguaugugccccugugucuauuaaauuucaagaaggaaggcacucagugcuaaugguggugcaggagguugucacuuaaggaagaauaauuagcuaccacaaaagacucccuccccugacccccaaaggugguauuuauuauuuuggcaaguuuacugguugugggaccuagggucuuauuuuuagguguaagaaacuaagaaauaugguauauucagcacaccaaagaaacuucaucucacggggaugacuucacauuauccaaauucaugaaacugugguauuauagcauaacaucaguucagucauuuaaaagauaaauacagcuucaguucaacuggaaggcacauauugacuuaagcuaugcguucugucccguuaugcccaucugcaugggcuggccaauuauaaucugacaguugcuggugagcuaggugccugaauauuuaaaaggcguccagcuaagacagccugcuguguccaccuccccaagagacaugacagagaugauguuaccaaugcaacuauaauacuaaaagagcacugacucagcgaaccuuugcccuaugccuaccugugcuccuauaacuguacuuuuuuucaggcuuucgggacaauaacuccauucugacuggcagauuuguuuuugcuauguuaauaaaaucaauaaaugucuaucagucugccuuuugaaaggauuuuuuuuuccauauuaaggcacuuuauuuuucucuguuccauguuucaggcaacaucucacucugguucuuguacuaauaguuaugcaauuucuagugaaaugaaaaaaaaaguauuuguuacuuuccagauucauauuuaacccuaccauugcugauuauuuuagccaucugaucauucauucuccaaaauuaccucacugcuguagcucacuguuauguuuuauuuauuuuccuaacuucccucccuacccccacugagucccucaauucuugauugaaugcucuuauuguuuuuauucuaaggccuguggucuguugaagcaauuuuuuauuuuuuuauuuuaccuuuuaaauuuuuuugagacagagucucccugugucacccaggcuggagugcaguggcacaaucuccacucacuguaagcgauucucuugccucagccucccgaguagcuggaauuacaugcaccaccacauccagcuaauuuuuguauuuuuaauagagacaggguuuuuccaucuuggcaaggcuggcccaaacuccuggccucaagugauccacccaccuuggccucccaaaguggugggauuacaggcaugagccccaugcccagccuuguugaagcaauuuuuaaaaaccacauucuucuuguuuccucuuuucccagugggacaauccuuauuuucugaucauuucuaaugucuggcauuucguucugcaccaugccucccauuuaacaugcuccaagucauucaugugguguggagcuucauuugucccaucucuaguuacuucugcucauauucuuuguugguauugcuuccacagcauuuuuuuuuuuuuuuuuuuuuuuuuuugagacagagucucgcucugucacccaggcuagagugcaguggcgcgaucuuggcucacugcaagcucugccucccagguucacgccauucuccugccucagccucacgaguaacugggacuacaggcacccgccaccaugcccggcuaauuuuuuuuauuuuuaguagacacaggguuucuccauguuagccaggauggucuccaucuccucaacucaugauccgcccgccucagccucccagagugcugggauuacaggcaugagccacuacucccggccgcauuuuuuguuuuugauauuaguuugugcuuggccuuuuagccagugugaaccauucauuuucaaaguccaugcaaugagcauguucuuggcaagaccuugcacaucauuuggagcuguagaaguuuccaacugggauuugguuaaagcuccaggcauuuucuggagauuaaaaaacugccaggaaaauaaugaggaguuuuucuuuacaaaaucuuaauccuuuuccaaaugcucuagauagccucucaguuggaccuucggagauauuugguaugggacucugcauuucagcaaacuucuuauuuuucauaaucuuguuagcacagcuacagcucccuccaccauuuuaggguaacuagggugguucauauuuauuaucucugacccuauaaagcugaauuguccagaaauucuaguugugugugugugugugugugugcgcgcgcgcgcacgcacgcgcacaugugcacaggcauguguauugugguagcgucaggcuuuucucuuucuguguggccaugaugaaauucagguacuguucuuccaucaucucaucucaccucuucauaaccugagaggcaaguauucuuuucaccccuauuuuacagaugggaaaaauuaaacuugcuaaaggucacacugccaggaaguaggcaccuugagccccagcuguuugacuuugcuccuccuuuuguaaucacuccccauaugacaucucccuuuaccucccaccuucauaacuguccccuacaugaauucaaucaccccauuccacuugggucaguugaaguacauaaauacacuuuacucaggcaugagaguuucaagguccaccgauauauggcacuggcuaacauucagcauuuuggcuuguguuuccaaaguuuuuuagaugggcaucuccagccaagugucuugaaucaauuuuaaaagaccaauccaucauccaugccuugcccagccuaagcucucuuuagcccguuucccuccauauucacccuaaaucugaccuaaacaauguauuaauaguucuuuucuucuaagacccagcuuuuguccuucuagucaagcuagaguccagucauagucaugaggcucaucuucuuggggucuccacuaauuccuggcuucuaaaaaaagaaaguauuuuucuuguccaagauuaucacucuaguaauaugguuguggucauaacuuuaccaccaaccccuuccaugagcuguuguugcuuuaccuuuggccuccagaaaaucuuauuauuuucugucuuccaugcucaaaacacauguccugcccuguuuuuuaaugaauaguggguauucugaaguguguucugucucaggcauuuccaaacccauguguaaaguucaaauuugucccaguuaaucccggaugggaaggaaguggaauuuuuuuuaaaucacaccuuuuauagguaugcuagccuuugucaggaggaucagugucugaguagauguugcuauaguucugcuguuauugcaagaacaguguccugugguacugcuguaauuaaggguuuguuuagauauaguuacaaacuccugugcacugcugugugauaaacuggcaguucaacuuuacuccaggcaaacuccauaccacccuggaucugggaauggaucugguauuuuccaugccccucaaaagugaugcacucugaucagguguuacuauacaaugcuucauaaaaacgauaaaaguacaaaugaaacaaugagauuagauaaucuuacauccuaucaaagaaguaaacagcucauccaaauuacaucaccaggugagagguaagaaguaaccacacagacuaaacauccuaggggaucuauucugaaaggugacugggaagaauagguuggcagaccacaauagauggccaggaaagcaaaugaucaauuugaaaugagccgcaaaacugaggaacaccaggggaauaaaauuaccgaugccagcaguuggagaaguugaauagcaauaaugugcugaggcucaagacagagcgauaaaaguacugacuuuauuuaaaaaaaggcauguacaugccuuuuuuucaucuuggaggaacacacucuccaaaccgacauuguagaaauuuucuaauucuaacaugaagcaacauauacccuucucauaaauauugguguuuguuguuuauucauauuuuauaauaauaaucuuucaguuacuauucugaauguuagaggcaaacccagauuugcuaagacaugaaagaaucuguauggugugguuauaguaagguuagaauagaccuucuauuuaauaaccaggaaccauacaauuuuuuuuauugacugacuggcccuuuugucucuguggucauuuaggucuucuuuuggcuugcagcuggccucaagagcagacugacagagggauguguuucauuuucccaaucuauagacauuuuuaagcacgugauggucagaacacugcugacaaaaguauuucaggaguuuggcaaugaaaccuuguauuuauuaugaaacauguauccucuggugucuagaacagagcacuuucugaggcucaagaaagauacauagcaaugaguagauggaaccaucuuccugucucagaacugagccaagucauuuaccaguuguaccuggucagcucuuuggggaagcuuucaaaagaggcagauuccagcuuagaaaaagcaucagugcacucugaaucccuaagaucauuaccagggccuucaugguauguuauaaaaacuggagaacaucuagaugagcugaugaguugcuaccgugucuagguuuauguuuuaugguggccaaaacaaaugaaaaacaacuauaaguacuguguuuggcaucaguacuacaugauagcgaaucauaacaaugagacugaaaaggugacaaaguaaccuaaaagcagauaaaaaagaaaaacaaaaacuugcaaaauuagucccuaaaucaacugcauucacccuagauacacaucauuuuucugacucccaacagaaugccuuuuuaaaauagaaaacuguacagguaguacaauaacauaauuucagauuacugaaguugccuuaauuucaaaagcgggugauuucucaucagcuuugaugaugcuaccauuccugguugaugaugcuaccauuaccucuuuaugaaucuguauaaugcuaugaucauugcuaauaauacuagacauuucacgggaagcccucuuacaaaaugcaaaccagagcugcccuaagggcuuugaaggaaagaucaucuauacucauccuccacaggauuguucaucaguucuccagcaaacguacggagagacacaaaaacaaugugugauauagucccugaucuaaggaaaaaccuuguggaugacuuauaaggaaucuaaauauucaagugcuaaagucugaacuaccagcaaccacgagccaauuaaucaaaacaaauuuauugaacaauacuauguuagacauuuuugagggacaccaaaaaagucaaguaucugauuguugugcugaaggaacaaaaaaauugguuaagacaguuuuacaacaccaugagguaguauuauguuauggaaaggauacaggcuguacacucugacaggcugacccaggcucaaauucagaccuccaugagguuugucaguugugucaaauuuugauauucuguuuucuuguauauaaaacgagaguaauaaugccaucuauucucaagguuguuaugagaauuauauucaugauagaaugaaaauaauuauuugcauuauaaaaaguauuuuuuaaagccaccuucuguaauucugaagaagacaaauucagccuuuauugggugagcuaggagaaugaaaauugacaaaguaaaauuucuuuguggaaaaagagagcuuaaagagugagcuuauguggaagauagaagaggagaggggcacugccaaaagugaaaauaccgggagcugcagaacuggagaagcugcaggugugcagagagagaugaggcaguuagcagaugaagaaguuaaaauuauuuaguugauacaauuuuuugcuacauguaaucauuuccuccauuuuccaauauaaucuuuaguaaaaucuguaaguuuaucaaagcuuuauagaguuggauuuguuuuugggagauggagucacguuuugaguuuugcuuagaaggaucaaguaagaauccaaggcugcuguaggguccagucuuaucugggucauauagauaaaaugcuugacuugaugacaguaguaagaguaaauaaacuguaugcaacuuacuguuaauaguuauucagaggaaggaagaauaugugcuggaguaauaacaaaaaagauguuuuggaaagaguaggauguauacuugucuuuaaaaguuguggauacaacuuuuaagaaaggaagagaagagagaagccauuccagguagaacauuuacauggcagagauguggaagcaagaguguguaugguaauuuuagggaacucugaagagaacauuuugauuauaacaagagauauuuguuaagaaauacuaaaauugugucuggauaacuuagaaucacauugaaaagagcuuugaaagacagauaaagaguuugugauugagauaguagcaugcagggccuagggaugguuuuaagaaggaacacuuaaucauggauauuuuguuuaaaaaaauuaaucagauugggauaauggcuuggacuguaaaaaggagaaacuaaagaccaacaaaaacacguaggauggaugcuuccugaaaaucguaguauagaaagacaagaaaaacuuaagcaauuuuaaaagaaagguaguacagcuugguaagaaauauggaaaacuaaauaaugaaagcaguucugagauggcaaucuggaacaaaaacaguacugugaauagaaugaagagcauugauggggaaucugaccaaguggucaaagauaggacuggauaggacugaggauuugaaguuucagcaagacauucacgugugucaugagaucaguuggaaauaacuggagcaaaggugaaaaguuaggguugaugaugccgaugaagccauuguuugccuaaagugugacagcuuaacuccagaaauuuuaauagguuccuugagaaguugagaguagacagaaaaaggaugaacuacccagagagaguugagacauagaaggcuaugaagaucaagagaggaaagaauuccaagaaauaucuucaugcuuccuuaacugaguaaaugauaccaccauucacugcuacucuggccaaaaccugggaaucauccugaauuucucuccuccuuucucauccugcacucaacccaucaggcaaucuugcugaaucaaccuuuaaacauagaacauauucuaccaccuccauagcuaccaccuuggccaacacacugacaucucuuaccuggacuacagcgguacuccuauaaaucaucuuacuguuucucuuggccucuacaguguaaaaaucugaguauaucauccagaauaugucauauuaugucauucuccuacucagaacacuuccauggcuucugcucauacuuagaacaaaacucagugacuuugcuguggcccucaaggcccuagauguccuggccugaugucuuuugaggcuacagaccccacugcucauuccuucucuuagucuacuguagccacccugaccauuguuggccuccaguacccuaaggaauauuaaauaaauaaaaguauaaauauguaauauaauaucaggucauauaaauucugugaagaaaaauaauacaguugagagagagagagagagagagagagagagaaagagagaaacauaaaccuaagccuuuuccuuugucguucauauaccuggacuccacuacccacaccacccccaucaccacugucagcagcacacauguauuuucaugacuugauuuuuuuuuacuuucuuuuauucugugacuaucuugaacaucaguuacuguccuaaacaauagggauccagcagggguaaaaacagacgauccucccugccuuugcagagcuuccauucuaguugggggaucauucaauagacaagaugaauaaguaaauaugguguaugguagauaaugacaaguauuagggagaaaaagaaagcaugggaagggaauaggaaguaucuguguugcaugugaugaacaggaguugcaauuuuagguagagugaccgcagauggccccacugaguggaugcuuaggaaagacuaggaaaaagcugggggaacaaacaagucuauaaaacaacaagccaaagacgugagaggagugugccuggcauauuuguaaaagagcuucugaagagccagauggagaugugagaugacgacagagaggugggggggucagauuaugcaggaacuugcaucacucucucucaccuguguuauuuuucuucacagaacuuccauuaccugacaguauauuauuuauauuuuuauuuauugaauguagaaaauguguuccauaaagguagguauauuaguccauuuucauacugcuaugaagaaauaccugagacuggauaauuuauaaagaaagagauuccacauggcuggggaggccuccaaucgugguggaaggcagaggagaaaaggcaugucuuacauggcagcaggcaagagagaauguguaggggaacugcccuuuauaaaaccaucagaucucaugagacuuacugucacaagaacagccaggaaaaacccgcccccaugacucaauuaccucccaccaggucccucccaugacagguggggauuaugggagcuacaauucaagaugagauuuggguggggacacagccaaaccauaucagcaggacuucgaacuuuucgccgugguaguaucuggcccacacuagaaacccaauguuagugaauaaauuacugacugaaggggagggccuggaacauaauguuaacuguggacgagugcaaacagaaggggucuuugaaguuggcagaaagguauuuacuggucuuauaguccuuauggcuccuucauaauaauaagugcuugaaguagguguggagagguaaaggaguagaaguaaagaaaucagauaaagugauaucacucaguuuuuaaguuuccuuaacagcaaugaaauuaaauagguguugcacagcugccuguggcguguucuuuuuuccucugacuuauuuaugauuuauuuaucuucuuaaguagauacuuuacaaaauugagcaugcaguauuauguugauccaucacaucccuuggagaacugacaaaucccauccugcucauuguuaacauaauuuuaauuaagaugucuuaaacucuauguuaagacuuagcuauaaucucauuuacuuuguaugagguguugucuauuucaugauauagguaaaaaucucaggcaagagauuuccuccagcuucagaauaugagacacaguuaagccuaagugacugaagaacauuucuauaaggaaaccaauuaauguaaaugaaagaccuuuguaaguaagaucaaauauacaaauaacauaaucgaaaaaacaacugucuguuuucuugucucaucuugaaaaaauucagacccucaacuauauuguaauagaaggcagcauccuauaaaaucagauuuacacaauguuauuucaaagaaaauacuguaggcuuuaaaucauuuauccaaaaaucuuuuaaacaucagaauaaagauaauacagcaaaggaaaauaaaagaaauuuuucauguuauagagauggcagagcuuuguacaaguaacauuuuuggggaaagaaggcauaucugauccuaggaaaaacagcccuuuagagcucaaagcagagaacuaaacaauagaauacaaacauaauuaauuucgugaggcuguauuaauaaaaccaacaacaaaauuucucuucugggagugcugucauuuucauuaaccuuggauacuuucaucuuguuugauuucaucauaaaagaaaguuaccaaagaaaauuaacacauuuuguuauaaucaucauggauuauaacaaagugcuuauaggaaaagacauuaaauaguuccucucauaagcuuaucuugugguuccuauuagcuguuguugauaauagucuaugcugcuuauaaacuggucugaaaagucuuuagucugaaguuggagacacuuaauaucauguagauuuuccuuauauaucagugcaucagaagaaaacuuuaaauuuuauguuaaucagaaguaaauaaaacauacacuuuaaggucacuuucaagauuuuuuucaaaaugaaucuuuaaaaauaugcauguuuauuauuuccuggggcaggaacuuauuuacaguuuaaguacaaaaauuuuuugaaauagacaaaaguagcuuagaaguagucuuauuuauuuuccccuuauccauaaggcuuuucuugcucuugauuuaggugaaauggaaaauggcaaugauaggcagcuacacaguuauuuuguugcuaggcuacacaugugcccauuuaaccugcuuccugagagagcacaguuuccagaaugcuacguaaaaauacuccuuuauuuccugggaggggaaaaaaaagagaguugacauccucucuagacuacauuuguuuagcagguuagagagggcaugaaagaugaaagauauguccacaaugagcaaacuucaaaaaaccugacagcucccuaucuuacaugaaguaacagauggggacaugguugcgugcguaucagugcguguucaggggucuucggaacaaggagcagacaggagcuuuugccuucugcuugcuuucuucauuuucuuucuuucauaacugccuguuccuccagcuucucacaguuuuacaaaauacauagagggagcauucugggugucuuuccccgcaggcauaaacagacacauucucucucucucucucaucuaagguauauucccaaaguguaagucagcuuuaugugagccuuguaaaauggaucuuaacaggauucccaaagugaugauauaccuggcuuauuaaugguacauuccaccccucaaaugucccccauccacucccacccucucagccucccaaucgcacaccagcacauauccauccucucucuccaggugccaguaacccuccuggcuccaacaaucaacacacuaaggcucugcagccccuuucaggcaacuggccugggauucugucagaagaugagauaucccaucccccaguauuccaggucaacucccuuuccccaucuucuuaucuauuaugcuuugggacuacaggccccagccccaaacucuucaaaguuuucauugcagggaugcugagcuccuacucugucugcuuugcagcaaccagagguacccuaagcuuccucaaaacgauagaggcucaaugguuguugcuggugaaucaaauacuugacccauuuguuguagacauuguuacaucaauguguaauaucaauuuuuaaaauaucugcacaaauauuaguagaaauacaaaaaucccuuuaaagaaaucaaaugaguaaacaugacuaugauaaugcaaucauccuugagauuuaugcgauuaucguuuuguacauguaccauuuguucccuuuauaaaaagugcauagcuuuacugcugcuaacauuaugauuucuuuucugcuggggacacugcuuuucaaggucuuuugucaaguuuauaauauguccuauguuuuuguacaguuuuaaauaaagagcuuguuuuucagguuucagauaaaagcaacacugauguuucauugaaacaagaaaaaaaggaaauuccucuuuuaaaccaagguaaaaaaaaaucagcucauguauauauauauauuagcuauaauguuugagacauuuucaauauggcuugacagccugauauauagaucagaaguuugucagcaacuuggauuuuaaaaaauuaaguuuguuguucuagaagugagaggaguagagagagggugagcugccaaccuuguguguuuugacggggcagagagacacuuucuggcugaggacaguguccccagcacugccacacugccugaaauuuccauagacuuaugccacucucugucuugaauucuccuucuaauuuugauuaggauugauaucaggucaauaauuuucaaaaucuguuuugaaaauuaugaugaugacaguccccguuuuuucaucuuuuaguaacuuucugcuuuucgugauucuucugaggucccuaaaaguaguucaacaaacacauuuauuaguuuuuucaugcccaggggauguaaugugucucagguaaaagacuggaacuuauuuaaggcaugaaguuuccaucugauaguauucaauccaguaauaauucuguggauagagaagcugaaaacaaacuggauucaaaauauuuuauuuucuuagugcucauuauuauuacuguaauuuuuauuaugcauucuaauguuauuaugccauuaucuuuuaauuuugauauuauaccauuggacccaagaaacacauccauuauuuucauugucuucaucuucuuuugaaauaaguuuuaaagaucuuagucuucuuagucucagcucauuugguuucaucauucccaauccuuuucuuuaucaauccaugccaugguuuuauguucucuuuugguggcacguuuuuccuuccuucauacuuuguugcuuagguaaccuaaucagcuauucauucacaacuuuauguuugaacccauuagugaggucccuaagaaaucacacuuuuucuuuuucaucuuaauuacaauaauuugcaauuccaccaucaggauuucuuuuguaagggugucuuaauuuuaaagccaaucuuuuauagacaguucaaacuacuacugugacuucaaguaugguucuguuggauuuccaaauuguacuagaaaaauugcuaauacaauuuuauccuaaaauuaauauuuaauuuuaaauacucauccuagguuuggcaggaacaaauugugaaauguuuucaaaugacuauuauuuugaauuaguuagcuguuggguuaaaaauuuucacuuugcauugcaagucagugaguaaaaccaauggugccuacagcaugguuggaaaacaucuguccauucauucuuuuuccuuaaaagggucaggcagauccucagccauuuacccaccaucuagaacuuugcuuguugauguccucuucuacuuagccuucaauaacccuaaacuucuugguaaagguuuacuugguggaacaagauaucuggacaguuguaauaaagacuucuacauggaagaaggacacauugacucauugcuuauacuguccccaagacacucuuaaaacaauccaaguggaucauagaauuucugcuuugcugugagcuggaaauaaaucaccaaguucugugaaccuauaauucugagguccucugagugagaagacuaacuaaaugacucuaggucucuuccugcuuuaaaguucacuuuccuacuggagacacauuuuucaucgggaucugucagaaugucuuugaaccugaaccccaaauaggagagaguggguuauugggggaagaugguugucuugguagaggcuggugaaagcagggaaucaacaguucugaucauacuccaggcucugguaaaaaauguccauuuaaaaauuaccaaaaaaaagcuacacucucuuggauaacuauauauacuacauaaacuuuauuuuaaaacauuauaaacuaccuuaagaacauauuauagaucucguuacaacugguacaguuuuauaaauggauguuucaauacaaauccauauuauacagagguaguuaaugaacugcuaacauuucuuuugguucaguuuauugugugaucauccaaaugcgauuguuugucuauguucuuuugaagaaaaacaggagcugugcaaugauguucuagcaaugaaaagaagcucuucauuaccuagcuggaaaaggugaguguacuacaguuauacaaauuccaagugagugcaauuauccugcugaaaaguaauuaucaauguuuaaauacaagaagaaaggaaauaauagcaacaaaagcaaucaagaauggaaccaaauuuuacaacagagaugugaaagaauuagcaauacaccuuacccccaaaccuuuucauuucuuucgugaagaacuggaaauaaugaaauggagcuggcuuaacuuccuacccacagcaaguaaccaauucaaauuacuuuaauguagucaaagaacugaaaaugucacacauauauaagguaugauuaugaaaucauuaacugauuuuuuuuucucugugguucauuaucuuauugucauacauacauguaauuauaaucauugugugcuagaauuuuuuugacaugagaauuuuaucacuuuuaaaaugaaaucagcugaauguuuuggauauccaauagaauuaaaagaauguuuuaaaggaagcaaacucuuauccucuguacaaacccaucuaagcugcuuuccaggcauucagacccaguuucucugaauccaaauccugugcucuuugcauaggagcacacugaauuaagagcaagaaaaaacagagaggggcuauuuuccugcacuugcugacaggguagugagucaauccagcacucaaaccucaucacuucacucuuccacuccaaagccuuuucagccccuacuacuuuuaagguaagucacaaacuccuuagcauggcacagauccucuucucucaugccucuacuuuuagcccccacuuugcuucccaaaggguucuaaauuacuaguaguucucuuuuauuacaucuucucauccccccuuugucuguaccacuuccuuuacuugaaugcccucagcaacucauaugccagugucaguuacccuuucauuuaagucucaguucaaguguucccuucuuuagggucuccuugacucuccucaccaaacucagguauucacagagucacuguugcaaugaugagauuauauuguaauuuguuccguaguuauuuguuaaauucugugaucugacaugcaguggugagcagugaucacagucaagugaaguuaucuguuugaaucucugucuucccauugcauacagguuccuaaaggauagaggccuucuugucuucuucauaauucuaagcuuuugaaaggucuucucugacaacuccaucuaaaguagcccaucucauuucugacaagucacacuuuuaucauccuguuuuauuuuuuucaaagcguguauuacuauuuuaaaguaucuccuuuaccaccuauuucuuuuuaccauuuuuuaauuuuagcuugcuuauuuucucuauuuuucacuagaugccaaugcacuccaugagaguagggacugucuugcuuaucccugugucucugauauccagaaugacacugacucauacuuggcacucaguaauauuuguugauuaaauaagugauguaacuuuuuuuccccagugcuguugccaggucuucucauggccaauacuuugacuuagaauuauuuaugaaaauuugcuuuacaauuuaagaaucauccaaaaacuaaaacacauuuguguguaugcagguguguguaugcauguauauauuauuucauguaauacuuuuuggucuuuaugagauuguuuuuuuuuuggaaucacuguugacuuguaaauacaauaugaauguuagaaacaguccacgaaaaacaaucuuuuuuuuuuugcauuuaaaaaaaaaccaaaacuaguauauuccuuuaugugaauuucacgaagaagcaaaaauaauccauggagauagaaaucagaauggugauugccaaagugggaaugggugaggauugacuggaaaggggccuuaacgacuuuuugggcuggugaaaaugucccauaacuugaucugggugaucguuucuuucuuucuucuucuucuucuuuuuuuuuuuuuuuauacuuuaaguucuaggguacaugugcacaacguguggguuuguuacauagguauacaugugccauguugguuugcugcacccauuaacucgucauuuauguuagguauuucuccuaaugcuaucccucccccugccccccccaucccacgacagguccccgugugugauguuccccacccuguguccaaguguucuuauuguucgauucccaccuaugagugagaacaugcaguguuuuuuugcuauugugaauagugccacaauaaacauacgugugcauugugucuuuauaguagcaugauuuauaauccuuuggguauauacccaguagugggauugcugggucaaaugguauuucuaguucuagauccuugaggaauugucacacugucuuccacaauaguugaacuaguuuacacucccaccaacaguguaaaagcguuccuguuucuccacauccucuccagcauguuguuuccugacuuuuuaaugaucgccauucuaacuggugugagaugguaucucauugugguuuugauuugcauuucucuggugaccagugaugaugagcgucuuuucaugugucuguuggcugcauaaaugucuucuuuugagaagugucuguucauauccuucacccacuuuuugaugggguuguuuauuucuuguacauuuguuugaguucuuuguagauucuggauauuagcccuuugucagauguauagauugcaaaaauuuucucccauucuguagguugccuguucacucugaugguaguuucuuuugcugugcagaagcucuuuaguuuaauuagaucccacuugucuauuuuggauuuuguugccauugcuuuugguguuuuagucaugaaguccuuguccaugccuauguccugaaugguauugccuagguuuucuucuagggaaaaacaaucuuaauggaagaaacuuaucaaaugcauuacuaaugauggugaugauaaagaugaucauaacaacaaaaauagguauuauuuacugaccacuuacacuaaacauugagcuacauucuuuguauauccucaguacaacucuauaagguaggcccuauuauuauucaacagaacaagaaacagagguuuagagaggaaucuccugugcucuaguauaguacuuuuuacccuucaaccucaaugccaacaugaaugaaucuuuaacaucccuaaaaugguuaaagaaaaagacuucuuuaaugaagugucagcauaaagaagguuauaacuaaugagcauucagacauuguguaaauauucuuuaacaggcaauuaagcauuaguuuauauaauguucuuaaucuuaaaaaaaucagcaaaguuagacaguauaauuaaugccaaagagcuguugacaguagaagcacauuccguuugauauaaacuguuauccaauuuuaaaagauccucaucuuauaaacauguaaaauucucuagagcugugaucuuaauuuauggacaucagcaugaaaggauuacaaaaaaaaaucuuuuuauuacuugacaaacaaaacccuucaugaucugaccucuaccugcccuccccagcuccauuucccaugucguacugcccccagacucuuguacuuuuuucccccuaugguacugaaagcuuuagucucaucaacaaacuauacauccuuaccgugaguuauuuuucaugcugcagccauguaucuuuuuaaaaccugcaucagaucaccuuguucccaugccugaaaacuuccaaugguagugcccacucugcuucaaagaaacucuaguucccuccccaugcccacgaugcccugcaaucccaacacugaccguucucaucucaucucuuuccaucugcuuccugcucacuccagcccaguagcucugaacauucuucuuccucuuccagaucaugacuaaguauuucucucaacuuacuuuguucuuuuucuguuuuauucuaugcuuuucucucaggcuaaaauaaacuuuaguuuaaaagucucuugcauucuuaguuaagugauuuuuucugguaauauuguaaccacaucgcagguucacuugcccacugcuugcagagucuaauuaacaagagcuaggucugguguaaagaaagugacuuuuuauuccaaagcuagcuuaggggaagaaguaugggcuuccugccuuaaggguaccacuucaccuuugcagcagaaaguggacacuuuuaaagggggccuaucaugaauggcaccucaggggaggaggugagcagguguguggguccccaugcuagcuuggugccuuaucuacugggcaguugaguuagcauuucaugggcagaaauagguuguaaagguggcugaaaacucucuaggugggagagaguuucguagugggacuuuggauuguaaaucaacuguuaccucuggaggcagucuccugguggcugaaaguuccacucuggagcuucuaagcauaaaguuacaugaacuugcccucuagggaguuucuggugaaggggagguaaaagguuauaauuguauuucuaaaggacuauguagguaaguggggaauggggaaauggagaaaagagaaaauaaaaaauaauaguaacucauuuucuuuuuccuagaaaaauggggcuacuugguuacaguauguuuuaauuuguugcuuuuuaaguauauccauuguagauuuuugccauaugguuaccaugaggcuuacaaaaaauauuguauaguuguuuaacagguuuaaaaagucucuuucaucaagugaaagacaaguaguauaugacuacuguuaaaaauaaauuaucaccaauuccauuuaauugucacuaccuaaaaacuuugaaaaaaauaugugacuggaauaaauauaaauucuucuaauuaagaauuuguuucauguaacuacagugguggcaguuuucggcauuacacgcauguucuuguucucauuuguuguauaugaacauuucacucauuuuuguauauuaguguuucugaaauuauuaauaccuaacaugauuucuacuuugaaaugacaaaccucagcuugcucaaugugccgauggaagaugugaaucuaaguucuggacacauagccagaguuucugugaguggcaguuguaaaguugcuucuucgccagcgucuucucaaagcacaccugucaaggaaacagugagaaaacugaagucuaaguuaagguaaagauauuuacucacauauuuccacaugcuuuguuuaacuuucuaagcagugacaacuccuguuguuuucccuacugaguuuuaaugauacugaauaaauucaguagagugacauuaugacuugucuccuaacuaugcugauuuagauauacuauggguuaaauaucccuuguaauagaacugguaacugccuguuguuacauagucuggcaguaugguggacauuagucuucucuugaauguaauaaauaauuuuuacugaauuuucuuucuuuuuuccccaacaaaggcucuuaugacauuguauggccuuuuaaaaacucuggguuuuuuuugguuuguuuuagucuuggauacugaacuuauugagggaaauugaguuuuacuuguuuuguucuguguagaauguuaacauuuguggacaugguauuugaggaauuuaaaugucugggucucauuucucaaaggauggagacaaggagaggaaaaaguucaugauucaggguuuuuccaaauagagacugauaauagaugggggccuuaaaaucaagucaaagaagucuauauacagacuugugcucuaaaauaggugccauaugggagggugggagguggggcugguagcaccacuaaauuaauguaccucauugguuuuguugggauccacagacuuuuguuggguuuuaagggucuuguguggggugagaugcucgggccagggaaaacaaacaacaugcccuaccuggaaugguauuuuuccuuaggauagcuacuugauuuuuucgucagugauugacaugaucuuccugaagaugagaguucucaaacaguagaagcagguaggaagaaagagaaagguggaggagaacacguacauagggacuguagccucuacuaaggcccaggcugugguccuguuuaugagaggagacugcuaaccccaguagacuugaacucaauuccacagaugccauggguguggugaaagucuuuguagcagcauccagagugcagggcugugauuacuacaugggcaugaagaccccaccugcugucucaugccuaacaccaguccugccccaggagggaggaagcacuccugguuacauguggaaggaccuuguagagggaucuauuuucacuacugacacuagggauccagagacaaguuguugauggagcaaugaauacagacugcuacauuccagaacaccaaguucugaccaccaaauaucccuuucggucugguuggcagucuuccacuagccuggaaaugggacaaaagcaggccagaccucagcaugguucaggcauuauaagguugaaaaaggccuuggccgggcgcaguggcucaugccuguaaucccagcacuuugggaggccgaggugggcggaucaugaggucaggagaucgagaccauccuggcuaacacggugaaaccccaucucuacuaaaaauacaaaaaauuagccagucaggguggcaggcgccuguagucccagcugcuagggaggcugaggcaggagaauggcgugaacccgggaggcggagcuugcagugagcugagaucgcgccacugcacuccagccugggugacagagcaagacuccaucucaaaaaaaagccacuuauccaaugaucuagauagaugucaguauuauacugcuguagcuuacaguauaaucccuaaagaaugggauucucuaacuaguuucccacccucugccuguauuuuucuagaagugguauuuaagguccucagcuuugaaguuggauugcuguaaauuugaacccugauauguuacugguccuaaaauucaggccuauugguuggucacuaaagcauaguaguauacaguaaauuuuauaugcaugugccuguauauauuugaauaaaugugaguaucauuaaaaauguauagauaugaccacauguucaauuauucggacauuacuacaagugaaucaggccuucuuaauaauaguagcuaucacaccaggcaccguggcucaugccuauuaucccaguacuuugggaggccaaggugggaggauugcuugaacaagcaguucgagaucagccugggcaacauagcaagacccugucuccauaaaaauaauaguaacaauaauagcuauaacaauaauagcuaucagguuugaaccuuuauuauauuucaggcauccacccacuuacuuuuuauaaauuaguuucuauucucacaaauucaugagaaugguguuauuuuuaaauauuguguauggaugaggagacugaaacuuggaggaacuaacacauuacaagucucauggacaauuacacaaauaugaaggauggggcugggguuuaaggcaaggcuuucugauuuggaaucccaugcucuuaaucauauauagcauauacccucucuucacacuaggagaccuagagagaccugucugaguguguugcagcagaguuuggaugcauagcuacuuaaauuucuuuuucagauagaucaacuuucuuuuucaaauucauuauuuuccugauuuuuuuucuuggcuaauuuuuauuugucuaaguguaacauuucuauuaauuuuagugaguuacaugugaucaaaaaggggauaaucugauugaguguacuaagacuuuaaauugcauccacuucuaucauuaggcaucacuagaaaauuaaaauuucccagaaacucuaaugaacaggcagacucuuuauugcuuagaaucaucauacuguuaccaacugagcacucugaaagcugaaugcguuaauauaucagcucuauucuguaccagcuuaaauuuuguauggugauuauuuuauuaaaaauauucuaugauaaaaaaauuuggacagaacacaggauuuaacugaaacaaaaugagcuccuugucauaccaguuuucucuuuugcuuucagcaacauguaguauguuuucucaaauuucaccagugaaaacagauuucuuguuuucuuuguaagguauuuuguuguuuuucuuguuguuguuuuuguaguauuauuugcuauuuuauaucugguccacauguaauuucuugaauuuacuagacuuuuaguuuuucaaggcaugaagauuguggucagcuguguacaauguaaaggguauaaaguauaaagaaauacucagaauuguuuaccauauuuaccuuucuugucacaugauaaaaaagaguaguaguuagagaccuuugaaguauaaaggguguucccuccauuugggucacuuuggacgugacgucauccuuaucaauuuccacaaugccaagguagugucuggccaucucuguguaauuaaugcuaacaauuaauuaaaaauguaguuuuuacuguacauacucauuaccuaauuaugcucagucaggcauuuuccugucuuauauuacuucuugcuuuuuguguauuaguuuguugacuucccaaauaaaguaacaucuuugaaaacagauugaauugucaacaguaugucuaacauauaucagcauauauuuaaauaauacuuuuaauuuaauugaaagggauucauguaaaaagcaguaaauaguauuacuggauguuaaaauacuuuuaaauauuggagugcaacugagugguguuaaguuagugguacauaagcugaacugguuccagacuauuaaauuuuaucagaugauccuaaacauuggaguaguauuacauuucaaaucucuuucaauaauaauaauaauagcaauaauauuaguaauaauacauauuuguuaugcacuuacuauaugcuaggcacaguccuaagggcuuugcauaugauagcucagucaucuuacaacaauccuauaaauagauauuuuuauuaucaccauuuugcagaugagaaaacugagacauguagaggauaaguaauuugccuagcauuauauaacacuuaagugacagagcuuggauuugaacccuggcaaucugaccucacaguccuugcucuuaacuguugaaauguaaugccuuguuuugguuuauuguuguguauguaaacuugauaaggcagacuccauuuauuucaucucuauaaaauauaaacaugcuuuuuguuaucuuagauuuuuaaaauaccaaaaaaaaguuuuaaaaagaaaguaacuuuuuaacauuucugccaguuguuaaaggaaaaggccaugaaaauacauauacuagcaguugaggucugccaaaaaacauuauuacaacugugccauuuccauuucauacuagucuuuuacugaguuaaggaagacaguuuuggucaaccuccaguaggaggcuugcucuucuccucagcuaggacuaagcuaauuaacuagguuauuguuuaaaagaacagcuggaugaccagguaacucuauggacuccugcccaugucuaccauguuuagaaagaguagaguuguaucaacaugggucaaagauuuuucuuaguaaaaauuauuuuguugagaaaggaauaugacuauggagugaaauggaaauggcccuuagcuggaacuuuucaaagcuuggccauaauuuguagagaugguguugauuuagugguucagcucacuuaacuaaacucucuaaaaacuuugaauucaaacuugcagauauagauguggauuccacagaaauucaucugagaugggcuucauagccaagauucugaaugaaaguaacaacuuuggaagauaucuuuaagauauuuauuucuugaauucuugagaagaaagacaauguuaaacaaagacaaauuucugauuuuauuaucaacucugggcguaaaauucugaguaaaugcuucaagagaaggacuauuccuguuccuaagugggacaaaagucccauugaaauggcagcacuugguucaggaguugccccaagugcaucuacuuaaugcaguggauacuagugaaugaauccagguuuauuccuauaauuuugugcuucgugucuccuggcccaccuuuaaauguacuuuauggauuccuggcucacugugucuguucuaggggaaaucucaaguuugaggauagagagagguuugauaagauguacccucaagagcaaagaaaguauugcugaagaauaucauucaagaaagggacucaagacaauaaaacugaaguaauuuuuaaagaguucuuaagcaucuacaaucagacccuacguaugugauuuuugguauccuauagguuuuuacagaaucuaauugcuuuccugaauuaauuuuacaggaaaauggaaaggccuguguguuuguguuuagagacugcaaguugcuggguaauuugucuuccucucuagucagucuuacagaccagaaucuccaagggagaagcuauuuaggagcaaucugauguggaagagagugaaaggcucaauaccagggaguccaggagggagacagacacugaaggaggguccagggaacuugcuugggccuggugggggggugggggugucuguaauagccaggaaaucagagaaaauaggaauaauuccucaaucaaagaguuuccauaaagauuacaugaaacuauguguagaaaaugauagcagugcuuagcacaauucuaguacuuuauaaagaauaguuggauuggccgggugcgguggcucacgacuguaaucccagaacuuugggaggccaagguggguggaucacuuaagcccaggaguuugagaccugggcaacauggcaaaaccccaucucuaaaacaaaaauaacaaaaaugagcugggugugguggcgugcgccuguaaucccagcuacucaggugggugaguugggaggauuacuugagcccaggaggccgaggaugcagugagcugagaucacgcaccacugcauuccagccucagcaacagagugagacucagucugaaaaaaaaaaaaaaaaaccaaaacaaagcaaacaaaaaacgaacaaaaaaacaccaagaaaaaauacuugaaucugaccaacuuuuuggucagauuuuuucccaaagaaaaauacaaaauucucugguguauggugcagguggccuggaauacuuccuucacaugcccccaucugcuacaccuggcuaacucccacucuuccuuuaucacuacugaaauaugaguuagaaccccuucuucuggucuccauggugcaccuuucucauuguccuccaagcauuuaucacaugguauuggaauagcuugcuuucuugucucuauugccccacuaggccaaaucaguucaguaagauuguauuggguuccuggcaugggggcaugaugccaggcucuguggggcacugaaggucaaagguguuuuaguagagguuuaaagaaugucuguggaauuaaugaguugagaaaaugcaaaauggcaaaagguacugugauuucaguaaacaugaaaucguguuuaaagauaucuauuaugugucuaauuuuagaaauaauaguacauguguaagacaguauucagacuauagaugauguuugcuguagauuuugaaauagagaugccacagauugaaaguaaucgagaacuaauccagaacuuuuucucaccccaauuuucuccuuugguuuuuccccuucccuaguaaaugcugccaucuaauauuuauuugucuaagagcguuuucuuaggggauuucugauuugcucuaaauuuaaaggcaaaagaauuuauacucacaauggaaagaaccaaugcucugaaaagguuucaagccugugguggggaaagggagccugaauuugaggagaagcaagguuuaguuuguguaaaaggucucucaccccuccugcuccaacaaaacggccguaguguugacccagguguucuuucccaggaacuccuguugcaacuuuucuuuucauaugauuucuucucaucucauauaccuggaagcugcuccaccuuuuuuaaauccuguuccuaccccauuuaucuucuugcuagccagacaaauaacucuaaggaguguuguaugucauauuuaauguuugggcaaugccaagaauuuucagcuuuucgguuugaaucuccuugaaauuauaaauauguauuaauacaaauaauauacuuaaaguauggggaauauaaauuguggaagaaagagcuguuuucucuuugguauaccauauuauuuuacaacuggaaaaauuuugcaaaucccuuagauaauauacaugaggcucuuggaauacgucagcauuagaauacuauacacuuuaagaugugguggcuguaaauuucuagaucucauauucucccaggaaugaaauaugugucauauaggugauuaauccuagaaaagcugucacaguagaaggaugggugcuauuguccuuugacaaaaugaagcaccugucagaacaauggccaccacuguuuagaaagagcaggguccauguaugauuucuaagaguagucuuggagucccuuaugcaaaaauuacucuggagacuuaaacucuuugguuuuucucaggaaaaaagucaguaagucuguagucagccuacuuucuuccaggaaauuugcaaugcugaguucucugcagaagagaacacucaacuagguacaggccuuuccuggacugguuguucauggauugcgaggcauugugagguuggcugguuucuuuucuuuuuuuuucuccucccugccucccucccucccucccuuccuuccuuccuuccuuccuuccucuuucaguaaccuuuuuauuuugagauaaauguauguucacauuaaguuguaagaaauaaugcugagagauccccuguacccuucaccuagcuucuugcaaaacucuggaacagaaucacaaucaggauauugacauugaugcagucaagauacagaccaguuccuuugccagaauggucccuccuauugccuuuuuauagccacacccaccuuccucuccccagucuaugcuuucugaagaacacuuugaugucagugauaaaaacaaaauguuuggggggaacuaauguucaucuuugccaggauauuuaauacccaggagacaaacccaguucugacaguugagugcuaccucuguuauccuaguauauucccauaucugcugugcuuguauuccuagggagauucuucuguauuuuuuuccugagcaucagcuaccaucagaauuggaagaaccugcauuaaguugugagguaagcugguuuuuuuuggaacugugagggaaugauagaauagccugaaucucagugaagaaaaauguaaaguguuuccaauaagaggaccuagaguggcuuaagugaauaaagaugagcaucuuuauaccaaauggugauucauaauuaaagcuauauuugaaauuauuguggcugugaguuaaacaagguggaaaauaucuuacagacagauaguugcagagaugaaaagaaacaggacauagucccugacuucucucucccccaccaaaaacagaguuucuguuccuuagauacaucuccucagcugcuucuuaugagcagcugagcugaggauuggguaggucaggcacauuagguauccaaagcacuaaucuuaccgaaaucaccaagacaucacugagauagaugaagaaaauuguguuuaccaaaucuccucucaggaacaguaccagaugugauuggaaagaaaacuuugaacagcugcuuggggugcaaagaguaagccucacaucuauuggcuaugcuuaaguaacagugaguagucuacaaagggcucccgcagggcuguggugaaguugagugaggugcacaugccugacaagcugcucagcagaaguggagggaagagcugccuagugcaggagggugggaggccuuuucuccaccuccaugcucgguguugccuguggagaugauggauacacuugguauuggugaaaauagcacaaauuaugaaugcaacagagggacuauaugagucugaucuugggcacaaucccuaauuuucuagucuguaaucauuguuucugccucuuuacccucuacucucaccucauccucucccguggggcuucugauuccacagcugaacuaugacuguucuugucagggccaccagugaccucuugauaagugcagugucacucuuaccugaccugucagaggccuucaaccuaggugaccacuuucaccuucuugaagcaccuucuuuguguagcuccugugacugcacacugcccauuuuauuuuuuauuuauuuuuauuuuuauuuuuuuugcuuuccucccucccaucuucuuuguggcagcuccuguuguacacgguuucucaauguuggcaugucugaaggcucauuccugggccacuuucuuuucucuauuaaaugcuguuucuagguaaccucgucuaauuucuaacuuuaaaauauuaauacuaccccccacaugccagugacuuccccaucuguuucucugacacucccuuccaagaaacccagacuccagcugcgcucucgacaucucccuuugaauauuuauuauuuuaucgcuuaauuuuccuucaccuugaguuuuguaucugcacaauuuuuuaacugugcuguauucauuuauguaagcugacuuaauccuuuuuuggaaggaagcaaaguauaauuuaguuaauuaauuuaauuagacccagacuuaaaaggcccauaguaccaauguuggccaguucuaggcuuugaugcuuuuuauacucaaugcuugugugauauaacucugcuguagacagcacauucucuaaaagcuaauauccuguucuauuaucauuuaugaaaacagcuggagcagugcccagagcagaugaacaaaaagcugaaaauguguuucaaccagguaagcuuccuuucaguaucaccauuuauauucuaaaugauccuguguucgaaaggauaaauaauguacauuuccaaauguuagguuugaaaggaaaucaaauuugcauucacuuaucgagacuuagauuaauguauagcuuaucaggugucauaaagcaacauauuuuugaauuuuaaaauacuaacauuucuauaacauaaagcuaugaaacacuuggaguaggacuguaucuugaauaggaaacaggacauucugagcuuuuaaagaaauauuuucaccgaauccucaaaaugcuagacugaagcagaaauuuuaaaguuuuaaauuauuuccaacaauuugauaucgcucugaguuuuuuaaguaccuuaucaauaguuuuuaaguuagugauuuuuccauucuaaaaguagacauaaaaguaauuaaugcuaauauaagaaguaaaagcaauuuuuaaaaauucauccauagccucaagccauuccaagaucacugauauuaauauuuuuauguauuuccuuacaaccuuucucuuccucuggguagauuuuuuuuuaacaguuaucaaauaaugcuguguaucuaguccuuaaggauuuccugggggagaaagaguccagagugcccuucaguucuacuacagaaguaucucaaaaaaucauauguccucaaaucccuuauuuuacacuuaauaauaaaaaaaaaaacccugguacuccaagaugugaacuuggccaagcugauguaggggaugaauguuggagccaggauggccaugaagauucccagauucaucgcacaggccagaguagucaagaacuuugacaccaggaucaauacugaaauguugggucuuuguugacacuuuaccugugcuuucucaccuaaucacuagcuccauauuagugcauccauuagcaucuucuucuguaugcuuauguuuacagccaucuuuagaaagcucucauauaaugaaaaucuguaaagauugagaggugacuggcccuuccuggaguugugcaaagaaugacucuaagcagagacacugccucauaguuuuuauagguaauggaguaccuuugcauuugaucuuagccaaaaguccaagaagcaauuacaauggaagacaucugaauauucuuguuuuauaagugaaaaagaauggugaaguaaauucccaaaagacauacaacuaggcaaacuugacaaguagaaccuaaaccauauuccuucuuacaaagacuguaucacacaguauuuaaaguucagacugggccuaaauuuaacaacccuuguucauacguuugccuuugauguuucuaucaacuggacggugauaaacaacuggaaauaaaaggggagguguaauuauuggucucccauuacuguucaacugaaaagugaauuuauuuuuugaauaacauuuugcuguaaaagcaguaacugaacauuuucaguuugaagaguuacuugucaacauuuccuaacaagaauaaaagacaaaguuuacuuucaauauauuuugaugcuguucuaccacuaauauuauuuucaucaauaauguaaaacugggauugauugauugggagccacuagagcugccaggcacugaacuaggucuuuucuauauuaacacauuuauccucacaacuuugguagguagguaccacuaucucuuuuagcaaugaggaaauagagauucagaaagauaauaucccagugucaugaucagauucagaacuggagccugauuuuucccgcuccaaaguuguuuucauucuacuuuuuuucaacuuuuuuuugcccacccccucuauuuucgugucgcuuguuuuugucuugaaauaggaucuugcuacauugcccaggcugaucuugaacucauggguuccagcaguccuccuggcuuagccuugaaguggcuaggauuacaggcuuguaccaccacaccuggcuauuucaucuuagucucauccagacuugaauacuucaucuuugugauagaggucacauguauuacuugcaauaaguauauuacaacuucucagccuguugguguagaaaaauuauuuuuaaguuacuagagaccugacauuacaucaugagacauauauugaggagaugcugacaguaauauauuucugugggguaugugugguagauggguuggcguauuggcccaccaggaauucauugucccaaccgaaagucuguggcagucagcuugaggagcuuaucuguaaggcuccuggaucuuccuguagcucuccacuuacugguuaggggacucugauuugaaugcacuguaaaacuuugaaauuugcuaagaauuauacugucauacagcuguuuauccaagcuuauauauaccguuuuauaucuguuucuaaauauuuuuuccaaugucuacaccauuaguaauggagccagagugaauaagacauguguuuauucagggugaacagaguuagcauagaugaugagcaguauccccuuaacaugcaggacaagucggauuaaaaaaucaaagcgagauaaacagucaggagaccagcaguuccuacugaaaugagaucuuguaagcaaaacacagaacaacuugauuuaaggugugugcauuuaauaaagagagccacaucaaagcacgggagaaacuuacauaagucacuggcuucuuuggucacaacagugguuuucauaacuacuauuguaguaguagaugauucauaauagcauuggugguccugcaucaccugacucaaaccauuaucuuuuauucuuuccucacaggccucuguuccaucuaaaaugagugccccagaguuauuccaacuuacuuacacuggucuaccucugagccuuuccccuccugauauuccccaaaauacuccuaucgacucucccaauacacagugggccucuugaaauccuuccccauugagcuuggucaauauuauguuuuauaugaagacucucaguuuuuccaugugaaauuaaucuugaccucucuguguucugggagaaccuuaaaacuuuguuuuagcauuaguuaacauuucuaucuuauaauaguuuauuauauuucacuuucuccucaguuagaugauagaauccuugaaguuaauaauccugucaucaaacucuguauucuagcagcauucaaccagugccuuugaaugcaucuggaucuuaauaguuacguguugaaucaaaguugauuguuucugcuuuagugacugccaacauaaacacuuaaaugaauauuccuguuuguaugguacaaaaucuauagauguuguaggccuuccuuacuuugcacaaacucauuaggauuuuggagcugcaaaacugcuagagcuccuacucuuugaauucaagguagaaaauuaaaaucucaguuaaauauccuuucuuucaaauccuaauuccauucugaauuaauguaguucggaaagacuuugguuuuugaucugcagauacuucuacaagaguggguuuaaccagcagaacuaagccucucaucuuguuacaauuauuuucucaccuuaauuaaaauguuaacacacaaaaaagcuaguacaacuagauguccuuuuacacugagcuugaaaaguugucaaaaguguuaccuuucauagaaacuuccuggagagguuagcagaaccuccuggagagaaaggcaagagaauaaaccaaaaggcuggccuguagaauuugauaaaaacguaguuuacugguuacuaaaagguaaacuuucagagacugaauaugacuuuguaguguacuauauaaacauucuuggucucaucucguauuaauagugucgaggcuuuuuguuuuugcuucuuucuuucaauuucaaaauaauuauagauucauaggaaguugcaaaaauaguacagagagguccuguguacucaucacccgguuuccccagugcauaauuaugcauaauuaugguacaauaucaaaaccaggaaauugaauuugguaaaauguguguguauaguuguaugucauuuuaucauacauggaaguuuguauaaccauuaccgaaaucaggaugcagaauucucauuacugaaaucaggaugcagaauucucauuaccauaauuaucucccuuaugcuaccuuuuuauagucauauccacucaggccuuccacaauuaccucuaacuccuggcauccacuaauauguucuccaucucuauugcuuugucuuuucaggaaugcuguagaaauggaaucauaugugugugucauuugacaauugcuuuauuuauucagcgucacuucggguccauuuaagugugucaauagcagguuccuuuugauggcugauuagcaauacuauuguuuuuucaaauaauguuuccauaauguuugccauuuuugauauuuaucuuugauuuguuuugguuuauuuuauuguggcuuuuauuuuuaugaaaaaaguguuuucugacuguuauucagcauggcaaaagcuauaaaauucuggaguucugaaaacuguaauuaaguggcuagugacaggugaacuguauguaacacuguccuccuuauuccagcugaguuaaguuauuccuucuacuccaccuucaggcaguagauaucucucccuggguuugccugcagccucuauaggaagcaucuaugaagcuuccugguggagguggugguuaccuuaguuguaagucaucaacuuguuagguugaauuaaagauguucaaaaguggauucccuuccaggaucuugaaauguggcguggauuucaaggcaggauuuacccauguguuugaaauucccuugcugugagugcugcauuaucugcuguccugaaucccugcuauuuagugccuuucuugggggcacaagguccuuauguuccauaagauuuaugugcacauuuguauuaucucaugcugugaacuagagaguucuugagggcaaagacuguacccuauauaucuccacgucaucuauaauuaaaugcagugcuuucgaguuaggaacuaguuagugaauauuuauuaaacagaauuuccuauauguagggauuuuuguuugcuuguuuaaaggauuuuguagaaaaaggggaaacucgugaggucagcgaaugcuaaaggagaugauguggaugucagagaagggucugcacauagucaacguaguggagggucugaaaagggaaggguaggcccaaaagacaaaugaggcuaccuuacaacuuucuuggcaacccagucauguuagaaugcagaaaucuccuuauuacauaaacaucaaaaugcuuaucaaaaugggauuugccguguaucucuuuucucagaauaucucuuggccuucuagaaauguuuauacaagcaauuaaugucauucugaaacugaagcauuuggccucuccauuaccucuuucugcuucaugagugccucaggcacagcaugaaauuuuggagaacaaccaagauucuucuauuaaugagggucauauacauaacuaucuguacuuuuuguaucacgauaaggaacccgaagagagugagaacaggaauuccucuuucuguaguuucugugcuuucuagaugcuacagccuugccuuacaaguaacacuacaucaucugccagacagccccaaguggugggccauucugucauugccugugaauuacuggugcuguggagagagucacaggcaccugcucacuuugugccuuaaauaaucuggugaucgccauugggagaacagauucaaccuuuacgagguuucuucuucauuccagaccaaaggucuccaagcucacugucaugugucucuuuccuccuuauaauuacaauuauugaaauauuauacauuuuucucuucucucuuagucuucuaucagaguguauguaaguuccuuaaggguaucaauauuuccuaaauuuagaccaccuacgaaguugacacuugguacauguaggcagaguuggaauaugaaauugucuagugauauuagagggaaaguaauauuuuaaaaacaugcuaaaacuguuuuuaaaacauucccagauacagaauacuuacaugguccaauaugaaaaaaaaauaaagaggaaauugcaguccauuaucuaugauucaaauacaagaggaauacauaaugaaaucucucuggggcaaugugaaaauaaaagaaaaaucucugaggauaagcugaagaaucuucguauaaaacuggcacuauuguugcagaaacuccaacuggugagugaaaaaguuguauuugagcaguaggaguagacucuauggaacgagaacucagcuaacuucuccuaacauugucauucacuuacugaccuggacaagucacuuaagucagcccuuacucucugcauaaggauuuugaaaucauaaauaaaugaacugugaaggcauauauuagaacauuuagaaacucuguguucuuucguaucuuuuuuuuuuuuuuuuugagauggagucuugcuguguugccaggcuggagugcaguggcgcgaccuuggcucacugcaaccuccgccuccuggguucaggugauuccuccugccucagccuuccgaguagcuggaacuacaggcacacauucuuuuguaucuuaguucagaaucuuugcuugugcuguugguauagcaugaucauccuugguguccccuuaauaacaugugaccaguagguaauuuuuucaguuuuuucagacagcgaaauauuuuacuuuacuuuuauuuuaaugcauaaauaaaaauccucuuaaucuuagaggacaguuuuggagaagucaggaaacaucauguaaguauggauuacugucaguuuuguuuguacguuucaaugcauaaagaauugaguuaugugauagguugaacugaugaggaagagcccaucuucuauagcacauggaaauguugcauaaaauacaacaaaacugaaaauauauguagucaggauugaaagucuuccuguggauucuagaaauaaauugagaaauccaagccagaacagugagccuagggagccuguggcauuuuguccucaaauauaggcccugagugcuggaacaggagacagagccuuccugggccaugcaaggugaggggacaagaacugagacccuuauggaggauuggcuagaggauugccuugcccuugaaaaggcuagggagagacaagaaacucgccauacauauaucuguauaaugugugaagaacauggaccuugaagccaggcugccuggguuucauuccugguugugaacauuuaaacgugggagucccuucccacuucaaaaaaauuuuuaauuuaucugaaauuuaucuuguauuaaguacaaaacaaaaugcagaaaagcuuuuuuuuuuuuuauuugcuuaauuuaaguauauugccaaaagagaugucccucuccccuuugauggucuaggcaacaguuaaaauguuauguuauuaaaauuuagaaagauguuuaaugcuaauuuuuauauaaagguaauuguauuugcgcuucuaucaaccauaccacuucagccaauuugucuaguuuauuuauugcuaugagaguaggauuucaguagagcuccuuuugguucuuguggcugugaagaaugccaaauguuuucauguguuaaaagucugguauggagccuagcacaugguaguguuucagugacgauuauuguuucacuaacaaguaaacuagaaagaccaaagaaauuauguauccuagaaauugaauaccacuuccugacuauuaaacaaguuuauaaaauaauuggcuuucauaauagcaaauccacguuaggcuaagaaaaacugaaagaauaaucguuuacuacuccuucucugccaaaccucuagguucuuaagcagcagccagaguaaccauacuaauuuaauuugcuguauucacaaaguuugguaggcaaguuaagggcuucagccagcagaguaugaaacucuuuugccuaaucucaguggagagguacucaaagggcuccugcccaaauguauuacucucaucgccccacaugaaauuucuauuucacaguuucugguugccagagccacugccguagaguacagcagagaaucgagaugagggacccagagcagauagagauggggcaggcacaugaagaagccgaguguggaaauaauguagcauccuggaagaaguuuauuccaccaggcagaggauaauagccaaaagaugagauuauaucuaacaggacgagaagugcuuugugucagggucacagggcauucuucagggucagcgaauauuuggaagucaagguaaauaucaacaucauuguaauccaucuguaggaacagugucccagucaccaagcuggaacucaguaaaauucagccuuguuagagcaaaucugugguagagggaguaaaguugaagcauauuuuauggaaccagagaaaagaugcagaggcgagguuaauggugcuagacacuuagugcuaggauuguuucugaaaggcccuuccuaaaaauccucuuaucuguucguucaguuggagaguuaguugaucccauaguugggcccaagggaaugagauuuagaucagucagccaagagggaacauucaaggagaccucaguuuauggaaaaacgggauuaaaaguuaaaagucaaaauguaaacuuuauuucucaacauaaucuccaucaaggucaagacacuuauguaagcaauggcagcagccuuuuaguccaucucuaaagaucuaagaguccuuggaauuuaaccaugucaaugcagucuuuuuuacauuauuaaagaaaaauggaugcccuuuacagauuuuuuuuuaaagauuuuuaaaaagaagucagaaggagucagaucaggacuauaagguguaugccuaaugauuuccugucaaaacugucacaaaauugcccuugucugaugagaggaauaagcaggaacauugucuugguggaagaggacugucugaugaagcuuucccaggcauuuuucugugaaagcuuuggcuaacuuucucaaaacaccauuauaauaagcugauguuauuguucuuuggcccucaaaaaagucaacaagcaaaaugcccugaguaucccaaaaaauuguugucaugaccuuugcucuugaccgaccacuguugcuuugacuggaccacuuccaccucuagguagccauugcuuugucuucaagaucauacuugcaaagccauguuucaucuccuguuacaguuuuuugaagaaauccuucaggaucgugaucccauuugucuaaaaucuccauugaaagcuuugcucuugucugcagcugaucuaggcacaaugguuuuggcacccauugaguggaaaguuugcucaaguuuaauuuuucagucagaauuguguuaacugaaccacuugagaugucugugguguuggcgauuguuucugcuauuaagcaucauccauccucuccaguuagagcaugaacaagauuaacuuuuuccuugcaaagggauguggacagucugacauugcuagcuuccucuucaacaucaucucaucuguucuuaaguuaucuguuauuuguuaacugcugauuucucucuuuuuaaaaaauuacuugccauaguccuauagcccccucagucuaaucucauccuucucuguuauaggcucuccauuggggacauuguccccauaaacuuuucaugaagcaugaaugauuuuaccauucuuccacccaagccucaccauaaauuugauguauguucuugcuucaauugcagcagaauucauguugcucugauaggggcugcuuucaaacugauaucuuauccuuuuagugcuucagacuagauccuggucaaauaugucauaacaacuuagugugaguugauuuuuguucaaaauuuuugaaauccaugccuacguaguuuuuucauaauaugcauuuuccaugaacuuuuugaagacccaacucauacgucuaacuguuccauggaucaagaaguccaggaaaggagagcaugaaaucgccucaguagggagcugaguaaaagagagaaggggaggauaaacaggagacagaccaggguaguaagccaagagcugagggaaaagacgcugcaauggaaauagaggaaacaaagaagacaaaauuuggcuacuugucuguuuuugccuacaaggcuaaagauucauuaauuuuaaaaauaggagauuacagucuauaacaaagaaggaugagauuagacugaggaggcuuuaggaauauagcaaguaauuuuuuaaaaagagaaaaaaaguuguacuaacuuccacuacagaauaaaaaaaaugaaccaaguuucuaaccgcuuguuagcauaaaaugacauuaaaugagaaaaccuuuugaaagguuaaaagcaugauucaaauguaagguggcuuuuguugcagcaugagucauagggaagacuguuaggaggcugcccaaauuacaggaauaagcucugcagcuucuuucccuggugugacuguugcuucucuuuuccagggugguccagaaggugaccuggagcagacugacacuuauuuagaagcuuugcuuaaagaagauaaucuucucuuccagaacaauuuaaauaaaguaacuauagaugcaagacauagacucccuuuagaaaaaaaugaaaagacuucggaaaauuaagucagagaugguauuaccuuuuaaaaaaugcuaauaagaaaauuggaagauucuuuuaaaaauuuuucuuuuuuguuguuguuacuguaaagucuauucuguuuaacaauaagaaauaagaaauaauuuuuuucaaauaagaaaauuguguacucuagaaauggagaccgauuuacaauuuauguauucccuaauccaauuaucuaaaucuuccuuuucuuucagaaauauuaauaauaucuagaguucucuaauuuucaugugagcuacugaaaaaaaugaaaaugucacucaagcuuaacuuuuguuauuccuuaaaagauuguuauuguaauuuuguuauuccuuaaaaacauuuaaaagcagauuuuuucaaaaucgauaugugaaggacuacagaaucaccuccucuugaagauauugaaaaagaaagacauuaugcccuuucuccacuauagccaacacucagucaagcagaaaauacaaauccccccaaaacuuugagacauagcuuauauaauuuuauuauuuagucauaguaaaagaauaaaucuccuaagcauaauauguauacauauuacacauauguaaaaauuguuguuuuacauuuacauauacguaaagaaguauguuuuuacacuuuucuugauaaguguuuuuuuuuuguuuagaaaugucugaaacuuuagacaaaaacaguaaaacauuuaauauucauuugugaa

SEQ ID NO: 192637 - RNA, 4378 nt, Homo sapiens
uuggacaacucuuuuuauuaucuuucuacaguaaacaaaguauaaucccaaaguucugcagauauuuaauugggaaaagacacaacccuacagucaguugggaaagacuaccuuuagaagagaaaaaugaauuguuugggaagaaauacauuaacagaacuguauuucuaacgcauuuacuuuuuaagccaucaaauguucucauuugagccacguguucugugcacauucagagaaccuuuugaaaaugaauuaagucuuugccuucuuuagucuguugauaaacucuugagaaugcugagaaaucuccagaaaaccaguauguuuucucuugggaacgaauugcagagccucuugccaauuaccauuguuuuucagacauaacaaaauacguaucauuugaucuaaggugagauuuuuguuaccaauuucccauuguaaauauuuaucuaauggaaggcauucaguugccagguucagccguuuugccuuggcuagggaugugccuggcugcauacucuuaucaacaaaagacccaauuacauaaacuuugucaugccugaaaguagucauaacauugggagaaucugcaguuaaauagauaauacuguccuuuggaaauaaaucuacaugagacuuuucuguugauguuaaaagcaauuugucccauuuuucuugauaccguuuaacuaacucucugugcaaagcaccaucuauuuuuagauugcagaaauaaauauggaaaggaucaacauuucuucuguuccauccuucacuuucuaaaagcugggaaacaguauucugcaauucuuuucguuucauauaauuuucguaagccaugucaaaaaccaaagguuguccaaacugcauggccugggcacccuuccagcccauugcuauguccauauuccuaucccaaagucguaaaaauagaaaguuuuucuguuuaucuuccucagugguuucuagcagcuugauauuuuuugcuucuucccuugcugcugcuuucauuuccuuuuuuauuugccuagcuuuuuucacuuuuuccuucguauauaaauauuuuaaauauuuuuuuuuugcuguguuagaaacacauuccauaaggguuuugagcucuucuucagugauguguucugguacuucucugccaagcaaucuccacaucucaaugaacucucugguggcagcuagaggaucuucauccuuacugcuugagauuguugaaacacauucuucuugcacacuagauuucaugguaguuuuccacuuauccaacucuagcucuucagaaggggguguacucucauuuuuaggauaaguaacagcugguauuuuggaagacauguaucucugcaaaauuguuaaguuauuucucuuccuaugaaggguaaauggcaccaaaaaccuggugaaaggucugaagaaauugacacuaacacucauuuugaggaaagcagccauguaacaaaaccccuguaaaagaagaaaaaugcaauuaaaaauuagacaaagauuuuuauaacuucucaacuaauugugcaaguauaaauuugaaauagcaaaauaaaaucaauuuuugaaacacaagguaaaaucuuuguaccaauuuuuuuccuagacuccuguggucuacagccugugaucacucauugaguaaaaaguuuaaaacuuaguuggguucuuggccgggcgcaguggcucaugccuguaaucccagcacuuugggagccugagguggguggaucaccugaggucaggaguucaagacuagccuggccaacauggugagaaaccccaucucuaccaaaaauacaaaaauuagccagguaugguggcaagcaccuguaaucccagcuucucgggaggcugaggcaggagaauugcuugaacccgggaguuggagguugcagugaggcgagauugugccacugcacuccagccugggugacagagugagauucugucucaaaaaaaaaaaaaaaaaaaguuggguucuuauuuuagacaugaauuucacuauugcuuuagcuaaaaggauaaguugaagauccuuuuuagauuuuuaucuaggggcccagagaaucaauguuacugggcaacaaaguuauguaccaccgaggcagcugacaucaugaugcugcauacuccuccauucuacacuaagcccagauacagaaccaaacauaagauccuucacaaaagcaacaaauaaagacaaaggacaugaaagguacugagaauggcaacagguaaaaagcacuuagaaacugcuguaccaaugcccucguuacagaaauauaccaagaucuacugaucaaaaaauagcaacaaauucuuccccaguucaggcuuuauuuugcagcaaauaauguuauuaacaaagaaaauguccaagauugagacaaauguauauaaauguauauaaagcuccacaguuuuauccuaaaagccuggauguccaugagauauugaagaugcuuaaagauguaaaacuugucucaaauuugaaggaaaagaaauaaagggaauucaaauuuuuacaaaaugcaaauaaaacacuugaaaaauuccuucuucccuuggcuucauuuaaugacccugcacaggcuccuagguuuccugcucucugaccugugcacugauguccagaugccccucccuuaaagguggauguaacuccgcauucuauccuauucuuuuuuuucaaucuauacauuucccuucugagaugugaccuacuucuguggcuucaaugaccaugcauuagaaagacaucucaaaugcaggccgggugcaguggcucacuccuguaaucccagcacuuuggaaggccgaggagggaggaucgcuugaggucaggaguuugagaccagccugaccaacauggcgaaacccugucucuacuaaaaauacaaaaauuagccaggugugguggcgcaugccuguaaucccagguacucgugaggcugaaguggggcgauucuucuacuucccagguacucgugaggcugauguagaagaaucgcuugaauaaggggggcggaaguugcagugagccgagauuuugcaacaaaaucuguugcagugagcgacagaguaagacugucucaaaacaacaaaaacaaacaaaaaacaccucaaacgcaacaaaucgaaauaaccccucuaccuuugcuucacaaucugauccuccuucaauguucuguuucaagggauauugcuauccauugguauuguucccaacauauauuucuaagcuuauugcggccaggucagcagcaucucuagcuauucuucaccucacacuucaaguauuccaccauuacuuuucacagcacucuggugccuaugacaguacuucuaacacugcacuguaauugccugguuaucuauuugccucacuagaugguaaggacuaacuaguguccaugaggacaaggacuuugucuauaauguuaacauugaauccaaugcuugacaguauuuggcucacaguaaucacgcaaauauuuuucuaauacccuagaucgaugcuuccuucauuaaaaaaaaaaaaaagaaaaaaaaaguucagccucccuuuauuauuuuuuuugagacggagucucgcucugucacuccaggcuggaguauaguggcgcgaucucggcgcaagcuccgccucccaggguucacgccauucuccugccucagccucccgaguagcugggacuacaggcacccgccaccacgcccggcuauuuuguauuuuuaguacagacgggguuucacuguguuagccaggauggucucggaucuccugaccucgugauccgcccaccucggccucucauugugcugggauuacaggcgugagccaccgcgcccggcucagccucccuuuaaagagaaaacaauuuacuuuagaaucccggaaauauuuaacugggguccccaggccccaaucuaauaaacauugauuucagaaggaguuuuaaaaguuuuauucuuguaacuggcaaggacuuagaauaccacagaaaugaaaaccccaauuguaaaaagcaaucaaguacaucauuucaggaaccacugauuuuguuucagguacuguacuaguuauaguuuauuaaaaucacugggcuuccucuuacccgugggccuuccgaacgcacaugcuccacuaagugcaucuuggaacgucuccggcguccucccacccccaacacacacauuaggcgaaagaagaaacucgcuuaccaggagugcagagauagugguucccgcuggcgcaaagaacagggacccuggaggacgaaggacuccgacguacggacgcccagggauccgcgccgaagcuagcacgcagccuacccaacagucuacacagccgacc

SEQ ID NO: 192638 - RNA, 188968 nt, Homo sapiens
uuuuuuuuuuuuuuuuuuuuuuuuuuuuccuuuccccucccccucccucuccaagccggagggguccugaggugacagcgccugcaacugaaauuucagcagcgggagaagauggacaagagaaagcucgggcgacggccaucuucauccggugagaaagggucagagaagggcugaacauauugucuccuacccgggggaaacgggaggcgcaggcggcagcugggguugcggcccgaagccgcgggggcgagggcgggggcggggagaggaaggggcgcgcacaauggaaggcucccgggucgcccccgccccuggagucgaagacccgguccgagcugucaucgaagccucgggcgcucuucaccucaaaaccccuuuuauuuuuucccuccucccgcgaacacccuccuugcgucucaucggcccauggaucuucccgguuggcuugucacucucugccacgccuuccucguaauuccaccaauguuccaauuucauuucggcuucucagcgccugaccccacuuuccucucuuccuuugauucucgacuuugcgucccuuccccucucccuccucuuucccucagcagguagcugcugcuggggaggaaagguggggcuugcgaccggagacuccuuuucuuugauacaaugccucuccgggucucguucugcugaacaggcccgccuaauagccuuuuucuuuuccagccuacccugcgucuuccaaaagugauuggaaagucaaacaaaggauuugaagccgugcuuucguuguguuuuuauuuucagcauauuuuuuguuuuggacguuacuuuguuuuaaaugacuaucuucaguuuuguguacaacgucuuggaaacaagaaaguggaguuauaaaaacgugagguagagcuccucccaguugagaaguuuuuaucaaacauuucauccauuaggggguccucaaguccuuguguuaaguccuauggaugguaggaggagaggacgaggacucauaugcuuacaguccaguacacaaacgaacgcccaaugaaucaauuauuucauuucauuuuucuguuucugaugguaccguugguuucugcagagacaguuaacaauuacagauuuauuggccgggcgcgguggcucacgccuguaaugccaacaccuugggaggccgaggcggucggaucacaaagucaggagaucgagaccauccuggcuaacauugugaaaccccgucucuacuaaaaaaugcaaaaaauuagccgggcgugguggcgggcgccuguagucccagcuacucaggaggcugaggcaggagaauggcgugaacccgggaggcggagcuugcagugagccgagaucgcaccacugcacuccagccugggcaacagagcgagacucuguaucaaacaacaacaacaacaaaaaaaaaacaaaaaaaaccaauuccaaauuuauuuaggagugcccuguggcagugcaucucaaacugcuuucagccuuaauugcaaaggagagugauuauggaucucuggggacacugcuugaagcaguugaaaaccugaaaucccuuuucauaugcaaccaauguuaucgauguucuugguguauauucuggagauaauaguuuuuuccuuugaaagcacauguauaaaugauauauauguauauuuauacauacauguagguauaugccuccaacugaugaguguuuuaauagucuccaccccccaccaaaccucuaaguaaaauggacacauuaggaaaacgcacaaugcuuagcuggugucauuugcgggcuuccuaacacagaacuuuaggugugaucauaucuuccuuugagaugcacaaccuuuuuuaaauaaaugcauuucaucuagguuuaauacauuuuugaggagggaagguaagauauuugccuuguaauucaacaagucacguuccuuuuuaccugauuacacuuagauuuauuuauuugucacaguaacuugauguaaguaguugugggaaguggauuuugauaauaaagcuguuaauccuuaaaagacauugauauuuacguuaguuauaucucuagagagcguuuucuuuuucucgugaucucucuuuuggagcuguccuuucugaaaaguaagguauaauaaaauccauacccaaaucuaauguuaccuagcuguucuccaguaugccucuaguuuuaagaugugcacuaauuaauuuuuaaguaugcuucugcuuuucuuaauagcguauauuuaauuuccugaauaaauucucagaaauaaaacauuggcugguugaaagauuccguguagugguuguaggcaugcaguugccauuucauuguaaguuguugcuaacuggaacccaaaugaagugacuuuuuuuuuuuuuuuuuuuugagauggagucucgcucuguugcccaggcuggagcgcaguggcacaaucuaccaccccugccucccagguucaagcgauucuucugccucagccucccuagcagcugagauuacaggugccugucaccaugcccgguuaauuuuuguacuuuuaguaaagaugggguuucacaauguuggccaggcuggucucaaacuccugagcucaggugauccacuugccucggccucccaaagugcuggaauuacaggcgugagccaccgugcccggccaugaagugacauuuauagucaucaaaguuuccuaaguaugcagaagaguuugauuaauaaaacaggaagaagagguagaaggaagguggguagcaguagaaagauaaaauaaaacacaaaauuugaaguuuuaucugugagacuacauuaggcugcccuaaacuuucugcuaaacaaggaagaacuguaaaauguucacaguguaccgcucaaaacuuuuucaguugcaaguagcagaaacccaauuccagaugguuuaagcuaaacacauguauuuguaacucauguaacugauaacuauaccauuuaaagcaguauauuagauggugauacacauuaaaaaacggcuggcaucagagacagguucacugaaguugaaugauaaagugucugggagcaagggagaaugaccauuaaaaguguuaaacaacaaaaauacagcacagauaaauuagaaucauagacugcaauuuucaagugaauuuuugaaucaaaauaggaaacgucaaguaaauuugaaccaguuuucaacugauugcuucaggcaacauucuuggaggccugugucacucucauuuguaguuaaggauaacguauguucuuuaaguacuuaggcacuagacauugugcuaagaacuucacaaacuucaauauuuucaaaagccuuauaagguaauuguuuuucauuuacagaugagaaaaccgggauuuaggggcaggauaaagauuaguaauagcuaguaaggaacagaauucaaaauguggucucuaauuacaaaaucuauaguuuuaacuucauuuacugcuacuagugucccugaugguauaacuuucuuaaaucuuucaguagguccaggugauguuugcuuugcauugaaaguguaaugaaugauaauugaagcucaagaugagaacuuaacgauuaguuaugauaaagcugcauuauuugcagcaaucuuaguugaagucauuggaaugaauggaauugcccacaaaaaauaguauagagugaggaaggucuuaaaucacauacaacuaauuucaaagugcggaggaagagauauuacuaagcaguuagauaggcugauuaggauugugacagguucgggaagaaagggaggagaguaaaaaaaauguuagccuuucagagaguuaaaguagcaugaggguacuggauuuggcaauuaggaggcuacuuuuacugaugguaagagugguuaguagacuaguagacaaaagccagauuucaacaggcuagaggaaugaguggcagugaggaaauggggcagcaaaaguaagcugggaaaaugagaugggaaggaaauauuucuagaacaagcuugaguaggaaauuagguagaaaggcuuguuuuuuuuaggaauaugagagacuuaaaucagguugguagggagugggaaagggguggagagggaaagauugaauauauaucagguaggagauaauggagugaggucccagaagaaaugggagagagggaugacaucaaagaacaguuuggugagauauagggaaaggagaaaagauggauaaagauauagacagaucuugagaagcuaaagauauugcaguuuuggcuucuaaaaugaaauaagguaauuuuuugagaaaggggcuuuuaaaugguacugggaaugcaagauaggucaauuagggaugaauauauauuaaguacucuugcagucuuaguuauagcaagugugaguuuuauaguaguuggagcuguuaguacuuugugacuuaguagugccaagcauuacaagagcaagaguuuggaagaaaaaugaguuuaauuuuacuuaaaggguguggcaagauauaagggcaaagaguggauuuaguggcagugaggaagacaguauauagaaugaaagguuugcauuugagaacuugagaguuuuccuuaaagcuguaaggaacaguuuuccuuaaagccuuucuuuuauuuuuuuggagacggggucucacucugccccccaggcuggagugcaguggcacgaucucggcucacugcaagcuccgccuccuggguucaucccauucuccugcuucagccucccgaguagcugggacuacaggagcccgccaccacgccuggcuaauuuuuuuuuguauuuuuaguagagaugggguuucaccauguuagccaggauggucuugaucuccugaccucgugaucugccugccucggccucccaaagugcugggauuacagacgugagccacugcgccuggccuccuuaaagccauucuugaaugcguauugcugaaauggagauauguagaaguuuguaccauuaaaugaagaugaguccauuguuuugagugaguugauuaauggauguuuuagugcuucagaaugauggugaauuuugaugauacguaaacuaugaaccaagaaucagaguauucuagacauguuggaaaggaucuugggucaguagauggcagucauaaauaugggcaagggaauauauccaauuuuuuuuuuuuuuuuuuuuuuugagauggagucucgcucugucgccaggcuggagugcagugacgugaucucagcucacugcgaccucugccuccuggguucaagcgauucuccugcaucagccuccugaguagcuaggacuacaggugagugccaccaugcccagcuaauuuuuguauuuuuaguagagacgggguuucaccauguuggcuaggauggucucuaucucuugauaucaugguccaccugccuuggccucccaaagugcugugauuacaggugugagccacugugcccagccaggaauguauccaauuuauguuaauuuuaaaggaggaauuauuguaauaaaguuagaauauuaauaggagaugguggcgguggggaaggagauuuuuuuuuugucuuccccccaaaggaaacaauggagauuguucaucucuacuucuguuuuauaagugggagaguuuuaacaaaguaauauaucuaauaaaaagcuaggauuuaguuaaccuaagguggaggagaaauucaaggaaaauauucaaaauuuaaggaaacuguauugacuuuggaaaagaauuugguaaacuagggaagagaugaagaagauguagaugaggggguagaauucaauuauaugaggugugauaauaagaaggugauaggcuauagggauugacaccuugguggugauuccuaggcuugaugauggaaggcagaggauugaaaaguaaauuaaggggguaugguaacacagagaauggguuaugaauaagauugaguagcuccaaagauccagacuagaauucuguuauaaugccuuccugaugaauaacuuucauuuggguuuucaguaauuuaugaaucuggcugauguggucugcuucauccuaguucgugugugcucguauugguaaaucacccuuggguugugccuggcuccacccauuucugccugucuaaaccuuauucuucaaagcccagcucuuuuuuuuuuuuuuuuuuugagaugggaucuugcucuguugccuaggcuggagugcaguggcacgaucauagcucaaugcagccuugaacuccugggcucaggcuauccuccuacuucaggcuccggaguagcuaggacuacaggcccgcacuaucaugccuggcuauuuuuuaaaaaaacuuaguuuuucuagagauggugucucacuguguuaccugggcuguucuugaacucuucgccucaagcgauccucccaccucggcuucccaaagugcugggauuauaggcaugagccaccaugcucagcccaagcccaguucaguugugccuuuccaagaaccauuuccuugauuaauucaaacuuaaauuuaugccuguuucugcacuucuguuggucuuuaugccucuuauaugauaauuaucagauuccaucauauauucuagcuugcugaguugucuaaugucuacuucuauacuauuaacacugugacagggacugucauuaauuuuauuuccccauagcauccaguaugccuagaguguacugguuuagaguaccaucucuggaauaugaccggugauggaucacuaugguaacguugggcaaguuauuuggauuccucaaaucuuaauuucuuaaucuauaagauggagauuauacauuauugauuucaugauauaaggauuaaggaaaauaauuuguguaaagcacuuagcauaauuccaggcaaugauaauuacuauuaugucaaauaaauaggcugggugcuguggcccaugccuguaaucccagcacuuugggaggccaaggugggcagaucacuugagcucaggaguucgagaccagccuggccaauauggugaaacucucucucuacuaaacauaaaaaauuagccaggcauggugcuuccugccuguagucccagguacuggggaggcugaagcgggagaaucgcuugaaccugggagguggagguugcagugagccgagaucgugccacugcacuccagcgugggugacagagcaagacuccgucucaaaaaaaaaaaaaaaaaauuauggaauaaauaagugaaugagugggaaaaguuaugcuuuuaguuuuuugacucauauauuuagaaugagaguaauuggagagauuuuccuauaugcuaaugcuaauauacuacagucuuuuaaagggagauacuugacuauaaaauguuauaguuaccauuucuuuugcacuaacuauguguuagucauaaugcuaaaugccuuaauauggacuaucaugcuuuaaucugaacgauuaaaaaggcagauauucuccgccauuuuacagaugagaaacugagacucagagaagucacaacuaguaagccgagauacaaauuuagguugucuagcuuuaaaauauguacucuugagcaugguaacuauaccauacagucucaagucgaggcacaucauaugcuuauuuaaacacuccagagcuaaccugguauaagauggagcaagucagcuauaaaaaaauuguaaauuuuuuuauuagacaaaguuggccaagaagaaaaaaacauaaauauuugggaauucacaguagcauuaaugaaaggaaauaggggaacauacuacaaaacaggauggaagcacuuuuaacccagugagacauuuuugggauauaaauuuguaaauuaaaauuuaagaaacugacauuccuuuuaaaaugacauguacuuuuuuauuuguauaaauuuaaggguuacaaguacagcuuuguuauauggguauauugugugguggugaaaucugggcuuuuaguguaaucaucaccugaauaguguacauuguacccauuaaguaauuucuuaucccucacugcacugcuccuagccuuccaagucuucaaugacuguuauuccacacucuauguccauguguauacacauuauuuagccccuacuuauagugagaauaugugguauuugacuuucugaguucuuuuuuuuucuuuuuucuuuuucuuuuugaaaugguuucgcucugucguccagacuggagugcaguggugcaaaaacggcccacugcagccucgaccuccugggcucaagcgauucuccacaugccucacugcagccuugaccuccugggcucaagcgauuuucccaccucagccucccaagcagcugagaccacagguggugucacuguaccuagcuaauucaaauaaauauuuuuagagacagggucucaccauguggugcaggcuggucccaaacuccugggcucaagcagucauccugccuuggccucccaaaguguugggauuauaggugugagcuucuaaucugaguuguuucacugaagaugaaggucuccaguucuguguuacuguaaaagacgugaguucauuccuuuuucauuccggaauaguauuccauuguguauauguagauauguguuuuguuaaauuuaaaauugacuagaaaaugaauuucuacaggauacuuucuuaucacuuauuuaaaaaauucuuuauuuuugguagucaacuugaguacuaguuuauuuaaauuauuugaaguuaucaaaagcuuaaguguagaggugaaaauaauuuuuuuuuuuuuuugagauggaauuuugcccucguugccuaggauggagugcaauggugugaucuuggcucacugcaaccucugccuccuggguuugagcgauuuuccugucucagccuccugaguagcugggauuauaggcaccugccacuacacccagcuaauuuuuuuuuuuuuguauuuuuaauagagacggguuuccccauguugaccaggcuggucucgaacuccugaccucaagugauccaaccaccucggccucccauuagugcugggauuacaggcaucagccaccgcgccuggcccaaaaauaauuuuuuagaucaggaaaacauuacaugguuucucagcaagugcauguagugaaacuaaugcuguguauuaugaacuuagaagaaaucauuucagcaauauagauuucuggguagucuauauuucauuaguuauuauuauuauuucugauuuuaaguaccauacaguacacauaucuuuaguguauaguucagugacuuuuuuuuuuuuuaauuugagacagugucuugcucuguugcccaggcuggagugcaguggugccaucauggcucacugcagccucaacugccugguucaagugaucuucccaccucagccuacugaguagcugggagugcaggugcacaccaccacacucagcuaauuuuuguacuuuuuuaugcagacgggguuucacccuuuugcccaggcuguucucaaacuccugagcucaagcgaucuacccaccucagccucccaaacugcugggauuacaggcaugugccaccaugccuggcccccaucacuguuuuaacuaguguuaccauagguuuauuuuaacucuucuugaauuucugagaaauagaaucauauacucuucugcaucugguuuccuuugagcaugccugagaaauguauccauauugugcguagcaguaauucauuaucuuuuauugcuauacaguuuuccauuauaugaauauguuuauccauacuugauggauauuuggguuguuuccaguuuuuggauauuaagaacaaaaauaccugaauauucuuauuucuguugguuauuuaucuaaaaguguaauuguuggacauugcauaggcaggugucuaacuucaguagaugcuggugaagcagauguacucauuuacacucuuagcaagaguauaugaguuccagucucucaccaauauuugguguugucaaucuuuuuacuuuuacccauucuaaaggcuguuuaaugguuuucauugccauuuaaauuuugcauuucccuagugauuaugaaauugagcaccuguuuauauguuuauuggccauuuggauauucuuuuuuugugaagugccuauucagacuuuuguccauuuugaagauaggauuaucuugcuuuugcuuuguaggaguucuuuauauauucugguuaugaauucuuugacaaauacauguauuauaaauauuuuucuuuuauucuugacaugccguuucacucuugaugauuuuugaugaacagaaguucuuuuuuuuuuuuuuuuaaaucugagacagggucuuacucugucacccaggcuggaaugcaguguugcagucauggcucgcugcagcuguaaccucccaggcucgagugauccuuccaucucagccuccugaguagcuggaacuacaggcaugugcuaccguguccagcuccuuuuuaaauauuuuuauagagauggggucccacuguguugcccaggcuggucucgaacuccugggcucaagugauccccaugcccuggccuuccaaaguguugggauuacaggcaugaaccacugugccugaccuuuuuuuuuuuucuuuuuucuuuuucaaagcaaauccagccaggcgcgguggcucaugccuguaaucccaacacuuuggguggccgagguggguggaucaccugaggucaggagaccagccugaccaacauggagaaaccccgccucuacuaaaaauacaaaauuagccuggcaugguggcgcauaccuguaaucccagcuacucgggaggcugaggcagaagaaucgcuugaacucgggagguggagguugcagugagccgagauugugccauugcacuccagccugggcaaugagugaaacuccaucucaaaaacaaaacaaaacaaaacaaaaaaacaugcuaauccagugugguucuuuauuuuucuuucaugucagauggguaauacgcugaccugguaacaagguucaagguggcauaucucacagaugcgugugaacacccagucaucaugcucaugagcuacaguaggaucagaaguucuuaauuuuaaugaaguacaguuuauuaacguuuucauuugugguuaggacuacuuguguccucuuugaaaaaucuuugccuacccaaaggucgugaauauauucuccuacuuaaaucuagaugcuuuguuuuuaucuuugacauuucaaucuaugauucauuucaaauuaauuuuguguauggugugagguagucaaggguguuauucccccauuugguuaucagauugccucagcaucauuuugaaaaucaucccuuuccuauggaauugcagucgugcauuugucauaagcagcugaccauauguugaaucucugccauuuauuuuuuuaguaaaaucugugauauauuccaguagacucuaaguuccaggaaaguuuggaauuugcccacuauacuguacugccuaauuugcccacuauacuguacucauugccuagcacagugucaggcacauaauagacauugaauuaauguuugcugguuggaaguuauaacucagaaaaauccacagcaagucugaaaaauguuggugaguaaaagagaguuaagcuguucccuaagcauguugcccagcaugcuuagauauguaguagaacugaaaguguuuuuauagaauauucucaacuucuaacuucuagaauuucaccugcuucuaccucccccauuauaagaauuugucugaucaaaugguucuacuacuaggugugaggucuuuggucagggaauuucuguuuaguucuuagagccaaguuuuccucuuucuuuucuauugucauuauauauauauuuauauauauaaauauuuuacuggggacauuuugugagaaucugcuauucuucugacacauguaguuauuuuuugacuuuuauguuuagcccuucaguuucuguaaaauguguaaauucuaaaucuaacaaguuaauuuaaaacaaaggaugaaugugaaagaaucuccuuugucaaacuguuuaucucauuuagauguuaaacgauaauuuuuaccacgucuuugguuuuuguagaaaucaucacagaaggaaaaaggaaaaagucaucuucugauuuaucggagguaugcauuuguuuugcuuuuaaccuauuaucuuuggaguuacugauauugaaaguauuuugcuguuugucuuuuuaauaacauuuuaaagaaaacaguauaaaacuuuagucaguguuuugggagagugguguauucuaauuaacugaagguuaaccaggagacuuuucuaccaacuuuguuuaaauaguugacuaguauacuuucuggaccagaugaccaguauacuuuccagagcucauuuuagauuuuauuuaaaacauagcacaacauuucuuugaugacuuaaucuauuagaguaccaaugugcauucauuaguaaugcuauagaugcagaguaguuguacucaagguaugugcugaacauuacuauugggaauauguccuuuuaagccucuuuuuuucauuuauuucuucuacguaagccaagaguagcaaaacaaacaaaacgaaguuucuaccuauauaggaaguguuuuaaaaaauuaauuccuuuuaagaaagauaaucuuuuucuuuuuuuuuaagagacagggucuugcucuguugcccaggcucaaguacagcucacugcagccuugaacuccugggcuuuagggauccuccugccucagccucccauguagcugggaauacagggaugugccaccaugaccagcuaauuuuaauuuuuucuuguagagacaggggucuugcuauguugcccaggcuggucucacauuccuggccucaagcaauccuccugccuuggccucccaaaguguugggauuauggcauaagccaccauaccuggcauauagagauaauuuuuuuucuagaauuuuguucuuuaaaugcaguaauaucccgauuuacauuauaagaauuuauuaaacccuuuucucugaagcagucuaaguuaugcacagagaacuuuaauaugauacgucuucauguuauauaguuauagcauuuaacaaagaaggagaagaagucauaaaggaagacaaugagaggaaaucaagaguaccuuagaagaccauauagaaaguauggcuuuagauacacuuucuuuuuuggcuuaagauuugcauggugugguuucuccauuuaaaacucuggauuuaguuuaagugggguaaauaggagguuaaaaaaaaucuugugcugaggcgggcggaucaucuuaggucaggaguucaagaccagccuggccaacauggugaaaccccgucucuacaaaaauacaaaaauuggccgggcgcaguggcucaugccuguaaucccagcacuuugggaggcugaggugggcagaucacgaggucaggagaucgagaccauccugguuaacacggugaaaccccaucucaacuaaaaauaccaaaaauuagcggggugugguggcaggugccuguagucccagcuacucgggaggcugagguagaagaauggugugaaccugggaggcagagcuugcagugagcugaaaucaugccacugcacucuagacugggcgacagagcgagacucugucuccaagaaaaaaaaaaaaaauuagcugggcaugauggcaggugccuguagucccagcuacuugggaggcugaggcaggaaaaucgcuugaacccgggaggcagagguugcagugagccgagauugcgccauugcacuccagucugggugacagagcgagacucugucccccgcugcccccuaaaaaaaccuuacauugccaggaugaauacuaucauaucuacuuugaaauaccucuguauuaacuaccacuauuuuuguuuuuauuauauccagugaagugaaauaucgugcuuuagacuauugcauuauucaugcaauuaaucugaaauccugccauuagaaauuaauacugaguuaauccauuucucugauuuuuagauguacuacaguguuucuuaaacuuuuuguuuacaaggaaguugagacuuacagaaaaguuacagaaauuuuacagaguuccuguaaaauucacucagguucuccuaauguuaucuuauauaacuacgguaugauuacaaaaaacaaggaauuuauauugauacaguaccuuaaaccagugguccccaaccuguuuggcaccagggaccaguaucguggaagacaguuuucccauggacaggggucgggaagaugguuucgggaugaaacuguucuaccucaaauuuucaggcauuggguucucaugaggagcaugcaaccuagaucccuugcaugcacaguucacaauaguguuugugcuccuaugagaaucuaaugccacugcugaucugacaggagggguagugcaggcccuaauucucccgugcugcucgccuccugcuguguuguccuuggccuggggguugggcacaccugcuuuaaacuauagacaucauuuggauuucuucaguuucacuaauguccuuuuucuguugccagauccaauccaggaucccacauugcauuuaguuguuaggucucccuaguuuucuuaagucuaugacaauucuucagucuuuuuucuuucaugaccaugacacucuugaagaaaacuggacaguauuuuguagaauaucucucacuuuggguuuguuucagguuucucaagauuagauuaagguuaugacuuuuugggaggaauaccacagaagugaugaugaccuucuuagugcauuauaucaggggguacaugauagugauauaucuuaauacugguaauaucagccuugauuguuugguuaagaugggaucugccuguuuccuccauuguaaaguuacuuuuuuccucuuuauaauuaauaaauaucuuaggggagaugcuuugaaucuaugcaaauauacuauuucuucucaaacuuuuguuuacuauuuuagcaucuaucaguguaucuugccuccaaauuuauauaugugguauuuuggugguuuucucuuuugcccauucauuauagauuuaugaauguaaauucuucuauaaggggccagugugguggcucacaacuguaauccuggcacuuugggaggccaaggugggaggaucacuugaggucaggaauuugaggccagccugggcaacauagugagaccccauaucuacaaaaaaaauuagcugggcauguuggcauaugccuggaaucccagcuacuugggaggcugacauaggaagaucguuugagccaggggaguugaggcugugaucagcugugaucgcaccacugcauuccagccuggauaacagagugagacacugucucuaaaaaauaaaaauucuuauguaaggcagagcugauccucuucccccacuuacuuacuuacuuauuuauuuauuuagagauccuccugcuucagcuucucaaagugugaggauucuaggugugagccacugugcuuggcuucacuuauuuauuuguaucaauauggacucauagaauauuuaguuuauucuaugaguuauaauccacuacugucauuacagauuuguuggucaaaguauuccagccuugggagaucuuucauguuggcuguacccuugugacgugcuccuaucuuuuuuuuuuugaacacuuacuuucugacacuguauauuuuuuggcacugcaagaugcuuauguuguguuuucccugccccaggcuuggaaucaaccacuuucccagggagccuugguucuuucaauugaaggaugauauuuagaaacccaugucugugugcuagguauacuugcaacugggaugucauuguuuuuaggcuuucucaacagacaagacuagaaaaauauauguucacacauacaacauacauaugucuauuuauuuucccacacaaacacauguaucuauauuuauuucuguaucucuaucuauauaucuauaaaaaauuaauacugauacuucugauuccgguccaacaccacaaggcuuauucuagcuuuuccucuuuccuuauuuuuuucugucucucauuaucuacaauauauuuacuuauuucuuaaucccguaauuuauauauaaaguuguguuaguguguuuaaaaaagguagacuuucuuagaaaauuagcauauuucauuauuguuaguaguuuauauuacugccuuuucccuccaggcugcuaguggaaauaaguuaccaaaaggauaagagcuuugauggauauagggagaagauacuaauacguguugaauuuaaaguguuuggccugggccugguggguuggcucaugccuauaaucccagcacuuugggaggccaaggcggguggaucacuugaggucaggacuucaagaccagccuggccaagauggugcaagcccaucucuacugaaaauacaaaaauuagcuggguaugguggugcauuuuuguagucccaucuacuucggaggcugaggugggaggauuguuugaacucgggggcggagguugcaguuagcugagguugugccacugcacuuucagccugggaaacagaacgagacucugucucaaaaaaaaaaaaaaaaaguguuugaaguguuuggcugggugugggagcucaugccucuaaacccagcacuuagggaggccaagaugggaggauugcuugagccacagagcccaggaauuugggacuagccugggcaacaaaguaagacccugugucugcaaaaaauaaaaaaauuagucagauaugauggugcaugccuguggucccagcuacacaggaggcugaugcaggaagauugccugggcccaagagguagaagcagaaguaaguuauguuugagucacuacacaccagccuaggugacagagcgagacccugucucgaauaaauaaauacauguuuaagaaauauuucuaaaaugacacuagauuguuguagagauauucuaaaguucaauuaagaacuuauuucacugggugaauuaaggccacccagacacaaccagaauuaauacuuugguguguauccuucuaguuuauuugucuguuuauaagaaacauauuaaaaaauagaaaaccacaaaauacugucuuguaaucuuuuuuccuacuuaccuauauaucaugaacauuauuuucugaaaucuaauuuauuaaagcauuggucaguagauauuuauuggguauucaacauguauuggacacuguguuaggcauaaguaccagggaaacaguggugaacauuuuuuucuucgacuuuuauuuaagcucgggguacacuugcaggauguguaggaucauugcauagguaaaugugugccauggugguuugcugcaagaacaacccaucaccuagauauuaaggccagcauccauuagcuauucuuccugaugcucccucuaccggucugacaggccccaguguguguuguucccccauuguguccaucuguucucaucauucagcucccacuuaaaagugagaacaugcauuguuugguuuucuguuucugcauuaguuugcugaagauaauggcuuccaacuccauccaugucccugcaaaagacacgauuguguuccuuuuuagggcugcauaguauccuauguauauauguuuuauauuuucuuuauucagucuaucauugauggggauuuggguugauuccaugucuuugcuauugugaauaguguugcagcaaacaugugcaugcauauaucuuuguaauagaaugauuuauauuccuuuggguauauacccaguaaugguguugcuaggucaaaugguauguuugccucuaggucuuugaggaaucaccacacugucuuccacaaugguugaacuaauuuacaaucccagcagugguguaaaaguguuccuuuuucucugcuacauugccagcaucuguuguuuuuugacuuuuuaauaauagccauucugaguggugugagauggugucucguugucguuuugauuugcauuucucuaaugaucagugaugucggccacaugugugucuuccuuuaagaacuguuuguucauauccuuugcccacuuuuuaaugggaauuuuuuuucuuauaaauuuauguuccuuguagacucuggauauuagaguuugucagacggauagacugccaaauuuuucucccaaucuguagguugucuguucacucuuuugcugugcagaaguuccuuaguuuaauuagaucccauuuaucaauuuuugcuuuuaucgcaauugcuuuuggcauuuuuguuaugagauauuugcuugugccuauguccugaaugguauugccuugauuuucuuguaggguuuuuauaguuuuguguuuuacauuuaagucuuuaauccaucuugaauuaauuuuuguauaugguauaaggaagggguacaguuucaauuuuugcauauggcuagccaguucucccagcaccauuuauuaaauagagaauuauuuccccauugcuuguuuuugucagguuugucgaagaucagauaguuguagguguguggucuuauuucagaguucucuguucuguuccauuggucuguuccauugauucuguuccaggaaugcgugguauggcaugaugguuguauagauaaaauaguaauuuugacaagaaucuggaguacuucacuagggagagaaggaagagcauucuagauugugggaagaguauaugcaaagguuuagagauauaaaauaauaugauguguuugaagaagguugauuucauucauugugguuggguuguaguuuuguagugaugugaugugaaagagcccaaaugguaaagaguuuuacaauuguuaagaguuuuaucuguaaguaauggcuaccauuguugaauuuuaaguauugcagccauaauuagguuuuauguauuagagaacucuggggcugacauuugaaagguuaaaaggggaagagacagcagacaagagaauaguuaggaagcucuucugauucuucauucaacuuucauuugacuuucagagucaaggagagguuuuuugugaauaaaauuauauuuaauuguauauaaauuaagcacugaauuuaaaacuccuuaaaacaguuagcaaauuauugaugcaggguaguauagugguucuguuagcugaauuagcucuuguauauaguucaauuaaacuaauuauuuucucauccuauuuucagauaagaaagauguuaaaugcaaaaccagaggauguccauguucaaucaccacuguccaaauucagaagcucagaacgcuggacucucccuuugcaggugguaaauaaaauuaauuuauuuuaaguauacaguuuuauuugguauguuuaaaauauuguaauaaaacugaauguuuauuuucugauaugucccuuuuuugguuuucuuguguuauuuaauugcagauuuuaguucauuuuuggcauguugaaaugauacuuugagguuaggcucuucguuuaaaacuauguauauauaauuaugcauaauugauuacuucaugaaauuuaaaucuuauuauuguaaaauaaauucuguuuuaaguuuacuaaaacgauaauguuuauagaauuguuuguucuuaugcacuugacccauuuuaaguuuuaaaauguauguuuuaaggaguaauauaacuauauuucaaaagcuauuuugauuauaaaucuggacuuuaucucauuuuuaagcauuauaaucagacuuugaugaauaaggauuaagauagcaguuuuuuguguuuuguuuuuuaacuuuuauuuuaaguuuagugguacaagugcagguuuguuccauagguaacuugugucauggggguuuauuguacagauuauuucaucgcccagauauuaagccuaguacccauuaguuauuuuuccuguuccucucccuccucccauccuccaaccucugaaaggccccaguguguguuguucccucuauguguccgcguguucugaucauucagcucucacugauaagugagaacaugcaguauuugguuuucuguuccuguguuaguuugcugaggauaauggucuccagcuucauccaugcaaaggacaugaucucauucuuuuuuauggcugcauaguauucugugguguauauguaccacauuuucuuuaucuaaacuaccauggaagggcauuuagguucuuuagagucagggucuguguugcucacacuggagugcaguggcacacucauagcucauugaauccuugaacuccugggcucgagugaucuugcugcccagccuccugaguagcugggaauacaagcaggugccuggcuacuuaaaauuuuuuuucuguagaggugggaucuugcuauguugccuaggcuugucuugaacuucuggccuuaagaagucuuccuacuuuggucucccagagugcugggauuagagguaugagccauuaugccuggccuuggaauguggaaguccaagaugaaggugcuggcaggguugucuucugaggccucuuuacuuggauugcagauggcuuuuucucugggcacacguaccccuagugucucuucuucuuauaaggacauuaguccuauuggauugggacuccacccacaugaccucacucaaccccuuuuaaggcccugggaguuggggcuucaacauaugaauuuugggggaauacaauucaguccauaacuguagcauuuauuuuaggauaacguguuuuaaguaaucuuaaaauguauauuuuugguuacaaguaaaauuaacccuuauuuauuuacguauuuuuuuuuugagacagggucuugcucugucacccaggcuggagugcacuggcacacucacggcucauugcagccucagcuuccugggcucaagcugugcucccaccucagccuccugaguaucucggauuagaggcaugcaccaccaugcuuagcuaguuucuaaaauuuuuuugcagagacaaaguuuugcuguguugcuuaggugaaccucccaccucagccuccugaagcgcuggguuuacaggcgugagcccccgcacuuggcucuauuaaccauuuuuuuuuuuuugagauggcguuuugcucuuguugcccaggcuggagugcaaugucgcgaucucggcucaccgcaaccucugccuuccggguucaagcgauucuccugccucagccuccccaguagcugggauuacuggcaugugccaccacgcccggcuaauuuuguauuuuuuaguagaggugugguuucuccauguuggucaggcuggucucgaacucccaaccucaggugauccaccugccuuggccucccaaagugcugguauuacaggcaugaggcaccgugcccgaccuccuauuaaccauuucuaaaauuuguucuuggaggagagauuuguccucaguauucuuugcuuaaaauuaguguaaaagaacauuuagaaauuuuguuauuaaauaauacauuuguugguuuguauuggauacaaagaguacauaaaaagggaaacaauaaaggagaccaggugacuucuguuuacuuaaaaagaaaauaauauauuugcauaagguuagaaaauuugggcuguguagaaagauacaaggugggcugugugugguggcucacaccuguuauccuagcacuuugagaggcugaggugggaggaucucuugagcccaggaguuggagaccagccuaggaaauauagcgagaucuuguuucuacuaaaaauuaaaaaauaaucuaggcguggucuugugcaccuguaguuccagcuacucagcaggcugaggugggaggaucucuugagcccaggauuuggagaccagccuaggaaauauagcgagauccuguuucuacuaaaaauuaaaaaauaagcuaggcguggucuugugcaccuguaguuccagcuacucaggaggcugaggugggaggauccuuugagcccaggaguucaagauuaaagaaagcuaugauugugccacuauacuccagccugggaaacaaugagacccugucucaaaaaaaaaaaaaaaaguauaaaaugaagcaaauaaaaucucguucuguccuuuuucucuaaaggcaaccacuauuaaugaguuuuuuucauuuauuucuagaaaaaagcauauuuccauauauauggguuuauacuguuuuuugauauucgcaaaaguuaagugauacuuaaauuuugggaaaucgaaauccuguuugagauuggaaguggcauaugucagccuuacugugcucugugguuggcuuaaaguucaccauauuugcuaaauauuugcucauacuuuguguaguguuugaggcugugcaaguaucuugccgcauuuccacuacucaacuuuuuuguuguuguuuuuagugguuuucaauggaagagaaaggaauaaaugccccuuuccauagucuuuaggagaauuuuaacucauuuauugauuuguuugugauuuuuauugacauauaguuacauuaaacaggcaaucuuaagaguaaaguuagaugagcucugacuagaguaacauauugucaugcuccagaaauuuuccuuguuuucauuuuaucuuuuaaaaaaaucaaaagaauuuaauauauuuuuaauuaauucauuuuucuuuuuuaugugacucaaguauaugacucaaccauugugucuuuuccucuucuguugcuuguaccuccaccaugauucuggcaaccauucuucugauuucuguuuccauaguuuugccuguucuuaaauuucauaaaaauggaaucacauaauauguacucuuuuguguuuggcuucuuuuuauucaguauaauauugcuaacauuuauccauguuuugcaucuaucacugguuuguuucuuuuuauugcuauguaauauuccauuaugugaauauauuaugguuuauuuaauucucuauugacugacuuuuaggcucuuuuuuuuuuuguuuguuuguuuguuuuuuuuuugagacggaguuucccccuuguugcccaggcuggagugcaauggcacgaucuuggcucaccacaaccucugccucccggauucaagcgauuucucccaccacagccucccgaguagcugggauuacaggcaugcaccaccacaucgggcuaguuuuguauuuuuaguagagaugggguuuauccauguuggucaggcuggucuugaacuccugaccucaggugauccgccugccuuggccucccaaaaugcuggcauuacaggcgugaaccacugugcccggccugggcuugguuuuaauuugcauuuuugugaugacuaaugacguuaaaaacauuuucuguggcuguuagguggaguguucuguagaugucuauuagguccaguuaaucacuuccgaguuuaagugagagucucuuugugagcuuucugccucaaugaucugucuaaugcugucagugggguguugaagucuuucacuauuaugaugugguugccuaacuaagucuuuuuguaggucaagcaaaacuuguuuuaugaaucuggguguaccaauagugggugcauauauaauuaguuaagucuuuuuguuggauuuuaccauuuaucauuauguaauacccaucuuuguccuucuuaauuguuauuuguuuaaagucuauuuuaucugauauaagaauaguggcuccugcucuuuuuuauuuucuguuugcaugguagaucugucucuuucccuuuacuuugagccugugaauguuguuagaugugagauggguaucuugaagauagcagaugguugggucuugucuuuuuauccaccuugacacuccaugucuuuuaagagggacguuuagccauuuauacucaggauuaguauugauaugugagauuuugauccugucauuauguuguugguuguuguauagacuugacuguauaguugcuuuguagugucugugggcuaugugcuuaaguguauuuuugugguaguaggugucauucuucugauuccauguuuaguacucccuuaaggaccucuuucuuguaaggcugguguaguugaagcaaauucccucaguauuugcuugucugagaaggauuuuauuucucuuucacuuaugaauguugggcugguaggauaugaaauucuuaguuguaauaucuuuucuuuaagguugccuaaaagaggcccccaaucucuucugguuugcaagguuucugccaagaagucugcugcuagccugaugggaguuccuucuguacaugaccugacccuucucucuagcugccuuuaagauuuuuucuuuugcguugacuuuggugaauuugaugacgaugugccuuggcgcaggcaaggcucucucugucgccaggcuggaguacaguggugcgaucuuggcucacugcaaccuccaccucccagguucaagcaauucuccugcgucagccucccaaguagcugggacuacaggcacaugcugccaugcccagcuaauuuuuuguguuuuaguagagacaagguuucacuguguugcccaggcuggucucgaacuucugagcucaggcaauccagcugccucggccucccaaagugcugggauugcaggcaugagccaccgcgccuggccugcaugucaaccuuucuauugugauuagggaaauuuuuguggaccauauccucaaauguauuuuccaguuugcguauucucucccauucuuucucaggaaugccagugagugauagauuuagucucuuuacauaaucucacauaaauuaucccuccacugaugaaauguuucuauaccuauaaaacucugaagacucugaugaagaguuccuagaacugauaaaggacuuuagcaaccuuucaggauacaaaaucaauguagaaaaaaucaguagcauuucuagacaccaaauaauguccaggcugagagucaaaucaagaacacaaucccauuugcaauaggcuuaaaaaaaaugaaauaccuaggaguacaguugacuaagaaggugaaagagucuacaagaagaaccacaagacacugcagaaaaaaaucagagaugacacaaauaaauggaaaaacaauccaugcgcguggauuggaagcaucagugucacaaaaaugaccauacugcccaaagcagucuacagauucaaugcuauuccuaucauacuaucaaugucauuuuucagagaauuagaagaaacuauucuaaaauucauauggaacaaaaaagagcccaaauagcuaaagcaauccuaaacaaaaagaauaaagcuggaggcaucacaguaccugacuucaaauuauauuauaagcccacaguaaccaaaacagcaugguacagguauaaaaacagacacauagagcaauggaaaagaacagaaaacucagaaauaaugcugcacaccuacaaccaucugaucuuugaaaggcugacaaaaacaaauaauggggaaaggauucccuauucaauaaaugcugcugggacagcuggcuagccauaugcaacagaaugaaacuggacccuuaccuuuuaccauauacaaaaauuaacucaagauggauuaaagauuuaaauguaaaaccucaaacuauaaaaaucuuaggaaaaauaccuaggaaauacccuucuuguuaucagccuuggcaaagaauuuuuggcuaauuccccaaaagcaauugcaacaaaaacaaaauugacaaaugaaacuuaauuuaauuaaagagcuucugcacagcaaaaaaacaaaacaaaaucccuaaggaaugggagaaaauauucacaaacuauugucucugacaaaggucuaauauccagauucuguaaggaacuuaaaucaacaaaugaaaaaccaauaaccuuauuaaaaaauaauauauguuuuuacauauauauauguaaaugguaagucuauuuguuuuaagguaugguuuaaauccauugugucuuuuuugacuuucugucuucaugaccuguauagugcugucaguggaguauuaaagucccccacuaauauuacguugcugucuauuucauuucuuaggucuauuaguaauuguuuuaugaauuugggagugccaguguuagguguguauauguuuaggauugugauauuuuccuguuggacaaagccuuuuaccauuauauaaugcccaucuuugucucuuuuaacugcuguugcuuuaaaauuuguuuugucucauauaagaauagcuacuccugcucgcuuuugguguccauuugcaugaaaugccauuuuccaccccuuuaccuuaaguuuaugugauuccuuaugugcuaggugaguuuucugaaggcagcagaugguuggugaguucuuauccauucugcaguucuguaucuuuuaaauggagcauuuaggccauuuacauucaauguuaguauugaaaugugagguaccauugcauucaucauacuuuuguugcugguguacuuggguuuuuuguuuuugcuuuuuaacuuguauuuuuauuuuauagguucuguguaauuuaugcuuugaagagguucuguuuugauguguuuccagaauuuguuucaagauuuagagcuccuuuucucaguucuuguagugguggcuugguaguggcaaauuuucucagcguuugcuugucugaaaacaacuguaucuuuccuucauaaaugauacuuacuuucguuggauacagaauucuugucugauaauuguuuguuugaggaggcugaagauagccccaauucccuucuagcuucuaggguuucuacugauaaauccacuguuaaucugauagguuuuccuuauagguuagcuggugcuucugucucacagcucuuaagauucuuuccuuugucuugucuuucgguaaccugauugccgugugccuaggugaagaucuuuuugugaugaaauuuccagguguucuuuguacuucuuguguuuggaugucuaggucucuagcaaggccagggaaguuuuccuugguuauuccagaauauguuuuccaagcuuuuagaauucucuucuuccucagcaacacugauuauucuuauguuuggucguuuaacauaaucucagacuucuuggagacucuguucauauuuucuuguucuuuugucuuuguuggauuggguuaauucaaagaccuugucuucgaguucugaauuucuuucuuccuacuuguuuaauucuauugcugagacuuuccagagcauuucacguuucuaaaaguguguccaaaguuuccugaacuuuuuauuguuuuuuuucuuuaagcgaucuauuuccuugaauauuucucccuucacuucuuguaucauuuuuuggauuuccuugcauuggacuucaccuuucucuggucccucccugauuagcuuuaugacuauccuccugaauuauuuuucagguaaaucagggauuucuucuggguuuggauccauugcuggugaacuagugugauuuuggugggggguuguugaagagccuugguuugucauauuaucagaguuguuucugguuccuucucauuuggguaggcucugucagagggaaggucuagggcugaaggcuguugcucagauucuuuugucccauggcauauucccuugauguaguacucucccccuuuuccuauggauguggcuuccugugagcugaacugcagugauuguugucucucuucugggucuagccacccagcgagucuucccagcucuggccucauacuggggguugucuggacagaguccugugaugugagucaucgauggaucucucagccguggauaccaaugccuuuuccaguggagguaguggcggggugcaauggacucuaugaggguucuuagcuuugguguuuuaauguucuauuuuugugcugguugaccuccugccaggaggugacccuuuccagaaagcaucagcuaugguaggauagagaggcacuggcggugggagagacucuagaacucccaagguuauauguccuuugucuuaugcuaccaggguggauagggaaggaccaucagguggagguggggcuaggcgugucugagcucagauucuacuugggugggucuuguuuuggcugcuguggggggugugggugagauucccaggucauuggaguuggguaccuaggaggauuauggcugccuuugcugagucaugcagguugucagggcagugggggaaagcugacagucacagaccucacccagcuaccagguaaaaugaagggccggucucugucccacugugcuccccucaacagucccaagucuguuuccagucugagggugugaaugggcuucucaccccguucaaaugguuagaaaguucugcuagagauuuccuucucccuguggaguuauaccccugcuccucuggucauccacccaauggauuccuguggugccaggcaggaauggcuugcuaggggacgcagcgagcucccagggccuuuuugcugcuuccucuaccccuguauuucaccuggcucucuaaauuggcucagcuccagguuaggucggaaacuucucccgcaaacagaccuucagcuucuccauugggggcacguguucgggagagggaggucucccuuucccacuuccgcaguuggggcacucacaguauuuggagugucuccuggguccugcaggagcaguccacauccuuuagagggucugugggcccucucgggauugcugguuuguuguugcugucgaucuggggcuaaaauccacaaugagagcuucugcaagcugcucugcauguagcugcaaucugguccugccuccuguccaccaugaugauuucaagcuguucauuuucuuacuguugaguuguaagaguucuucguauauuuagauaacaguccuguagcagauacgucauuuucaaauauuuucucucagucuuuggcuugccuucucauucucuugacauugucuuuccagagcagaaauuuuuaauuuuaaugaagcccagcuuaucaauucauucuuucauggauuguggcuuuggugucauguuuaaaaagccauugauagacucaaagucaucuagauuuucuccuauguuaucuucuaggaguuuuaugguuuugcauuuugcauucagguuugugauccaguuugaguuaauuuuuuuuuuuagacagagucuugcucuguugcccaggcuggagugcagugguguaauuucagcuuacugcaaccgccgucuccuggguucaagcaaucucaugccacagucuucugaguagcugggauuacaggcaccugccaccaugucuggaccuggcuaauuuuuguauuuuuaguagaggugagguuucaccauguuggccaggcuggucucaaacuccugacuucaagugaucagccagccucggccucccaaacugcugggauuacaggugcaagccaccaugcccagcccaguuuguguuaauuuuuaugaaggaugugaggucuuuguccagaucauucuuuugcauguggauauucaguugcucuagcacaguuuguugaaaauaccguuuucuuuuuaauaauuugaacuuucagacucagcuaguacauaugcagguuuguuacauggguauacugcuugaugcugagguuuaggguacuauuauaccgucacgcagguaggaagcauaguauccaauaguuaguuuuucaacccuuuucccacccccuuuauuccccacuaguaguccccaaugucuguuuuugccaucuuuauguccaugauuacccaauguuuagcucccacacuggaugcucauggacauaaagauggcauggguggccauaagugagaacauguaguauuuuguuuucuguuccugcauuaauuagcuuaggugauccuauguugcugcacaggacaugaucuuguucuuuuuuuauggccgcauagcauuccaugguguguauguaccacuuuuuuuuaauccaguccaccacugaugggcaccuagguugauuccaugucuuugcuauuguaaauagcgcugcaguaaacauuugacugcaugugucuuuuuggcagaaugauuuauuuucuuuuggacauauacucaguaaugggauugcugguucaaaugguaggucuauuuuaaguucuuugagaaauuuccaaacugcuuuccacaguggcagaacuaauucccaccaacaguggauaagcauucccuuuucuuuacagccuugccagcauucguuguuguuguuuugacuuuuuaguaauagccauucugacuggugugagaugguaucuccuugugguuuugauauggauugaaaggaacuuuuuucauucuauugcuuuugccucuuggccaaagaucaguugacuguauuuauuugggucuauuuuugggcuguauguucuguuucuuugaucuauuuauuaaaaaaaauaaaaagauaggucaccauagugucuaagaaaaaauaaaaaaauauucuuucacccauaccacacucucuugauuaguguagcuuuauaauaagucuugaaguuuggcagugucaauccucuauguuuuucucuuuaaaaauuguguuuuuuaugccuagucguuugcuucucuauaaacuuucuagucaguuuguugauauccacaaaguaacuugcugggauuuugauugacauugcauugaaucuguugaucaacuugugaagacaugacaucugaauaauauugacucuucuuauccaugaacauggaauauuuuucuguguauuugguucuuugauuucuuucaucacaguuuuguagcuuuccucauacagaucuuguacauauuuuguuagaguuauaccaaaguauuucuuucuuuuuuuuuuuuuuguugagacagagucucgcucugucgcccaggcuggagugcaguggugcaaucucggcucacugcaagcuccgucuccuggauucaugccauucuccugccucagccucccgaguaguugggacuacaggugcccgccaccacaccuggcuaauuuuuuuuuguauuuuuaguagagacaggguuucaccuuguuagccaggauggucucgaucuccugaccucaugaucugcccaccucgguaucccaaagugcugggauuacagacaugagccacugcgccuggccaaguauuucauuuuuuaugugcuaauguaaacgauauuguguuuuuaauuucaaauuccaguuauuuaugcaggcauauaggaaggugauugacuuuuguauauuaaucuuguaucaugcaaccucgcuguaauugcuuauugguuucaguuuuuuuguucauucuuuuggaauuuccacaucgacaguuacgucaucugcaaacaaagacaguuuuauuucccaaucagcauaucuuuuuaaaaaguuauaaauauuuguauauauuuauggcauacaugugauauuuuguuacaugugaagaauguguaaugaccaaaucaggguguugaggauauccaucaucacaagcauuuauuauuucuauguauugagaacauuucaaguucuuacuucuaguuacuuugaaauauacaauacauugauguuaacuauagucaccguauucuacuacugaauauuagaacuuacuccuucuaucuagcuguauguuuguagccauuaaccaaccucucuccauugugaccucuccccucuacacccuucccagccucuaguaucuauaauucuacccucuaccuucaugagaucaacuuuuucagcacccacauaugagugaauacauggaauauuuuucuuucuguuucuggcuuacuucacuuaacauaaugaccuucaguugcguccauguuucuguacaugacagaauuuuauucuuuuuuauggccaaauuauguuuaauuguguaaauacaccauauuuucuuuauccguuuguccauugaugggcaguuugguugguucuauaucauugcuguugugaguagugcugcaguaaacaugggaguguauguaucuuauugaaauauuguuuuccuuuccuuuggauaaauacccaguagugggauuacuguaucauggguuaguucuauuuuuaguuuuuuuuuuuuuuuggggaaaucuccauacuguuuuucauaauagcuauacuaauuuacauucccaccaacaguguaugugaguuccuuuuuuccugcauccucaccagcaucuguuuuuuuuuuuugucuuucugauaauagcuauucugacugggauaagacgauaucucauugugguuuuauuuacauuucccuagugguuagugauguugagcauuuuuucauguaccuguuggccauuuguaugucuuuuaagaaaugucuauucaugcccuuugcccacuguuuaacgggauuuguuguuuuuguugaguuuuugaguuccuuguguauucuggauauuagucccuuaucagaugaguauuuugcaaauauuucuccuauucuuuagacugucucuucauucuauugauuguuuccuuagccguacagaagccauugucuauuuuuguugcuuugcuuuugaggucuuagucauaaaaucuuugccuagaccgauguccugagguguuuccuuuuaguaguuuuauaguuucagguauuauauuuaaguugucaauccaucuuaaguugauuuuuguauauggugaggaauaggggucugguuuuauuuuucugcguauggauauccuguuuucucagcaccauuuauugaagaggguguuccuuacccaguguauguuagggugccugaguugaaaaucauuuuacuuuaaauacguggauuuauuuaugaguucuuuauucuguuccauugcucugugggucuguuuuuaauaccaguacuaugcuguuuugguuacauugccuuauaauauaguuugaagucagguaguaugaugccucuagcuuuguucuguuuucucaggaauguuuuggcaauuuggauucuuguuuccauacaaauuuuagguuuauuaucuuucauugcuaugaaauagucauuggucuuuugauagggauugcauugaaucuguagauugcugcauaguauggucauuuuaacaauaugaauucuuccaguucauaagcaugauauaucuugcauuuguuccuauccucuucaguuuuuuccauuaguguuuuguaguuuuccucauggaggucuuuuacuucuuugguuaaauuuauuccuaguuuuuuuuguuuguguguguguguguguguuuuuuuuuuuuuuuuuuuuuuuuuuuuuuguagcuguuguaaguggaauugcuaucuggauuucauuuucaguuaguucauuguugguguauaaaaucacuacuuuuuuuuuuuuuuuugacagagucucacucuguuguccaggcuggagugcaguggcauggucucggcucacugcauccuccacuuucugggcucaggugaucccaccucagccucccuauuagcuagcacauaaucacuacauuuuugauguugauuuugugucguucaucauaucugcauaugagaucugagucuuucuuuuuuuuuuuugacacaguuucacucugucacccaagcuggaguauaguggcaugaucaucugcaaguucacugcaucuuccugggcacaaggaaaccauccuccugccucagccucucaaguagcugggacuacaggcacgugccaucaugccuggcuaauuuuuauuguuuaaaauuguuuugcagaggauggugucuugccauguugcucaggcuggucuugaauuccugccuuggccucccaaagugcuggaacagcaggcgugagccacugcacccagcugagaucugagucuuuuuuggugaaguuuuuagguuuuucuaaauauaagaucgugucuucugcaaagagggauaauuuuacuuccucuuuuucaauuuggaugucuuuuauuuuuucucuugccugauugcuccggcuaggacuuccauuacuauguugaauaagcauggugaauaugugcauccuguuuuguuccaguucuuagagggaagucuuuuagcuuuucuucauucagugugauguuagcuguggauuuguaauauaugaccuuuauccugcugagguauguucuuuuuauagcuaguuucuugagcauuuuuaucauaaagugagacauuauuuuaucaaauuuuuuuuugcaucuguugaggugacugcaugguuuuuguuuuucauccuguugaugugaugugucauguuuauugauuugcauauguugaaccauucuugcaucucugaauacaaucucacuuagauuaugguguauuaucuuuuuaaagugcuuuuggauucgguaugcuauuaauaauauuuuguugagguauuuugugucuguuuucauaagggauauuggcuggaaguuuucuuuuuugugugcauuuccuugucuucuuuugguauaaggguaggaaugacuucguagaaugaguuaggaagaauuccaucaucuucuauuguuuggaauaguuucagaagauuugguauucuucuuuguaaguuugguagaaauuggcaaugaagccaucaggucgugggcuuuucuuuuuugggagccuuuuuauuauucaaccuuuuaaaauuuucuuuagugacagggucuugcucuguuguccaggcuguaguacaguggcaugaucauucuccuuguagccuagcuuagaauuccugggcucaagugauccucucaccucagccuccugagcagcuaguaucacagguaugcacgaccauggcuggcuaauuaaaaauuuuuuuuugguagagguggggucuugcuguauugccuaggcuguucuuaaacuccuggacucaagcaguccucccaacuuggccuuucaaagcgcugggauugcaggcauaagccacugugcuggccuacucacucagucuuguuauuuguuauuggguuguuuaggguuucuguuucuuucugguucagucucgauagguuguauguguccagaaauuuaucuaucuuuuucuaaguuuuucaguuuguuagcucguaguuguucauaguagucucugauaaucuuuuguauuucucugguaucaauuggaaugucucuuuuuucauuucugauuuuguuuauuaggguauguguguguguuagccagucuagccaguuguuuaucaagauuaucuuuaaaaaaaacaacgcuuuuuuucauugauucuuuguauuauauuuuuagucuuucuguuuucuuuaguuuugcucugauguuuauuuuuuuuucucuacuaacuuuuuuuuuuuugagauggagacucacucugccacccaggcuggagugcaguggcgugaucuuggcucacugcaaccucuaccucccagguucaagugauucuccugccucagucucccaaguagcugggauuacaggcacccaccaccacacucagcuaauuuuuguauuuuuaauagagagggcgugucaccauguuaaccagguuggucucaaacuccugaccucaagugauccacccacaucagccucccaaagggcugggaucacaggcaugagcuaccauguccggccauuuacuaauuuuguuuuggcuuguucugacuuuucuauuuuuuucaggugcauuauuagguuuuuuuuacuuaaaaucuuuauacuuuuuugucauacguauuuauugcuauaaauuucucucuuaauagugcuuuugcaguuacagguuuuaaaugcugaauuuauauuuuuacuuguuucaagauguuucuugauuucccucuuaauuucuucccugacucuggucauucagaagcauguuguuuaauuuccauguauuuguauuguuuccaaaguucuuguuauugguuucuaauuuuuuuuuccauuguggucugcaaagguacucauauuauuuugauuuuuaaaaauuuggugagguuuuagguaauaccauucagggcauaggcaugggcaaagacuucaugacuaaaacacaaaaagcuauugcaacaaaagccaaaauugacaaaugggaucuaauuaaacugaagagcuucugcacagcaaaagaaacuaucaucagagugaauaggcaaccuacagaaugggagaaaauuuaugcaaucuauccaucugacaaaggacuacuauccagaaucuacaaggaacuuaaacaaauuuacaagaaaaaaacaaauaaccccaucaaaaagugggcgaaggauaugaacagacacuucucaaaagaagacauuuaugcggccaacaaacaugaaaaaaagcucaucaucacuggucauuagagaaaugcaaaucaaaaccacaaugugauaccaucucaugccauuuagaauggcaaucauuaaaaacucaggaaacaacagauacuggagagguuguagagaaauaggaaugcuuuuacacuguuggugggaguguaaguuaguuuaacccuuguggaagacaguguggcgauuccucaaggaucuggaaccagaaauaccauuugaccaagcaaucccauuacuggguauauauacccaaaggauuauaaaugguucuacuauaaagauacaugcacauguauguuuauuguggcaccauucacaauagcaaagacuuggaaccaacccaaaugcccaucaaugauagacuggauuaagaaaauguggcacauauacaccauagaauucuaugcagccauaaaaagaaugaguucauguccuuugcagggacauggaugaagcuggaaaccauuauuuucagcaaacuaacacaggaacagaaaaccagacacugcauguucucacucauaagugggaguugaacaaugagagcacauggacacagggcggggaacaucacacacuggggccuuugggggauuggggguaaggggagggauagcauuaggagaaauacuuaauguagaugacggguugaugggugcagcaaaccaccauggcacauguauacuuauguaacaaaccugcauguucuacacauguaucucagaacuuaaagaauaauaauaauaaaaaaacuggcaauguuaccuuuguggccuaacauauggagaauguucuuugugcucgugagaagaguguguaaucuguagcugguggaugaaauguucuguagaugucucuuagguccauuuggucuauagugcagaaauguucaauuuuuuuugguuuauuuuccuucugcauguugaaagugggauguuuaauucuccaaguaucauuguauugggauuuaucucucucuuuaguucucauauuugcuuuauuuaucugagugcuccuguauuggguguaaauauguuuauaauuguuauguucucuugcugaauuuaucucuucaucaauauaugaugaccuuuuuguuucuuuuuauuuuuauuucaaguuuugcaauauauuuuuuuccuucaauuuuauuuuaaguuccaggguauacgugcaggaugugcagauuuguuaaauagguaaacgugugccaugguguuuugcugcacagaucaacccuucaccuagguauuaagaccagcauccauuagcuguucuuccugauguucuuuuucccuucgucccccugacaggcuccaguguguauuauuccccaccaguguguucucauuguucaacucccacuuaugagugaggacaugugguguuuguuuuucuguuccugcauuaguuugcugaggauaacggcuuccagcuccauccaugucccugcaaaggacaugaucuuuuuccuuuuuauggcugcauaguauucccugauguacauguaccacauuuuuuuaauccagucugucauugaugggcauuugggaugauuccgugucuugguuauugugaauaaugcugcagugaacauaugugugcauguaucuuuauaauaaaaugauuuauauuccuuuggguguauacccaguaaugggauugcugggucaaauggcauuucugcuucuagaucuuugaggaaucaccacacugucuugucucuuuuuaaguuuuuuugguaacuuaaugccuauuugucugauguaaguauggcuacuccugcauacuuuugguuuccauuuacaugggauauauauauguauccaucacaucccuucacuuucacuucaugugugucuuuauaggugaagugaguuucuuguaggcagcauucuguugggucuuguguuuuaucuauucagccagucuaaaucuucuaauuguggaguuuaaaccaguuacauucagguuguuauugguagugaagacuuauuccucucauauaccucaaaauaauaagaaccauguaugacaagcccacagccaacaucauacugaaugggcaaaagcuggaaguauuccccuuaaaaacugccagaagaccaggaugcccacugucaucacucuuauucaacauaguauuggaaguccuggccaggacagucagguaagagaaagaaauaaagggaccuaaauaggaagagaagaagucaaacuauuccuauuugcagacagcaugauccuagaucuagaaaaccccauauucucagcccaaaggcuucuuaaacugauaagcaacuucagcaaagucucagcauacaaaaucaguguccaaaaaucacuagcacuccuauauaccaacaacaaucaaacugagagccagacuaggaacgaacucauucagaacugccacaaaaagaauaaaauaccuaggaauacaucuaaggagggaggugaaagaucucuucaaggagaacuacaaaacacuguucaaagaaaucagagaugacacaagcacauuccaugcucauggauaggaacaaucaauauuuuuaaaauggccauacugcccaaagcaauuuauagauuuaaugcuauucuuaugaaacuaccaaugacauucuuuacagaacuagagaaaacuauuuuaaaauucauauggaaccaaaaaagagccugaauggucaaggcaauccuaagcaaaaagaacaaagcuggaggcaucaugcuauccaacuucaagcuaugcuacaggcacacugaccaauggaacagaauagagagcccagaaauaagacugcauaccuacaacuaucugaucuuuggcaaaccugacaaaaacaagcaauggggaaaggauuccuuauucaauaaauggugcugggauaacugguuagccauaugcagaaaauuaaaacuagaccccuuccuuagcccauauacaaaaauuagcucgagauggauuaaagacuuaaauguaaaaccucaaacugaaaacucuggaagacagccuaggcaguaccauucaggagauaggcacgugcaaagauuucaugauaaagauaccaaaagcaauugggacaaaagcaaaaauugacaaaugggaucuaacuaaacuaaagagcuucugcacaccaaaagaaacugucaacagaguaaacagacaguguacagaaugggagaaaauuuuugcaaacuaugcaucugacagaagucgaauauacugcaucuauaauuaacuuaaacaaauuuacaagcaaaaaacaaccccauuauaaagugggccaaggggggcaugaacaagugcuuuuccaaagaagacguacaugcagccaacaaucauaugaaagaaagcucaacaucacuaaucauuagagaaaugcaaaucaaaaccacagugagauaccaucucacacuagucaaaauugcuacuauuaaaaacuccaaaaguaacagaugguggugagguuguggagaaaaaggaaugguuauaaaguguuggugggaguguaaauuaguucacccauuguggaagacaauguggccauuccucaaagauguaaagacagaaguaccauucacuccagcagucccauuacuggguauuuacccaaaggaauauacauuguucuauuauaaagacacaugcacacauauguuuauugcagcaguauuuauaauagcaaagacauggaaucaaucuaaaugcccaguaauguuuuacuggauaaagaaaauguggcacauauacaccauaaaaugagaucaugucuguugcagggacuugaauggagcuggaggccauuauccuuagcaaacuaauggaggacagaaaaccaaacacugcauguucucacuuauaagugggagcuaaguuaugagaauacauggacacagaaggggacaacacaugcuagagccuuucagaagguggagggugugaggaggggagagcaucagguaaaauagcuaaugaguacuaggccuaauaucugggucauaaauauucuguauaacaaccccccaugacauaaguuuaccuauguaacaaaccuacacagguaccucugaaauuaaaaguuuuaaaaaaaggacuuacucauuuuguuaaugauuuucugacugcuuuuauaucucuauuucucuauucuuuuauuguuuaccuuuaugauuuggugguuuuuaaaaaauuauuuuuuauuauacuuuaagcucuaggguacaugugcauaaugugcagguuugauacauagguauacaugugccauguugguuugcugcacccaucaacucaucauuuacauuagguauuucuccuaaugcuaucccucccccagcuccccaccccgcgacaggucccagugugugauguuccccgcccuguguccaagugaucucauuguucaguucccaccuacgagugagaacaugcgguguuugguuuucuguccuugugauaguuugcugagaaugaugguuuccagcuucauccaugucccugcaaagaacaugaacucauuuuuuuuaaggcugcauaguauuccaugguguauaugugccacauuuucuuaauccagucuaucauugauggacauuuggguugguuccaagucuuugcuauuguggauagugcugcaauaaacauaugugugcgugugucuuuauaguagcaugauuuauaauccuuuggguguauacccaguaaugggauugcucagucaaaugguaauuccaggucuagauccuugaggauucgccacacugucuucuacaaugguugaacuaauuuacauucccaccaacaguguaaaagcauuccuauuucuccacauucucuccagcaucuguuguuugcugacuuuuuaaugauugccauuguaacuggcgugagaugguaucucauugugguuuugauuugcauuucucugaugaccagugaugaugaguguuuuuucaugugucuguuggcugcauagaugucuucuuuugagaagugucuguucauauccuuugcccacuuuuugaugaggggguuguuuguuuuuuucuuguaaauuugaguucuuuguagauucuggauauuagcccugugucagauggguagauuguaaaaauuuucucccauucuguagguugccuguucacgcugaugguaguuucuuuugccaugcagaggcucuuuaguuuaauuagaucgcauuugucuauuuuggcuuuuguugccauugcuuuugguguuuuagugaugaaguucuugccuaugccuauauccugaaugguauucccuagguuuucuucuaggguuuuuaugguuuuaggucuaacauugaagucuuuaauccgucuugaauuaauuuuuguauaaggugucaggaagggauccaguuucaguuuucuacauauggcuagccaguuuucccagcaccauuuauuaaauagggaauccuuuccccauuucuuguuuuugucauguuugucaaagaucagaugauuguaaaugugugguguuauuucugaggccucuguucuguuccauuggucuauaucucuguuuugguaccaguaccaugcuguuuugguuacuguagccuuguaguauaguuugaagucagguagugugaugccuccagcuuuguucuuuuugcuuaggauugucuuggcaaugugggcucuuuuuugguuccguaugaacuuuaaaguaguuuuuuccaauucugugaagaaagucauugguagcuugauggggauggcauugaaucuauaaauuacuuugagcaguauggccauuuucaugcuauugauucucccuauccaugagcauggaauauucuuccauuuguuuguguccucuuuuauuucauugagcagugguuuguaguucuccuugaagagguccuucacaucccuuguaaguuggauuccuagguauuuuauucucuuugaagcaauugugaaugggaguucacucaugauuuggcucuuuguuugucuguuaaggguguauaagaaugcuugugauuuuugcacauuuauuuuguauccugagacuuugcugaaguugcuucucagcuuaaggagauuuugggcugagacaaugggguuuucuaaauacagaaucaugucaucugcaaacagggacaauuugacuuccucauuuccuaauugaauacucuuuauuucuuucucuugcccgauugcccuggccagaacuuccaauacuauguugaauaggaguggugagagagggcaugccugucuugugcccguuuucaaagggaaugcuuccaguuuuugccuauucaguaugauauuggcugugggucugucauagauagcucuuauuauuuugagauacguuccauugauaccucguuuauugagaguuuuuggcaugaagguuuuuaauuuugucaaaggccuuuucugcaucuauugagauaaucgugguuuuugucauuguuucuguuuacgugaugcauuacguuuauugauuugcauauguugaaccagcuuugcaugccagggaugaagccgacuugauugugguggauacgcuuuuugaugugcugcuggauucgguuugccgaaucuccuugugucucuaucuccuucaguucugcucugaucuuaguuauuucuugccuucugcuagcuuuugaauuuguuugcucuuccuucuguaguucuuuuaauugugauguuagugugucgauuuuagaucuuuccugcuuucucuuguggacauuuagugcuauaaauuucccucuacacacugcuuuaaauaugucccagagauucuuguauguugugucuuuguucucauugguuucaaagaacaucuuuauuucugccuucauuuuguuacuuacauaguagucauucaggagcaaguuguucacuuuccauguaguugugugguuuugaaugaguuucuuaauucugacaucuaauuugauugcacuguggucugagagacaguuuguugugauuucuguucuuuuuuuuuuuuuuuuuuuuuugagacggagucuugcucugucgcccaggccggacuacggacugcaguggcgcaaucucggcucacugcaagcuccgcuucccagguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaucgcgcccggccgugauaucuguucuuuuacauuugcugaggagugcuuuacuucgaauuauguggucaauuuuagaauaagugugauguggugcugagaagaauguauauucuguugauuugggguggaaaguucuguagaugucuauuaggucuguuuguugcagagcugaguucaaguccuggauauccuuauuaaccaucugucucguuuaucuguguaauauugacagugguguguuaaagucucucauuauuguuguguggggguguaagucucuuuguaggucucuaaggacuugcuuuaugaaucugggugcuccuguauucucuaaggacuugcuuuaugaaucugggugcuccuuuauuggguguguauauauuuaggauaguuagcucuucuuguugaauugaucccuuuaccauuauguaauggccuucuuugucucuugaucuuuguugguuuaaagucuguuuaucagagacuaggauugcaaccccugcuuuuuuuuugcuuuccauuugcuugguagaucuuccuccaucccuuuauuuugagccuaagugcgucuuugcaugugagaugggucuccugaauacagcacacuaaugggucuucccaucagugacucuauccaauuugccagucugugucuuuuaauugggguauuuagcccauuuacauuuaagguuaauauuguuagugugaauuugauccugucauuaugauguucgcugguuauuuugcccguuaauuuaugcaguuucuucauagcacuggugguguuuacaauuuggcauguuuuugcagugguugguaccgguuguuucuuuccauguuuagugcuuccuucaggagcucuuguaaggcaggccugguagugacgaaaucucucagcauuugcuugucuguaaaggauuuuaugucuccuucacuuaugaagcuuaguuuggcuggauauuaaauucuggauugaaaauucuuuucuuuaagaauguugaauauuggcccccacucucuucuggcuuauaggguuucuuccgagagauccaccauuaguuugaugggcuucccuuugugaguaacucgaccuuucucucuggcugcccuuaacacuuuucccuucauuucagccuuggugaaucugacaauuaugcgucuugggguugcucuucucacagaguaucuuugugguguucucuguauuuccugaauuugaauguuggccugccuugcuaaguuggggaaguucuccuggauaauauccugaggaguguuuuccaacuugguuacauucucuccaucacuuucagguacagcaaucaaauguagauuuggucuuuucacauagucccauauuucuuggaggcuuuguuuguuucuuuuuacucuuuuuucucuaaccuugucuucuugcuuuauuucauuaaucugaucuucaaucacugauacccuuucuuccacuugacugaauugucuaucgaagcuugugcaugugucacgaagcucucgugccaugguuuucaccuccaugaggucauuuaaaaucuucucuacacucuuuauucuaguuagccauuugucuaauguuuuuucaagguuuuuagcuuccuugcgauggguucaaacauccuucuuuagcuuggaauaguuuguuauuacugaucuucugaagccuauuucugucagcucguuaaagucauucuccauccagcuuuguuccguugcuggugaggagcugugauccuuuggaggagacgaggugcuccgauuuuuagaauuuucagcuuuucugcucuaguuucucccccuuugugguuuuaucuaccuuuggucuuugauguuggugaccuacagaugagguuuugguguagaugaccuuuuuguugauguugaugcuauuccucucuguuuguuaguuuuccuucuaacagucaggucccucagcugcaggucuguuggaguuugcuggagguccacuccaggcccaguuugccuggguaucaccaauggaggcugcagaacagcaaauauugcagaagagcaaauauugcugccugauccuuccucuggaagcuucgucccagaggggcagccaccuauaugaggugucugucauccccuaaugggaggcgucucccaguuaggcuacacuggggucauugacccacuugaggaggcagucugucuguucucaaagcucaaacgcugugcugggagaaccacugcucucuucagagcugucagacagggacguuuacaucugcagaaguugucugcugccuuuuguucagccaugcccugcccgcagagguggagucuagaggcaguaggccuuguugaacuguggugggcucugcccuguucuagcugcccggccacuuuguuuaccuacucaagccucagcaauggcggaugccccucccccagccaggcugccgucuugcaguuugaucucagagugcugugcuagcagugagcaaggcuuugugggcgugggaccugccgagccaggcacggggagagaaucaccuugucugcugguugcuaagaccuugggaaaagugcaguauuugggcgggacugucccauuuuuccacguagccugucacagcuucccuuggcuaggaaagggaaguccccugacuccuugcacuucccgggugaggcgacuccccgcccugcuucagcuugcccucugugagcugcaccuacuguccagccagucccagugagaugaaccagguaccgaaguuggaaaugcagaaaucacccaucuucugcgucaaucaugcugggagccgcagacuggagcuguuccuauuuagccaucuuggaaugcccgauuuuguggcuuuuuguagugauaacaugugacuccauucucugucuuauuugugugucugcucuacuauugaguuuuauacuuuuguguguuucuuugagaguuuuaagacucuauuaagcauuuuuguaguguagugugauaaauucccuuagcuuuugcuugucugggaaagauguuauuuguccuucauuuuugaaggauagguuuguggaucugguauuauugacugacauuuuauuuucagcacuuguaauauaucaucauaugccuguaagguuucugcugagaaauuuguuuuuaaucuuauggggauuuucuuaugugugauuugauauuuuucuugcuauuuuuagaauugugucuuugacuuuucacaguuugacuaugauauaccuuguagaagccuuuuauggauugaaucuauuugaggaauuuuguacuccuguaucuucauguuuuugucuuuugcaagacuugggaaguuuucagcuauuauuuuuuucaaauguuuucuuccauuucucuuucuucugaaacucccauaauuugaauauuuggucgcuuuauggcaucucauauguuauguaggcuuucuucauuuuuuaaaguuguuuuuuacuguuaugucugaauggguuauuuuuuuaaaaaucuguuuucaaguucagaaauucuucugcuuaauuuugucuauuguugaggcucucaacuguauuuuauauuucauugaaaucuucaguuguaggacguuuuaaaugauaucaaucuuuguugaauuucuaaucgagaucauaaauuguuuucauaauuuuuuggauuauuuacuuuuuaaaaaauaucucacuuaguuucuuuuguaucagaauuuugauuuuuuuuccagcauuccauacauuuccuuuucuuaugggucucuuauuggaaaauuauuuuguuucuuuggaggugucuuguuuccuugcuuuuucauguuucucaugucuuuuuguuagugucuguguuuauuucaacagcuguuuucuuccaauuuaccauuaacauugguagggaaaaacuuuuuccuauagauauauuuauagugcugguucugugaagugguuugucugauuuuuacauagacacagucauguaaucuuuuaugauuuuuuggauuguaacucaugucagcagugucacaguuccuaagugaugcagacugcuuuuguuaauggcagccauggugaggcuuugcugagcaugaggacuccaggugggcuguuccuuaagcaccaguaguaauggcagugggcuagguggacuugucauuaguugccugagugguguguguggaugccaguauggcuggguguguugagccaauccccagaccucuaaaugauuuguguaggcaauggcaguggcagcuauagguggaguuggcuuguccucagguuuuuggaaggcaugugucugagccaguggcgggggugagggggguggauugaucccuaggccucuggaggaugaugugcacaggugcugauggugggcagagugggucucccuucaugcccccuccaccccccuaauggugugugugggucuugguagcaguagguggguagguuguucccuaggaacccugaugauguacauuggugacauugaggaauguggauugauuuuuguuucuccggaugacaugugugggugccaguaguggugggugggccacuuuaaguuuuuuguuauaauguauuuucauucuuuuuuaaauaaagcauaacauuaaauuuacauaagcaucuguuuccuuucuguucuucagauugaauauuucuauuggucuaucuauuuccagauccacuuaccccuuuuuagucuccuuucugcuuuuuaggccagcgguccccaaccuuuuuggcaucagguuucauggaagacaauuuuucuauggauccagguaguggggcaggugggaugguuuuggaaugauucaagcauguuacauuuauugugcacuuuauuucuguuauuauuacauuguaguauauaauuaaauaaauauacaacuuaccauaauguagaaucagugggagaccugagcuugauuuccugcaacuagaugaucccaucuggaggugaugggagacaguaacagaucaucagucauuagauucucauaaggagcaugcaaccaguaucacucauaugcacaguucauaauaggguuugugcuuugagaaucuaaugcugccacugaccugacaggugguggagcucaggugguaaugugaguaauggggaguggcuguaaauacaggugaaguuucaguugcucacuugccgcucaccuccugcugugcggccugguuccuaacaggccauggaccaauaccaguccauggccugggguuagggacuccugcuuuaggccauucagugcuuuuuaaaauuuggucauguuacuuuguaguucucaaauugccauuuguuucuuuuuuaauuuuguuccucuguugagauuuucugucuuuuuacuucuuucagagaguucauccucucagagaacaguauaauagccacuuuaaagcuuuuuccuggcugggugugguggcucacaccuguaauuccagcacuuuuggaggcugaguggcuggaucaccugaagucaugaguuggagaccagccuggccaacauggugaaacccagucucuacuaaaaauacaaaaaauuagcugggcaugguagugggugccuguaaucccaacuacuugggaggcugaggcaggagaagugcuugaaccugggaggcggagguugcagugagccgagaucgcgccacugcacuccaggcugggcaacaagaguaaaacuccaucucaaauaaauaaauaaaugaaugaauaaauacguaaauaaauaaaugaaguuuuuuucugguaauuucaacaucucugucuucuucuacuuggcugcucuugauacucaucuuuugugaguuguugagauuuccuaggcuuuuuauaugccaagcaguuuuuggauuauauccuggacauuuugaauauuaaguugcaggucucugggucuugguuagauugcagguuugguauuacuuugaguucaccaaugucauucuuagcauauacucuucaggguccuaagauagcuucuccaugaagucugucuagaauucuuaguugcacucagugggagaagcagagaagauuauucuuauuccauuuuauuucaaguagaauucuugcucauuuuuuaaaucugaguuuuuauuuuauauguguguguauauauauauauauauauguauauauauauauauauauauauauauauauauuuauuuauuuauuuaugauacaugguuuugcugugucaccgaggccugacugcagugguacgauuauagcucacugcagccucaaacuccuaggcucaagugauccuccugccucagccuucugaguagcugggacuacagacaugugccacgaccuuuauuguagacauagggucucacuguauuuaucagacuggucucaaacuucugacgucaagugaucuuccugccucagccucccaaaguguugggauuacaggcauaagccacuguaccuggcucaagucugaguuuuuagucuuuguuauugauguguagaaauucuuuguauaauaaggauaugagucuguugucaguauguguauugcaaauacuuucaaucuguagcuguuuuauuucuuaauuguaugucuuuugaugagcagaaauauuugauuuugaugaauguaguuuaucagucuuuuccuuuauucuuagugguuucuucuuuuuuuuuuuagacagagucucgcucuuuugcccagacuggagugcaguggcaugaucucggcucacugcaaccucugccuccuggguuccagcgauucucaugccucagccuccccaguagcugggacuacaggcaugcaccaccacgcccagcuaauuuuuguauuuuuaguagagacaggguuucaucguguugcccaggcuggucucgaacuccuggccucuagcgauccauccaccuuggccucccaaagugcugggauuacagaugugagccacugcaccuggucucuuuauucuuaguguuucuuuucuuucuuucuuuuuuuuuuuugagacagaguuucacucuuguugcccaggcuggaguguaauggcgcgaucucggcucaccccagccuccaccuccuggguucaagugauucuucugccucagccucccgaguagcugggauuauaggcaugugccaccacgccuggcuaauuuuguauuuuuaguagagacgggguuucuccauguuggucaggcuggucucaaacucaugaccugaggugaucugccagccucagccucuccaagugcugggauuacaggugugagccacuguauucuuagugguuucuuaaugcuguauuucuuacuggagauuuagucauaugcuuuuuugcuauuguugugacaaaauacauacaacacaaaauuuaccauguuagccguuuuauggcauucaauuuaguggcauuuaguucacucacaguguugugcaaccacuuucucugucuaguuucagaacuuuuucauuaccccaaauggaaacucuuuaaccauuaagcauucacuucuuaauuuaucucucuauucugccaacuucccagccccuggaaauuacuacuuuguuuucuguugccuggauuuuccuguucuagauauuucacaaaaacagaaucacucaauauaugaucuuuugugucuauggcuucuuucacuuagcacaaaugcuuucaaaguucauccauguuauaguaugugguaguaguuuaguucuuuuuauggucuaauaauauuccauuguauggauauaucacauuuguuuaucuguucaucuguuuguauuguuuucaccuuuuuuucuguuauugaauaaugcuucuaugaacuacaagcaucuguucgaaaaccuguuuuccauucuuuuguuuuauacuuagggugagaauugcugugucaugugguaauuuuauguuuaaguuaucgaggaacugcaauacuguuuuuuuuuuucuuacgguaccuguaccauuuacauucccacuagcaauguaugaagguuccauguucuucauauacucagcaacacuuaauuuuuuuucucucuugcucuuuuacuucguuuuccuucuccucucuuccuucauucuucauccuaguggguacgaaaugguaugucacugugguuuugacuugcauuuuuuuguguuuccauauaaauuuuagggguauuuuuccuucuucugggaagaauguuauugauauuuuuauagggauuuuggugaaucuauagauuucuucauuugguguggacauuuuaacaacauugauucuuuuuucauuuuucuuuuuuuguucuugaaggagauaaacaauauugauucaaaccaugaccguggaguuaucuuuccauuauuuugacauucuccaguuucuuucaucaauguuuuaugguuuucauuguggagaucuuucacuucuuugguuuggauuugcauuuccuaaugacuaaugacacugagugucuucuaaugugcuuuuugucauuuguguaguuuuuuggagaaauaucuauucacauucuuugcccauuaaaaacuauuuuugucuuuaucuuacugaauuguaagaguuuuuuuuuuuaaauuuugaauacuauaccuuuuuuucuuuuaagagauggggucuuacuauguugcccaggcugaccugaaacucuuggccucaagcaauccuccugccuuggccuuccagagugcugggauuacaggugugagccauugugguugaccuggauacuauacuuuuaucaguuauauuauuugcaaauauuuccucccauuugguggguugguugccuuuucacuauuccaguaaugaauaaaaguuucaaauuuugcugauguccacuuuaucauuuuucucuuguuacuugugguuuuuuggucauaucugugaagucauugccaaauacaagucaugaaaauguacugcuguguuuuuuuuucuaagaguuucauaauuuuagcucuuguauaauguuuaggucuucucuccauuugaauucauuuuugaauaugaugugaagcaagugugcaaguuccugcuuuugcauguggcgguucaguuguucuagaacuauuuguugaaaguuuauuuuucucucaugaaugguuuuggcauccuugcugaaaaucaauuauugguccuagauauauggguuuauuucuagacuuucaauucugucccauaaaucuguauguuuacccguugccaacauuauuuugauuacucuagcuucauaguaaauuuugaaacugaaaugugaguccucuaauuuugcucuccuucuucaagauuguuuugguucuucugagccucuagcaauuaaucaucagaucaguuuguccauuucugcaaaacaggcuguuggaauuuugguagggagugaauggaaucuggaggucauuuuggggaguaaugcccaacugcuaaccaaaauaguugauauaguuaauaaagucuuucaguccuugauuaggggaugucuuuucauuuauuuaggguuucuuuaauuucuuacagcauguuuugauauuuucagcagaaaagucuuacauugccuugacuaaauuuauuauugaguauuuuauucuuuuugauaugcuauuguaaguggaauuuuuuuucuuaauuucucuuucagauuucucauugcuauuaaauagaaauacaacugauuuuggccuuucgaucuuauauccugcaaguuuucugaauuagucgagcaaccuuaacauuuucuuuuugguggauucuucccucuuuugguuauugcgaaucguggacuacaaacaugauuguacaaauaucucuuuuaugaagacagucuuguaaauuuacuacaaaugucuguucugugauguggaaguaaaaccaaaacuuaauacagauguaaucauuguauaucuuugugagguagcuacuguuacuauaucccuuuucagauaaagaaacuaaggcauagagaauauaaaugacuuauuugccuaggcuaacacuguguauuaaauaaauuaauuugaaccuuuuauucuagucauauuuaaucuaaacucugucaauaagguguccggcucuuuccuaaaauuuuccacauggcaguuccuagguaacuaauuuuaauaucuuucaauuguuauaaguacaguuacuuuagaaucauaggcccuauuuaaccuucuauguaauaauuuuuauuccuuuaaguacauuccagauuuuaauagcuguuuaagcuuuggaaucucaaaguguugauuuuuugauuaaaguuaccuugguacuuuaaaaugucuuccuaguauuuuuugguggacuuacauuuaugcauuaguaaaagagccagauauuccauagauugcacuuauuauuuuucucugugaacuauguauuugaucguuuauaacaaauuuccaaauaaaaaagaacaguuuaaaugccucuugucauauugauauguuuauuauuaaaauuucauuuuuuuuuuccuagugggaaagaagccuaaggaauaaagucaucucucuagaccauaaaaauaaaaaacauauccgaggguguccuguuacuuccaagucaucaccagaaagguaagauaugugugugugcgacauaguaugggcuuaaccuauaaaguugaccauaaaugauucauuuaagcuuguugguucucaauuaugaccacauguuuaaaauagaagguuugaauucaguggacucuaagauucuuucagucucuaacuuucugugauuuuaaguaucuuaacucccuuguuuuugugcauuuggaacaucuugauaagcuuucgcugauaaugcaagaguuauacauagacugauaaugaugauugaaucauuguuugcgaucagcagugagaaaggguguuccauuucugcugcuucuucuuuuuuauuuuuuaaaggcuagucaaaugaagcagugggaguggggcagaaacagacaucugcaacuuguaaucaacugguuguaaacaccucuguacuugggccagccaaaaaugcucuguuuagcaacuaugguccuauagucauaguguuaaauuauuuguauaggggaauuaaauaucuggaggauucaaauuacaguuguuacuggaaauaauuuagagcauuucagaauuggacauaaaucaauuauuagaaaguuauuuuaaaaagaguauugaauuuucuuuuuaacauagugaaugaaaaaaugacaauagcaaauuauaauuauuggaaagucacacaaauuuagaagacucauugggguccuugaauuuaugucaaaguacuucuauaaacuacuuagucuaauucucccuuuucagguaaauuguguguaggaaauauaaacauauauuggugacuccauagcaguuuaugagccuuuugacauuauuaccauaccauggauaaauugucaaggugaauaaggcaggucuauugaugcaaugaugaugcuuucauccuuagaacaagcacacacucaguuuucagacuugguuucccaaaaagauuuacauaaauaauuauacuugguuugagagauggaaugcuagaaguaaaggaaugguaauuuuuaauuaauaaaaaccaagccacauuuucggaaagguuugcacauacaaaguuguuuuaucuuaugggagacauauccugaagacuuugcaugcuucacaacauacaucauuccccuuuagcugccgucuugcaucuccgcaugugugcgccuaaucucagcugguccacccaggacccucuuagcaccaacccuaguucucugcauggccccuuaucugcucugauaggaugaaagaaacaaucaugaaucaggaaaaacuugccaaacugcaggcacaagugugcauuggugggaaaggaacugcucguagaaggaagaaggugguucauagaacagccacagcagaugauaaaaaacuucaguucuccuuaaagaaguuagggguaaacaauaucuuugguauugaagaggugcauauguuuacaaaccaaggaacagugauccacuuuaacaacccuaaaguucaggcaucucuggcagcaaacacuuucaccauuacaggccaugccgagacaaagcagcugacagaaaugcuacccaacaucuuaaaccagcuugguguagacagucugaacaguuuaagcagacuggcugaagcuuugcccaaacaauccauggauggaaaagcaccacuugcuacuggggaggaugaugaugaugaaguuccugaucuuguggagaauuuugaugaggcuuccaagaaugaggcaaacugaauugagucaacuucugaagauaaaacuugaagaaguuacugggagcugcuauuuuauauuaugacuacuuuuuaagaauuuuuguuuauggaucugauaaaaucuagaucucuaauauuuuuaagcccaagcccuuuggacacugcagcucuuuucagguuuugcuuauacacaauucauucuuugcagcuaauaaagccgaagaagccugagaauaaacuuugaaacaaagguuaauaaaguucuuugccuaguaaaacaaaacaaaacaaaacaaaacaaaacaaaacaaaacaaaaagcuuauaucauuaaggccaggcgcaguggcucacaccuguagucccagcacuuugggagaccaaggcagguggaucacuugagugcaggaguucaaguacggcuuaggcaacauggcgaaacaccaucucuacaaaaaacuaauaaaaguaaaauuuaaaaaauacuuauauuauuuaaaucucacuuuuccauaagaaugcuuguaaaguggugggcacagguucuuugggauaacaaucaauaauuuuguuacauauuauuauuuuaauuuuguuuuuuaguuuucuggcauuaucucuaauauuuuuuucaguuuauuuucugcuaaauuaucagccuagcauaaaaagauaauuguuuggccuuccuuauagaauuuacgacaucugacuucuguuccagaguuagugauuuucaggcauggucacagcauuaacauuauaacaucuauuuaauauacacuuaaugauauuguuaggggauaaaaagauuuuaaaauucaauagcaguagaaauugaauuaaaaauacaauaaugacccaaaucaccaucuucuuaauaaagaacaaugugguugacgugauccugacaaaggaaaaugauguauuuuuuaaacugauaaaagugauguagccaacaggcaauaguguaauuaauuaguuuuauaguuuacucagccaauuuuugaauaauagaaugugauuuuugacagauuuuuaaaaucuagagggcuuuguaucauuucaaaauuuuguaccaaagacacauauauaugucuuuuauauauauaacuaauuaucuguauuaauacauaauuaguucaaauucacaauguuaaaauguucauaaaauauuuccggggaauguguaugaauauuaaaaaguggaauuuaaaaaaguaucucuguuguaugguagaaaggaccugagucauuuccaaauccuaguugucuuaagcuaggagcaggcaucuugucuauacuuuaguuuuucucuacugaaaguucuggagcuuuugauucuuaaccuuuuucugaauguucuacuucuaaaagguaggugaaaugggaugguuaggauaucuagaauaucuggaaacuaaggugggauagaacaugaugaguuauuuagaugaaacuggauuaugacaguuaaguuagcaggcagaauuaggaagugacuugguucaaaacaacaggaaugagaaauuaugauguauuugcuucacagcacaagaauuuuguaaaauucucuugggcagauuauuuuuagaagagaaccaguuugguuuuucucuuuuaaugggauucuuuauuccucgcuugaucucauuuucacuaucaaugagcuuacauaauuuguaucuacagauuuaguucucuuguagcguauuuuuuuuuaaaucaaauuaugcuguucuuccuacuccacuaauuauuuggcauaucagucauaagaguacaugagcaauaucaguuuggaacugaaaacccucuauuuauaauuacggcagcuaauaucuauuaaauacuuauuauauguuaggcauuaggcuaagccuaaacugucuuauuuaauuuucauaagucugugagauguaaguagcauuggccuuaucucauaguugaggaaauuuaggccuucuuacuauaauggagaggaauguuguuaaugcaucucuaggaaaccuaguucaguauuaacagacuuaaauuuuuguuuuaauaacauugaauucuccugggcuaucugaaacauuuuauaaaucgcugcugugcuaagggaaaucaaacaacaaaaauacaccuggggagggggaaaguuuccauauguuuguauuacuuuggaacugcugacucuaucuccuguguuugaucuuacuuuaaagauuguaauacuuuuuagugcuuuuuuaaaaauuaaguuuuauugugauauaauuuacauaucauaaaauucacccauuuuaauucaauaauuaaauaauuuuuaguauauuuacagaauugugagccaucacuacagucuggugaugguuuuagaacaucccaucaugcuccaaaagaaacuacucauuuacaaccacuuuccauucucaccuacagcuguaagcaaccacuaaccuacuuucugucucuauaagauuugauuuuuuggacauuucauauagacagaaucauacaauauguuugaucuuuuucaucuggcuuucacugagcauaauguuuuugagguuuauuaauauuguagcauauaucaguauuucauuucuuuuuauaccacauuguguuuauucaccaguuggauuuuuauguuguuuccacuucuuagcuauuaugaauaauauugucauaaacauuccuauacaaguguuugcaaguguuuguguagacauauguuuucuuuuuucuuuuucuuuuuuucuuuugagauggagucucacuuuguugcccaggcuggaguguagugguggaaaacagcucacugcagccuccaucucccaggcucaagcgauccucccgccucagcccaccaaguaguugggacuacaggcacgcaccaccaugcuuggccaauuauucuguuuuuuguauauuugagguuuuguuauguugcccaggcuggucuugaacuccugagcucaagugaucuacccaccuuggccucccaaauugcugggauuacaggcgugagccacugugcccauucuuagacauacauauguuuucauuuaucuugaauagauaacuaggauuagaauugcugugucaugcauuaauauuguuuaacuuucugagcaacugcugaacuuuuuuucaaaaugacuguacgauuuugcauucccaccagcaauguaugaaggauucauguuuuucuacauccucaccagugcuuaucuccuuccguucuucuuuccucucucuuucuuuucuuuccuuccaucuuuccauccuagugagugugaagugguaucucauugugguuuuguuugccauuuccuaauaacuaaaugauguugauuaucuuuucaugugcuaauuggucauuuguuuuuuuuuuuuaauuuuuuaaauuauacuuuaaguuuuaggguacaugugcacaacgugcagguuaguuacauauguauacaugugccauguuggugugcugcacccauuaacucaucauuuaacauuagguauaucuccuaaugcuauuccuccccccugcccccaccccacaacaggccccggugugugauguuccccuuccuguguccauguguucucauuguucaauucccaccuaugagugagaacaugcgguguuuaguuuuuuguccuugcgauaguuuacugagaaugaugguuuccagcuucauccaugucccuacaaaggacaugaacucaucauuuuuuauggcugcauaguauuccaugguguauaugugccacauuuucuucauccagucuaccauuguuggacauuuggguugguuccaagucuuugcuauugugaauagugcugcaauaaacauaggugugcacgugucuuuauugcagcaugauuuauaauccuuuggguauauacccaguagugggauggcugggucaaaugguauuucuuguucuagaucccugaggaaucgccacacugacuuccacaaugguugaacuaguuuacagucccaccaacaguguaaaaguauuccaguuucuccacauucucuccagcaccuguuguuuccugacuuuuuaaugauugccauucuaacuggugugagaugguaucucauugugguuuugauuugcauuucucugauggccauugaugaugagcauuuuuucaugugucuuuuggcugcauaaaugucuucuuuugagaagugucuguucauauccuucacccacuuuuugaugggguuguuuguuuuuuucuuauaaauuuguuugaguuuauuguagauucuggauauuagcccucugucagaugaguagguugcaaaaauuuucucccauucuguagguugccuguucacucugaugguaguuucuuuugcuguaaagaagcucuuuaguuuaaguagaucccauuugucaauuuuggcuuuuguugccauugcuuuugguguuuucgacaugaaguccuugcccaugccuauguccugaaugauauugccuagguuuucuucuaggguuuuuaugguuuuaggucuaacauguaagucuuuaauccaucuugaauuaauuuuuguguaagguguaaggaagggauccaguuucagcuuucuacauauggcuagccaguuuucccagcaccauuuauuaaauagggaaugcuuuccccauuucuuguuuuuguuagguuugucaaagaugagaugguuguaguuaugcggcauuauuugugagggcucuguucuguuccguuggucuauaucucuguuuugguaccaguaccaugcuguuuugguuacuguagccuuguaguauaguuugaagucagguagcaugaugccuccagcuuuguucuuuuggcuuaggauugucuuggcaaugugggcucuuuuuugguuccauaugaacuuuaaaguaguuuuuuccaauucuguaaagaaagucauugguagcuugauggggaugccauugaaucuauaaauuaccuugggcaguauggccauuuucaugauauugauucuuccuacccaugagcauggaauguucuuccauuuguuuguguccucuuuuauuucauugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuugcacauugauuuuuguauccugagacuuugcugaaguugccuaucagcuuaaggagauuuugggcugagacaaugggguuuucuagauauacaaucaugucaucugcaaacagggacaauuugacuuccucauuuccuaauugaauacccuuuauuuccuucucuugccugauugcccuggccagaacuuccaacacaauguugaauaggaguggugagagagggcaucccugucuugugccaguuuucaaagggaaugcuuccaguuuuugcccauucaguaugauauuggcugugaguuugucauagauagcucuuauuauuuugagauacgucccaucaauaccuaauuuauugagaguuuuuggcaugaagguuuuuaauuuugucaaaggccuuuucugcaucuguugagauaaucauaugguuuuugucauugguucuguuuauaugcuggauuacguuuauugauuuucguauguugaaucagccuugcaucucagggaugaagcccacuugaucaugguggauaagcuucuugaugugcugcuggauucgguuugccaguguucuauugaggauuuuugcauugcuguucaucagggcuauuggucuaaaauucucuuuuuuuguugucucugccaggcuuugguaucaggaugaugcuggccucauaaaaugaguuagggaggauucccucuuuuucuguugauuggaauaguuucagaaggaaugguaccagcuucucuuuguaccucugguagaauucggcugugaauccaucugguccuggacuuuuuuggguugguaagcuacuaauuauugccucaauuucagaaccuguuauuggucuauucagagauucaacuucuuccugauuuagucuugggaggguguauguguugaggaauuuauccauuucuucuagauuuucuaguuuauucgcguagagguguuuauaguauucucugaugguaguuuguauuucugugggaccgguggugauauccccuuuaugauuuuuuauugugucuauuugauuuuucucucuuuucuucuuuauuagucuugcuaguggucuaucaauuuuguugaucuuuucaaaaaaccagcuccuggauucauuuauuuuuuuugaaggguuuuuugggucucuauuuccuucaguucugcccugaucuuaguuauuucuugccuucugcuagcuuuugaauauguuugcucuugcuucucuaguucuuuuaauugugaugucagggugucaauauuagaucuuuccugcuuucucuugugagcauuuagugcuauaaauuucccucuacacacugcuuugaaugugucccagagauucugguguguugugucuuuguccucguugguuucaaagaacaucuuuauuucugccuucauuuuguuauguacccaguagucauucaggacuagguuguucaguuuccauguaguugagugguuuugagugaguuucuuaaucgugaguucuuguuuaauugcacuguggucugagagacaguuuguuauaauuucuguucuuuuacauuugcugaggagugcuuuacuuccaacuaugugaucaauuuuggaauaagugcgguguggugcugagaagaauguauauucuguugauuggggguggagaguucuguagaugucuauuaggucugcuuggugcagagcugaguucaauuccuggauauccuuguuaacuuucugucuuguugaucugucuaauguugacagugggguguuaaagucucccauuauuauugugugggagucuuaacucucuuucuaggucucuaaggacuugcuuuaugaaucuggguccuccuguguugggugcauauauauuuaggauaguuagcucuucuuguugaauugaucccuuuaccauuaugcaauggccuucuuugucucuuuugaucuuuguugguuuaaagucuguuuuauccgagacuaggauugcaaccccugccuuuuuuguuuuccauuugcuugguagaucuuccuccaucccuuuauuuugagccuaugugugucucugcacgugaaauggguuuccugaauauagcacacugaugggucuugacucuuuauccaauuugccaguguauuuuaauuggagcauuuagcccauuuacauuuaagguuaauauuguuaugugugaauuugauccugucauuaugauguuagcugguuauuuugcucauuaguugcaguuucuuccuagccucgauggucuuuauaauuuggcauguuuuugcaguggcugguaccaguuguuccuuuccauguuuagugcuuccaucaggagcuguuguagggcaggccugguggugacaaaaucucucagcauuugcuugucuguaaaggauuuuauuucuccuucacuuaugaagcuuaguuuggcuggauaugaaauucuggguuguaaauucuuuucuuugagaauguugaauauuggcccccacucucuucuggccuguagaguuucugccaagagaucagcuguuagucugaugggcuucccuuuguggguaacccgaccuuccucucuggcugcccuuaacauuuuuucuuucauuucaacuuuggugaaucuuacaauuaugucuuggaguugcucuucucgaggaguaucuuuguggcguucucuguauuuccugaauuugaauguuggccugccuugcuagauuggggaaguucuccuggauaauauccugcagaguguuuuccaacuugguuccauucucuccgucacuuucagguacaccaaucagacguagauuuggucuuuucacauagucccauauuucuuggaggcuuuauucguuucuucuuauucuuuuuucucuaaacuucucucuucauuucauucauuucauguuccaucacugauacccuuucuuccaguugaucgaaucugguacugaggcuugugcauuugccgcguacuucucgugccuugguuuucagcuccaucacgucuuuuaaggacuucucugcauugguuauucuaguuagccauucgucuaauuuuuuuucaagguuuuuaacuucuuuuccauggguucgaacuuccuccuuuagcucggaguaguuugaucuucugaagccuucuucucucaacucgucaaagucauucucuguccagcuuuguuccguugcuggugagaagcugcguuccuuuggaggaggagaggugcucugauuuuuagaguuuccaguuuuucugcucuguuuuuuccccaucuuugugguuuuuucuaccuuuggucuuugaugauggugacguacagaugggguuuugguguggauguccuuucuguuuguuaguuuuccuucuaacagucaggacccucagcugcaggucugcugaguagccuaacugggaggcaccccacaauaggggcagacugacaccucacacagccgcuuacucucugagacaaaacuuccagaggaaugaucaggcagcaacaucugcuguucaccaguauccgcuguucugcagccucugcugcugauacucagggaaacagggucuggagcuaauucgucguuuguaugucauuuugagaauugucuacucagauccuuugcccauuuuaaaauuggauuaucuuuuuguuguaagaguuaaaaaauauuuucuugguacaagucccuuaucagguauaugauuuucauauauuuuaucucauucuuuuggcaaguuucucacucucuugaugguguccuuugaaacauaaaaguuuuuaaauuuugaugaagucccauuuaucuguuuuucuuuagucucugugcuuuuggugucauaucuaagaaaccacugccuaauccaaggucaugauccauuacuacuguguuuucuucuaagaguuuuauaguuuuagcucuuagauuuaggucuuuguuccauuuuaaguuaauuuuuggguauggaaugaaauagguacccuaauuaauauuuuugccuuuggauauucauuugugccagcaccauuuguugaaaagacaaauggugcgucuucauuauuuuccauuguauugucuuggaaucuuugugagauaucaauugauaguaaauguuaggguuuauuucugcauucucaauucuauucuguugaucuguaugucuguccauaugcugguacugcuaugugcuauugcaacuuuguaguaaguuuugaaauugggaagugugggucuuacaacuuugcuauuuuuuuuucaagauuuuuuggagcuguucuggguuucuugcauuuucaguugaauuuuagaaucagcuuaucauuuuaaccaaaaaaccagcaaggauuuugacagagauuguauugaaucuguagacuaaauuggggaauauugccauuuuaacaauacuguguucagauuaauaaacaugggaugucuuuccauuuauguccuuuacaauuuuuuucaauaguguuuugugguuuucagugugucuuugacuuuuuuuuguuaaguuuauuccuaaauacuuucuuauuucugaagcuauuaugaauggaauuguuuucuauuuuuagauuuguauuuauuuauuuuuuuugagacaggaucuuguucuguugcguggacuggaguacagugccauggucauaacucacuguggucuugaccuccugggcuuaagugauccucauuccucagccuccaagucucugggaccaccggugcaugccaccacgcuuggccaauuuuuugaauuuguagagacggggucucauuguguugcccagguuggucuugaacaccuggucucaagcaauccuccuuccuuggcuucccagaguguuaguauuauaggugugagccauugggccuggaauuguucucuucauucauuuacucuuggauuuccaacuuuuuagcauauaguuguugauauuaauaguagugucuaaugauccuuuguauuuguaugguaucaauuuuuaugucucacuuuuuguuuucgaucuuacuugggucuuuuuuucuugguuggucuagcuagugguauaucaguuuuauuuuugcacaaugucaacuuuauguuugauuuuuuuuaagucuucauuuuguuuauuucuacucugaucuuuaccauuucuuuccuccuacuaauucucguuauguuuguucuugcuuuucuaguccauugagguucauuguaaccacuuuuuauuugaaauaaccacuuuuuauauaagcauuuauugcugugcauuucucucucaacacugcuuuugauuguccauaguuuugguauguuguguuucuguuuucauuuguuucaggaaguaaaaaaaauuuuuuucuuuuaauuucuucagaccuaguggcuguucaggagcauguuguuuaauuuccagggguuuguacaguuuccgguguuccacuuguuacuugauuuaugguuguauuccaauguggucucaggagauacuuuauaugauuucaguuuuuaaaaaauuauugagauuuguuuuguguccuuucauaggaucugcccuggagaauguuucuugcacuggugaaaaaaauguguauucugcagcuauuggaugaaauguuuuguaaaugucuguuaggucuauuaggucuauagugcagauuaaaccugauguuuucugucuggaugaucuguuuaguguucaaagagaguguauuaguccauucucacauugcuauaaagaacuaccugagacuggguaauuuauaaagaaaggagguuuaauuggcuuaugguucugcaggcuguccaggcuucuguuucuggggaagccucaggaaacuuacaaucauggcagaaggugaggaggaagcuagugcauuguacauggcuggagcaggagaaagagagaacgaagggagaggcacuacacuuuuauaaauaaccagauuucguuagaacucacucacuauuaggagaacaucaagggagacauucucccccacgaaccaaucaccucccauaaggccccucuuccaacauuggggauuacaauaugacaugagauuuggguggggacacagacccaaaccauauaagaggauguugaaguuccaaacuauuauuguauugaggucuguuuucuuuuuaacucuaauaauauguacuuuauauuucugugugcuuugauguuggcuguauguauucagaaucuuuauuuucuugcugaauuuaugcuuguaucaguaugugaugaccuuuuuguuucuuuguaaguuuuuugacugaaugucuauuuugucugacauaaguguguauagcuacuaaugcauauguuuuguuuucauuugugugauauauauauuuuuuaucccuucacuuucaguuuaugugugucuuuaucuaggaagaguauaguuuggucuuguuuuuuuaaauccacuuagccuguuaacauuuuuaaauuggagaauuuaaaccauuuacauguaagguuguuauugguaguguaaagacauuugucauuuuguuagcucucugauuguuuuguauauccuuuguuccuuucuuucucuuuauuguuuacucuuaugucuugguggcuuucuauagugauaaugacugauuccucucucucauuugugucugcucuuccaguuaguuuuauacuuuuguguguuuucaugaugguagauacuuuuugcuucuagauguaugacucccuuaagcauuuuucacagcaucagucaagcaguuauaaauugccuguuuuuguuugucugagaaagacuuuauuuauucuucauuucugaaguauaguuuugcugaauaugucauucuuggcugguagcucuuuauuucagcgcuuugaagauaucaucccauucucuccuggccuagaaaguuuuuguugagaaauuuaguuagucugauggagauucccuuauaugugacuugaugcucuucucuugcuauuuuuagauuucugucucugccuuugauuuuugacaguuugagcauaaugucugggagaaguuuagugucuuggauugaaucuauuugguaaaauuugaguuuacuguaucuuaauguguaugucucucauaagaguugggaaauuuuagcuauuauuauuuuuauuuauuuauucauuuauuauuauuauuauacuuuaaguuuuaggguacaugugcacaaugugcagguuaguuacauauguauacgugugccaugcuggugcgcugcacccacuaacucgucaucuagcauuagguauaucucccaaugcuaucuuuccccccuccccccaccccacaacaguccccagagugugauguuccccuuccuguguccauguguucucauuguucaauucccaccuaugagugagaguauacgguguuugguuuuuuguucuugcgauaguuuacugagaaugaugauuuccaauuucauccaugucccuacaaaggacaugaacgcaucauuuuuuauggcugcauaguauuccaugguguauaugugccacauuuucuucauccagucuaucauuguuggacauuuggguugguuccaagucuuugcuauugugaauaaugccgcaauaaacauacgugugcaugugucuuuauaucagcuugauuuauaguccuuuggguauauacccaguaaugggauggcugggucaaaugguauuucuaguucuagaucccugagaaaucgccacacugacuuccacagugguugaacuaguuuacaaucccaccagcagugucaaaguguuccuauuucuccacauccucuccagcaccuguuguuuccugacuuuuuaaugaucgccauucuaacuggugugagaugguaucucacugugguuuugauuugcauuucucugauggccagugaugaugagcauuuuuucauguguuuuuuggcugcauaaaugucuucuuuugagaagucucuguucauguccuucacccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcuuuuuagucaaauugcuccuguuugcagacgacaugauuguauaucuagaaaaccccaucgucucagcccaaaaucuccuuaagcugauaagcaacuucagcaaagucucaggauacaaagucaauguacaaaaaucacaauguacaaaaaucaacagacaaacagagagccaaaucaugagugaacucgcauucacaauugcuucaaagagaauaaaauaccuaggaauccaacuuacaagugaugugaaggaccucuucaaggagaacuacaaaccacugcucaaugaaauaaaagaggauacaaacaaauggaagaacauuccaugcucauggguaggaagaaucaauaucgugaaaaugaccauaccgcccaagguaauuuauagauucaauggcauccccaucaagcuaccaaugccuuucuucacagaauuggaaaaaacuacuuuaaaguucauauggaaccaaaaaagagcccgcaucgccaaaucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucggaaauaacgccgcauaucuacaacuaucugaucuuugacaaaccuaacaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuugaccuaaaaccauaaaaacccuagaagaaaaccucggcauuaccauucaggacauaggcaugggcagggacuucgugucuaaaacaccaaaagcaauggcaaccaaagcuauuauuuuguuaaauagguuuucuuucgcuuugcccaucucuucuccucugaaacaacugaaaucucaauauuuguucuuuuuauaauguagcauguguccuguuggcuuuauuaauucuuuuuuuuuugucugacugguucauuucaaaagaaaugucuucaaguucagaauuuuuuucuucugcuuagucuauuguugaaguucuuaauuguguuuuuuauuucauuaauugaacucuucuauugcaggauuuuuguuugguucuuuuuaaugauaccuaucucuguguugauuucucacuuauauccugaauuucuuuucugauuuuuuuuuguauuguuuuucuguguucucuuguaacuuuuugaguuuccuuagauugggauccccaaccccuggagccauggacugguacugguccguggccuguuaggaaccaggccgcagagccaggggguggguggcaggugagugaauauuacugccuuagcucugccuccugucagauaugugggagcauuagauucucacaggagcaugaacccuauugugaacugugcaugcaggcgaccuagguugcauguuccuagugagaaucucaugccugaugauaugagauggaacaguuucguccuaaaacaguccauacuccccugccaucccguggucuguggaaaaauugucuucccugaaacuggugccuggugccaagaaguuggggaucgcugccuuagauaauuauuuugaguuuguuuucaggcauuucauacauauauuuuucucuguguuacguuacuggagaauuauuguauuuuuuuggaggugucaugcuuucuugcuuugucauguuucuuauguucuuauguugauauccaugcaucuggugugacaguuguuucuuucaguuuuauggauuaaccucauuugguagagacuuuuuccuguagauguaucugugauguuuguuaggguuguauucugaguggaugcagugguauagucuccauguuauuucuuuggucauaaucagugauauuggugucugcaagguccuuauugucuuaugcugcaauuuauuuauuuauuuuuaaaauuuucagacucgucagcaggaagugaaucugugguuucuaacggagacuguggcaaggcuuuacuggggacagguacaauagucuuuggaccccuggguggcauguaugagcaccagucaugguagggaugagccauuugugccaguucuugggauuccuggugguaacauggguuaggguggugguuaggguccaggcaggucaguucuugggucccuggucagcauguuuggugccagcuguggccgagguaggugacaggaaacaauggguggguucucaggccacuugggcauuggcaauguacuugggcauuggcaguguacuugggcauuggcaauggugaguagggugggcuagugcuuaggccccuugacaguguguaugggcuguggugguggcaguggacagggcagcccugucuuuaggcacaguauugugcgggcagguccugguggcagcagauugggugggccuguucuuucuuccugggacagugccugcggauacuguuugcaggggcagggugcaccuguccuuggguccccagguggugugcauggguguuggcuguagccauccauaguggugggugguggcagcuguuuuucaaguuauuggugcuguugggcacuggcagcaaugagugggccuggccaguacucaugcuucuggacagcaugggcaugggcuuguccucaggcccuguacuguacauguaaacacugguggcagcaaaugaaguguuacuauuugguucugggaugacaugcuugugugcuguuuggaguaggcaggucucacuugucuuuaggcaccuggauggcgggugugggugcugauggugguggugagcugggcaggccuccauagauguacuuuaucauguuggagaauuuccuuucuauucuuaauuugguagcggcuuucaaaauaauguaugcauguuugaauuuccugcauucucauaugguaauuuauauucuuuauuuuacucaucaaauuuauuggauaaauucauuuucauauauuaaaguaacugcauuccugggauaaaucuccuugaucugauuuauaauauucuuaauacguugcuggauucaguuuucuugaggauguuuauguuuguauacgagagggagauucauauaugguuuuuuuucuugugcugucuuuuucugguuuugguauuaggcuaauacugucauuauagaaugaguuggaaaacuuucucuccuucauuguuuucuggaagaguuuuuggggaaauugauacucauucuuuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccucccagacggggcggcuggccgggcggagggcugacccccccaccucccucccggacagggcggcuggccgggcggggggcugaccccccaccucccucccggacggggcggcuggccgggcagaggggcuccucacuucccaguaggggcggcugggcagaggcgccccucaccucccagacggggcggcuggccgggcggagggcugacccccccaccucccucccggacggggcggcuggccaggcggggggcugaccccccuaccucccucccggacggggcggcuggccgggugggggggcugacccccccaucucccucccggacgggguggcuggccgggcugaggggcuccucacuucccaguaggggcggccgggcagaggcgccccucaccucccggacggggcggcuggccgggcggggggcugacccccccaccucccucccggacggcacggcuggccaggcggggggcugacccccccaccucccucccggauggcacggcuggccaggcgggggggcugaccccccaccucccucccggauggggcggcuggccgggggggggcuggcccccccaccucccucccggacgggguggcugcccggcggagacgcuccucacuucccagaugggguggcugccgggcggagaggcuccucacuucucagacggggugguugccaggcagagggucuccucacuucucagacggggcggccgggcagagacgcuccucaccucccagacggggucucggccgggcagaggcacuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagacgcuccucacuuuccagacugggcagccaggcagaggggcuccucacaucccagacgaugggcagccaggcagagacacuccucacuucccagacgggguggcaccgggcagaggcugcaaucucggcacuuugggaggccaaggcaggcggcugcuccuugcccucgggccccgcggggcccguccgcuccuccagccgcugccucccgggcggcgcucgccggcgcggcggcaaagaccgauacucauucuuuuuuaaauguucaguugaauucaucagugaagccaucuggucacgcccuuauaggacaauucaaguuuucuauuuacucauucguugaaaccgacuuuauugauguguaauuuacauagaauaacauguaucuauuuuaaauauaaauuuguaugcuuuuggacaaguguacuaaaugaauuuuaagacucuaaaguuuuuuuauuguaguaaaauacacuuaacauaaauuuuaucaucuuaaucauuuuuaauuguacaguuuaauguuguuaaauaaauugauaaugugcagccaacaccaucaucaaucuccauaauacuuuccaucuuguaaaacugaaacccauuaaaaaaauaaauucccauuucucccuccaccccauuccccuuaugaccaccaguuugcuguuuguuuugaugauuuuaacuuuuuaaaguaccucauacaguauuugucuuuuugugacuagcuaauuucacuuagcuuaauguccucaagguucauucauguuguagaauaugccagauuuucuuccuuuugaaaggugaauaauuuuccauuguauuuacaugccacauuuuguuucuauauuuauucaucugugggcacuugguuuacuuuaauauuuuagcuaucguuaacauggguguacaaauaccucagcucacuguuuuuaauuuuuuuggguguauauccagaaguggaauugcuuggucuuauaguaaugauauuuuuaauuucuugaacaacugcuguauuauuuucugcaauggccguaccucauuuuauguuccugcuagcagugaguaaauuuccaguuucuucacauccacaucaacacuuguuacuuucuguuuuuuuuuuuuuaaauuuguaguagccauccuaaugguaugagguggcauuucauuguagucuuaauugcauuuuccuauuuauaaaugauacuaagcaucuuuuuauguauuuauuagagauucauauaucuucuuuggagaaacggcuacacaagcccuaugcuuauuuuuaaauuggcuuuuuugguuuuuuauuguugaguuuuaggauauuuuuucuuuuuuugagacugggucuugcuguguugcccaggcuggagugcaguggugugaucacauagcucacuguagccucauccuccugggcucaagcccucccaccucagccucccaaguagcuaggacuacaggcacaugccaccaugccuagcuauuuuauuuuuuauucuuuuuuagaaauuuaaaaucauuuaaaaauuuuuuuguggguacauauuagguguauauauuuaugggcuacaugagauguuuugauauauaggcaugcaaugugaaauaagcacgucauggagaaugggguauccauccccucaagcauuuauccuuugaguuaugaacaauccaguuacauuuguuaagguauuuaaaaauauaugauuaaguaauauugacuauauuacucuauuguacuaucaauaguagguuuuauucauucuauuuuuauuauagccauuaacuguccccaccugccccccucagcccacuaguucucuucccagccuuugguaaccauccuucuacucucuagguccaugaauucaauuguuuugauuuuuagaucccacaaauaagugagaacaugugauguuugucuuucugugccuggcuuguuucacuuaacguaaugaucucuaaucccaucuguguuguugcacaugauugaaucucauuuucuuuuauggcugaauauacuccauuguauauauguacuacauuuuauuuauccauucaucuauuaaugggcacuuagaucacuuccaaaucuacugauuuccuuuuucugguguauaccagcaguggaauggcuggaucauacgguaguucaauuuucaguuuuuuaaggaaccuccaacguguuuuccauagugguuauauuaauuuacauucccaccuaaaguguguaaguguucccuuuucuccacauccuugccagcauuuguuauugccuguuuuuuggcuauaagccauuuuaacuggggugagaugauaucucauuguaguuuugauuugcauuucucugaugaucaaugauguugaacaccuuuucauaugccuguuugccauuuguaugucuuuuuuuuuggaaaaauaucuauucaaaucuuuugccuauuuuuuugcucacauuauuagauuguuuccuguaggguuguuuggacucuuuguauauucugguuauugaucccuugucagauggguaguuugcaaauauuuucucacauucuguggguugucucuucacuuuguugauuguauccuuucauguacagaagcuuuuuaacuugaugugaucuuauuuguccauuuuugcuuugguugucugugcuugugggguauugcugaagaaauauuagcccagaccaauguccuggagauuuuccccaguguuuucuuguaguaguuucauaguuugggguuuuagauuucagucuuuaauccauuuugauuugauuuauguauaugaugagagauaggggucuaguuuauuguuuugccuaucaauauucaguuuucccaggaucacuuaaugaagaggugucuuuccaucaguguauguucuuggcaccugugucaaaaaugaguucacuguagguguauggguuuguuucuggguucucuauuuuguuccauugaucuauguguuuguuuuuaugccauuuccaugcuguuuugguuaguauagcucuguaguauaauaugaagucagguaaugugauucuuccaguuuuguucuuuuugcucaagauagcuuugccuauucugggucuuuugugguuccauauaaauuuuaggauuaguuuuucuauuucugugaagaaugucacugguguuuugauggggauugcauugaaucuguagauugcuuugggugguauggagauuuuaacaauauugauucuuucaaucuaugaacauggaguaauuuucuauuuuuuaguguucucauauuucuuaauaauuguuuuauaguuuuuauuguagagaucuuucccuucuuugguuaauuccuagguaauuuuauauguggcuauuauuguaaaugagauuacuuuuuaauuuuuuuucguguuuuuugcuguuggcauacagaaaugcugcugacuuuuguauguugauuuuguguccugcaacuuuacugaauuuguuuaucaguucuaauaguuuuuucauggagucuguagguuuuuccaaacauuggaucaugucaucagcaaacgaguaauuugacuucuuccuuugcaauuuggaugcccuuuauaucuuucuguuaucugauugcucuagcuaggacuuccaauacuauguuaaauaacaguggugacaguagacauccuuguuguguucuagaucuuaagggaaaggcuuucaguguuucccuauuuaguaugauacuagcuaggauacuaacuaugauagcuagugggucugucauauauggcuuuuauuaugugaggcauguuccuuuuauucucaguuuuuuuuuuauuaugaagaacuguugaauuuuaucaaaugguuuuucagcaugaacagaaaugaccauaugauuuuuauccuucauucuguugauaugaugaaucauguugauugauuuuuguaaguugaaccaucuuugcaucauagggauaaaucccacaugguuaugaugaaugagcugucuaauguauuguugaauuugguuugcuaguauuuuguugaggauuuuugcaucaguguucaucagagaugcuggccuguaguuuucuuuuuuugauguuucuuuguuugguuuugguguuaggguaauacuggacuuguagaaugaguuuggaaguauucccuccuccucucuuuuucagaauaguuugaguaggauuggcauuuguucuuauuuaaauguuugguagaauuuagcagugaacccauugggucccgggcuuuccuuuacugggagacuuuuaauuacagcuuugaucucauugcuugcuauuggucuguucagauuuuggauuucuucgugguucaaucuuguuagauuguauguauucagaaauuuguccauuucuucuagauuuuccaauuuauuggcauauaauugcucauuguagccacuaaugauccucugaauuucuguaguaucaguuguaaugccuccuuuuuaauuucugauuuuguuuguauuuucucuuuuuguuuuucuuuagguuggcuaaagguuggucaauuuuguuuuaacuuuugaaaaaaccaacuuuuuguuucauuaaucuuuuguauuuuuaaaauuucaauuucauuuguuuuuuucucucuuuauuuuuucucuucuaauuuuggguuugguuugcucuugcuauuuuaguuuuuuaagaugcaucauuagauaguuuauuugaaguuuuuuucuuuuuuuugauguaugcauuuaaaacuauaaacuuuccucugaauauuacuuuuucuguauccuauagguuuugcuguauuguguuuccaauaucauuuguuucaagaaauuuuucaguuuucuuucuuaaugucuucauuggcccauuggccauucaggaacauauuguuuuauuuccauauauuuguauaguaucuaaaauuccucuuguuauugauuucuaauuuuccuuuguggucagagaagaugcuucauauuauuucaguuuuuuggaaaguuuuaagacucguuuauugaccuaacauauggucuguccuuaagaauggucuaugugcugaggaaaagaauguauucugcagcuguuggaugaaauggccuauaaauguguauuagauccauuuggucuauaguguggauuaagucugauguuuguuuguuuguuuguuuguuuguugauuuucugucuggaagaucuguccagugcugaaaguggggugcugaagucuccagcuauuauuuuauugaggucuaucucucacuuuagcucuaauauuauuuccuugguauaucugggugcuccaggguugggugacuauauauuuuaaauuguuauauccucuugcugaauugaccucuuuaucauuauauagugacccauuugucucuucuuaucauuuuagucuugagaucuguuuugucucauagaaguauagugacuccuguucuuuuuugguuuucauuggaauggaguacauuuuucuaucccuuuauuuuuaguuuaugugugucuuuauaggugaaguguguuucuuuuaggcaacagaucaauggguuuuucauccauucagccagucuguguuuuuaaguuggagaauuuaguccauuuauauucaauguuauuauugauaaguaagaacuuauuuccugccauuuuguuaauuguuuucugauuguuuuguggucuucucuuucuuguuuuuuuuuuuccuuuuuuuuuuccuuccugucuuccucuagugaaggugauuuuuaauaugauuugguuuaaugcuuuuuauuuuuuguguauccauuguauguuuuuugguuugagguuaccaugaggcuugaaaauacuaucuuauuacccuuuauguuaacccgauaacaacacuauuugcauaaacaacaagcaaaauaaaaauuaauaaaaacucuaugccuuaacuuugucucccugcuuuuuaacuuuuuuguugcuucuauuuauaucuuuauuguauugacugucuugaaaaguuauuguaguuauuauuuuugguugguuuauccuguagucuuucuacguaggauaagaguaguuuacacaccacaguuacaguguuaugauauucuuucuuuuucuauguacuuauuaccagugaguuuuguagcuuccagugauuauuuuccuuggugauguugaugcuaguagauguucuucauugucugggcauugaagaguuagguuuuuauuguagucuucucuaucugugcuuacuuguagccauccuuuuugggaaggcuuuucagauauuugaaaggagcuggguguuaugcucuaagcuuuagggugcaccccaacucaguaaugcugugauucuuacagacucauagagauacugucuugauagucuuguacaagaacugggagaauucucuggauuaccaggcagagacucuuguucuuuucccuuacuuucuaccaaacauacagucucuauuccaagccaccuaaagauggggguggagugacucaagcaccccuguggccaccagcauugugacugugcugggucagaccugaagccagcacagccugggucucucccaagaccugcugucacuacucccuggcuacugccuauguuugcuuaaggguccagggcucuaugaucagcaaguggcaaagccagccaggccuguguucuucccuucaggauggcaagaucucccaagcccuuggucaguccagaagugcuguccgggagucagggacuggagucaaaaaccuuagaagucuaccuaguguucuauuguauuaugguugagcuggcacucaaaugacaagaugcaguccuccccacucuucccucacuuucccaaaagcagaagagccucaccccauagccauugcuaucccaggccacaaggaguauggccagacuaccuacaauuucccuuaaggcccgaaaucucuuaagauggcuuguugugaaugcugccuggccugggacucaaccuuuagggcagugagcuccccucugcuccaggucagguccaaaagugccaucauagggucacguccuggaauuagggaccccaagagccucuuuggugcucuacuccgcuguggccaugcugguaccaaaggugcaagacaaaauccccuuuuaauuucaaagaauaagauaacuccuuuucuuucaaaaacugcuucuuuaguauuuggccaguugucaaguaacaaaugcaugugcuggaaagguagagucuaaggcagaccucagggauggaugauuuuuuuugagacgaagucuggcucuguccgccaggcuggagugcaauggcgcaaucuuggugcacugcaaccucugccucccggguucaagcgauucuccuuccucagccucccgaguagcuaggacuacagacccacgccaccacacccagcuaauuuuuguauuuuuagucgagacaggguuucaccauguuggccaggauggucucgaucucuugaccucaagugauguaggaagaucuaccaggcaaauggaaagcaaaaaaaaaaaaaaaaaaaaaagcagggguugcaaucauaaucucugauaaaacagacuuuaaaccaaccaagaucagaaaaaccaaagaagggcauuacauaaugguaaagggaucaaugcaacaagaagagcuaacuauccuaaauauauaugcaccuacuacaggaccacccagauucauaaagcaaguucuuagagaccuacaaagagacuuagacucccaaacaauaauagugggagacuuuaacacccuacuguuaauauuagacagaucaaugagacagaagguuaacaaggauauccaggacuugaacucagcucuggaccaagcagaccuaauagacaucuaaagaacucuucaccccaaaucaacagaauauacauucuucucagcaccacauugcaccuauuccaaaauugaccacauaauuggaaguaaaacacuccucagcaaauguaaaagaacagaaaucacaacaaacugucucucagaccacaguucaaucaaauuagaacucaggauuaagaaacccgcucauacugcacaacuacauggaaacugagcaaccugcuccugaaugacugcuggguaaauaacgaaaugaaggcagaaauaaagauguucuuuaaaaccaaugagaacaaaggcacaacauaccagaaucucugggacacauuuaaagcaguguguagagggaaauuuauagcacuaaaugucaagagaaagcaggaaagaucuaaaaucgacacccuaacaucaaaauuaaaagaacuacagaaggaagagcaaacaaauucaaaagcuagaagaaggcgagaaauagaucagagcagaacugaaggagauggagacacaaaaaacccuucaaaaaaucagugaauccaggagcugguuuuuuugaaaagaucaacaaaauagauaaaccaauagccagacuaauaaagaagaaaagagcaaagaaucaaauaaaugcaauaaaaaaugauaaaggggauaucaccaccgaucccacagaaauacaaacuaccaucagagaauacuauaaacacuucuaugcaaauaaacuagaaaaucuagaagaaauggauaaauuccuggacaaauauacccuccuaagauuaaaccaggaagaaauugaaucucugaauagaccaauaacaggcucugaaauugaggcaauaacuaauagccugccaaccaaaaaaagucuagaaccagauggauucacagcugaauucuaucagaaauacaaagaagagcugguaccauuccuucugaaacuauuccaaucgauagaaaaagaggaaaaucucccuaacucauuuuaugaggccagcaucauccugauaccaaaaccuggcagagacacaacaaaaaaagaaaauuuuaggccaauaucucugaugaacaucgauaugaaaauccucaauaaaauaugggcaaaccgaauccagcagcacaucaaaaaacuuauccaccaugaucaaguaugcuucaucacugggaugcaaagcugguucaacauacacaaaucaauaaacguaauccaucacauaaacagaaccaacgacaaaaaccacaugauuaucucaauagaugcagaaaaggccuuugacaaaauucagcccuucaugcuaaaaacucucaguaaacuagguaucgauggaacauaucucaaaauaauaagagcuauuuaugacaaacccacagccaauaucauacugaaugggcaaaaacuggaagcauuccauuugacaacuggcgcaagacaaggaugcccucucuuacuacuccuauucaacguaguauuggaaguucuggccagggcaaucaggcaagagaaagaaauaaaggguguucagauaggaagggaggaagucaaauugucucuguuuacagauggcaugauuguauauuuaggaaaccccaucgucucagcccaaaaucuccuuaagcugagaagcaacuucagcaaagucucgggauacaaaaucaaugugcaaaaaucacaagcauuccuauacaccaauaacugauaaacagccaaaucaugagugaauucccauucacaauugcuacaaagagaauaaaauaccuaggaauccaacuuacaagggaugugaaggaccucuucacggagaacuacaaaccacuacuccaggaaauaaaagaggacacaaacaaauggaaaaacauuccaugcucauggauaggaagaaucaguauugugaaaguggccauaaugcccaaaguaauuuauagauucaaugcuaucccuaucaagcuaccaaugacuuucuucacagaauuggaaaaagaacuacuuuaaauuucguauggaaccaaaaaagagcccgcguagccaagacaauccuaagccaaaagaacaaagcuggaggcaucaugcuaccugacuucaaacuauacuacaaggcuacaguaaccaaaacagcaugguacugguaccaaaacagauagauagaccaauggaacagaacagaggccucagaaaucacaccacacaucuacaaccaucagaucuuugacaaaccugacaaaaacaagcaauggggaaaggauucccuauuuaauaaaugguguuguguaaacuggcuagccauaugcaggaaacugaaaugacuccuuccuuagaccuuauacaaaaauuaacucaagauggauuaaagacuuaacuguaagaccuaaaaccauaaaaacccuagaagaaaaccuaggcaauaucauucaggacauaggcaugggcaaagauuucaugacuaaaacaccaaaagcaauggcaacaaaagccaaaauugacaaaugggaucuaauuaaagagcuucugcacagcaaaagaaacuaucagcugagugaacaggcaaccuauggaaugggagaaaauuuuugcaaucuguccaucugacaaagggcuaauauccagaaucuacaaagaauuuaaacaaauuuacaagaagaaaaagagaaccucaucaaaaaguaggugaaggguaugaacagacacuucucaaaagaagacauuuacgcagccaacaaacuucugaaaaaaauucucaucaucacuggucauuagagaaaugcaaauuaaaaccauaaugagauaccaucucacgccaguuagaauggugaucauuaaaaagucaggaaacagcagaugcuggagaggauauggagaaauaggaacacuuuuacauuguuggugggaguguaaauuaguucaaccauuguggaagacuguguggugacuccucaaggauguaaaacuagaaauaccauuugaccuagcaaucccauuacuggguauauacccaaaggauuauagaucauucuacuguaaagacacaugcacauguauguuuauugcagcacuauucauaauaauaaagucuuggaaccaacccgaaugcccaucaaugauagacuggauaaagaaaacauggcacauauacaccauggaauacuaugcagccauaaaaaaggaugauuucauguccuuugccaggacauggaugaaacuggaaaccaucauucucacaaaagaaacacaagaagagaaaacaaaacacugcauguucucacucauaagugggaguugaacaaugagaacacauggacacagggcagggaacaucacacaccagggccuguuggggaguggggggcugggggagggauagcguuaggagaaauaccuaauguaaaugaugaguggaugagugcagcaaagcaccauggcacauguauaccuauguaacagaccugcauguugugcacauguaccccagaacuuaaaguauaauaauaauaaauaaaaaauuuauuugauauucuuuucuucaaaagaaaaaaaagaaaaagaaaaaggaaauucugugcugaugcauuguaccugaaugaaagcagaggugcauuuugccaggucccacagaaauuuaauuuugcauguauugagguaaucaugugguuuuugacuuuagcucuguuuaugugauaaaucaaauuuuuuuuuuuuuuuuuuuggagacagugucuugcucugucacccaaccuggaguucaguggugcuaucugggcucacugcaaccgccaccucccggguuuaagcaauucucgugcuuuagcuucccgaguagcugagacuaaaggugugcaccaccacucccggguaguuuuuuguauuuucaguaaagacaggguuuugccauguugcccaggcuggucucaaacuccugagcucaggcaauccucuugccucggucuccccaagugcuaggacuacaggagugagccacugcaccuggccucaaauuucugauuugcauauguugaacccccguuucaucccagguguaaagccugcuugaucgugaugaauaagcuuuuugguaugcugguggauuugauuugccuguauuuuguugaggacuuuugcauugauguucauaaaggauauuggccuuaaauuuuucauuuugucucugccaaguuuuuguaucaggaugaugcuggccucauagaaugaguuggggauguuagcuaguuauuaugcagacuuguuucuguaguugcuuuauggugucacuggucuguguacuucaguguguuucuguaguggcugguaacauuguuuccuuuccauauuuagugcuucuuucaggagcucuuccaaggcaggucgugugguaaucaauuuccucagcauuugcuugucugaaaagaaucuucuuaggcugggugccauggcucaugccuguaaucccagcacuuugggaggcugaggugggaggaucacuugaggucuggcguucaagaucaggcuggccaacaugaugaaacccccgucccuacugaaaauaaaaaaaauuagcugggcaugguggugggugccuguaaucccagcuacucgggaggcugaggcaggacaaucacuugagccugggaggcagagguugcagugagucaagauggugccacugaacuccauccugggcagcagagcgagacucuaucuaaaaaaaaaaaaaaaucuuauuucuccuucacuuaugaagcuuaguuuggcugcauaucacauuuuggguuauaauuuauuuucuuuaagaacauugaauacuguuccucaaucuguucuggcuuuuaugguuucugcugagaugucugcuguuagucugaugggcuucccuuuguaggugaccugaccuuuuuagcugccuguaacauuuuuucuuugauuuugaccuuggagaaucugaugauuaugugucuuugggaugaucuugugaaauaucuuacucggguucucugcuaggccucucuagcuaggcuggggaaguucucaugggugacagaacucaugaaugauagguuggggaauguuggccucucugacuagguuggggaaguucucauggaugauauucagaaauauguuuuccauguugguuaccaucucuccaucucuuucagguacacuagugaguuguagguuuagucucuuuacauaaucccuuauuucucagagguuuuguuuguuucuuuucauucuuuuuucucuauuuuugucugacugucuuauuucagaaagucagucuucaggcacugagauucuuugcuccacuuggucuauucugcuauuaauacuugcgauugcauuaugaaauucuuguauauuuuucagcuauaucauguuaguugguuucuuuguguacuggcuauuuugucuguuagcuccugcauuuuuuuauugugauucuuagcuuccuuggauugguuuucaacauacucuugcaucucaaugauuuucauuccuacucauauucugaauucuauuucugucauuucagccaucucagccuaguucagaacccuugcuggagagaugguucgguucuuuggaagaaagaaggcacucgggcuuuuugaguuuucaguguucuuuugcugguucuuucucaucuuugugggcuuaaguuccuucagucuuugaaguugcuaaccuuuggguagagucuuuuucuuuuaucuugaugacuuugaggguuugauugugguaaaaaguggagucagccaacuggcuuuguuucuggaagauuuuaggguaccagugcucagcucccaacuucuccuggacugugugcucuaacucugugggacuuguaucagaccccaacuuuguucucuguuaccucaagguuaggaauccacuguguuggggggcugaggugcuccuggacugcuggucacuacucuccaauggguggugucagcuaaagcauuucauagugcaguagugcaguggcagcuggauguauccucauuugcaugugccagcagcagugguaguguauuaguguguucuuaggcuguugauaaaggcauaccccugacuggguaauuuauaaagaaaaagagguuuaauagacucacaguuccaugugacuauggggggacucacaauuauggcagaaggugaaaggaacaucuuacauggcgguggacaagagggaaugaaaaccaagugaaagggguuucccuuuauaaaaccauuagaucucaugaggcguauucacuuccaugagaacaguauggggaaacugacacuaugauucagugaacucccacuaggucccucccacaacacgugggaagaugagauuugggugggaacacagccaaacuguaucacgcaguguggccuagugcaugucuguuggcuguggcaaggugcuaaugggugccagggugccugucuucauaugaguguucaccacaguggcagcggcaauguggcugauggggagcaggagucccugcuggugacugugugugugguugugcuguuggugauguuggcacggguguggugguacugguggguacaggucuuugugcuuucucugugcgcuguaggcaggggugguugcucaguguggggggaaggugugcuguucuuugugucuggcuucacuuccugucaguguuggugcaagggugagguacuuccaggggcaaggcuggcuggcuuugugcucgccaugguuugcacugcaaugguggucaguugugggagcgggguggacugcacucacacaguggcagggcagggugcaugcacagucacaugcugcuggggcaaagaaagcaaaacccuccugcacacauauacaucagcaaagcaacgugcggggaugggggguggguugccaugggccaaggggaagcugcgguguguggagggaguggcaggcuugugcaugguuuugggggccaccccacuggagcucucugccuguuaggcaggucccccagugauacaggaccccagggcacccaaugcugcccugcaaguagacaccaccaggcugcggcccugggaguggccacagaccaaggauggucaggucagacuggccuuguuugauaggcaagacaacccugcagaguucagguccaacaguuccccuagggcuaaagucucuuaugggagcaagucaagccuagagggauggcccucacuggccaugcucugcugcagacucucccgcaccaaaccuucugggcuccacaucagcuggugugcugccccuaccacuucucuaagcagcucucccugccaacugaaguguccguggugguugaggggucuccuccugcugggauuccagagacccuucgggagaguggauugccccuugccaguucaacucacccauugccccccagagucacugggggcuaugaaugaguccugguacaugguaagccugugcaagguucccaccuuccucccucuucagccuagcuucugugucuucccuccauccagucucugugccuucccucugaagaucuauuaggagugcacccaucgucuuggucccuuggugguagccauuccacuuggcugugucuagucagccacuguguugggagccuguuuucauuucuuuuggguaaauaccuaggaguuggauugcugggucauaugguaggugcauuuuuaacuuuguaagaaacugccaagcugccauaagugauugugccguauuauauucccaccacuagccauguagaaggguuucauuuucuccacaccccugccaacacuuacauggucaucuucuuuauuaucacccuuucuaauggagguguagcaguaucucuuugugguuuuaauugcauuuccuugaugacugaugauguugaacauuuuuucaugugcuuuauugaacuuuaagaaaucuucucuaggauaucuguugaauuucuuuuguuccuuccucuuuuuuaaaacuuuuuuuaaagaccagaaaaauaagauuaaugauauugaaugucuuuuuguaugcauguuggccauuugugcauuuuuuuggugaaguguccaaauguuuuguccauuuuuuuuugaaggacaagaaauacucuaaauaaaauuaugacaaaaggcaugaaaacaaugccuucaucccaauuguuaguuuauuuuccggaaucaaaauguaggacuccaagucugagggagaauucuuuuuucugauuucugaauuuauuuggccaagcuauauaauuaagucauguuuauguauucauugauaaacuacuuuuguugaaaaauuuuuaaaaaauugagguuuucuggaaaaccaguguauuuuuuuuuauucauaggcaaacauguuauuuuuuuucugcugugauuaugcugggucuuccuacaauuauaaaauuucucauauguaaaauagaaaagauacaguauauuucuuauuuuuuaggaaugcgauuuuuuaaagaaucugaguauauggaucaaugaucauuuccccucauaaaaaauuaagugaguauuaguauaaugguuuggagcuuucaaaggaacacuuuauaaauagacaguuggaugguucuaaaaagccuaggcaaguaacaggaaccagccuaccuaaguauauagauuguuggguuagguggaguucucuguuuagcugccuuuuacuuuucauuuuugcugugaaauauaauguaauuaacaaaaaaugacuaaaagguaaacaguucaaugaauuauucauuaaauuuaaucuauuuuuaauaagguagauuuuaaccaccacugagguacaaaacagaaaacugccccagaaguucucaaccccugcaaaugauaacccuuuaaagcagcaguccccaaccuuuuuggcaccagggacugguuucauggaagccaauuuuuccacggaugggguugagagugggguggguugguguuguggggagugguuuaggcaugaaacuguuccaccucagaucaucaggcauuagauucucauaaggagugcacaaguuagaucccucgcaugugaaguucacaauaggguucgugcuccuaugcgaaucuaaugcugcugcugaucugacaggaggcagagcucaggcgguaaugcucgcucacccaccguucaccuccugcuguguggcccaguuccuaacagaccacagacugguacaaggcagucugggggcuggggaccccugcuuuaacgauaaccacucaccuaacuuucaaaguaauuacuuucuuaguuuuguuggauaguauuguuaccuaaguauauaucccuaaauacuaaauuuagguuuuauuuugccugguuugaauguuguucuuuacucuuaaguuucucuucugguauacagagaaaucuuaugacacuuaaauguuguagauguuuagaauuuuuucaccuuacuaguuuggggggaaaaagauuacugacuucuguugccggauauuuuuagucagacaaauuauaauaaagucaaaugugaaauaaguauuuucccggagaagccaaauuguccgucucauuuagagccucacuauuagaauaaucaguaaaauuaccaaugauuuguuauuuuccaauauaaauucuuauuuggucugagugaauagaaaaauggcuuuuuccaacauugaauagucucauauuugaaauuauuaaaauuaccauugagauaauaauuuccucaauaauuuagcaaauaccuaagucauauaguuuuuccauuagacuuaauuacauuuuauccuuaaaauaaauuuccuuaaaguuuuguuugcauuuuuauuuggucauuuagaauuuuaaauuguacaguuguaaaauguauaaauaauagacugguagucuuuaaacauuuuggcacauuugccgucucucggugucucuuuaugcauguauauagaugggcaucacauauauacauauauacaugcacauauacauacauuuuuuggggaaccauuugagaguaaguugcaggcaucaugguauuuuaucuucagauacuucagcuugcuuuuccuaagaacaauaacauucucuuacauaacaauuauaauauacuaucaagaaaauuaacaguaauuucauaucaucaucugcuauaaaguccacaaucagaauuucccgaguauucccaaaaugucuuuuauuuauuuauuuuuaaaucuauuuggccaaaacugcaguuacuuuuguaccuaccuaauagaaucaaguucagguucaugcauuguauuugguuauuauaccccauuagucucuuaaucuagaagaguucccaccugcucugcccuuucccuuuuaaccaucacauugaguuuugaggaguccagaccaguuguucuguagaaugccucacagucuauauuuuuauuauuuuauuggucuugcccauaugauuagguccagguuacauuuuuggcaggaauauuucauaccugaugucauguacuucuuacugcacauaucaggggguaacauaauuucugguuguuucacucuuaguacuccuauguuugaucacuugcauaagauggugccugccagaucuguucauuguaaagacaccuuuucuucuuugcaauuaauaaucaucugugaacucaauuaucuguuugcaggaaaaaaggauauuuguggcauuauaaauguguuaaucucacagggauuucuuaacuguaagacaacguguguuucuuuaguaagcuuguguucccccucucuacaaggauuauuugaaaacuuuuuucaaaccuauguuccuuuaucuuuccuaucacuuuuuuuuuuugagacggagucucgcucugucgcccaggcuggagugcaguggcgcaaucucggcuuacugcaagcuccgccuccuggguucacgccauucucuugccucagccuccugaguagcugggacuacaggugcccgccaccaugcccggcuaauuuuuuguauuuuuuaguagagacgggguuucaccauguuagccaggauggucucgaucuccucaccucgugauccaccugccuuggccucccaaagugcugggauuacaggcgugagccacagcgccuggccuccuaucacuuuuaagagaaggucuugguuggaaugccucuucuccugucauaaaccaguguagugugaagcaguuaagagugcuggcaagaaauuugagagugugugguucugaaucgcauuuucacuacucacucguuuuacuuagauauuaaucagccuaucuuggucuccucagcugcaugagaagaauaauuuguaagccccucauggagugguugugaggauuaaaugaaauaaaucauuguaaaaugcuuagcacagugccugguauauaguacauguucaauaaauauuagcacuuaaugcaauuucuugggaaacuuacuguguuaauuauccugccuucugugucuuuaacccuuacgugcuucccauaagcauuuaaacuuacacaaaucuuuccuaucuuuaacuaaucaaccaguaacugacuaaaaacccuuuccugcuucucaugucuauuuucaggucuugucuuauuuuccacuuucacaaccauauuucucaacuacuuucauuugcuauaucccuuugcuccuuucccuuugcugaucccacuguauucugguuucugcucccaccauucuucuaaacuaccucugauaaagucaucaucuccguaaauuaauuuuuauuccucauuauuccuagcacuuccauuuuauucuucauaaacaucaaaaugaucuuuuaaaaguguagcucugaucucaguguuuccuaauuaagacuaguggauuuccauuguuguugacauaaagucucacauccuuaauaugguuugcuaaguccugccuaacugcccauucuuagacacauuaccucuuuauucuaaguacaugagucagguaaguccuuuaauuucuuugaagaagcuuuacucaaaacauuugcauuuuguccuguuuuuuggaccuuucuccauuuuuuacuuguuuccuuuggauagugccuguccuucuuugagacuucagcuucaaggucauauucucagaaacuuggcucagaagaagugcaacaucuguauuucuucuucauagcacauauuagaauucuaauuaaauaaugaauugguuuauucucuguaauguacaccccaugaaggcaaaaacucaacuauuuuguuuguagcugaaacuccagauuauacuagcaucguuguuuugcuggaagauguucaguaagugcuuguagaaugaauuauuauugauccauagagaugucauuuauuuuuuaauaauuuuaaaacuaauagcuuaauuuuuuuuugugugugugcaacauguuuggaguuuucaguguucuauggaaguacccugggaacuuguacccucuucccacuagaugguuuggggauauacacucaaauggcugcugcaaacaagugguuuuuuuuuuugagaguucccguuuuaucuugaaaauaugugaacauauugcuguuucuuaauauucuuguguuuguuaagcaaacaaacaaaaagugccuaaaacuguuucauagguaguaaaauagacacucuucugauuaaacauuucccaguacuuucagccauuccucacuugacauuguuuuaaaugcacuugguagccuguucacaccacugcagaaacuauauuccauaguuuuuggaauuccagaacuaaacauaguuauucaaauauucagcauaaagauguauugaaugagaagauggguaaaacaugaugggcaaaaguguugcuggaacugcuugcauuugucagucuuuuuuuuuuuuugaaauugguauagguacaguaagguaaauuuuuuaaguugaccuauuuuagaaauaagauaaaauuaaaucuguaucuuaagacuguauagccuuaagaauguaagugaugcaguaguggacccuuaguuuuaauaauguuuucugaaucaacaaaugcuaaaacaaaaacacauuuuuagcacaaacagugguuacaucugugaugagaucugcaaaugaacacuguccuucaacuaacauuguuaauaaacaugaaugcauugccaggagucuagcagcuguacauguguaaugauaguuguaguaaacuugacagaauucugaagaaaaucccaacuuaagugaaauagauuuuacuuuuuaagguaucuuugauaauaguuaggcauuuuuucuuuuuucuuaggguauuuacuauaguugcuugaggaacugaaguuuacaguuucuggagauauuaguuugugaugaauucauguauucuacaauguguaguaccauauauacuaauuauuuauguguauaacaggcaacucaaaguuauguugacgaauguccuauggacggauuuaggacgaaaauucagaaagacccuaccuagaaacgaugcuaauuuaugugaugccaacaaggugcaaucagacucauugccuucgacaucuguugacagccuagagacaugucaaaaauuagaaccucuucgccaaagccuuaauuuaucugaaagguauguuguucaguauugauuuuguucaacuuaccacauuugaaauaauaugaaucccguacuccuaaugauaaaauuguugaaaugaccugaaaggagauuugcauauauaggcauaccacacucuaaagcaaaucuuaaagcugccuaucuuaauuuacagaguuagcugauguuucuguacuucauuaagcagauugacauggaauuauauuuaaaaacgaguaucauuaguacauuuaacuuauuuaaauuugauacauguacacaucuuuuuagggauuauuuuaugauuaaaaugaagauacauauauauacguguguguauauguauuauaugcauauaaauguguguguauauaugugcauuaauauuuucuucaucuuuaacauucuuucaaaauguuaucuaaucuagauccuaaccacuuuugacuuuuuugagcuuguauuuuaaaugaauuuuuaaaacaggagaugauguuaaaauauugccucuagguuuuuaauaguaaauguucaguuuaauuuuguagaguaacaagaccaauuucuguuuuguguuuuuugaaagaauuauaugggaguuuggggcugaaaacuaggaauuagcucuaggaaucuauaacauaauaucuuuuauacaucacgauuuacaauuucagccauuaaaugaauguuuuggagggaagguacuuuauuuucaguuagaauaacuuacaauuagcgagacaguacuuugguuauauggucuguaaucugaaugacaguauauaaguacuuuaaaccaagacccagauaaaaacugcuaacuuucaacacaguuauuuuuaaaauaaaaguagaauucuugucaaaacaucugaagauauuacacauuaauuuuuaaagagaauacuucuuuuaaaaagacaaaaucauaaaaagccaaguuuaacgaagaaauuucuuacuagcucauaccugauauaaauuuaauuuucuaaaacacuguaaaucuuaagagucagacagcuuagcaucaguaauuuaugaagcagcuugcucucauucuauguucuagcagauuucuuccccaguacagguuaaucucuuacugcacugacagauguaaauaaaagggcuacuuaaaggaauggcuuucuaauaucuuugacucuuuugaaaggaaccuuuaaacucucuucaaaugacaacaaacucaucaaucgccucauccuacaucuguccuuuuuccaaucagaacagugugguaguccauucucucagaauaauaguuuuaccacuaggaauuuuuagcacauagauuaugugcucaugaaauucaaauauaauaugaaguaaagagucccaguaagauucuaauuuguuuuuugcuguguuuuaaaauuguuguugucuauuguucaguuagugggugagcuaccagcuaguccagaccucuuuccucagcuccagguguccuaaacucaacuuguuguaaagugagaaccucaucuuuucucaaacuugugccuguuuuuguauuccccucuaucugagugauugacacuacuuacaaauuagaacuugggaauugucuuugacuccucuuuuuuccuuauccuuauauccagucauuuaacauauauacauauauauauuuuuuuggggggcgguagaaaauuaaaccuuauuuaauuuuaaaaccaaaccacuaggaaaauauaucauagccuggaaacaguaaauggacaggcuguguuaucacuucaaguaauaaguuggugaaaauacaaugagguugcuaucaaaacaauaaggugccaugcuggggcaggaacacuguguugcaaaagccccaggcaaaaaugguauuugguaaugggggcugccucuccuuugcuuuaaagaagucagcucauccuagcccaaguugcuuacuuuuucuuccuugaauuuccugcugccagggguuugucuuaguugugcucuguuaauucagggggcuaaguauguaaugcuagguuuaggcuuucauucuaucuguucuauaaaaaccagguuuuuccaaauccaguacuucauaacuuuuauaaucaaguagccaacugcuccucuuuuacuguucauuccuagauacuaguauauaucacaaucaaaaccccuuucucuuccaaggggaaaguguuacugcaagauuguccugucauuuugcuacacacagccucaggguccaucaggcaguaauuaugcuucccguaauuaguguguccucgccucucauguuuuugcauggucuccaggcugaaagaugcagcauguaauaauuuuaagaaauguacauccacaucuugaugaccagaaauggggaucaaggaaccuuucaaaguucuuaucuaaacuagucucccucccaauuccacaucuuaaaaucaacuuguaugcccuuguauaaauuacacaaaaccaagaaaacaaagacccagaaaacuuuuuuuucccuucuaaguuagugaccucauggauuuuguuucacagcuuauggaaaaugguguggugacacuucugguaaacaggauguuggcaacaaagagaaaauaucuuucuucaaacuccaccaacucuaaccugccagccuauugguaccuguguaguaagaagagucugguguguuggagggcucuggccuguuacaggggagauccuuacugccaggacaagcacuggccacaggaaauauaagaucuaaaacucuccuguaaaucucugacccaauuuaacaccacuuuuuuccauuucauguuuuaggacugaaacaugaaagaaccagugucuagaggcaagugacauaugcauuacacuuguggccauccuuaauuucuucauucauaaacuuugcuuaaaauacuaaaguucccaaaugccuuauaaaaaauauauucuugcccucagcccccauggccacuggcaaagacuuuuauuucccaauggcuaagagagcuuccuucaucuucuuggucauaguugggaugaggugcauguggucauccacacacuuggucacacaaccguccagcugcugcuucaccugaagcuccuuacucccagcagcuauugaaucuuuggcuuuguuguugcauugcgugguacacugggccaggugguccuggaacuucuccaacucacuggugaccaaagccugggcuugagccagaagcacauggcagugcuugaugcacuggugcaccugcugcagggaggccuggcuguccucacagcagcuggugcugcaccggaacaugagacccugcaucuuccggauguucucucucuccagacucuucaccaucgauucuaccacucgucaccugcagcugcuguagcuguuauggugaccccacacugccccaugcugugcggccauauauaguuauuuuuaaccccuaaaucugucuuuuaaaggaucuguucuccaucuuuauugccagugcaucaguucaagcccuaauaacuucgugccuuuauuacuaugguaguaacuugauuagguuuccuuuacguagucuuuuucuucuuguuuuauucuuuauguuguugucaaaauauuuauucuaaaaggcagaucuuacuugccacuuacuaguuuaacaucuuucaauggcuccacauaaucuucuggauaaaguucaaacuucuuaguuuggcacacaaggcccuuaaugaucucgccuuugcuuaucucuagcuuugugucugucuguuccuccauauucacaauguacuucagguuuagggaacuauuuucagcuuacugaauguauauacuguuguauacauccuguuuguuuucuugucuuggaaacuauccccccccucccuuuuuuuuuuuaaggaagccuuccuugauuccacccuccaaaucuauauaugaucccuuucuuuuucuugcuaaacagcuuguuaguauaucauaacgcuuaucacacuauguugugauuuuuaguucucuuccucccuguagcaaacuuccugaggauaggaacuauauuuuauuucuuauuuuuucuuuauuccuaauauaguacuggacacuuauuaaaugcucaauuaauguuugcuggauaaaagaaagagauugcuucucaccagaguuacaucucuagacucuuugucuaacauauauuuucccuguaagaaccaauuauauacucaguaauuuuggugacaaccaggaaaagagauauuacaagcgucaaauaaggaaacuggagaacucuuguguauggcuuuggauagauguuuucuaccugauacuugcuauauauaauaggagacuuaggcuuuuuucagucuuugcuuaacuuugauaugaggcuuuuuguuuuauuuucauuucuacucaggacuuaaaauuuuagaaagauaagagggagaaacauuuauuuuugcauuuuaauuuuauccuaaaguuuaaucauugaguaaacugaaauuacucauucaguuccagaaaugguauuuuguuggacauuuuauuugcuuucuggaaucuaaaguagugaacuaaguaucuugccuuuuaugugagggcaguuuggcuuuuugauuucaggauaaaauugagaagaaaaauagaaaagacaguucaaaucaaucuuguaaguaauggagaaaaggguuuuagcaguaucaaaagaguuuuagaaauaucaaacuagcaguauguggaaugcacauuuauuuuuuaaaaauauguaaacugcauuuuaguguuaguuuuaucuccauguaugguucauaucuauuuuccugggagaaaauuccagacaucuauaagucuuugucaauaggaaagaaagaaccuagugggacacuuauacaaggcuuuugagaaaauaaacuaucuuucuucugcuuucaucaguuuguaccagagaucguuagagaaauauggagauaguguacccauauuccauuaagaagaguuagcugcugguacuuggaauuucuguaaauauauuuauuuaucuuugucuuaaauuuauauguguuuaaaauuaaaaagaauuacguauuccagauaugugaugguaaaacuauuuggauauugcaguguuccugucauuuuaagauuuuuaaagccaguaaucuaguugagugauaauuauucacuuaaaauuuagcuuaauaaaagaacaaauuuagaaacuaaucugugaaucucuuuaauaaaguuacucaaagauuaaauuuuuuauacauaccuuuaagaugcugauuuagaagguauauuuuaaauuauaucaucugggacaagcauagaguuaugagaauccucuuaaaaugccacauagcacaauuuuagaaaggaauucauugcagcaaaaugaaaacuaaauuaguauuguaauuuuuggcucauuauagauuuauuaauggauauaauuauguuaucuuucagcaaagacuucauuucucuaaaaauuugcucuauauaugaaguuguauguuaauagcucuuucuaguuccucagaguuuucccugcauuauuaaguuauuugaauaugacaguuuccuugcuauuuaaacaaggaaggaaccuguaguuugcaauugagaaaacuaagagucagagagaauaaucaugcagagacacagucagaaaaugauacuacuucucaggccaguauacuuucugcuaccucucacugcauuucaaaauuuguuucugcuuugguuuaguguauuuaugauauuucgaagugggauuucauaguauuaguaaauaaaauuaaauaaauaauaccuuacguacugauacuguuuacauacuuaggaaaaaauuggguaaaugugugaaaugacaacuuuaguucuuccuuccagauucagauaguaugaaagaugaaguauacaccuuuauauacuucaauuccuugcagaaauucagaacuucugaaaugcuggcuagcccuggaauguccuugacugugcuaauuuauaaaccuguacugcaaaagacagcuagguauuguuaauuuagcucucaguuuauagauuuguguucuucaagccuaucacacaaaguuccuuguuuccucaggguacccaaacuggauaaguuuucaauaguugaugaaagguguuugggcuguggcugugugcuaugaagagcuauguguacuguagucauugcuaacuguuuaauuauauacuuuaauuguauauugaaaauugcaaacaucuaauaagauuuuuuaucaagauugcagagcauaguaaauuauaaguauuauuugaaaggguaguuuauagcuuugagcaagacuacaauaauaugaaaauuauuacagaaauaugaaaauuaagugauauuccauuuauuguguauuuacuaugugccaggaauuaugcuaacugcuuuccaucuauuaucucauugaaucuuaacaacuuuguaagggagauauuauucuucccauuuuagagaugagaagaucaauguguagagguagaaauuaugguaauuaacuugcccaaggauuuauaguuauaaggugguaaaauaagaauccaaaccuauguuggucuaacuucaaaguccuugcuguuaauuccugugccauacugcuucucuuugcauuuucacccuucugaacuuuaauuuuugucaucaguaaaguaggaauuggacuuugcuacagauaccauaucuaauucuuuuauuuuauuuuauuuuauuuuauuuuauuuuauuuuauuuuugagacagaaucucacucugucauccaggcuagagugcaguggcgcagucucugcucacugcaaccuccgccuuccagguucaagugauucuugugccucagccucccgaguagcugggaucgcaggugugugccaccaugcccggcuaaucuuuguauuuuuaguagauggaguuuugccauguuggcuaagcuggucucgaacuccugaccucaggugauccacccaucuuggugucccaaagugcugggauuacaggcgucagccacugugcccggccuauaccaugguuucuuuauccacuuguugauggaugggcauuuggguuaguuccacauuuuugcaguugugaauugugcuccuauaaacacgugugcaaguagcuuuuuccuauacuuccuuuccucuggguagauauccaggagugggauugcuggaucaaauggugguucuacuuuuaguucuuuaaggaaucuccgcacuguuuuccacagugguuguccuaguuuacauucccaccagcaguguagaaaaguucccuuuucaucacauccaugccaacaucuacuauuuuuugauuauggccauucuagcaggaauaaggugguaccgcacugugguuuugauuugcauuucccugaucauuugugauguugagcacuuuuucauauguuuuuuggccauuuguauaucuucuuugagaauugucuauucauauccuuaccccacuuuuugaugagauuguuuguuuuuuucuuguugauuuguuugcauucauuauagauucuggauauuaguccuuugucagauguauacauugugaagauuuuuucccacucuguggguuauccguuuacucugcugacuguuccuuuugguaugcaaaagcucuuuaguucaguuaacuccgagcaauuuaacuuuguuuuuauugcauuuguuuuggguucuuggucauaaaauccuugccuaagccaaugucuagaaggguuuuuccaaugucaucuucuaaaauuuuuauagauucaggucuuagauuuaaguccuuaauccaucuugaguugauuuuuguacaaggugagagaugaggcuccaguuucauucuccuacauguggcuagccaauuaucccagcaccauuuguugaaaagaguguucuuuccucacuuuauguuuuuguuugcuuugucaaagauccacuuggcuguaaguauuuggguuuauuucuguguucucuauucucuucccuugaucuagguguuuauuuuuauaucaguaccaugcuguuuuggugacuuuggccuuaugguaugagaucagguaaugugaugccuguagauuuguucucuuugcuuagucuugcuuuggguauucaggcacuuuuuugauuucauuugaauuuuauaauuguuuuuucuaauucugugaagaaugauggcgguauuuugauaggaauugcauugaauuuguagauugcuuguagcaauauggucauuuucacaauauugauucuacccauccaugaguaugggauguguuuccaguuguuuguguugucugugauuucuuucagcaguguuuuguaguuuuccuuguagaagaggccuuuugacucuuugguuagauauauuccuaaguauuuuauuuuuauuuuuuggcagcuauuguaaaagggguugaguuuuugauuugauucucugcuuggucgcuguugguguauagaagagcugcugauuuauguacauuaaucuuguauccagaaacuuuaccgaauucuuuuaucaguucuaggaguuuucuggaggaguccuuaggguuuucaagguaaaugaucauagcgucagcaaauagggacagcuugacauccucuuuaucgauuuggaugcccuuuauuuuuucucuugugugauugcucuggccaggacuuccaguacuauguugaagaggaguggugagagugggcauccuugucuuguuccaguucucagagggaaugcuuucaacuuuuccccauucaguauuauguuggcuguggguuugucauagauggcuuuuauuauauugagguaugucccuuguaugccgauuuugcugagaguuuuaaucauaaagagaugccggauuuuguugaauauuuuucugcaucgauugaggugaucaugggauuuuuguuuuuaauucuguuuauguggugugucacauuuauugacuuacguauguuaaaccauccuugcauuccuaauaugaaaccuaugugaucaugguggauuaucuuuuugacauguuguuggauucagauagcucauauuuuguuaaggacuuuugcaucuguguucaucagggguauuggucuguaguuuucuuuuuuuaauguccuuucuugguuuugguauuaaggugaugcugucuucaugggaugguuuagggaagguucccucuuucucuaucuugucgaauagugucaauaggauugguaccaguuuuucuuugaauguccaguagaauucugcugugaauccgucugguccugggcuuuuuuuuguuguugguaauguuuaaauuaccauuucaaucucacugcuuguuauuggucuguucaggguaccuaauucuucccgauuuaagcuaggaggguucuaucuuuccaggaauuuauucuucucuucuagguuuucuaguuuaugaguauaaagguguuuauaguagccuugaaugaucuuuuguauuucuguguugucaguuguaauaucucccguuuuguuucuuauugagcuuauuuggauuuucucuccucuuuucuugguuaauauugcuaauggucuaucaauuuuauuucucuuuucagaaaaccagcuuuuuguuucauuuaucuuuuguauuuuuuuuguuuuaauuucauuuaguucugcucugaucuugcuuguuucuuuuguucugcuggguuuggguuugauuuguucuuguuucucuaguuuuuugaggugugaccuuagauugucugugcucuuucagacuuucugauguaggcauuuaaggcuaugaacuuuccucuuagcaucgccuuugcugugucccagagguuuugauagguugugucacuauuguuguucaguuggaaaaguuuuuuaauuuccaucuugauuucauuuuugacccagugaucaccaggagcagguuauuuaauuuccauguguuugcaugguuuugaagguucuuuuuagaguugauuuccauguuuuauuccacuguggucugagagagugcuugguguaauuucaguuuucucaaauuuauugaggcuuguuuuguggccuaucauauggucugucuuggagaaagguccaugugcuguugaauagaacauauauucugcgguuguuggauggaauguucuguauauauccauuaaguccauuuguuccaguguauaguuuaaauccacuguuucuuuguugacuuucugucuugauggccugucuagugcugugaguggaauauugaaguccccuacuauuacuguguugcugucuaucucauuucguaggucuauuaguaguuguuuuauaaauuugggagcuccaguguuaggugcauauauguuuauauuuuccuguuggacuaauccuuuuguccuuauauaaugccccucuuugucuuuucuaacugcuguuucuuuaaaguuuguuuugucugauauaagaauagcugguccugugagauuuauguuuuaaagagguucuguuuugauguguuucuaggauuuguuuuaagguuuagagcuccuuuuagcaguucuuuuagugcuugguaauggcgaauucucuucccauuuguuugucugaaaaagacuguaucuuuccuuuguauaugaagcuuaguuucgcugcauacaaaauucuuggcugauaauuguuuuguuugaggagggugaagauagggcuccagucccuucuagcuuguaggguuuuugcugagaaaucugcuguuaaucugauaguuuuucuuuacagguuaccuggugcuuuugccucacagcucuuaagauucuuuccuucauauuaacuuuagauaaccugaugacaaugugacuaggugaugaucuuuuugugaugaauuuuccagguguucuuugaguuucuuguauuuggaugucuaggucucuagcaaggccagggaagcuuuccucaauuauuccccaaaauauaucuuccaaacuuuuagauuucucuuuuuccucaggaacaccuauuauucuuuuuuuuuuuuuauacuuuaaguuuuaggguacaugugcacacgugcagguuuguuacauauguauacaugugccauguuggugugcugcacccauuaacucgucauuuacauuagauauaucuccuaaugcuauccuuccccccuccccccacuccacaacaggcccuggugugugauguuccccuuccuguguccagguguucucauuguucaauucccaccuaugagugagaacaugcgguguuugguuuuuuguccuugcaauaguuugcugagaaugaugguuuccagcuucauccgugugccuacaaaggacaugaacucauccuuuuuuauggcugcauaguauuccaugguguauaugugccacauuuuuuaauccaaucuaucuuugauggacauuuggcuugguuccaagucuuugcuauugugaauagugcaacaauaaacauaugugugcauaugucuuuauaguagcaugauuuauaauucuuuggguauauacccaguaaugggauugcugggucaaauaguauuucuaguucuagauccuugaggaaucaccacacucucuuccacagugguugaacuaguuuacagucccaccaacaguguaaaagaggaacaccuauuauucuuagauuuggucauuuaacauaaucccagacuucuuggaggcuuuguucauauuuucuuauucuuuuuucuuugucuuuguuggauuggguuaauuugaagaccuuguuuucaagcucugaauuucuuucuuccacuuguucaauucuauugcugagacuuuccagagcauuuugcauuucuauaaguguguccaaaguuuccugaaguuuugauuguuuuuuauuuaugcuaucuauuuccuugaauauuucucccuucaccucuuguaucauuuuuuggacuuccuuacacugggcuucaccuuucuuuggugccucccugauuagcuuaauaacuaaccuccugaauucuuuuucagguaaaucagggauuucuucuugguuugaguccauugcuggugagcuaguaugauuuuucagagguguuaaccuuauuuugucauauuaccagaguugguuuucugguuccuugucauuugaguaggcucugucagagggaaggucuagggcugaaggcuguuguucagauuccuuugucccaugggguguucccuuauuauaguacucucgcccuuuuccuauggauguggcuuccugagagcggagcuguagugauuguuaucuuucuuuuggaucuagccacccagcuauucuaccaggcucugggcugguacuggcgguugucugcacagagucuugugaccugaaccaucuaugggucucucagccauggauaccagcauaguauuugggguguccugggucaugcugguguacucugcuuccuucaggagguguguggguccucuuaggcuuccugauuuauuccugcaguuguucuggagcaaaaauucacgaugcgagcuuccacaugcugcucugucugucgagucagagcugcaaucuagucugccucccauccaccauuauccccuuuuguucccaauucuggaggcaagaaauccaaucaagguguuuugagggcugugagagaacgccugugccaggccucucucuuuggcuuguagauggcugucuucucccugugucucuucacauuguuuucucacugugcgucucauugugguuuugauuuuuauuucucuaaugaucagugauguugugcuuuuaaaauaugauuauugucugcauguguaucuucuuuagaaacgugucuguucauguccuuugcccacuuuguaaugggauuguuugcuuuuuuucauguuaauuuguuuaaguuccuuguaaacucuggaaauuagacauuuguuagauggauagauugcaaaaacuuucucccauucuauagggugucuguucacucuaaugauaguuucuuuugcugugcagaagcuccuuaguuuaauuagaucccauuugucaauuuuugcuuuuguugcaauugcuuuuggcauuuuugucaugaaaucuuugcccgugccugccuacguccugcaugguauugccuaaauuuucuucuagguuuuuuauacuuuuagguuuuacauuuaagucuuuaauccaucuugagauaauuuuuauauaugguguaaaaaucggguucaauuucaauuuuuugcauauggcuaguucuuuucccagcaucauuuauuaaauauggagcccuuuguccauugcuuguuuuugucagguuugucaaagaucacagaauuguagguguguaguauuacuucugggcucuuuauucuuuuccauuagucuguguguuuauuuuuguaccaguaccaugcuguuuugguuacuauagcccuauaacaugguuugaagggauguaaggugauucuuccaguuuucuucuuuuugcuuaggauugccuugguuauaugggguucuuuuugguuccauaugaauuuuaaaguaguuuuuucuaauucuaugaagaauguuguugguaguaugauaggaauagcauugaaucuguaaauugcuuugggauauauggccauuuuaauauugauacuuucuauccaugagccugggauguuuuuccauuuguuugugucuucucugauuuuuuaaaguaauguuuuauaguucuccuuauagagaucuuucaccucccugguuagcuguauucagagguauauuauucuuuuuguggcuguuaugaaugagauugccuuugugauuugguucuccacuuggcuguuguugguauauaggaaugcuagugauuuuuguacauugauuuuuuuuauccugaaaccuuguucaaguuguuuuaucagcugaaggagcuuuugugcugagacuaucggguuuucuagauaguuguugcagcacuuuuuauucugauuaugguauaaauggauauuuucaagaguuuccugaaguaucuguuggcaaucucaguuaucuggaauccuuuggcaaauuagcauugaggauguaguauaauguaauaggacagacaaaaaacccccaaagauaacaggcccagguucuuccacuaggaaagcuacuuauacuugggcagcuuauuuaacuuuucugagcguuggguucuucauguuuacaauaaagagaggacuaauuuauuuuaaaguucuccaaggaucuaaaauuuuaugcugucuggaacauaaugaaaugaacauagugucuuuauguagggaaaaauaguaaaauuuuuaauuaggggaugugcauuguuuuagucauagugccauugcacacuuaauagacuacaguauaguguaaacauaauuauauauucacuaggaagccacaaaauuugugugacguguuuuauugugauacucacuuuauggcgggggucuggaacugaacuggcccugucuccaaguauaugcguauacuuuuguuuaagugaaaaugugaacuucacuguacuuuguuaccuuuguuguuuuaugcagaggcaucuagaaugaugaauccuuuccggaagauuuucaguuuacuuuucccagacccaucagaggaaaucacuguuugugguagcuauaugaaauguauuucuuaaauuguaagacuugaaacuugaaauuacuucuugauccaugggcuauagaauggauguuuuauuagcaggcaugaaaacaacacgaauucucuuguaccuccccaucagagcucuugggugacuaggugcauugucaacgagcuguaauauuuugaaaggaauuuuauuuauuuuuuuucugaguggcaguucucaaagaugguguuaagugauucagugauccacgcuguaaacagaugugcugucauccagucauccagacauuguaguuccauuuuuagaguacaggcaaaguagauuuagcauuuuuuuuuuuuuuuuuuugagacggagucuugcucugucgcccaggcuguaaugcaguggcaugaucucauugcaaccuccgccucccagguucaagcgauucuccugccucagccucugaaguagcugggacuacaggugugcaccaccaugccuggcaaauuguuuuuuuuaguagaggugggguuucaccauguuggccaggcuggucucgaacuccugaccucaaguuauccgccggccucugccgcccaaagugcugggauuacaggcaugagccaccaugcuuggcccaauuuagcauaauucuuaagggccauuggaucuuuugcaugguaauugagcacuggcuucacagauaagacaccagcuucauuagccccuaacaagagagucagccugucuuucgaacuuaugcauugacuuuuccuuucuagguauggaauuccuagaugucauuuuauuccaauagaaggaucuuucaucuacauugaaaaucuguuguuuaguguagccaccuucaucacuuaucuuagcuagaucuucuggauaacuugcugcagcuucuccaucaguacuugcugcuucaccuugcauuucauguuauggagauaguuuuuuuuuuuuuuuuuugaggcagggucucauucuguugcccagcaugacucauuucagcuuugaccucccagcuagcgucaucauggcucacuacagccuugaucucccaggcuaaagugauccucucacuucagucucccgaguagcugaggcuacaggugcaugccaccauacuaagcuaauauuuucuauuuuuuguagagacagggucucacuauguugcucaggcugagacaacuucuuuucuuaaagcuuguaaaccaacuuuucuucugcagcuuccuaaccucucucagucuucauagaauugaagagaguaucuugcucugaguuaggcuuuggcuuaagggaaugcuguggcugauuugauguuguauucagacuacuauaacuuucuccauaucaucaguaagacuguuuugcuuucuuauuauuuguguguucauaggaguagcacuuuuuuuuccuuuuuuuuccuuuuuuuuuuugagauggaguguugcucugucgcccaggcuagaaugcaguggcaguaucuuggcucacugcaacuucagccuccuggguucaagucauucuucugccucagccucccgaguagcugggauugcaggugccugccaccacaccuggcuaauuucuguauuuuuaguagagacgggguuucaccauguuggcaaggcuggucuugaauuccugaccucaagugauccuccugccucagccucccuaagugcuaggauuauaggugugagccacugcaccuggccaggaguagcacuuuuaaauuuguucaagaacuauucuuucucauucacaacuugacucugcagcaagcagucuugcuuucagccugucucagcuuucaacaugccuuccacacuagguuuaguaauuuuuaguucuuuuuuuuuuuuuuugagacaaggacuugcucucuuucccaggcaaacagagguggcgcaauccuagcucucugcagccuugaacuccuggggucaagugaugcuccucucucagcuucccaaguagcucggacuacaggcauguacugccauggcuggauggcucguuaauuauguuuuguagagauggagucuugccguguuucccaggcuggccucagucuccuggccucaagugauugucccaccuugaccucccaaagugcugggauugcaggugugagccaccacacccagccauuucuagcuuuugauuuaaagugagaaacuugagacucuuccuuucacgugaauauuuagaggccaugguagugcuggaauuggcauaauuucaacauugcugugucucaggggauagggaggaggccugaggagagagagagagauaggggaaugguugguaggugaagcagucagaacacacacagcauuuguuaauuaaguucaaugucuuaugcaugcaugguuuguggugcuucaaagcaauuacaauugugccaucaaauaucacugauuacagaucaucauacuagauauaauaauaaugaaaagauugaaauauuuugagaguuaccgaaaugugacacagacacacaaagugagcacaugcuguuggaaaagucaugcugauagauguguucuacucaagguugccacaaaccuugcauuugugaaaaacacaguaucugugaagugcaguaaagugaagcacaauaaaaugagguaugcucguacucuggcucuuucuauauauuguuucuuacaaacaaaguauaaguaaaguauugcuaguggcauauugauaacagucaacugggcaucuaauaaagaggaguuaggaaaacuuuaaaauuacauaacaggaacuuaaaaaaaucacaauaauuuggcuugggccagugaauucugggcugaauaucaauauugaaggcauuauuguaguguggcaaaguaauguucauaauaaugacuggccagcagaguaaauauugcacuaauuuuauaccaaauguacuucuuuauauaucaaauguacaucuucuguuuaagaagauaucaggcuuauauagugcauuugauauaaaacucaccaauuuaaggucuggagacuuaaaaauacaguccaggcuagaugcaguggcucacacguguaaucucagaauuuugggaggcugaagugggaggauugcuugagcccaggaguuugaaaccagccuggacaacauaaugagacauagucacuacagaaaauaaaaaaguuaccugggcgugguggcuugugccuauagucccagcuacuuaagaggcugagguaggaggauuacuugggccaggagaucgaggcugcagugagcugugauugugucacugcacugcagucucaaaaaagaaaaaccaacuaaacaaaaacuuuaauuuucuaaacauuuaaauguauugacucuuuuccugaugcuauuacauauuagcauauauguuaucaccauuauaugugcuguuucaguuacggaaucuuucauuaccagagaugcaaucugaaugaugucuuguuggauuuauuauuugucauuucccaauugcaaguauguaaauuacuuaucaaagacauuucuguuaaaugagaagaacaaagauuucuugaauugauuuguaguaagcuguguuuuuaauaauuucuggaaaaggaaagaaagcauuuuuagagaagaauuuguuaaaauuuuaagccucucaauggcauccauuaguauaauuaaagauauuguaguggcaggcuaaucuauguuauaagugauaagaaacaagugcuucuauaaaccaaaagauuguguuuuucuaaauuuuuaaguauuuauggguuaauuucuagggugguguaguucgaacagcuuucuugugcuaagauggcaaugauugaaaauucaccuuccuggaauacauuuuuuuuuaacugaaaacuucaguacaguacaguguuuguuauucuaugugacaggauacccagaguuauauugacgaauguccugggaacggaguuaggaagaaaauacauaaggaccccaccuguaacugagggaaguuugagugauacagacaacuugcaaucagagcaacuuucuucaucaucugauggcagccuagaaucuuaucaaaaucuaaacccucacaagagcuguuauuuaucugaaagguauguuuagugauaacuuuacucaaaauaauuauauuuauuuuuauguauccuucccuguucuuuuucacagauacauuauugcuaaaugugagguaaaugugcucugauagcugguauuauuuuucuccccggguggcuggaauggcuauuggaaccaacaguccauggcuaauaauguguuucagaagcacuggccaccauacuuguauuuuggaaaaauggauacagacacuuaaugaaaaucugguaaccuauuucaguaucccaguuugucugguguaauugaaauccauuccucugacauuagucuauugcccucucuuuuucuguucuauuuguccaucuauccaucuacccauucagucuugucuguuauuuuguuuuacuuuaauuuuuuugaggcggagucucguucugucgcccaggcuggagugcaguggcaugaucucggcucacugcaaccucugccucccagguucaagcgauucuccuaccucagccucccaaguagcugggacuacaggcacgugccaccacgcccagcuaauuuuuuguauuuuuuaguagagacaggguuucaccguguuagccaggauggucucgaucuccugaccuugugaucugccugcuucagccucccaaagggcuggcauuacaggcgugagccacugcccccggccuuguccguuauuuuuauauucagacucuagaauuuuaacuaguacuuagugcucaguaaauaguuuuugaaugaauggcugaacacauuccuuaaaaaaaugguuugagauuuuccauuaacaaauggaaaagcugaauuccauugacaaauguagcuuguugugccaauaagagaaaugcagaucugaaguugccuuuguuuuaagcucuaggagaggauuguguguggacuggaaauaagaaaaaaucuguggcacaaagcuagggauggucaguuaguacauucuguuagauuuauaaacuuccauuugcuacaagcuucugaagcuucucuuuuuauuuucuguguucagccuguaggauacuuuuuauauagaugaaaaguugauuauccuaauuuuuuuccccccaaacuauccaaagcuaacuucugguuuguauuucuauuguaagccuaauuacauuaaauaguacuuauaguugccuuuuuaaauaucuacaacaaauuuuauuauuuaaaacucuuuauuuucuaugaauucuugaauuuuucuucuuuuggaaaauauuuucaccuagguucuacuuagugaaucaguaacgacaauuuuaacuuuauauuuuauuaggucucuugcuaaguuuuccccccaaaaugagaauuucaguggcauuauucaguuacuaaauuuaauguguaauuggggaaauuaguaauguaucuaucaaguggcucaugccuauguaucuaucaaguggcucaugccuauaauccuagcccuuugggaggcugaggcacgaggaucacuugaggcgaggaguucaagaccagccuaggaggcauagugagaucuuguuucugcuaaaaaugaaaaaaaugagccagaugugauggugcaugcuuguagucucagcuacuugggaggcugaggugggaggaucgcuugagcccaggaauucaagauugcagugagcuaugauagccacugcauccuagccugggugacagggcaagacucugucucaaaaacaacagccggguaugguggcucacgccuguaaucccagcacuuugggaggcugaggcggguggaucaucugaggucaggaguucgaggccagccugaccaacauggugaaaccuugucucuaccgaaaauacaaaauuagcugggcgugguggcaggggccuauaaucccaaccacuugggaggcugaggcaggagaauugcuugaacccaggagguggagguugcagugagcugagaccgcaccauugcacuccagccugggcaacaagagcaaaauuucaucucaaaaaacacacaaaaaacaauaacaacaacaacaaaaguaccuauccacguugcaguauagcuguuuauuuccaccuccucugcuauaccaugagcuccuugagaagaagagguauugugucuuauuugcauuuauaccuaggacuuagcucaauguauacuaaauuuuuugcucuuggguuaaugcuuaugucauuuaauguaaaauucaguuuucugaguuguaaacagagaaguaauuuugaaugcccuauguaccucacaaaaauguuauuuuucuuuucuuuuaaaucucacuucugagaauucuuugagcccauaaaauaaaugaaaauauuaaggaagguacuuucuguuggagaaaaaguugugaugauugagcuuuaagucaaaugaugagcaaaaaaaaaagaaaaagauuaaaagaaaaaacuuaugaugugccauugcccauggaacucagaugaugucagugcacauuuauguuguuaagaaaaaucacacuuuugaagauuguaugaaacaaucaaauuguaaucuguacgcuucugccuuuaugccauucuggggcuaagguuuaauaauauuaauagguauaauauuucuggucauuccccaaaacuauucagugggaacacuagcucuccuuuaaauccuuucuaaauagauguggaauuuccaggugguuuugauguggaccuugaaaauucauucccuuagugacaauuuuauuugauucauguauuuggaauaagcaugaacuuuggagccagacaucuggauuaagauauuagcuauacugcuaauacacugacuuaccuuggacagguuucuuaccgugucuuuaaagcagggauaauaauacacaccuuauuggguuagugugcagauauaaggagaugauccauguaaagucccaaguauaaugccaggaaguuaguaggugauuauuaaaaguuagucauuauuuuugugucucucuuauuggugcugauaucagaaguauuauaaaaggauauuacuauaguugauguuacugaaaucuucuacaaugagggugccaacauguguuccugaguccacuuaucgucaucaccauugcugccaaagcaauuguuauggcuuuguuagccuccccauuuaauuuagcaaauacugaacuccuuaaaccaagcuuuaguucuuucuucccuuaagaugaauuuguuaaucuuaacccuaagaucauauggaauuaaaaaagagcccaaauagccaaagcaguccugagugaaaagaauaaaacuggaggcauuacacuaccugacuucaaaauauauuacaaggcuauaguaaccaaaacagcaugguauaaaaacagacccauaggccaacggaacagaacagagaaccuauaaauaaauccauauauuuacagccagcugauuuucagcaaaaggugccaagaacauacacuggggaaaggacacccucuucaguagugauccugggaaaauaugcagaagagugaaacuagaccccugucucucaccacauauaaaaaaucaacccaagauaaauuaaauacuuuaaacguaagaccugaaacuauaaaacugcuggaagaaaacauaggggacaugcuuguggacauuggucuaggcaaagauuuuuugacuuagaccucacacaggcaacaacaaaaaauacauaaaugagacuauauuaagcugaauggcuucugcacagcuaaggagccaacccaucaacagaguaaagagacaacuuccagaaugggagaaaauguuuguaaacuauucauccaagaagggacugauacccagaauauaugaggaauccaaacaacugaacaguaaaaauaaacaaauaaucccacuaaaaagugugcaagugacauaaaaagacauuucucaaaaaaagacauacaaaugacaaacagguaugugaacagugcccagcauugcuaaguguaagggaaaagcaaaucaaaacuacaaugagauaucaucuuaccuuagcuagaauggcgguuagaaagacaaagaauagcagauguuggcaaggauguggagaagagggaacucucauacacuguuggugggaauguaaauugguguaacuauuauggaaagcaguauggagauuucucagaaaacuaaaauagauuaaaaaaaagaaacaaaaaagaaaaaaacaaauuuuaaaaagaagucccagcuacucgggaggcugaggcaggagaauggcgugaaccugggaggcggagcuuacagugggccgagauugcgccacugcacuccagccugggcgacagagccagacuccgucucaaaaaaaaaaaaaauuuuuaaaaagaaacauaaaaauagaaccacuguacaauccaguaguccugcuacuaguauuuaucuaaaggaaaggaagucaauauaccaaagagauacaugcaccuaccauguuuuuuugcaguacuauucaccauagcaaagauacagaaucaacuuaagugucccaucaguggauaauggaaauacggugucuguauacacaauggaauaccauucagccauaaaaaagaaugaaauccugucaugugcagcaacauggauggaacuagaggucauuacaugaaauaagacaggcacagaaagauaaauguuggauguucucucucacaugugagagcuuaaauaaguugaucucauagaggcagagaguagaauuauaaacacuagaggcugggaaguguaugugugguggggggcaauggagagaauuugguuaauggcuacuauauaguuagaaauaauauguuuuaauauccaguagcagaguagggugacuguagugcauuguauauuuuaaaauagcuagaagagaggaauugaaauguucccaacacauggaaaugauaaauacuugaggugauggauaccccagauaauuugacuugaucauuacacauucugugcauguaccaaauaccauauguacccgugagaaugaguuguuauaaaccuguuuguccuauuuagucuuuuugcgcacuucugcuuccucuuacacuuuucuaccaugcuaugaagagcaggaagcccucacuagaagcugccagauguagccacccagucucaaacuuuucagcuugauuaacugugagcuaaauaaauuucuauucauuauauuguauuaccuggucucagguauucaguuacagcaacacgaaacagacuaagacauuuauauuucccuaauuagugaaguugagcauuuuuucauaugucuauuggacauuuguauaucuucuuuugauaaaugucuauucauucuguuacccauuuuuuaaauuggauuauuuguuuucuuuuuauagaguuguuugaguuuccuuacauauuuuagauauguacguaucccuagugagauguaugauuugagacuaucucccaaucuauagguugucucuccacucugaaaaugauuucauugguuguacaaaagcuuuuaauuuugauguaaucccuuuugucuguuuuuugcuuuuguuaccugugcuuuuugggugaaaucuaaaaaaucauugcucagaccaaugucauauaguuauuccccuguuuuggaaauuuuacauuuucaggucuuaugguuaaauuuuuaacccauuuugaguagauuuuuguauauggugagaaauagggguauaguuucauucuucugcauauggguauuuaguuuuuccagcaacauuuauugaagaggguauccuuuugcaguauauguucuuggugccuuuguugaaagucaauuggcucuaaauauggggauuuauuucuggguuuucuauucuguuccauuggucuauguauuuguuuuuuaaagagauggggucuugcuuugucauccagacuguagugcaguccaugaucauagcucacuguacccuugaacuccugacuucaagcaaucuucccuccucagccuccugaauagcugggacuacagauguguaccaccacacccagcuauuuuuauaccaaugucaugcuguuuugguuacuauagcuuuguaauauauuuugaagucagauagugugaugccuccagcauuguucuuuuugcucaguauugcuuugguuauuuggugucuuuugugguuccaugugaauuuuuggauugguuuuucuguuucuaggaagaauaucauuggcauuuugauugggauugcauuuuauuuguagauuacuuugggaaguauggucauuuuaacacuauuaguucuaauccaugagcuugggauaucuuuccauuuguuuauguccucuuuaauuucuuucauugguguuuuguaauuuccaauuuagagaucuuucaacucuaugguuaaauuuauucguaguuauuuuauucuguagcuauucuaaguggaauuacuuuauuuuuuuuccagcuaguucguugcugguauaugcuacugauuuuucuauguugauucaguguccugcaauuuuaaugaauuuauuaguuuuuggauggaguauuuagguuuuucuauauguauggucaugucaucuggaaagagggauaauuugacuaucucuuuucuaauuuggaugcccuuuauuucuuucucuuaccuaauugcucuggauaggacuucuaggacugugcugaauaagagucgugaaggugggcauccuugucuuguuccaguucuuugaggaaaggcuuccagauuuuauucaaucaguauaauuuggcuguggauuugucauauagggccuuaaucauguugcaguguguuacuucugugccuauuauuuugaggguuuuuaucauggggggauauugaauauuaucaaaugcuuuuuuugcaucuguugaggugaucacaugguuuuugcccuucguucuaauaugagguaucacaauuauugauuugugugugucuugcaucccugagauaaaucucacuugaucauggugcauuaucuuuuuugaugugugguuggauucuguuugcuaguauucuguugaggauuuuugcaucuguguugcucauauuggccugaacuuuuuuucucauguccuuguauaguuuuguuaucaggguagugcuggccuuguagaaugaguuagauaaaauuuccuccucuuaaguuguuuggagugguuugagaagaauugguguuaguuccucucuauaagauugauagaauucagcaauaaaaccguccaguccugggcuuuucuuuguugauagaccuuuuauuacugcuuugaucuuguugcuuguuacugguauguucagguuuucucuuucuuccugauucaaucuuguagguuguaugucucuaggaauuuuucaguuuccuugagauuuuccaguuugcuggcauauacuuguucauaauauccucuaauuauucuuuguauuucugugguaucaguuuuaaugccuccuuuuuuuguuucugauuguauuuauuucaguguucuuucuuguuuuuuuuuuuaaucuugguugguguagccagugauuuuuguuugucuuuaaaaaacaauuuuuauuauguugauccuuuuaauuuuucuuacuauauuucauuuaguucuucuaugacuuuauuaucuuuuuguuucuacuaauuuuggguuuaguuuguuauugcuuuucuaguuuuuugagaugcaucauuugguuguuuauuugaaaucuuucuacuuuuugauuuagguguuuacugcuauaaauuucccucuuagcacugcuuuugcuggaucccauauguuaugguaugcuguauuucuguuuucauuuguuuuaauacuuuuuaaauuuauuuuuuauuuuuucccuugauccagugguucuucaggagcauguuguuuaaguuccauguacaguuucuaaaguuccuuuguuacugauuucuaguuuuauuucauugcagucucagaagauaguugauaugauuuugauuuuuaaaaaguuauugagauuuguuuugugucuuaacauauggucuauccuggagaauguuccauaugcugaugagaagaauguauauucugcagccaugggugaaauguuuuguaaaugucuguuaggcccauuugaucaauaguguagauuaagucugauacuuuguuguucaauuucugucuugaugaucuguccacugcugagaguaggguguugaaaucccccauuauuuuuguauuggagucugucucuucuuuuagaucuaauaauauuugcuuuauauuucuguguucucuaauauuaagugcauguauauuuggaauuauauccucuuagcuuaucucuuuaucauuauauaauguaguucuuugucucuuuuuacaguuuuugacuuaaagucuacaaaaggaaaccaaaagcaugacuuaaaauuugcaaauggaaaccgaaagcagucuuaaaguuugauguauguauagcugcucuugcaugcuuuugguuuccauuuguguggaauguauuuuuuuuuuuuuuucggucaauguaugucuuuauuggugacgugaguagggagcauacaguugaauugggucauuuuaaaaaaauggauucagccaguucaugucuuucuggguuuuuuuuuuuuuuuuuuuuuuuugagacagagucucgcucuguugcccaagcuagagugcaguggcacaaucucgacucacugcaacuuccgccucccagguucaagcaguucuucugucucagacucccaaguagcugggacuacagaugcccaccaccaugccuggcuaauuuuuguauuuuuaguagagaugggguuucaccauauuggucaggcuggucucuaacuccugaccucaggugauccacccgccucagccucccaaagugcugggauuacaagcaugagccacugugccuggcucauauauuucaaguuggcaauuuaauuccuuuacauucaggcuauuauuaauagaugaggacuuaacuccugcauuuuguaaauuguuuucuggguguuuuguauauccuuuuuuucuuucuuccacuuuuaucauuuaucacuucaguuuggugguuuucuguagugacaguguucaacuccuuugucauuuucauuuguauaucuguucaacaguuaguuuuguacuuuuagguauguucauuauuuuagauagugccauuuugcuucuggguguaggauuuucuuaagcauuuaauguaaguagggccugucuaguggugaagaguucccucagcuuuugcuugucugggaaaaacucuuacucauuuaugaaggauaacuuugcuagguaugguauccuuggcuggcaguuuuuuuuuucuuuuaguacuuugaauauaucaucucauucucuucuggccugcauguuuucuguggagaaaucugcuguuuguuugauggagauucucuuauaagugucuagacauguuucuuuugcuguucuuagaauuuucuuguugucucugacuugguaguuugaccaugaugugcugcggagaagaccuuuguauuguaucuauuugaggaucucuguauuuccugugucuguaugucuaaaucucuugcuggauuugaaggcugaggugggaggauugcuugagcccaggaguucaaggccgcagugagcuaggauugcaccacucuacucuagcuuggguggcugagggagaccccaccucuaaaaaaguaaaaauuaaaaauaaaauaauaaaaauaaaucuuuugcucaacuugggaaguuuucagcuauuauuucuugaaguauguuuucuaucccuuuguuuuuucucuuugccuucugggacauugaaaauggaauauuuggucauuuuaugaugucuuauaugucauguaggcuuucuucauuuuuuaauucuuuuuuucuuuuuuuaugugucuguuuuuucagaagaucugucuucaaguucagaaauucuucuuggucuagucuauuguugaagcuuuugauuguauuuuuuguuucauuaauuggauucuuaaguuccaggauuucuguuuaguucuuuuuuuuuucuggauaucuauuuauuuccugaauuuccccuucagauccugaauuguuuuccuaauuucuucauauuauuuauuuguguucucuuauaucucucucaguuuaaaaaaaucauuauuuugaauucuuuuucagauauuuuauggauuuccuuuucauugaaauauguuauuggagaauuauuauauuccuuuguacaugucauguuuccuuuuucauguuucuuauguucuuacauugauaucugcacaucugguugaacaguuauuucuuccaauuuuauguauuagcuuuuguagggaaacuuuuuccuguagauguguauauauaguguugcuugaguaagaugcuauggcuuugauucugucugaaugggcauuauggugcagucuguguauaauuuuuuuggcuauaaucaacgucagugguggcuguguuccucaguggcuuagguuuuuguuguuaguggaggcuguggugaggcucugcugagauggagacuccaagcaagcuggcccuuagauaccugugguggugguggcaggcuggaugugcugguccuuggacccccaggcuucuaacaguugugcuggugguggcagguccuggugggccaguucuugggccuucaggugggcuugcucaggugucaugguggcaguggugguucauagacuuuugugaugugugaguggcauuggugaugguaguagcugugucuggucaauccuuauuccuuaagcacugcacaagugggugucugugguggcugggcuagccaguccccgaacuuccaggaggcaucugcaggaacugccagcaggcugggugggccuaugccuaggcucccagacagugcaugucagguaggcuuguacucaguccgccagaagccaugugcaggagccauugguggugugcucccuagucgaucccuagucccccugacaauacaugugcucauuggcagugauggcaguggguaagauggacuuguccucuagccccacugauggugugugcagaugguuacagauggggcagguugauuuucaggcucccggaagaaucauggggguaaugacuuaagcgguggcuggcaggaaguaccuguccucaugcucccugauggagugcacaggcaguggcuguggcaaccugggugugucauuucccaggccucuggauggcgcacuguggugcuggcaaugguggucaugauggcucuguggacaccagcaguggugggcagggaaggccccaggucccugaaugaugugugugggugccgccagcagaaguugugagggggcaggucucuagucaggcuccccaguggugugugcaaggcucuggccauaauggguggguuggauuaauccuuagacguguugacagugcacuugggugccagcagugguauugguggguggggugggccuguuuucaggccccagaauggcucaugcugccugugauguuggugggugggguaggccuauugucaggccucucaaugguaugugcugguacuggugguaguugguaugguggguugauuuuuuuaaucccuggacagcacauucaugugcuaaugguggcagugagcagggcugaccuagucuuaugcucucugauugugcaugugggcaccggcugcauuggguagggcugguugcuucccaggucccugaaccaugcacucaggcccuggugaugguggcaguggccagggaaggcauguacucaguccccuguauggugcacaugggugccagcagcagcaguuguuaggguccauugauucccaggcucccagaugauguacuugggugccaacauugguggcguuggcagggcuugccuauuuuuaggccccuguauggcaugugcuagugccugcaacagguaggagacacuuauucugggggccugggaugucagcugggaaggcugguccccagacccucugaagaugugugcagauguuguagcagcucugccccuggagggagcuggguugcuguuagugccuaggcaggcaccucucagacuuugggagaacaugcuuugacuccuuuuguccugggggcaaccuuccuggagcauugcacuacuuguuuucuggcacgcaggauacugucugggcuagagugcuggggaucuggccacacuacugguuccagccaaccuugcaaugcugcagccuucuagguggauuuggggaauguuagcaggccuucagggauguggaaauagaggggcuguugggccucagggcaugaugucgucuguugguaacuaggcucucaaaaugguacugcguugcagcugcuugagucucaggggaugugugggauccagcaugaucucucccuguugaacagugcaguuauguggacuccaggcagcccccauauuagucucagguccugccagggccaaggggcucuccuuuaccuaggauuacaagagucuucaguggaacauggacuuccggggauuucuugcuuaccuuuucuucacagcaaggagucuguccuggcucugagugcaucuuagccaggacaauugcuucauuucccuuuuucugugccugagagauucccugucaguucucugcugaauuacaguguuauuuuuuaggagcucuauuugauaggugguuaucuaacagcuguuuugguucuuaauuguggaggaggcaagugccagauaccucuagucagccucuugaagccccucauuaauuuuuuuuuuauccauguauucuuguaguucacugacguucuuuaagaggauuauucuguauuuccuaucuguccuuucacagaucuuucuucaagguccuguuguuagcggcuuugcucauuuuauuuuggaggugucuugauauccugauuuuucugguccuuguguccuugucuuguugucugcucauuugaggagagcuaccuuuuuuaguuuuuacaguuuuggcagagauggaccuucuccauuuagucuggcuuauaauucuagaugugucagcugguaaugauccuugguagacagaguuugcuguuggguucucuagaugacugggcugcugccuuugcucugaguuuggguaggucagcugacugggcuuugcuaucgacugagagcacuggaggagcucugcaauucauuugagcucuggaugguagugcaauugucuuagauggagagggucacaagauguauucucuggcugugugauacugcuauuugaguucagcaguuggacgggguugcaggagaggcccuaaguuuagguggaguugcccaucagauggauaggaccaccugcuuugcuaaguaaaaaugcauaguugacguuagacucugccuauguggggccuugguguaggcuuugaagcuggacugagcacuguuuaaucuccuaaauguggcagauuuagccccugccuuuugccaaaaucugcuguaguggucauccuuguccuuggguggggucugagggugggcuuugagguugugggguguguucacuucauuuacuuauguguaauuccucaugagaagacauucaagguauuuuuuuugucuauaugucaaugcuucaguaaguggcacauauauauauacuguauauauacacacacacaugcacacacacacaucuccauauauuuauucuaguaaauccuuucaguuugaaucuguuauacucuaacaagauuagguguuacgauuaaacuuuuuuugauaagccguaggcaaaaauauauaauuguuuucauuaaauugucuucauuucauucgucuuuuauuuuuuguauuaggccauucuugcacugcuauuagugaaauacccaauacuggguaguauguaagaaaugagguuuaauaggcucacaguucuacagacuguacaggaagcauagcagcaucugcuucuggggagaccucaggaagcuuacaaucguggugaugucacaggauccuugugguguugcuucgccagcuggugaccucuuugccugaguuuuacuugggucugcugggcuuguucugcccacuuggccuggcaggcugugcuuggcucccacuacuggcccggauuccauaccugccaacggcgagccaggugcagaguggcgaggggugugugagcgagugagugcugggucuggccacugugcacagccaggcaugucggcuguggugggacgggcagcuccaggugcuggcacgggugcuggcuucccacaagacugcaguuggaccagucguacugcaaguggcuuccacugcuggcacuggggauugagguggugcccagaagcuuggagacaccaggaacugcagagccccaaagagggugucacagcccuggcuaggggaacucuuaggugggcucccuuaagggccacagcucuucuuuccuucugucuucucuucuucuagucacccgcaacguggcaagaguguguagcacccuuuuuagcccuguuuguauuauagcucuuccaguccugccacuuggcaaguccugaauucuuguccuguguucaggaagaauuagguauguggacaacuggagggugaguaagguaaagugguguuuuauugagugacaguacagcucucaggagaccugaaguggauagcuccuauuugcaggcaggugauccugucgaguauacagcucucagcugagaggggacccacaguggguagcuucucucugcaggcagguaguccugauaucugcccaagucuggcugaguccagggguuuuuauggccuuuggaggguaggaagugcacgcuuauugguccauaggcagccauggcucagccuggagaaagcaccauaaguugucacucugguccacggaacugggagccugggccccagacuucaggcugucccaggccugaaggaggggcuucacuggggacacuccccuuucugcccaggaacuggucugccucccacugccaucaaccuccuauccccagugcccaggcaguucaugcugaggggugccugcaggcccacacugagcugcccucagcauccccuucccuccugugcucauuggcccccaaaguccagagggggcugagguggcagggggcuggcguguacccgagcauguguacaccuggccagguugugacagugccucgccuuggccucaacuuugcucuagaauuggagugggcacugagaguggagaggcugggcagugggagcagacacuucugagugugcgggggcaugggggccuuccugggcuccuuagaguacaggaaugcccagguuugcagcuguggcuauguggcugcagcagugcuggggaaggcaggacucccgccccuccaacuuggaaggaggguggggcuucugccuguucccagcucccaccagcucuguggaauuugcagucccggcugugccucccccacugcagccggccucuuugcagcagcugcuccagaugggcugcugcugcugccaucaguggaaagcaaagggggagcaggcacaucacauggugaaagcaggagcaagagaaagaguggggaggcugcuacacacucuuaaccagauguagcaagaacucacucacuuaucaugaagacggcaccaagcccugaaggaucugcucccaugaccuaaacaccucucaccaggccucaccucuagcauggggauauaguucacuaugagauuuggucagggacaauuauccaaacuuaaucauuuuuagugaauauguuuuaaaaaauuucuuauaugaguuucuguuaguauuuguccuuauuagggugcucaucucuuauucauuuuaaaaacucucauuaaagguauugacucuuuguaauauguauuguaaauuguuuuucaaguuugcuauacuacacuuucuuuauaguaucuuugauauagaagacuuuuaguuuauuuugcaaaauauguuaguguuuaauuccuguguuuuggcuuaucccuggcaagaccucuuuaaccccaaauauggagauaagucagccagcuacuguucucauuuguacugcuuuagaugagcuaucaauuccugaacaagucuguagauuacuuuccuaauugaaguucugauucuuuuuuugcccuuccauuauaaauauuuauuaagaacucccuuuuaggucagacugagcagaauguuuuaguauuuuuaaauuuuacuucccauugggauuuuuagaaauacuuuauaacugcuaauguaaagaagucuaauuuaauuuccaaauaauauauaccgaauuguauuagaaaauaggcuuggguguggugacucauaccuguaaucucagugcuuugggaggccaagauaggaggauggcuugaggucaggaguucaagaucagccugggaagcauagcaagacccugucucuacaaaaaacuuuuaaaaaaagaauuagucaggugcaguacugugugccuguaguccuaucuacuaagaaagcugaagcuggaagguugcuugagcccaggaguuagagguuacaaugagcgaugaucaagccacugcacuccagcaugggugacagagugagacccuguaccuaaaaauaaaaaaaagaagaaaaauauuucauaaaauuauguuuuacaaaaguaauaaagguuuuauuguagcuagccacucagcagggauugguaauuagccuugagugaaagggaucaaauugcuauuuuaaauugcaagacucuaauauagacuuccaacagagggagcccaaagcuuuuaaauggaaguggaggagguuucauuuuuauuaauguauuccagcucugucauaguuuccuauauucaugucaguugauuuucuuuuuaagcuuuccuuugguaauuugguaaugacaauaauccacauaaacacuaaagaagauacucuauuuugagaucauuuuccccuguuaacuuaaaauuucucuucuauguuuuaugucauaaauuuucuucugacuagcaauuugaaaaacacugauacaaauagugcauauauccuaaguucaacuccuuuaugcuagaaacauuagucaguuuugaauaaaauuacuaauaaugauacucauuugcacgguuaacucuugaacauuugcauuauaugguuaucacucuuuucaaaauaauauuucauuauuaucuauauguaauuuauguaaacauuuaaacuuuuuccuaauuugaacaauaaugcauauuuauauuaagagauauauagaaaaguaugaaauugauauuacccauaauccauuccucaauaauaagcauugauaauauuuugauaugcuuucaucuaaauauuuuucuggauuaaaugauuauaaucaugaaaaauaguguuauuuuuauucauuucacacuauccucuuuugauauuaaucuuuacuuuaggccuaugagauagauaggagagcaguuaauauuucuauuuuauaaauguggaaacuuuuugagguucaaagagauuaaguggcagagguagaacuauaacacaggucuaauauauaugagaugcauuuaaguuaaaaaacauaauguuaaaauaaacacccaaauguucaccuucuauuaaaaaauagacuauuaucagcaucaccgaagccuucuguguuccccacuuugcccauucugucccauucccaugcauucgccuuagaauuaaccacuuuucugaauuuuaaguuuuauauaauugugaacuuuagaaaaaugauucagguuacugaacaauauguauuacauggcaugcauuuuuuuugccuaacauuuuugugagauucauucauguugaugcauagagcuagagaucauccaguuuuacuuauguauuuauuguauuaauauuaaaaauagaucuaccuacuuuuuauugauggaguuuggauuguauccaguuuuuuuucucucauaaacaaugcuccuuuggacauuuucauuuuauauguguugccaguaaauaguauguaucuggauacuucucuuuuuacauucagucuacauuuauuuuuaacuauaaggcauagucuguuuauauuuuauacuacuauuuuucuuuaugcuuuuuauuuggucugcuugacuuuuuuuccuuucuuguauuuuuuuuuuuuuuagagauaggucuugcuauguugcccaggcuggagugcaguggcuauuuacaggcaugauuauagugcacuacagccuugaacuccuggccucaagucagccuucgaaguagcacacuauaggugugcaccacugugccccacccauucuuguauuuuaaaaauuaguuauguuuuguuuugugugugugugugggggggggggcggugguuugcuuuacguucuagaagauuuagacucuuucuauuuuuaaauaguuuucuauaaauuauaauauacuugauagaccuaucaaaguccaaaguuaauuaguaucuguguucucauuuugaauaauagggacuuuaaucuauuuuaaguacauucacauuauuguacaaccauuaccaccauucauuuucagaacuuuuuucauuuuuaccaaacugaaacucuguaucuaugaaacaggaacuccucauuccucucucccccuaaacccugacagccaccauucuacuuucaguuucuaugauuuauuucaugacccuaaguaccuuaaauaaguggaaucacaguauuuguccuuugcuaacugacuuaucucgcuuagcauagugucuuaaaaguucaucuauguugcagcaugugucagaauguucuuccuuuuuaaggcugacuauauuccauuuuauguaucaacuaaauuuuguucuauucaucuguugauagauagugguguugcuucuacauuuuggcuauuguguguaaugccauuaugaacauggguguucaguguguguuuguaucucuccuuuaaguucuuuuggguauauauccagaaguagaagugcuggaucauauggcaaucuauuuuuagcuuuuugaggaaacaucauacuauuauucauaguggcugcaccauguuacauugccaccagcagugcacaaggguuccaguuacuccauaucucgccaauacuuguuuucguuuuuuugauaauaaccauccuaaugcaugugagguggaaucucauugugauuuugauuuucauuuuccuaaugaauagugauauugaacaucuuuucguguuguuggccauuuauaugucuucuuuagagaaauguuuauucaaguacuuugccugcuuuugaauuggauuuuuuuuguaaguuguaggauuucuuuauauauucuggauacugaucccuuaauagauaugggauuugcaaauauuucgucucauucuguggguugccuuuuuacucugaugaagucuacguaaucuguuucuuuaguugacugugcuuuuguugucauauucagaaauguuaacaaaucuaaugugaagauuuuccccuauguuuucuuccaagaauuuucaaaauagcuuuaugccuuaugcuuaggucucugauccauuuuguguuaauuauuguauaugguguuagguaaggguacagauucauuguuuugcauguggcuauucaguuuuuccagcaucauuuguugaaaaggcugcccuuuccucauugaauggucuugguacccuuguugaaaaucauuugaccauguauuugaggguuuauuucugggaucucuauucuguucuguugguuuaugugucuguuuuuauacuaguaccacacuguuuugauuaccguagcuuuacagaaaguuuugaaaucagagaguauuaauccugcaacuuuguacuuuauuuauuuauugguagguuuuuuuucucugaacacuuaaaagauuucacuccacaguguucuuacuugcaugguuucugagaaaugagauacaauucuugucuuuguuuuucuauaguuaagggcuuauuuuuuucuggauuuuauuaacuguuuuuaaaucuuugauuuuuuugcaguuuaauaugauaugccuagguguuauuuuuugggcauuuauucucuuugguguucucugaacuugccagucugugauuuggugucugacauuaauuuggggaaauucucaugcauuauugcuuugcauuuuuccucuguuucuuuaccucuuucuucuuaugauauucccauuaugccuaugcuacaccuauuguaguugucccacauuucuucaauauucuguuacggguuuuuuuagucuuuuuuucucuuugcuuuccuguguuggaauuuucuauuucuauauacucaaguucagagauucuuuccuuuuccauauccugucuacuagugagcccauccaaggcauuguucauuucuguuacaguguuuugaucuuuaguauuucuuuuucauucuucauuacacuuucucucugcuaacauugcccauaagugcuuauaugcuguauacuuuaucuguugaucauauuuguuuuaaauuccuaaucugauaauucaacaucucugacaugucugguucugguucugauacuuguugucaaacugugguuuuuuuucuuuuagaguggcuuuuaauuuucuuuuuguuuuuuguuuuuuuuuggauaguuggacaugacguacuagauaaaagcaacuacuguaaauagaccuuuaggaauguggugguaagaugugagaggaagaaaagcauucuguaguccuguuagguuucagucuuuuaacccauuuaugcuuaguguucuauuacuggaacgcuaggcauguggaaguuauuuauauccuacugcuaaagguuaucaccaagcugugauugcaaaaauucaaaaaauugcaaccucaggcguuaaugagccuuuguccuuggccuguuaacuuuacaagugcuucucauucucuucugaaugcuuuggugcaacagcauaccuggaauauaaugaaguuagauauuucccuucucccacauggaaagcuagauggucuuggaauuguguauuuuccuugcuuuuccucacacagaaugcuagacggagcuagaguuggguauuuuuuauuuccccugcuugauuaggcucuaaaaaauaacucauaguuuaggcucuggugaaauaguuuuucuugagggcaggccuuguuaagaacagaaugcucugauauauuugaaaauguuuuccuuccucugcugaaccaugaggggauuuuucugauauucacugugagaaccugguugaacuccuggagauaaaacucacaaaagugugcgacccccuuuaugacuaaguccucugggauuuuuaacucuuagacuuauguacacugaacccucagcaauuugucaauugcaguuuaggucuucauacuccaauaguaguuacugggacuguuucugcuuguggguuuuugcuuuaguaaguugcgauucucuguauucaccuggcugucuuucucccauuuugggggcagccauucauccugugacuucacuuuucugucacguccaggaagaguuguugauuuuucaguuuuacccguuaggauagauaacuuccaagcuccuuucauguuggacugggaacuccuguguauugcacuucguuugaugcaguuuuggguuuaauuucucuuuuuuauuuugaugcucuuaguuuaucauuuauuaaaaguuuaccauguaugugguugaauccgaucauauuuuucucuauaauuucuuuacuuccauucucaagaaauucuucuuccacaaggcuaauaaauauaguguuuuucuucugaugguuguuuaaaaaaaaucuuacaacuuuuagucauuagcauaugauaguucauuuuaccuuagaguauuggauguaguucugaauucuuuuuuuucucuguuguuacccaguuaguccacuacaacugaauuugaaagcuuuguuucccagcuuuguuucaaauucuucuguuuuuuuuucuuuuugcauuuuuuuaaauuauacuuuaaguuuuaggguacaugugcacaacgugcagguuuguuacauauguauacaugugccauguuggugugcugcacccauuaacucgucauuuaacauuagguguaucuccuaaugcuaucccuccccgcuccccccaccccacaacaguccccagagugugauauuccccuuccuguguccauguguucucauuguucaauucccaccuaugagugagaacaugcgguguuugguuuuuugcuguuugccagccauuucuuauauacuagucuguaauacuauacuuuacuuguugauguuacucuguauuauguuuuauuaugaaauuaguagaacuaguucuccuauucccuucauuuauuguauauuuuaauaccuuuuuuguauuuuaaagauuguaauagaauaucaguaaccuaaaaauugccauuuuaaccauuuuuaaguguacaguucacugccauuaaguacagucacauauuugugcagccaucaccaccauucuuuuccaggacuuuuuccaucuucccaaacugaaacucuguaucuauuaaacucuaacucccuauuuuucccuucuuccagucccuggcaaucaccauucuacuuucugccuguaugaauuugacuauucuaaauaugucaucauaugaauggaauaucaguauuugucuuuuaguuaguggcuuauuuuuucuuagcauaauguccucaaaguucauccauauuguugugcaaccauuaucacaacuuuuucaucucaagcagaaacuguguuaccauuaaauaauaauuccccauucuccccucuccuaauccccuaguagccucuaaucuacuuucugucucugugaauuugucuauuuuaguuaccucuuuaaguggaaucacacaauauuuguccuuuuguguuuggcugaguuuacuuagcauaauguguucaaaguucauucauguagcacuuaucacaaguucauuccuuuuuauggcccaauaauauuuuauuguaugaauauaccacauuuuguuuuucuuuucauuucuugauggacccuaagguuguuuucaccuuuuggcuauugugaauagugugccacagugaacaguggaguacaagaaucuguucauguaccugcuuucaauuccuuuggguauauaccuaggagugggauugcuugguaacuuugugauuauguguuuagcuucuuuuuuuuuuuuuuuuuuuuuuuuuggagauggaauuucgcucuuguugcccacgcuggagugcaauggcaugaucuuggcucaccgcaaucuccgccucccggguucaagcgauucucaugccucagccucugaguagcugggauuacaggcgugcgccaccacgccuggcuaauuuuuguauuaguaguagagacggaguuucuccauguuggaaaggcuggucuugaacucucgaccucaggugauccgcccgccucagccucccaaagugcugggauuacaggcgugagccacugugcucggccuguguuuagcuucuuauaucgcaguucucuauuuagcuuuuugaggaaccaccaaaccauuccacagugacugcacuguugaacauucccaccaacaauguacagagguuccaauuuuucuacauuuuugccaauguuuaacuuuuuuuaaugaaaaaaaaauuuuuuuuuaaauuacucuguccuaaucugugugaaaugguauauuguuguuugggcuugcauuuccuuagugauuagugacguugaacaucuuuucaugcuaauuggccauuuguaugucuuuggagaaacaucucuucaaauacuuugcccauuuuuuaauuguuauuuauuuuuuguuguugagcuguaggaggucuuuauuauuaucaguauuaauccuuuaauauauaugugggugggagauauuuucucccauucuguggguugucuuuucacuaguguccuuugauaaacaaaaauuuuugauuuuuuuuuuuuuuuuuugagacagagccucauucuauugcccaggcuggagugcaguggcacaauuguagcugccaccuugaacuccugggaucaagugauucuccccucagcuuccugaguagcuaagacuacaggggcauaccaucaugcccagcuaauuauuaaauuuuguguguguguguguguggguggggugaaaccccauaaugaauuauguuccccaggcuguucuugaacuccuggccucaagcaauccucacuccucagccucucgaguagcugggauuacaggcgucaacuaccaugcccagccauaaguuuucaauuuuaaugaacuccaauuuaucuuuguuguugacuguguuuuuguuguuauaucaaagaaaucacugccaaaucuaaugucauaaagauuuccccuaugcauucuucuaagaguuuuauaguuuucugccuuauauuuagguguuugauccacuuugaguuaauuuuuguagaugguguuagauaacuguccaacuucuuccuuuugcauaugacuauccuauguucacagcacccuuuauugaaaagacugucccuucccuauugaaugguuucagcauccuugucaaaaaucuuuugagcauauauuugaaaguuuguuccuggguucuguuuucuauuucuauggucgauaugucucucuuuauucuaguaccacgcuauuuuaauacauuuuuauaauuuuaaaguauauuugcuuggcuauuuaaaaaaauucuuagaauuuuguugcauuggaaaauauuuauuuugagcuuuuauuacauuuacuuguuaacuugaauaaugugaauauuuauauuucuuguucaggaacuuggguguuuccaguccauucauuuccuuuucuuauaagaggauggaagcuaacaguguuugaacauugcuguccuuaucuuuaaacacgugacuuuccaccauguacaguuuagaaccagauugucauauucugcaaaaaacuguuauuuggauugagauuauauuacagauguguuuggcuucacuguugugcauuugaaucauaugacauuaccuuuugaaaauacucauuuuuauuuuugguuucaugccaacuacuuaaugcuuagcguuuagucaagaaaauccucuguuauaaagucuuuuuucuacaaccauauaacuuuuaaugugauuuacaugugaaaucuuauuuuguuuuucaguguucauugugcuagaaaaacaaggacuauuacacuguuugcuucuuauaucaggggaaacauaaguaccuaagcaucuuuuuagaucgucuuuuaggucacauuuuauuuuuguuuauagugccuguagugauaauucuuucagggaggacaaauuuuuuuugacuucucuuuugguuuucauuuucaguaaacaaaacucuaugguauaaauuugcuuagaugcccuuauucuucaagaaugauucuugaggguugaggaguggaaugauuugacucagucagaaccucuuugcaagugaaauuggcucacccuuacgauuuugauuauuuuggccuuuuaauuuccaaucugaaaauaaagaaaauuuuaccaaaguaaauaugaaaaugagcaguguaauagcagcaauaacccuuucuuuaacuaugacacuacacuggugauguuuggauacuguagcuuuuuuuaauuuauaagucauuuuuagccuuccaaauaauucucucaaaacaaggaagcauuacguguaauuggucuuuauaguccuuguuuuugacuuauacuaguugccuuaguuguaaauaauuuauauauuuuaaaauuaugaaauacuucaaauauguacauaaguauagagaauaauaugccaauacauaucacucagauuuaaccaauauaauuccuauuuuuucagauuuaaauuuguuuuuaaagaaguauuauagaaaguugaaaacuuauuuauuuuauauucccugauucuaauacucucccucuuuagaguuaucuacuacccaaauaggcuugaauccuuccagucuaaguuuuuauauuuuguuucauauguaugcacuuauacauuauaguauguuuuauauuucuaaauuuuccuuaguaguaacauugugacuaucauuccaaaauuuguuauuuuaccaguaccuuagacuuuaaauuauuuucucuguagguaaaauuuauuaccacauacuacugaaaauuuguuaccauacuuuugguauaugaaccacgcuugaaauauauuaacauucagcuuuggcuuauaauuguuugccuauacauagguuuaauuauugagguacuuguguccuuggaauuuuacuuuuuaaaccuaauuuaauacuuguauaguauuacucuuuugcucauuuugcauguacacaauccuccaauguugauaucucauuuuuuuucccccuaaacacacauggggaauuuaaagguagaaaagggaggauaacuuauuucuuaaaucugaguucaauauuuuuuuuacuacccagaucuuauagucugccaugugggacuguguuuguaauguguuggauuuuuaaauacaugcuaguuggcuucuaaauucauuugggcuuuauuagaauugaguauaauacaguucucuuuugcaggggcucacaacgaaguaagacaguagaugacaauucugcaaagcagacugcgcacaauaaagaaaaacgaagaaaggaugauggcauuucucuuuuaauaucugauacucagccugaagguuugugaaccuuagaaaacuguuggaauuugaauuuuuucuuauuguauuaauaauaauuuuuguuauaaauaaauuauuuuauuuuacuuugaaaggauaugugaaaguaaagggagauuauuuggcaacacaaauaaaauugcuaaaccuacucuuuauguagcguaguacucauuucuagauuuauuuacuaaucccaaaaguuaaauuuuaauauauuuuuuucuucuuuggggagacuuggauauagcuaugaaguuauguucauuuagcuguuucuaaguguuguuuccauggauauuaauguuacugcuaacuggguuuuuauuauuagcuaaucacugucuauuugccuaccaugaaauacauucucuauucauuagaauuucucucaacuucaggaggaugccaaacaagccacuauuagcaaauuugaagguaaauacuuccuagacuugugaaaauuuuuuguaggccuccuugcauauaggauuuaugauucgacuucuuuuucuuuuuugccucucuuucaagaauuaaaaauauuuuacugauacuugaagaaaaacaauuuuacuacauuauuuauuugugaaacuaacaccuuuaggggucuguuggauuauugauagcuucaaauguuguugaagucucuuuguugcuugcuuucuuucuugcuuuucucuuucucuuuuucuuuuuaagacagggccucacucugucacccaggcugguguacaguggcaugaucacacaugaucacagcccacuucagccucuaucuaccuccugggcucaagugauccucccacaucagccucccgaguaguugagacuauagucaugcaccaccacgccuggcuaauuuuuuguauuuugcagagacaaggucuugccguguugcccaggcuggucucaaacuccugggcuccagugaucugccugccucggcuucccaaaaugcugggauuauaggcaagagccaccgcgcuuggccacuguuuuauuuuugagugauuucauaaguuauucacaauacaaaaaaaucuuuugaugaugcugugcaaaaauucauuacacuucauuuggagcacagcuauuuaaagauucuuuuuaguagccuuuuuaauagaaaaaaauuuaaaaugaaacuacaguaauaacuuuuauuuguacaagaaaccagcugaaacucuuauaaaggcagucuuuggagaaugugcugugacuuuguucagacaagcuuccaauuagucacugucaguguauaaugaaaaacauuuauuuucuuauaaacuguacuuuucuuagaaguaauuacaaucaucucuguguaucuuuguguucugcaucuguagauucaaccuagcaaagauggaaaauauuugaaaaaaacuucaauaaaaauaauacaaucauaaaaaauacauauaacaacuacauaacauuuauguuguauuggguauuauaaguaaucuagagauuauuuaaacuauacaggagaauguauauagguuauaugcaaauacuauaccuuuaggggcuuauggauccauggaguuugguauccugggucccugggaccaauccccugaggauacugagggaugacuguauugauuaccaaguaaaaauguaaguauuuguacaagugggcucaguucagguacuaucaagacaaagauuccuacucuacccaggaaagcaguagaaugugaggacuaacaguccucacauugacuugaauaaaauacuuucugauuuguacccaggaguguuaccucaagaucacaguggcauuuuagacaugcaucagggaagaguacaugacaaaagaaacauuuuuuaguuuuucaguaucccugaagguaccacuacugguagggaaaguguuucuaauacaauuagcuauugaaucuuuauuaaagcaguguuuacucuccuacaucugauaccaguuauuuuuuaaaaaccuguaaauuaauggaaauucugaaugaaaucuuagguguaccauuuuuuuccauagcacauuaaguuugccuuguggaauuugcuuucaccaacauaauaccuuggaaauacuuaguauucuuuuguuuacaggauuuugucaccucuuuaguuuuauaugcuaguaauauuugcagguugaauuauauauuaugcagguggaauucuauuuuuacaauauuucauucuauauaauaaaguuauuccuuuuuccaugagacaggcuugacugauaugcaaauaauaaauuguuuaaaagaaaacuccuguauaaucaaguuuuucucaagccccuuuccuuucaugaaucauuuuacuguaguauaauauuuauguuuagaaauuauaguuugauacauuguguguagaaauuguauuagaccacuuuuauaguuuacaauauuacauauaaaauuuaaugugcuauccuaaauauuguguugaugauuuggggggaguuuuauuuuccuuagggaguaagguguuuucucuggaaauugaaaggcgauugacuaucuuggaauuuuuacccucaauccuguuccagugccuuccuuuaaguaaugucaaagacaaauuaucaugaauauuaguuauuaggaauuguugaagcuacaguaaaagcaagaauaguuugaagagaagauguaugguguugaagaacguuccgugaauggaaaagucaggccagucagaugaauugaaaauugugaauuaaaggcaacugcuuugugacuugcuguguauaaacuuugaguugguacuuguaugacauagauucagaaagcaaaauaauucaggauaacuuuuagucaauuagguggaaacuuuuggaagguauuuuuguacaguacauauauuugauaacaaauauuaaauauuuuuaguaaugauuggcaugaguuucaaaaugaugucuuguugacuuaaaaaaggaaguacuucucuagaaugauggauuuauuggagacuuaaaaugacagggucuugauuauugaaaagaagaaauaaacuggcaaguaaauugguaaccuugugaaugaucacauauuauagccaacuacagagcaaagguauuuugucuccuuuuaaagagcagugaucaacacucuuucaaauuauagucccuuuccacuaaaaauauguauuuauguaaauuacauuuuaaaagacuuaguuuauaaagucacauugaauuaucaaacuuuaagacaugaauuuucuggauuuuaauaagacccccccuuuuuuauuauuauuauuauacuuuaaguccuaggguacgugugcacaacgugcagguuaguuacauauguauacaugugccauguuggugugcugcacccauuaacucaucuuucacauuagguauaucuccuaaugcuaucccuccccccuccccccaccccccacccuacaacaggcccagugugugauguucccuuuccugcguccaaguguucucauuguucaguucccaccuaugagugagaacaugugguguuuaguuuuuuguccuugugauaguuugcugagaaugaugguuuccagcuucauccauaucccuacaaaggacaugaacucauccuuuuuuauggcuguauaguauuccaugguguauaugggccacauuuucuuaauccccuuuuuuuuuugauaguacagccaaaugcauuuauagcaaauggaaaaacaguuugguggcuuugcuuuggcuacuaugaaaaaggauauuucuucuuuauauauuuuucucaccucacaacuauuguauaaugaacauuuacuugguauauaccaauuaaaauagggcaugccuuuaccuucauccagugucaguaugagaauuuaacaguacauuucuguuuuaaugagcuuuggaaguaguauagcaauccugaugauguuacuucgagcuuuucuaaaagagauucucucuauacuuuuuuguccauauuuaugcuucauuuguuuuuuaagaccuuaacaguggaaguagagguugugaucaucucgaacaggaaagcagaaacaaggauguuaaauauucugauucaaaaguggaacucacucugauuuccaggaagacaaagagaaggcuuagaaauaauuuaccugauucucaauauuguacuucuuuggauaagucaacagaacagacaguaaguagagguauuuagauauuauaggaaauaauuucaugcuaugauaaaaacgaguugacuguggccaaauaauguuccucuagcuuucagcuuuuauuaugagauuucuuuaguuuuugguucacuguuagcuuuauuauuaaaaaacaauucuaaauguaacuuuucuuggugauacagaguuauuggaacacauuucaaauacuaugaaugauuaaaaaaguuaaaauugcuuauuuucuuguaucgcucuuuccuuaguagguaguuguacauccuucagacuuuucuuuuucuuuauuucagccaaauacuauucauacugucuagucauuuuuuuuugcuugcucuguaaaauuauuauuagauuuauuuuaucaguagcaauuuacuuaucaaauucuuuaagcuucuguuuaucuagaguuuagggaauuuauucuaaguaaagaauuaucauauuaaauacauacauuuucuauuuucaaagacuuaguauauaaguagcaauaaaacaguaagacagcuuuucaauuucuuugauccauaaaucauuucaggaccuuguaauguuuuuggguuguaauuauaaacaugauucagauuuauauaguaaaugagauauugaaggcagugguugauuuucauaauuuuuaauguuguuauauuguugauuuuuaaauuuuuuuaccaaaguaguuuuaccaaaguagucacauuggcauuauuacuuuugcaaaauaaaaauauguaaauacaucuucucauucuaaaguugacuuagaucaugggagaccgucugacaaagcauuuguaaugauggaaaucucccaauuucacccuuuaaaaaauuaucaggcaucagauuggacagaccaaauccuguaucuuuaaauuugggagacauuggcaaguauaauguaguauaauuguuuaguuuucuauccauguaguuauagaagugauauaauauuuuuacuuuuuuuuaggaauuuaaaaaugguuuaagcaagccaaauuugaaaaaugcuauuuuuuucuauguguuuauguuuagaaaaaacaagaagaugacucaacaauauccacugaguuugaaaagccaagugaaaacuaucaucaggauccaaaacugccugaagaaauuacaacuaaaccuacaaaaagugauuuuacuaaacuauccucacuuaacagucaggaguugacuuugaguaaugccaccaaaagugccucugccgguucaaccacugaaaccguugagaacucuaauuccauugauauuguggggauuucuucccugguugagaaggaugagaaugaguugaauaccauagaaaagccuauucuaagaggacauaaugaagggaaccaaucacugaucucagcugaaccaaguaagugacaggaggauuauaaaguuacuuaauuuccucugcuuuacuuaguuauuuuuuuauucuucuugaacaaauuuggcuaaggccauaagcuguuuaugacaucauuguggaauauauuaacuuuaggaaaaaagggcuugggguuuggggucuccuucaugaguuuuaaaauaucgauuuagguaaacuaauggaggacuugaaaacagaaguaauuuuuuucuuagauuaguaaguacacugucaucucaauaguuuuaaaauagauuauuuaaagaccaucauuacugucauuugguugaugaauuaugcagaguuuaagugcuaucugauuauuaucauuaauuuucauuuaaucagcuucugaguaguugaugccaucacaugguacaaagaaauuccaaagguuuuaaaggaucuccagugaauacucgcccacaucuuccccuaguuauuaauuucccauuccuugaagcaauucauguaacaggacuuaaaaguacaauuuagagugauggcacaauacacuguuagaacuagaauuuguuacuaaggccuccucauggcuuuauccauuuuuaaacaucuuuauucuuuagaagguaaggguacagguaacugcugaauaauugcgcugauauagagucauugucuguaacuacuauaaaucagauaacaacugauaggccuguuucuaaauugaauaaauuuagaugauucaguuuaacaggauuauuaaaaauaaauugcauuaauuagaaaguucuuuuuuuuuuuuuuuuuuuuuuugagacagagucucucucugucggccaggcuagagugcaguggugcgaucuuggcucacugcaaccucccccuccugggcucaaguaaucuccuuaaucagccucccaaguagcugggauuauaggcauguaccaccaugcccggcuaauuuuuguauuuuugcuagagacaggguuucaccauguuggccuggcugaucuugaacuccugaccucagggaaucuacccaccucagccucccaaagugcugggauuacaggagugagccacugcucccggccaaaaguucuuuuuuugauaugugauuguuacacauuuaaaauacauuuuucgucugggugcagugacccacaccuauaaucccagcacuuugggaggccaaggcaggaggaucaccugaggucaggaguuugagaccagccuggcgaacauggugaaacccugucucuacuaaaaauacaaaaauuagcugggcaugguggcgcaugccuguaauuccagcuacucgggaggcugagguaggagaauugccugagcccgggagguggagguugcagugagccgagauggggagacugugucucaaaaaauaaauaaauaaauaaauaaauaaacaaaaauacauuuuucuuuuccguuuuaguuguuguuuccagugaugaagaaggaccuguugaacauaaaaguucagaaauucuuaaguuacaaucuaagcaagaccgugagacaacuaaugaaaaugagaguacuucugaaucagcauuguuagaacuaccauugauuacaugugaaucuguacagguaauuuauuucugucuucucauagauuaacaaugaaauguacacuauugguuaaugacuguuauuuguuuuaucaagcugaauauuguaaugaaaauuacaaauuuucuuaguuugaauuuucagacaacuuuuauaguaguuugagugaaauacguaguugucuuuauuuugaaaugaaaagauuaugccauuuucuucuggugauuuauauuuuucagucugaauagucuauuacuugaauauuuuucuuuuuuuauggcuuucauuggacauuucacuaacauuuuguagaauuaaacacauuuucuaguauuuauaugucuggucuuggaguauuauggcuacuuggaauuacuccuuuuccucacauacuaugaaggcaguaugauauagaggaaagaacauggcuuuggagauauaggucagaaaccuaucaaguuugguaaguccucugccucuucauucuuauagaaaaucauaaauggaaguguguuaguuuaauaucagucgauuaauucaguccuuugaagagaguaggucuaaaauaagguucaaaucauuuauuaucaguauucuuucuuucuuucuuucuuucuuucuuuuugagacaaggucuugcccugucacccaggcuggagugcagugacaugaucauggcucacugcagccucaaccucuugggcucaagcaucccucucauucagccucucagguagcuggcaccauaggcucaugccagcaagccuggcuaauguuuuuaaaauauauacuauuuuuagagaugagggucucucuuuguuguccaggcuggucucuaacuacugggcucaagcaauccuccuaccuccaccucccaaagugcuaggaucacaugcaugagcuaccgcucccagcugguacucuuucuuauuauuagucugugauuauucuauuuguaagaaaagaucauugaccaccagugcagaauuaugguaaacuuaucuuguuuuguuuuugaauaaugucagaggcuguuauuuugcagaguauggugaagaguuggcccgaucuaugaaaacaguuuggucugauuauuguuucauggguauuuucuuuuguauuugguauuccacguagaaaucaccucagcagcuuuguucugaauuuuugcaaaaauguaaccauuuuuaccagauggggucaauauccuacuugaugguuuaguuguauauauaauuaaaagugucauuauugauaaugaauuuaaacuuguagaagaauuaggucuuggcaggguauaaauugacaauguaguaugaaaugaucauauuauaagaaaauaacauaucuuguggaauuuacuacauucauaaucacaaccaagcagccaauacuguggagaucuacaaagacauauaaggcagaaugccacaucucuaugcucucucuuguuccaguuuuaaaugaauuaugagaaauauggauuggucauuuuuaggagccagcuaguuuuuacaaaaugugaaacccaaugagaaauuauuucuauaccaacuucucauuuuaucacuaaaaaagcccacaguuauuugucugacugauguuggagcuaccugauuugauuugauugauugauucccuuuuuuacuuagggaauaagaagauauuaauaguauacuaagcaauaaaacaugagaaugacaaagaaauucaauuaagcagguaaauggcguuaugagcuggguuuaaaauaaugaguaugauauauguuuuagauaaggauuagucacauuugcgagagguaagaggggagugaguacauaugcauaauaacugcuuuaguaguaaucuguuugguaaugugugauguuacggauaaugugcagagguuaggcacauuugaaaaaguugaaaaagucaucugaaaguaguguaaauuucagaagaaacagugggaaagaguugcugcugauauugccugguuuucuauuauaauuuaaaagcaaaguuauauagucacuugaguggaagugauaugauuuuugagguuuuaggcaaguauaagccauuucugguugguugucuucaaacauagaguauacaauaaagcauauaaauuugagauaacagaugguucuuagguacuuacauuccuucacggcauauuaaaagugcaguagcacacaggcauaaagaugggaacaauagacauuggaaacuccaaaaguagggggaggguugaggagagccagggccauaaaacuuccuguuggguauuaucugggugacagguucaauagaagcccaacccucagcaucacgcaauauuauccuuguaacaaaucugcacauaugcccccugaaucuaaaauaaaaaaauuuuaaagugcaguagcaagaacauuauuuugguuaauggaaacaauuuuaugugguugaagugacacuggaccuggagagagaaacgugcauuugaaucuuuguuuugcuucuuacuaaucgcaugauuuuaggcaggucgcuuaaccaaucuaaacaucuguuaacuuuauuuaugaaaugggaaacugaaaaaccugccuauagggugguuguggggauuaaaagagauaauauauuuaaaaaccuauuuuaaacaaaaguacaauauauguuuaaaacuuucuucugucaaguuaaaaaugaauaaaaccuauuagagacuauugaaugugaaaccauggcuuugauacagaggaguauauauuucuggagcuuaggcuguggaauuaauuuuggauucagcuauuuaguguaauuuucucaaagguaagucauauauuuuuucagaaaaaaaaucuagauagcuauuucuucacaguaagaacaguauaaaguucuucaaaaauucacuaauaguaauuuaaagaagaauuugauggugaaagucauuuucagcauuuauauaguacuuaagaauuauaugcauuuuaugauuuauuccuuguuagaugucaucugaauuaugcccauauaauccugucauggagaacauuuccaguauuaugccuaguaaugagauggaucuacaacuggauuuuauauuuacuucuguuuauauugguaaaauaaaaggagcuucuaaagguuguguuacaguaaguauauuuucuuuaauuuucuuuuaguuuggaucuuggacaaggcauuuuaauuuuuuuccuuuuuuuucuuagcacaaauaagaauagaauuaagauuuauuuuauaugggacacuuuggauauguugaaagucauuauaccuaauuugaaaugugucuuucauucuccccuccuaaaauccuaccuaaucugacuacucuaaugaaaaucaugugugaaaaaaaaucacauguauugauaaucuuuggguucuaaaaguuauuugaugguaaaguaaaauuuuuuucaagguauaguuuggagcauaaagaagaaaucuuguuuuaccaguuuaaacgguuguaaacugacuucuccaaauuucuaaauuaaggauauccaggaacuaauccuacgcuguuuuucuaauuaaaaaagaaaauacuccuccucacccacuguauaugaaagugagacuggauucuacucgguucucuauuuuuuuuuuuugggggggcggacagagucucacuguuucacccaggcuggagugcaggggcgcacuccacugaucuuggcucacugcaacuucugccuucuguauucaagcgauucuugugccucagccucccgaguagcugggacuacaggugcguggcaccacaccuggcuaauuuuuguauuuuuugguagagauggagcuucaccauguucgccaagccggucuugaacucuuggccucaagugauccaccugccucagccucccaaagugcucggauuacaggugugagccacugugcccagccaguucucuauauuuucuuaccauuuugaccuuuuaaaauccuaaucaucuuuuaaagcuucucugauauacugacucuuccaggaaacuuucccuaaucccuccuuuuuagacggaauuaacuucucccuuugcuauacacuuauaacacuucauuugacuucuaagauuuauucuguguguuuuauaauuaccuauauucuuauauaaacuucuccauuaaccuuuuaagcugcuuauggugaagagccacaguuuuaguuccuuuuauagcuuccauaaauguuuccacucuaagcaggcacuuaaauguuuguugaagugacugugucagauuuaguaacucaggcauuuuuuauagcaguuucauucauauuucacuguguuagggauaaggcagagaauauaaaaaugcuaagauaugguuucugcuuucagggagcuuuuaaucuaauggaagagacagacacauaaauauuuacuuuacauuaugguaaaauauaaaacagaaauauguacaagaagggugcauauggcaauggauaucuaucaaugucuggaggaaucaggaaaggcuucacagagaagacagcacaugaauaagacaugaaguaccuguuguuuacuugguacccaugcagacaaagaccuaaucccaaauucugggaacugcaaauaauaguaguuugugauacagucaccauugcuucgaaagcucaagaaugaauuaaaauuaacauuuuuuuggccacugguuuuaacugauuuuggcaugucuggggugauuuuacaauucuuuuucuuuaaggaauuuuauucauuuuucaggauuuucuccccuauuuuacuuuauuauuuuaaauucagguuuacccaguuauuucuguugaguucuuuuugauggcaaaaaguuggauaaccuaaauauaugagagugaugauuagccgggggaaggaaaauccaauauaaauauuaaacaaugggauuucuauuaauuaauauauuaauuauauuauuacacagucagguggacauguuaugcucaaaaaccaagaucaagcaaaaaaccacaaacaaauuaguaaaggaacaauauuacaaacacauauaaucuugccuauuuagagacaacugccauucacuguauaguauauaucguugcauauucuucauacauauauagauacauuaaaacaaagggauauuacauaauauguacuauuuuguaacuuaccauaauuucauuaauuuaauuccucuacuuauuuugggauauuuggguugucuuuaaaaauuuuuaauuguuggucauuucaaauugucccaauauuuuacuauuacaaacaguagggaacugcaaauauucaguaagcauuguaaagugguccuaaaaauuaauugucagaaguccuggccagggccaucaggcaagagaaagaaagaaaguacauucaaauuggaggagaggaagucaaacuaucccuguuugcagaugauaugauucuaugucuggauucuauauauauauuuauauauauuauauauaaauuuucuagauauaggaucucagcccaaaagcucuuucagcugauaaacaacuucagcaaaguuuuaggacacaaaaucaguguacaaaaaucacuagcauuaauggcuuuuccauauucuuuauauguggacaauuuuucucaaggguaauagcuuuccugugaaauaagguguaagcacagauuaaaaguuuugccacauucuuuauacuuguaggaguuuugccaguaugaauuaucuuaccuacaaucaaguguggcaaccauauaaaggcuuugucacguuuuauacauuucuaggguuucacacuaguauaacuuuuuuuuuuaauguauugcaaaguuggagguguuuguacaaguacugucacaucuuucagguuuguagaguuccuuuucagcaugaauuaucguuugucucuuaagaauugagaacuuaugacuaggcaugguggcucaugccuguaaucccagcacuuuaggagacugaggcaaguggaucaucugaggucaggaguuugagacuagcacggccaacaaggugaaacccccucucuacuaaaaacacaaaaauuagccaggcauaguggugggcaccugcaaucccagcuacuugggaggccgaggcaggagaauggcuugaacccaggaggcggagguugcagugaggugaaaucaugccauugcccuccaaccugggugauaagagcaaaacucugucucaaaaaaagaagaaaaaaaaagaauugagaauuuguuguaggcuuugccacguucuuuacacuuguagaguuucuguccaguaugaauuauguguaauaaggguugagaacuuccuuaaaaagcuuugucacauucuuuauauuuguaggguuuauguuccauauaaauucucauauuuacuaagaguugagggcugguuaaagguuuucccacauucaucacauuuauaggguuucucuccaguauaaauuaucuuaugcuuauuaaggguugaggaacauuuaaaagauuugccacauuauugacucuguagguuuccugugcaauaugaauuauuuuauguuuauuaagggcugaggaccaguuaaaagcuuugccacauucuucacauuuguaagguuucucucuaguaugaguucucuuauguuuagugaggcuugacuaaaccaggugaagguuuugccacauugaucacauuuguaggguauaucuccaguaugaauuaucuuauguuuaguaggguuugaggaacaguuaaaauuuugccacauucuucacauuuguagaguuucuaugaauuaucucauguuuaauaaggguugaggaugaaaugaaggcuuugccacauuuaacacacuuguaugguuucucuccaauaagaauuuucuuaugugaaaaaaggggugaggggugguuaaaagcuuugccacguucucuacaucuguaggguuucucuccagugugaauuaucuuauguguaguaagguuagaggcagcuuaaaggcuuugccagauucuucacaucuguagcguuucucuccaguaugaacuuucuuauguguaguaaggguugaggacugguuaaaagcuuugccucauucuuuacauuuaaaaguuuuuuuuccaguaugucuuaugucuguuugacuuugaaaauuuaugagagacuuucacauauuuaucacauugaaauauuuuucucuggguaguugucaaacauugguuaaguccauuauaaccgcuuuugugcaccuuacacucauccacacuuuuacagcuuuuuuuaaacuguaaauugucauguccacauuuuucauaucuucucaguaucacuuuuuggaaagaaucuuuuaugcucugcucuggccaaagaucuugggcaaaaugagaacauauaacugggggucuggcaaucaucuuaugucucuucguagucaaagguuuuuucccuuguuccagacaggucaucaggucuggcuuagagacaacaauaccaaggaagaacagguuucuguaguucucuaacaucacauccuuauauaaauuccacugugcaguguccaggcaaugccacuccucgcgguggcucacgccuguaaucucagcacuuugggaggcugagguagguggaucaccugaggucaggagugcgagaccagccugaccaacauggugaaaccuugucucuacugagaaugcaaaaauugacugggcaugguggggcaugccuguugucccaccuacuugggaggcugaggcaggagaauugcuugaacccaggaggcggagguugcagugagccgagauugcgccauugcacuccagccugggugacacagcgaaacucugucucaaaaaaaaaaagaauguucauaguuaauaaaagcauuaaaagugcaauuacugucaaaaauucuuucagaaaauauaagccuuuaaagugaagaagaguauuuauucugaagacaaccguuacaaauauaaaggggguuguaguaccuuuacuuguaucacagaucuuauugcacacauuuuguacuagaggaaaacccucaagcaauugcucaagcuuuuuucagcaucagggaauuuauauuggagaagaguccugcaaauguaaugaauuuggaaacacuuuuuuuuuucaaaaauuacugcuuagaaaacaccagaguuuauaugaaaauauauuuuugccgaugcaguaaauaugaaaaaauauuuaauucaaaauugauucuauguaaauaucaaagaauuuacaguagaauaagguacugacacuucagacauuacacgaaaucagaguguugaguauaaaaacuaaucuacaacuaaaguuguuaaauuauuuguauauaacuuuaaagggaguagauuuuuugaaguauuguaauuacauugaaaauguacuuguuuccuugaaaaaauuuuuuugaaaagugaauaaugauguaauacagcuuucaaauuacuuuaugcuguuauuuuauuccuauuguauucacaugggaaagcauaugaucaauuguugcugcaucagagauauuagaaauucuuuuuuauuaguugggcauuauuuaugaccuuuucuauaaaugaauaaggagauuaaaaugugagaugcaugaugaaaauguaaguggagaggcucuuuguaguuaacuuacauuaaguaacguauaagguagguguucagaguaauacuuuucaacauuauagugagaggaaggaaugauuaauuauaguuaaaaguauauucaaauaaauuacuauauuauuuuacuaauuguacuuuuauguaauaaaaugcaguacauuaaaaaaaaaucacuagcacucauauacaccaacagcaacaaagccaagagccaaaucaggaaugcaaucccacucacaauugccacaaaaugaauaaaauaccuaugaauacagcuaaccagggaggugaaagaucucuacaaugaaaacugcaaaacacugcuccaagaaaucaguaugacacaaacaaauggaaaaacauuccauguucauggauaggaagaaucaauagaauuaaaauggccaucuugcgcaaagcaguuuauagauucagugcuauuccuaucaaauuaucaaugauauucacagaaauaugaaaaaguauuuuaaaauucauauggagccaaaaaaaagaggccugauugccaaggcaauccuaagcaaaaggaacaaagcuggaggcaucauguuacccagcuucaaacugugcuauagagcuauaguaaccaaaacaguaugguacugguacaaaaacagacacauaggucaaugaaacagaauauagagccuggaaauaaagcugcacaccuaugaccaucugaucuuugacaaagcagacaaaaacaagcaauggggaaagcacucacuauucaauaaacggugcuaagauaacuggcuagccauaugcagaagacugaagcuggaccccuuccuuauaccauacacaaaaaucaacucaagauggauuagagacuuaaaugugaaacccaaaacuauaaaaacccuggaagacaaccuaggcaguaucauucugaauauaggcacaggcaaagauuucaugacgaggaugucaaaaucacaacaaaaacaaaaauugacaaauggaucuaguuaaacuaaagaacuucugcacagcaaaagaaacuaucagcagaguaaacagacaaccuacagaaugggaggaaauauuugcaaaguaggcaucugacaaaggucuaauaucuagcaucuauaaggaacuuaaauuuacaggaaaaaaacaacccuaugaaaaaguggacaagggacaugagcagacacuuuuccaaagacauacauguggccaagaagcauaugguaaaaaagcucaauaucacugaucauuagagaaauccaaaucaaaaccacagugagauaccaucucauaccagucagaauggcuauuguuaaaaggucaacaacaugcugacgagguugcagaaaaaagggacacacuuguugggggaugcaaauuaguucaaucauuguggaaaguaauguggcgaucccucaaagagcuaaaaacagaauuaccauucaacccagcaaucccauuacugguauuauacccagacaaauauaagucauucuaccauaaagacauauacaugugaauugcagcacuauucauaauaggaaacauauggaaucaaccuaagugcccaacaaugacagauuggauaaagaacauguagugggaguacuaugcagcuaggaaaagaauaagaucaugucuuuugcgggaauguggauagagcuggaggcuauuauccuuagcaaacuaacauaggaacagauaaccaaauaccgcauauucucaguuauaagugggagcuaaaugaugaaaacucauggacacaaagaagggaguaacagacucuggagccuacuugaaggugggaggagggagaagagcagaaaaaauaacuaucgaguacuaggcuuaauaccuggguuucaaaacaaucuguacaacaaaccccugugacacagguuuacauguauagcagaccuguacauguaccccugaaccuaaaauaaaagguaacaaauuuuauuuauguuugcuggaacauuucauauaauuagauuaaaaacuuaaauguuuaauuauaggaaagugauuuagcaauucaaaguaaauauaugcaugugaacaaaggcugagaagaauccuacaaaaauuaggacaguuaugauggagagaauauaagcaauuaaaaaaaauuuuaaguauaaugaauaaccuaaaaaagggaaaaggguaaaaauuucagguuuuucagguuuuuagguauauucuuuuucagacaguucaggaugcacuguaacagaaauuaaagaacuuuuuuuucuuuuuugguggguaaagauauuagagaauuaaauuaauuuauucuccauauauucagugacuaccuacuauguguuaagcauuauuguagacacuggagauacuguucugacucucacaguaguuacaauuuagcugaauuagaaaaauacuuauagcuggaaauuauuacauaaauuagagccauguuccuauaguuagacacugguuauuuuuuuaguguagcaaaugcugcaauaaauguaaacauugucuuucuuaaaagucuuuguugauaguacgagaaauuaaguaauacuauauucagauaacuauuagcuauuguaagaaauuauaaaauagcucuuauuauuagcuuuauucuuaaguuuaaacaaaguugguaugauuucagagaacuagguuuaccuuacugccacaaaauuuuucuuauuuuuaaaucuagggguuaagucugcugggaguaggguuuuaacucuggagagguaaccuauuggcuuagucauuauucagagggauaaaugaauaucagauccuugccaaguagaaacauuugauagcucccgagcauuugaugggggaaagugagagaauaguguaguaaguaguggguggggacaugcagaugcacuacuucuacuuuauaauuuggaaguuauggcugugcaaauucugaaaggcaaacaccgcuucuguuuauuuuuuaguacuaaugauuuacguuugccaagauauauuuuauaggauuaaagacccugugaaacaugccagaaagaguuuggaaaggggcaguauacauuaaauaugguggcaguuauaugaaaguaacaauaauuagauauuugauuaaauuauguaacauucuugaucagaugcuagugucuaaugauaacaacuuccuugauuaaggaucuuacuaaagcuggaaaaaguucaauaaguuaccuaaguuuaccuacuuacuacuuguguaagugguagagacaguagaggcaggauuuuaacuccaagcucagcuuuuaguuaauuaugaucuauugccucacauuugguuuucauggcucacuuacucuauggaauauaggguuuuauauuugugaaaguacaagaugaaauaauuuuuaaauuggaaaauaaguggagucaaaauaaaccugugguuucacugaacauuguuugauacuuaaauggagcucacauaccaagaacauuuugauuucguuuugugcucacagaccauacccgauuugaucaacaaaauguauugaacaacaacaacaaaacuuaaccaaguaauaaauaaauagguacaaauucauuugauauuaauggaaacacaaacuucaaagcagaagucugcuuuagauaguacauguaagauuuagcuaggugcuccacaacccuauuauaaaagcagcucuuaaggaagucagauauauacaaaagguaccuagagaaaauaaguguccugggacagaaggagcagaaagagcaagaaccucaguuggaagggaauuuauaacaugaaacaaagaaagaugaaugcuaggaaugaagacgguggugcccaccuaaaagucauccagggaagagguuguucuggcuuagggacuuaauuuauauuaccauuuugacaggugcaucacugcugugaaugaaguugaaucuaugacuuuuguagccauuucacauuaaacaacugaauuuuuuaguucugcuuuuaugugguaaaagcaaauuuuaaaauuauaauugguaguuuuuguacagaaacagaauauucacaucagguuggacacaagccuucugacaauuuuaauuucucauuauaaaauaguauguuggcauuuugguuuguuuagcaguuucuugugaguuugguuagugugaguucaucaccaagggaaucaucgucagcugcugagucagcaaagccaaaaaugaaacucuguuuuauggacuauuuauauuuaccagagucacugcuacuuagaggucucuuggcaguuucuucugggcuuugucuuagucuuuacauuuucagaaaacauuuuugaaaaauauauuuauuagucuuacugguuuuuguaaaugagcauauugagaauuaaauuacuuacaugggguucuuaaaauuuccauaaaacuaagucuuuguagugaaauauuuuauugguuuauugauaaaaaggcuugagcacuuauaauguagacuuugaauauguacuugugauuugaaaaaaaaaauuugaauaguaacacauuuugagugguaacucauuguuugcuuuuuaauuuuuucuucagaucacaaaaaaauauauuaagaucccauuucaagguaaguuaucauucucuuaugaacuugucuuuuuacuauaguuuuuaguauaaauuuaaguaaaacuaaguuuaauaauguuucaccuuaauauuuuuuagcaauuccaaauggaguaaaaauguuuuauaauggacuuguucugaaaaucguaugcuauuguuuuaaugacuauaaaucaaacaguguuaaaggauucauggugauuucuuaggauuaacagaaacacaguucugauagauagcaacaauauuuugguauauauaaaaauggauaacaauaguaacuauaagaaaagaagcauaaggaaaauguuuaauauugcacacaaacauguaaaauguuuuugcauagaggguaagagaauguuauacaauugcauaucuuaguaagggaaaguagacuggaaaauguaccuguaacuuauagagacucacaccauuuucucauucucuucccaacugaaaaccuuucagaauaaauuaugacacuaagaaaaccaauauacaauagaggauaaucuauuuauauaaugaauucuaaaaagaacaaggaagaaaaacacacaaauggcauagauaggaauuagagaagaagaggcuucuguuccaagauuggagaugcuaucaaaguagcuuuaguuggauuaguuggauuuaguuggauuccacagauacuuuauguacagaauccaaaacuauguuaugauaauuguucuaauaauuugauugcuuacuguaucuuaauuaaguauuaagaauauaaagggcacagaauaaguauauugauaguccuaaauaggaaauauuaauaaauuauuaaggaauaauauuuguucuguagaagaaacaaaaaaagucaugugauuuuaaaaggggaugauaauuucagaaaagauagcacuacaguuuauaguuaaagaccuggguaacagagcugccucucaaauucuugcgauacaaacaucaaaaacgauauuuuagauuuucacaguuaauauuuauaauauugcuuucuuauuuuauaacuuuucuauugcauauaauuuuuaaaagaaauuuuauuacagauuguggaaaaauacucucuucagugauaauagguuuauaauuuuauaaugaaagaagaaaauauuagucuucuuccucaaguccuguccaaguucccauaaaucuuuuuaaaacaaagcaugcauauaaagguuuuuguaggugggaaccugagggucuaaauguuuccacuuuuucugugcagcuggggaaaaauugauuuauccguauuuauauuagguauuaauuauguuuggcuguuaguaacaaugcauaaagaaaauauuuuauuuuucuuucacauagaagaaauccagaaguaaucugaacugaugugauguuuccuuggucaucgggggcacaugacccugacacaugaguugcauuuuucuauucugucauuccugacguaugacuugcauccucaaguuuaucucauggccauuauuguagcucagacuccaucaucauauugauauuuuagacagaaagcaguaggaaggggaaaccguaaacagagcacaugcuaccaaucucuugcccuuuuaaggagccuucuuggauguccaugcgacauaaccuuuucugcuuacauuuuauuagcuagcuagucaagcccacacacccguuuguaaaggaagcuaggaaauagaguuuucaaaacuguguaucuugcuucccucaguaaaauuaggguucuguuacugaggaagaagaagaaauggauaaguggguaggcaacucccacuuuuaguaucugcuauacaccuguaacagaauaaaccauauauugggggcagacuugguaaugagguauaaauuuuucucaugaugguguuaaauucccuuuuuuuaaaaagauaaucuuuuuuuaaauuauuauuauuauacuuuaaguuuuaggguacaugugcacaacgugcaggucuguuacauauguauacaugugccauguugguaugcugcacccauuaacucgucauuuagcauuagguauaucuccuaaugcuaucccuccccggaaaccaucauucucagcaaacuauugcaaggacaaaaaaccaaacaccacauguucucacucauaggugggaauugaacaaugagaacacauggacacaggaaaaagauaaucuuuuaaaguugucuuccuaaagaaaauuuagcuuucauucuaaacaccaagaacaauuagauuaguaguaguuguguagauuucacagaaauaggaucaaauguaccuauggggcugugagcuucaugagaaagaaaugcugaguagcauucugagggcucucauucugguuuugauuuaagcuuugcugccaguuuuuacugacaguuuucagaauggaagaguuacaguaugaagaauagaaugacuggcuugggaacauuaagaugacugguaaauacucaucauggaaagauuuucauauuuuaauguucaugugaaucacgggguuggagugggcuauuaaacugagaucugcugguucaguagauguaagguggggccugauacucugcauuucuaacagucuuccagauguugcugauacuaaugucacaagcucagcuuagacuauacuuugaguaacaaaguucuaggaaauaaugcugggaggaauacuaagagguguguuucaaauaggugcccaucuuggguuuacgcuugacugauauuuguauuccaguucaguugcuugcugucuugcaguugaacuaagugaccuucaggacuucuuuaaaucaguuuuuuuuuuuuuaauguuucuuugaauuaaagaguaaaaguccucagaggagauuccuuuagcucccuaagagggagaaagaccaauaauuuagaaugaucaucuagaaguuuugagaaauaaaaccuggaggaauuuuaaaagaaaugucuccuuagaccauucagaaccuccuaauuuucuugagacucuuuugauaguggcuuaucuguauagcggaaugcaaaugccuuaggagaagaaagaugggcaggaauuggccuaugauagcacuugugaucuugguuuauauaguauugaccaauauagaaaagguggaaauauaucauuuucugaguuauacugugcuuaguuuucugcacugauagacauuuuuuuccuuuuugcuaacgauuaucagaauuccuggagagaauucucuccagacagaguuuuuaugcuaugaauauuuaaucucaaauuuucccucucugguuauaacugaaaucauauaaugugagagauucaaucucuauuuaauugucauuuaauaauuauuuagcccuuccuaauuguaaugugauuuauuuuuacucuaauaauacugcugggggcauuuuagcuaagguuagcaaagugcacuggaaauauauuuuugaaaaaacuauauaauucucuuuuuuuuaaaaaaaguaguguauuaacaagugucauauaauguuuaagugguguauucuuaaauggauuaauuuuuuaaauuguugucuuuuauuuguuucagugucccugaaugagauuucauugcuaguggauaccacacauuuaaagcgguuuggguuauggaaaaguaaggaugauaaucacaguaaaaggagucaugcuauucuuuucuucugggucucuucagauuaucuucaagagauucagacccaauuagaacacucuguauuaagccagcaaugugaguauaaaaugauuucuaaauuucaggauaacuugaaauugucauaaauaguuuuuuccuaaaauaauuuaauagaauguuauuucagugaauugaaauuaauuuuauuuagugaaaauaauuuuguuucuuuuuuuuuuuuuuuuugagauggagucucgcuuugucacccaggcuggagugcaguggcacuaucucugcucaccgcaagcucugccucccggguucacgccauucuccugccucagccuccugaguagcugggacuacaggugcccgccaccgugcccggcuaauuuuuuguauuuuuaguagagacgggguuucaucguguuagccaggauggucucgaucuccugaccuugugauccgcccgccucagccucccaaagugcugggauuacaggcgugagccacugcgccuggcccuaauuuuguuucuuaauuuuaggauagauuauuuaauucacauaauuucuccuuauaguuguauucaaccaauugaaauucucaucuaaaauaaaaagaauagcuuaaaaaaucuuaaauguuuaccuugaaaauuuuaaguucuuaaaaaaagaaugccuuaucuuuuagucauuugccauguuugacuacuuuccuuccuuuuuuucuuuuuguuugagacagaaucuuacucuguugccugggcuacaguacaguggcauguucauagcuucccacaaccucaaacuccugggcucaugugauccucccaccucagccucccaaguagcugggacuacaggggugcagcaccauaccuggcaauuucuauccuucuuucuucuuucuuccuuuuuucuuccuucuuccauuuucuuccuccuccuuccuccucuuucuuccuccuuccucccuccuuccuccuccuccuuuccuccucccuccuccuccuuuuuuuaaacagauugaaaucuuuuauuaaauuuuuuuuuuauuuccauggguuuuugggaaaccggugguauuugauuacauaaguucuuuagugguaauuugugagauauuagugcacccauaacccgagcaguauacacugaacccaauuuauagucuuuuaucccucacccccuuccuacccuuucccccugagcccccaaagucuauuguaucauuuuuaugccuuugcauccucauagcuuagcucccacuuauaacugagaacaugggcugauugguuuuccauuccugaguuacuucacuuagaauaauagucucuaauccuauccagguugcugugaaugccauuaauucauuccuuuuuauggcugaguaguauuccaucauauauauguaccacaguuucuuuauccacucauugauugaugggcauuugggcugcuuccacauuuuuggaauugugaauugugcugcuauaaacgugugugcaaguaucuuuuuuguauauugacuuccuuuccucuggguagauacccaguagugggauugcuggaucaaaugguaguucuacuuuuaguucuuuaaggaaucuccacacucuuccauaguggguguacuaguuuacauucccaccagcaguguagaaguguucccuuuucacuguauccacaccaacuucuauuauuuuuucauucuuugauaaugaccauucuugugggaguaaggugguaucgcauugugguuuucauuucucugauuauuagugauguugagcauuuuuucauguuuauuggucauuuguguaucuucuuuugagaauugucuauucauguccuuagcccacuuuuugauggguuuguuuuuuucuugcuaauuaauguuugaguuccuuguagauucugaauauuaguccuuuguuggaugcauagauugugaacauuuuuuucccacucuguggguugucuauuuacucugcugacuguucuuuuugccaugcaaaagcucuuuaguuuaauuaagucccaccuauuuauuguuguuuugguugcauucgcuuuuggguucuuggucaugaaaucuuugccuaagccaaugucuagaaggguuuuuccaauguuaucuucuagaauuuuuauaguuccaugucauagauuuaagucuuugauccauuuugaguugauuuuuguauaaggugagagaugaggcuccaguuucauucuccuacauguggcuugccauuuacccagcaccauuuguugaauaagguguccuuuccccacuuuguuuguguuugcuuuguuggacaauccaaaucuguaaaggggaagucaaacugucacuguuucaggauacaaaauuaauguacacaaaucaguagcucugcuauacaccaacagcgaccaaauugagaaucaaaucaagaacucaaccccuuuuacaacagcugcaaaaaauaaaaauaaaauacuuaggaauauagcuagccaaggaggaauauagcuagccaaggaggaauauagcuaaccucuacaaggaaaacuacaaaacacugcugaaagaaaucauagacaacacaaacaaauggaaacacaucccaugcucauggauggguagaaucaauauugugcaaaugaccauacugccaaaagcaaucuacaaauucaaugcaauucccaucaaaauaccaccaucauacuucauagaacuagaaaaaacaauccuaaaauucauauggaaccaaaaaagagcucacauagccaaagcaagacuaagcaaaaagaacaaaucuggagucaucauauuaccugauuucaaacuauaaggccauagucaccaaaacaguaugguacugguauaaaaauaggcaaauagaccaaugaaacagaauagagaacccagaauaagcccaaauucuuucuucuccuuuuuuuuuuuuuuuuuuuuuuuuuugcuuucuuuuuuucuagagaugggcucucgauauguuccucaggcuggucucaagcaccuggcuucaagcuauccuccugccuuggccucccaaaguuuuaguguuacaagugugagccaccaugccuggccaacuaccuuucuuaugaguuucuugcccuuggucaugacaaacucugacagaauuugcagcaaaguuaaauaaaauauagaagucuuugccuucagucuuuaguuucuaaaaagugaaauucaguuuacuuauauauuauuccuuuaagauucgguugaauacuuucccauaugcaccuauaacacuuaucuauauaauauacaucuugagauauuuuucagcuuuguuuagucuccagcuccugaaggaguuggguuuagaacuacaucaaucaaauuuaguaagguucuuucuuaccuguuugaucccucuaccuuuuuccuacucuccugcacaguaaagauguuaaguagugaacuaaauuuuauaacuuucaaauuuguuauuuuccuguccuaauuacuucuacuaggaaaauucaugauuaaauagcagagaagguggggaaaauagaaacagccauuuauaagcauucugugggaagagaaugucuucagaucaccauugaaaugacugaggagaaaauguaggagguguuuaauuggaauauguuucuaguugauagaguugauucauaaaggaggcuagagaaaaauaauuauuaauuauucauucauacauucauuaacaaauguuuauuacuaaaugucaggcacugcagauauagcaaucaguacuauuaugacauuuuagugcaguagaacaggaguccaccaauugugaguuuugguucuggauuacuaauggccuacuuuugggauauuaauuugccuugguuauuaccuaaaauacaaaauacuugggguuauauuccaaccuuacuauuauuaauaauuaaauuacuuguauuauaauccucuugaaaaauaauacuauugauacaaauuauuuuuuccuuuuguagcaaaaucuagugaauucauuuuccuugaacuacacaauccuguuucacaaagagaagaauugaagcugaaagauauuaugacggaaauaaguauaaucaguggagaauuagagcuuucuuacccguugucuuggguucaggcauuuccuuuguuucagaaccucucuucaaaagaaaguucuuuuauucauuauuacuguguuucaacuuguucuuucccugcugguguugcuguugcugaagaaaugaagcugaaaucaguaucucagguuagcauaucauuaauauaauuggcagagaagggggagguucagaaaacauuuauucauugauauuaggcugcuuucaaaugcuacauuuugugaaaagggcauaggaaccaacccaaaagaacucccguugccaaugcuggaacaauuuguuaaacaaaaucaauaaugacagcaugggauuauaaccaaauaaaaaauaaauauuagucuauauuuauauaaauagauaacugaguaaaugaaugaauaaauaauacaugguggauaagggacaauuauaucuuagaaaaaaauccaauuaauaaaugaaaaggaauaagagaaauacaaaaccacaaguagaacacuauguuuaugaguauugcaaaguccaccaacagaugcuaaauuuaaugaguaaaaauuuaaguagaaacaaaauauaugcauaaucucaaagucucuagcauaaaauauguauuauuuacaaaaagaaaagugguaacuuugcaguggagaaaccuuguagacaucacuuuaaccaaguuaucaaaaugaacaucaccaguaauaagacauguugacauaacacaccccuucguaucaugcacugagaaguaccacaucacuucugugguguucuuuccaguaauauguaaucucaauauaauuaugagaaaaaugagacaaguccuguuacaaaauaauugaccaguacucuuuagaaguaucaagguuggccggacgcaguggcuuacaccuguaaucccagcacuuugggaggccgaggcagguggaucacgagaggucaagacauugagaccaucuuggccaacauggugaaauccugucucuacuaaaaauacaaaaauuagcugggugugguggcgcauuccuguaaucccaguuacucaggcggcugaggcaggagaaucgcuugaacccgggagguggagauugcagugaucgagauugugccacugcacuccagccuggcuacagagugagacugucuaaaaaaaaaaaaagguacuaaggucaugaaaaacaaggaaagacuaaggaauuguaggauccuguaacagaaaaaggauauuaauggaaaagugaaaucaaaaugaagucuguagcuuaguuaauacuauuaggccaauguuaauuuuuuaguuuuggucauuguauuaugguuguguaugauaagauuaggggaauuugggcaagguugauuucuuucaacucuuuuguaagucuaaaauuaucuugaaaacaauaguaaguuuuaaaaugcuauguuuauuuuuauaggagguugguaauauacauguagcuuguauaucucugccaaauaguucuagaaagaaaagaauuuauuaagaagcuauggcauacucauauauacaccugugcacaugcaugcacauacacggguuuggccagaggcuaaucuuuuauucaaaaggccuauagaaagccacauuaguguuagauaaaguauaagacuucaucucuaucuuucuuuauguauaauguugucaauauuuugcauccuaauuauauuguuuauauauuuuccauuuaguggaauuacauuauuauaaauguagccucuuaauuuuaaauuuuauuuccuccuauuuauuacauuuuuugauuauuuugaacugcaaaauuguuauauucuucuuuaauucuguaguccauaucugcaaauaguacuucaaguuaaucuuugaccauuguuuauacaauaucuuuucaucaccaguauuauuuugguuugguuauaucuauggaaaaucuaaaaguauagauauaauucauagggauuuuuaaagucacauuuucucucacacgucuacguuuugacuuuguucuuuugaaaguuaugauguuugagacccuuuuucuugccacuuucugucagcccucaaacacagaugcggccaagccuacuuacaccuuccugcagaagcaaaguagcgguugcuacucccuuucuauuacaucuaauccagaugaagaauggcgagaagucaggcacacuggacuuguucagaaguauguacugucauagcauguuuguaguagaugggcauauuaguaguuuuuauucauguugcugcuuuucaguaguuuaacuuuugaaauguuuuaaguuuuacuuucaugcugauaguaauggaaauagguuuuuuuaaagaaauuaugaggaaguuaaaaaauuuauuaagaaaacaauaggugccauuuuacuuuuaugucaguaagacauaaauggcagacaaagugucauauuugguaagauuaaaguguuuauuaaaaacauuugaguagcaauguaugauuuuaaaaauucuacauuccuuaucugaacauaugauagggaaaaugaaauugcuuacugaaauaugcuucaauuuaagguacuuuggaguuuguuacaaguucucuuucagaaauugcuucuuuguucauauuucauccaugucuucucauggugcuaaggaagaauauggagucugugcauuuaauggugauuucuguaccuccaugugauucuauuucuuuguuuugaaaaaagacacuugaaagacuaggauaggaaaauagccaauaagguagaaacuaucauauuagcacuuuaaauuuacaguuuucuuuuuugauuuaggugccaugauacuaagauuaaaucaauguggaugacucuuaccauacugaaccuuucuggcgcaagaaguacauauuauaccuucauuacugacuacauuuuucauugaguacugcucuaccuauuccaagauuauagcccggaauucacaacuggucuuauuucuaagcuuuaagagagaaugccagcaggaggaugacuaauuaguugucaucucuucucuacuacuuucugguugugauuaaauuauaugucuccuuuguggucucuuaaguuuuauguggcaggcacuuuuuauggggagacuugccuccuaagcucccauguuauuucuuuuuuguccagcugcugguauagauuagccaccaggagcagagcacaauuuuugacugcuggcuuuucugaaaggaagggaacuagucuugaggauucaaacuuagaaagcggagaaaggaaaagcuauauuuuauuacaucaguuuauucaaaguuaaaaauuaugaagaagagcaacaucuucaaugguauaacugauugugagauaaaaccuauugauuagagacuaauucagauaguagccuauuaagacuagcccacaugggaaguauuggaaaagaaaagauaauacucaaucggaguaccauuaguagcuugugaggauaaaggaaggaaaauaucauuauuuaugccuggucaaauguuuuuuacccuacagauuugaguuacagaauaccacugcccaguuauuguuucauauaagaaaucucuuagauaauaggauuuucaauaucaguauauguuaacuuuauuuuuacuuuuaagguugauuguauauccuccaccaccuacuaaggggggauuaggaguaacuaaugaagaucuggaguguuuagaagaaggagaguuucuuaaugauguaaucauugauuuuuaccuuaaguaaguacaaugauaaaugauccuacauauuuuacagauuuuacugagaaacuuaaaauaaaugucuuuaucucugaauuauuuuaaauucuguuaaaaguagccugccaagauuucagauuuggaaaauuuuugcuuaccaagguuuucuagaauugacuuauucaguuucauugcuuuacuuacuguggaugcuauauaguuaagaagaguugcugcuuuuuugcuuuuuuagcuuuuguuaguuuuugauguaaauuucuuuaacuauuguauuaugguggugaaagaaguuacuuacaaauuacaaaucauuuugggaacuaaaaaacagcagcucuauugagauaucuguuguaucuuuuuuuuuuuguuugagauggagucucacucuugucacccaggcuggaguccaguggcacaaucucggcucacugcaaccucugccuccuggguucaagcuauuuuccugccucagccuccugaguagcugggauuacaggcgcccgccaccacgcccggcuaauuuuuguacuuuuaguagagaugggguuucauguuggccaggcuggucuugaacuccugaccucaggugaucugcccuccuuggccucccuaagaguuaacuaucauuuuaagaauccauaucacuuaauuucucccccaacuuuuuguauagccagagcugcaggaauugguaugaaaacauuuaaaacuuuaugcaaaggaaauuugcuucuagccgucauuuuguacuguaucucuagaccuagauucccaacaguugauggagauaucuccuaauuauuuuacacaucucucccaaaccaaauuuauuauaaucuuaccuaagcucuauuguuuuacuaauaauacuaguaaucuuuaucccaguaacucaggucaaagucucacauuauauuuacagacacuguagauuuaaucucuaggaauuaaaugugggucuuuuuuauaucuuccauguuucuuuuugaacauauggaauacaguuauaauuguuuuaauauuauuuucugcuaauucuaacaacucugucaguucuggguucaauugacugauuuuucucuucauuaugagucauuucuuugcacuuuugcaugucugguaauuuuuugauugggugcuggauauuuuuguauuuauaaauaugcuugaauuuuguuuugggacacaguaaaauuauuuggaaaauguuugaugccuuuaagauuuguuagaugaggccaauaacuuaaucuuacuacugaggaaagaccuuuuugaguauucuacccaaugucucaggaauuacgaaguuuccaauuuggcugauaggaacaggcaccauucuuggucucugugagcacuugguaucauucucucugaucuuuuuggguaguucuuucccuaucccuggguacuuuccucacauacauucgguguuuaauacucuccugaauacuugaagaggacuuugcagcugucuggaguucucuguauagcucuuuccuuuccaguauucugaucugcaaacucuagcuacuccauuuuuaaaaaacaaucacacauuuucaagccugcauaaacuauaaagaauagcagaguuuucuaaucaugaagggguuaauuacuaagugauuggauuauaagcuuauauggaaggauuguuuuaguacagaaauggacuaagaauuuagagaugaaucauaucacacaguuauuaacauuuuucuagauuuguuuagcagugucacaauuucacuuuuauauuugaguauaugauuauuugauuaauauuuucuacccucacuccucuggauuauaggcucuacaggggcagguacuuuauuuuuccccucuuguuuugugucucuaguguaaacaugguguuuggcacauguuaggaauuuuuaaaaguuuuuuaauuuuuuuuuuuuuuuuugagacagagucucgcugugucacccaggcuacagugcagugaugugaucucagcucacuacaaccucugccucucggguucaagugauucuccugccucagcccucugaguagcugggaccacaggugcacaccaccacacccagcuaauuuuuguauuuuuaguagagacgggguuucaccauguuggucagaauggucucgaucucuugaccucgugaucugcccgccucggccucccaaagugcuuggauuacaggcgugagccaccgugccuggccacauguuaggaauuugauaaauauuuguuaaguaaaugaaugaauaaguggguaauuucugcuuuacaugauggaaggcuagguaacuaaccaaacugaaagcugaaaucagaggaaacugcaagauugcuuugaaucaaaauagauaaaaaauaaagauuuccagaacacauaagacaacugggggacgaccaaguaaaaucuaaaaauaauuuacuuuugugggguuacuacuuuacagguaucuuauauuggagaaggcaucagaugaacuuguugaacgaagucacauuuuuaguagcuuuuucuauaaaugcuugacaagaaaggaaaauaauuuaacagaagauaauccaaaucuuucguaaguuaauccucuaauguacuuaaguuuuaagagaaaauguacuauuuuugaugcuccuaguaaaguggcuucuuuauaguauuuccucaaguaggcaguacuaccauuuguucagguccugggucuguuugccaugagagccauuucucauccuuccacuguuuugcugcccaugacagggaggcugacacuugcagucugcauuuccaauugcaugucccugggggaaauccuggaaguuggagggcaaggaagaaagaagcuagguuauuucuucccuacucucuuugcauugggaaaugauucugacaguggcuguauuuccucugugaguccaccucucacaggacagaccugcuauaacuccagcuuucaucuggagguacugcuuccucucuuugcccucuacccuacagguauagcaguuuccuccucugcuaaucuuugcugucucacuguccccguuuuuggcuuuguguuuuuuuguuuuucuuuuuuugucaaugcuauagccaauuuccugcauugaauucuaucuguuauauagggcuguuuuuguuuuccugguuggauccccaaugacagacuauuuaauuaaaccuaugcuacauuauacgaaauacccuauuuguuugcacaauuuagcugauuuuugcccaaguauuuuuuugguuaauacuaaaacuguggagcaguggcuagggauaggcaaaaaggagguauuucuuagacaguagaaacuuggauaguuguugcaacaugaggcauuucuccccuuuccccauacuuaacaauuuguaugauaaucuaucugaguagacucaugauaaagcugaguuauuguuauuuuaaaaguuaguguaaacauuucucuacugcuuuacaauuuacaacuccauuuauugacauuauuucaguuuuuccuaucaugacaguaccuuuugauagggcauauaaacuguaucccaauuuuucauaugaggaagcagucuaaugaagauuaauaaauuuuacuuaagaugaacagcuagugaguggcagaacuaguugguacuuaaaucuuuaccuuuuaacuucuaguccaaaguuuuuauuguacuagauugcuuuaaaaaauggcuaugagaguuuguuucaucucguuaaaauaacaggaguaauaaacaagaguuagaagaggauuaauggauaaacugcuugaauuugauauauuguuggagaaagaggguaggaauagggacacuaauuaauauuuauugagugccugcuaggaacuaagacggugaacauaaaguuauuugauucuacaguauuauugucauugucuuuaugaauugaagcuuaaggaaguuauaugaguuuuucaaaguuggauauagcuuuccaguuucaaaguucaacucuuucuguuguucauaguguugugauuauauaauuaauggucuaaauugggaugcuugugagaauaauaggaggcugucuuaguggguacacuagacaacgagugcguauaccagggcuuuucuagacaaacugggauguaugauuaacuccauuuugagugucuuuacagguuuggaauuuguccugauggacaagaccugcgaggaucaguuaaggagaaaacugcaauuugaaaauauuucugauaaucagggcuaggagagggauauauggaagggggagauuuauuaaauaaauuagguaacauuucugaugcccuccuguucuguuuuauguauacagaauuuaaugauugguaccaugcacuuaaucucauguuuuauuucaagauuauucaaaguagagauugugaauuuuguauacucaccuucaaacuaaggaaaugaaaguagauagauucugcuguauuaguaagcuuuucaaaaaacagauauuguguaccugauuauuauauacauaauaaaaauaaaguuacgugaguggcauccucuaggguaagaugcauaagauacuacacacacacacacauguacacaugcacaugaaugugugaauacuaaugcuuggucuguuaagcauucacacaauuugauauaucagaucaagcauuaguguuuacacaaagaaucccuacaaaucaguuuuuaaaagucaucagagcagcaagagauaugaauuuuaauggccaauaaauccacaucaaaaggcucuaacuacuaguguugagaagcuacagauuccuuaucaugcuuuaugagauccugaaagaucugguuucuuuccaucuccuuaaacucaucucauaauauuguuuccucucauuuaccauacuuaaguucaaccuaccucauuuccauuuucaaauaugcugaccgcuuuccuauuuucugccugaaacaacuuauccuggcauuuaaaaaauuuguuucacagcgugaucuguaaucauuuuauucguuuguuuacgucuucauuuucuguuucucauuugaagcuacaugaaguuagggacuuuaucugucuuauuuuccacucuauccucaguaccuugcucggugcuuggaacauauuaggaacucaaaauaugagaugauaacagugccuauuauugauuacugagagaacuguuagacauuuaguugaagauuuucuacacaggaacugagaauaggagauuauguuuggcccucauauucucuccuauccuccuugccucauucuaugucuaauauauucucaaucaaauaagguuagcauaaucaggaaaucgaccaaauaccaauauaaaaccagaugucuauccuuaagauuuucaaauagaaaacaaauuaacagacuauacacuaguugaaaguaauuguuuauacugauuauaaugguuggguccuuuugaaaugagaaaauucaauaaacgugacuuugauuuuuuuaugugguuaaucuuccacauagugucuaauugcugucaaaucuuuuagcucauucuggauccuauguuacuccugauguuuacccauagaguuuuggcuagauauuauucaaaugaacaagauggggcaaugauuucaguuuccuauaugacuugauaaaaauuauauaagaauguaaugguuugccuuuuuuuuuuccugcaauaagaguuccauccaagggacugagccagaagucacauaccaccuuuaucccccuguuaaaugucauuuucuuccuuccuaaaaccuuucuuuugacagucaaacuugguuuuauauccuucucuuuuaacuccccugauuagguaaagaaaagaaacuaguauuuguguguaugcaagccaacccuguucaagguggcugucucagaugguuuaauaaggggguccccaaccccugggcuucagacugguaccagucuguggccuguuaggagccaggccacucagcaggaggugagcagcagugagcgagcauuacugccuaagcucugccuccuaucagaucaguggcagcguuagauacucacaggagcgcgaacccuguugugaacagugcgugcaagggaucuagguugcgugcuccuuaugagaaucuaacuaaugccugacggucugaggaggaacaguuucaucuugaaaccauccccccuaaccuugucccuggaaaaauugucuuccacaaaaccagucccuggugccaaaaagguuggggacugcugcauuaccauaauuccuuuguaccucuuaugacacauuuuaguuauuuguuauaguuuuuucugcccauauuagauuaugaauacuucuagggcaguguaggugacuuucauuauuuguuuuuaggaaccuaauaaauauuuguugaagaaauaaaaggaaagauggaugagugguagguacauuuaacaucauccuguaguuuccuuguguaugaaaggaagggagaugaauuuuauuuuaaagaaucugagaauaaaagccucauuuuuccuccuccauuaagauuuuuaauuaaauuaaguuaacugauuaauuuauuuuuuagagauagggucuucccuuguuacugaggccagagugcaguggugugaucacagccucaaacuccugagauuaagcaaucccccaaguagcugggacugauuauuggugugugucaccacccuggcuaauuuucuuuauauuuuuagugacaggagucucgcuauguugcccaggcuaguguugaacuccugaucucaagugauccuccuaccuuagcauccuaaguagcuggaaucacaggcaugagccaccacacucagcccauugaguuuuaaaaccucccuaaugacagauauaacaguuggagaauucuguuaagguuuaaugacaguauuuuauaucaugcccagauggagcuaagcaaaauaaguagauuuaacuguguuuauacuaaguugcacagccaguuuuggaaucugaaaagcauuuaauaaauugcugccuuuauucuguccauuucauuauuguuuauaguuauuaaauuuaagaauaaccagggguuacuauaaggagauauauuuauaauguguuaaauaugauauaucuuaaagaagaugguuaaacuaaauuuaagauauuucaauauauaaaaauggcucuugaagucccuaucuuaaaugaaaaaauuuuuauauaucaaaucugucuuucauacucucagaauggcacagagaagacauaaaagaguaagaacauggacucgucacauaaacauuuuuaauaaagauuacaucuuuguaccuguaaaugagucguaaguauuucagauuauuuaagaacauauuggaaagaauucagaaaaaaauuuuguaguguuuuuagauucauaaucaguaaaaauuauggccacauacaucucagguauuauuuuaauuuuuuuaaauaaaaguagcuaaggcaaugaauuccuuaucuuggauuuugguuugacaaugguuauguuguaaaaguagugaaaaaaaaauaaagugacaaaugaccacaagacuauaaugacugagacauugaauguuuuuuuguuuggauuuaagaaaaaauuuucuaaauaaaaaaauaaaaauauuuuugagugaaucuucaaauacuuaagaaaacaaacucuucaagcaccaauacaaaaaaaauaaugcuaugagucuauuuauuaaggcagauccuuaauaggaaacaccgauuguaugaaaguaaauaaauuugaacuacucagcuguuacccuaaauaguguuacuuaugccuugguaacucuggauauuuaguguugauauguaugcucuauauuauaaugagauguuacaguggaugucuucaaaauuaauaugaaauuuauucucacuuucucagauguaucucuagaauauauuauauguuguuuagacuuugcaugguauuaagauuguaguucuuuuucaacaggucucacugguaucucgcagucauuuguuuuccaugguuagaagaagcuguguaugaagauuuuccacaaacuguaucccagcagucccaggcucagcagucccaaaaugacaacaaaacaauaggugacauccauaacguagaugguguuuuuaauaaugaugacaauaauuuaaugguuacagggaagaaaaugaaguuaacgguaguauaguuauuuacuaucauuaaaccuacuuuaacaggaugaauaaaaaaucugaaauuuuuaaugauagacaaaauauaauucugaaguuguacuguuauaucaaguuuuauuauggcacuuaaaauuacuacuuauugaucuuaugaaauauuucaaacauacaaaaaaguauaacuaauaugaccaacaucaauaccuguuucaccuggauuaagaaauuaaaacuuuucugauauaauaauaaucuccucugugaccacucccauuucucuuucuuuaauccagaaguaaccacuacccuaaauuuuauguuuauuccauguauuauuauuauuuccauugacauuuuuugcuuguuuuaacuuaaaaaaauugacagauaaaauugcauguauuuacuauguacaacauacuuuuuuuuuuuuuuuaagagacguugucuugguguagugcaguggcucaguuauagcucauugcaaccucgaacuccugggcucaaguaauccuccugccuuacccuccugauuagucaggacuacaggggugcaccaccuuaccuggcuuauuuuuaaauuuuuuuuuguaaagauaggaucucacuauguugcccaggugggucuggaacuccuggccucaagcaguccucacaccgcaggcuccuaaaguauugggauuauaggcaugagccaccacaccuggcuacaacaugauauuuugaaauacauauacauuguagaaugacaaaaucuagcuaauuaauaguauuauaccauuuuaaaaaauacacuagguuugcuaacaugacuaggaauuuaugccuuugauuuccagacaaugcuugaaaucccccauuuuuacuuaaucuaauuuccuguagacuccauuaauuuggcuagguaauauaggaucucuuauaauucuuccacgaguuuucuuacaagccaaaaucuaaaguaaauaagccuacuuucuuugagaaaaaaguaacaaaauuaaauguuuuauagcuguagccuaagcaguaagcugauugaaaaauagccauuagcauuaauacuggccaaaacccauguggggaaaaagaaaaacugaugaagcaacugauuauguuuaauuaucuugaaaccucaaauguguacuuacacaaaacuauauggucauaguuagaagcaccauuauuaggcagauuaacuaccuucugcauuaaauagcagacauuuugauuaaugagcuauuuuugaagauuaucuuuuuauagagaauuugccuagcuaacugguauuuccaaucauggcucugggguuuaccuguuauuugauaacagccaaccauugucaguuuuaucuguugauugaauuuuauucauaacauuaaucaugaaaaaaauuaaaucucaaguauuuuuacugugcauccaguaacugcauaaaaauuauaauuuuaagcuuuucuaaguuaccuguauaaaaacaugcaauaaacacucauaacugcuuaauuauuucuaacuagauaaugaucuacguacuacuucgacacugucuuugagugcagaggauucccaaguaaguguguucuuuacagaugggaaggaaggaaaacucaugaauauaauaauguuaucuguaaaauagagcauagcuaggugggcuaugcuggcccaucauuagauugugcugcuuugugauucuuugacaguuuuuguggggcuggggaagagaacgagauuaguuauuauucuuauaucuguuuagcuugcuuuaacuuuuagguuauuuaguaguuuaucugauguucaucuugguuaacuacuuuucuaauuucuaaggaucagauucacuuuuauuuaugucaguaacuuuuugaacuuagguaauuaaucaucuuaagcacauuauauauucuacuuuauuuucuuucuuucuuccuuuuuuuuuuuuuucuuugugauggggucuugcugacacccaggcuggagugcaaugguacaaucucagcucagugcaaccucccccuccuggauucaagcgauucuccugccucagccucucaaguagcugggauuacaggugcccaccaccaugccuggcuaauuuuuguauuuuuuuuuuuuuuuuuuuuuuaguagagaugggguuuugccauguuggcuagacuugucuugaacuccucaccucaggugaucugccugccugggccucccaaagugcugagauuagaggcgugagccaccgagcccggccagaaaauuauugguaaaaaucauucaagguagacugaaagugaauccauguaacuccuuaggcuaaaauaguuaucauuaacucuuccuuauuuggagcuccaaacagaucugcauagccuagauucaguguucuaaauuaagauugccacuuaaugauuuuuuuuuuuuauauguacaaauagcagcagacucccuggcacaggccuaugucuuuacugucacugauacgaacugucacuucuuacggaggaaggcuuccuuuccugcugucacggcggcaaaauaggagcauuccuucuugccuguagggccagauuucucaaauugaguuucuuagaauauucauucuaagacucaguucgugauaagcaggauuccaaggucaauuaaguugggcaaacuuuguauacucuuucugucuuagagagccaguguuuauguuagaauaauaaaggcacugagaaggucugcauuaaauaaaugugcuuaaguuugaucuguaguuucucaaacuuaugaagaaaacaaacaacaucaacaaaacaaaauucccuaucccuuuucccuuaauauagauuaagguucugcaucuuaggcuucaaagggaagaaaugugucucuacugacaucauaaauuggagaauguauguaaagacacguuaaauuaacuuguuuaucuuugcuuaagauaauaacuuggaauggaaguaauuaaaguuccagauugcuuuuuaggaaaaguuaaaacuccuuaacugcuugagacugcauguaaaaguauauagccuacuguuuuagcaguauaauaaauuuguggaaaaugaaguuagcucacuuuugaugaugaagauaacuauuacuugaaauuuuaacuucaaaguuugaaacacuuuaaaggaguaacugaauaguaaauuauucaaaauagcuuuaauugcagucauaaaaauuuauguuauuucagaguaccgagucgaauaugucaguaccaaagaaaauguguaaaagguagguacaugcuguaauaauaauacaguuuuuugagguauuuagauauacuuuguauacaaguauguaaaucuugauuuuguccuuugcuuuucauaggccauguauucuuauacuagacuccuugaaagcugcuucuguacaaaacacaguucagaauuuacgagaguaaguaaugacaauuuuaccauuccagucuguuaucuaaaaccucaguaauuuugaaguuaccuucagaauuauugaaaagacuauaucaggaauuauauuuuauuaucuauuucaacaauccuauaaauuuaaucaauaauaaauaucuucuauucuguuaauauucaaguauuaauauuucuaaaggauuauauuaaagguaaauucagaauuuguauucauaauugaacagaaaguauaguuuuacaaagaagcauugcauugauuaucaaaaguaccacuuuagaaaaaaauaagaacucuuucacauuuguauaauuauguauauguauguauguguaauuuuguaauuuacuguaguacuuggaaaaaacuaaugaugaaacuuuuaaaaugauuucuuaguuuacuuuguugaguuaugaaaguugaguuguugaaaaaagucuagcuuuuacuuugaaaaucacauuacauauuuucuuuaaaguaguacuugugagccuuauaaaauguagguugcacugcuaaaauucaguguggaaauuuggcuugagacagcacaucuggcaacaaauguuuuuccgccuuucugaaaauguugcauacugauaaauagauuucuacuuuagucacucuuauuuguugauuauuucagguauuuagagguagagugggaaguuaaacuaaaaacucaucgucaauucagcaaaacaaacaugguggaucuaugcccuaaaguuccuaaacaggacaauagcagugauuguggaguauauuuauugcaguauguggaaagcuucuucaagguaugugaagcuauaaauaaguuuuuaauucacaguuaccaccauacggucacaaguuacuggguguaauaguccguucucaugcugcuaauaaagacauacccaagacuggguaauuuauaaaggaaagagguuuaauugacucacaguucagcauggcuggggaggucucaggaaacuuacgaucaugguggaaggggaagcaaacauauccuuuuuuacaugauagcagcaaggagaagaaugagagcugagcgaagggggaagccccuuauaaaaccaucagaucucaugagaaguuacuaucaggagaauagcaugggggaaaaccgcccccaugauucaguuaccuccuaccaggucccucccaccacaguggggauuauaggaacuacaauucaagaugagauuugggucggggcacagcaaaacuauaucacugggcaagcaaagaggcaggcacauguuacagguaaucaagauuuuuuuuaaagagaaagaaauagaaccacaggugauccagauacuguaauuggcagauaagaacuuuaaaaugauuugauuaauagguuagagaagauaaagccaaagaugaaacaaaacggaugaagacauggaguauacaaaaaaaaaaucaaauagacguucuagagcugaagauguauaaugacauaucugaaauuaggaacuuauuggacaaguuuaauagaggacuagauacaguagaagauaggauuagugaacuccagcuauagcccagagagaaaaaagaauguaaagaagagaacagagcuuaagagacaaauauaaaacaguauaauuuacuguuugaaagguauaauuuacauguuacuggagucccagcaagauuggagagaaagagaauagggcagagacaguauuuuaaauaaaauuuucuaaaaugaaaagaucuguuuauucaagaagcucagaaaacuauagcuggagaaguacaaugacaaacauagguguuauuuucuagcucacagagacuuuguaggaacuguagcaguauuaaagaugaaauuuuaaauagcaaggaaucacucuuugcuuuuugaacugucaucucauuacuucagucauugccacuauuauuuacaaagaugggucuaguagcagaauguuuuugaccagaagucggcuuggagaaugcuuaacgguacuuugaaagcaugagaguuauaguaugcagcuacaacuuuuugaugucuuuaauaugagagaggaaggauaauauauaguaaaauacaguacacauuuuggaaaucauuaaauaucuauuauguuggguuuuuucucccuuuuuuauuccacacuagaacuucaucauagggugucagguucugccccucucauacccuuuccagauggauuugauuuugugaauauacuaaaaaugcuuaauuguaugcuauuggugaauuguauuaugugaauuauaucuuaauauaauuguuauuuuaaaaaaguuagcaauuugucauuucuuauaaaaaugaaauuaaaacaaauuugaaauuaugcugcuaaagugauuacacucuuuuuuuccucucauuaggauccuauuguuaacuuugaacuuccaauucauuuggagaagugguuuccucgucauguaauaaagaccaaacgggaagauauucgagagcucaucuugaaacuucauuuacagcaacagaagggcagcaguagcuaguuaaucuguacaaacaugacacagauguucucuaagauuacuggaaagccucuuaccagcauuuguguuagccagcucacagagaagaaaauaacuugcaguaguuuuauaauaagucauuggaacauuauuuaaaauauguaggacacauuauuagaauuguugggaucucauagauggaaugggaaugggggugauauagauaaacuuacuagauauaaauuaaaauuuuauaaauauuucauauuuuucugaguaaauaugauuggauuaugcaacagcauauguaauaugggaauguuuuguagauaauaaaacuuacaugaucuguacuuccacgugacugggugcugaggggaguuaaagccucccuggugccagccccagugcuugucaaauuugcugacaggucacaucauauuguaauucuauucuuugcagcucaagcaugcaguaugaauacuguguauuuuuuaaaaaaauaauuuaguaucaaggcuucagaaaaugccauuuacggcaucccuucuguauguaacaaaaagacauucauaauguuaggaagaugauaaaaauucgcucuuuuaaagugcagcuuauuauucucaauugcuaaauacgauuacucugcuuuuuuuuuuucauuucuuuugaugucauaugugaguaucuuauaauuuaguucauuuguucaggguaaaauuugaaacaaaaaauuuuaccugugcaaaauaguuuuuuaaaaauuauacauguagcucaacuugagguacugcuauauaaauauucacucacauuaucacggaauuuauguauaguuucucuaauauagaagauaaaauugguguccucauaacuuuaacaaagaaaacccucaguccuauuuauuaauggguagaauuaaauauauaauuuuauagcucaguuuacccaguauucaucugcaaagccagauugcucucauugcuuuuauauuuuuaaauuguagcuuuuagagaccuaugauccucauggaacuuaauuuuuuauuaaauauucagguaacaguucugaauucaugugauaaugguggcauuauauaugauuaaacacuucagaacuuucuaauguuaucaggaguauuuugagggagauaugauuauauuguauuuucucagauaagaaaaauguuuuuuaacaauauuauuuuaaucuguuuuaagcaucucuuagauuuacauuauaacuacauaaagcagugaagcaaaggcaaauuaagauaaagcuagaaagucugaacauuuuauuucaaaaucauacgaaucggggucaguuaagccucaguauucuuagcuuuuguugauuuuggcacuaucuuuauauuauuaaauauauuuguuguuuggauauuucauauaaagauggcuauaauuacauauuucauucccaauuuguguguguugggggguacuuuuaaaggugacuauuguuuuguacaucuaauuuugggaaagcaagucuauaagacaucuugugauuucuuaauguuuuuguuuguauguuuuucaaagauaucacuguccuuuaucauguuuugaagauuguuuaaaauucauuuuccuaaauuaaugugcaaguaauguuuugaggauaucaguguuuuauauuaaacauauuuccaauucauuaa

SEQ ID NO: 192639 - RNA, 188968 nt, Homo sapiens
uuaaugaauuggaaauauguuuaauauaaaacacugauauccucaaaacauuacuugcacauuaauuuaggaaaaugaauuuuaaacaaucuucaaaacaugauaaaggacagugauaucuuugaaaaacauacaaacaaaaacauuaagaaaucacaagaugucuuauagacuugcuuucccaaaauuagauguacaaaacaauagucaccuuuaaaaguaccccccaacacacacaaauugggaaugaaauauguaauuauagccaucuuuauaugaaauauccaaacaacaaauauauuuaauaauauaaagauagugccaaaaucaacaaaagcuaagaauacugaggcuuaacugaccccgauucguaugauuuugaaauaaaauguucagacuuucuagcuuuaucuuaauuugccuuugcuucacugcuuuauguaguuauaauguaaaucuaagagaugcuuaaaacagauuaaaauaauauuguuaaaaaacauuuuucuuaucugagaaaauacaauauaaucauaucucccucaaaauacuccugauaacauuagaaaguucugaaguguuuaaucauauauaaugccaccauuaucacaugaauucagaacuguuaccugaauauuuaauaaaaaauuaaguuccaugaggaucauaggucucuaaaagcuacaauuuaaaaauauaaaagcaaugagagcaaucuggcuuugcagaugaauacuggguaaacugagcuauaaaauuauauauuuaauucuacccauuaauaaauaggacugaggguuuucuuuguuaaaguuaugaggacaccaauuuuaucuucuauauuagagaaacuauacauaaauuccgugauaaugugagugaauauuuauauagcaguaccucaaguugagcuacauguauaauuuuuaaaaaacuauuuugcacagguaaaauuuuuuguuucaaauuuuacccugaacaaaugaacuaaauuauaagauacucacauaugacaucaaaagaaaugaaaaaaaaaaagcagaguaaucguauuuagcaauugagaauaauaagcugcacuuuaaaagagcgaauuuuuaucaucuuccuaacauuaugaaugucuuuuuguuacauacagaagggaugccguaaauggcauuuucugaagccuugauacuaaauuauuuuuuuaaaaaauacacaguauucauacugcaugcuugagcugcaaagaauagaauuacaauaugaugugaccugucagcaaauuugacaagcacuggggcuggcaccagggaggcuuuaacuccccucagcacccagucacguggaaguacagaucauguaaguuuuauuaucuacaaaacauucccauauuacauaugcuguugcauaauccaaucauauuuacucagaaaaauaugaaauauuuauaaaauuuuaauuuauaucuaguaaguuuaucuauaucacccccauucccauuccaucuaugagaucccaacaauucuaauaauguguccuacauauuuuaaauaauguuccaaugacuuauuauaaaacuacugcaaguuauuuucuucucugugagcuggcuaacacaaaugcugguaagaggcuuuccaguaaucuuagagaacaucugugucauguuuguacagauuaacuagcuacugcugcccuucuguugcuguaaaugaaguuucaagaugagcucucgaauaucuucccguuuggucuuuauuacaugacgaggaaaccacuucuccaaaugaauuggaaguucaaaguuaacaauaggauccuaaugagaggaaaaaaagaguguaaucacuuuagcagcauaauuucaaauuuguuuuaauuucauuuuuauaagaaaugacaaauugcuaacuuuuuuaaaauaacaauuauauuaagauauaauucacauaauacaauucaccaauagcauacaauuaagcauuuuuaguauauucacaaaaucaaauccaucuggaaaggguaugagaggggcagaaccugacacccuaugaugaaguucuaguguggaauaaaaaagggagaaaaaacccaacauaauagauauuuaaugauuuccaaaauguguacuguauuuuacuauauauuauccuuccucucucauauuaaagacaucaaaaaguuguagcugcauacuauaacucucaugcuuucaaaguaccguuaagcauucuccaagccgacuucuggucaaaaacauucugcuacuagacccaucuuuguaaauaauaguggcaaugacugaaguaaugagaugacaguucaaaaagcaaagagugauuccuugcuauuuaaaauuucaucuuuaauacugcuacaguuccuacaaagucucugugagcuagaaaauaacaccuauguuugucauuguacuucuccagcuauaguuuucugagcuucuugaauaaacagaucuuuucauuuuagaaaauuuuauuuaaaauacugucucugcccuauucucuuucucuccaaucuugcugggacuccaguaacauguaaauuauaccuuucaaacaguaaauuauacuguuuuauauuugucucuuaagcucuguucucuucuuuacauucuuuuuucucucugggcuauagcuggaguucacuaauccuaucuucuacuguaucuaguccucuauuaaacuuguccaauaaguuccuaauuucagauaugucauuauacaucuucagcucuagaacgucuauuugauuuuuuuuuuguauacuccaugucuucauccguuuuguuucaucuuuggcuuuaucuucucuaaccuauuaaucaaaucauuuuaaaguucuuaucugccaauuacaguaucuggaucaccugugguucuauuucuuucucuuuaaaaaaaaucuugauuaccuguaacaugugccugccucuuugcuugcccagugauauaguuuugcugugccccgacccaaaucucaucuugaauuguaguuccuauaauccccacuguggugggagggaccugguaggagguaacugaaucaugggggcgguuuucccccaugcuauucuccugauaguaacuucucaugagaucugaugguuuuauaaggggcuucccccuucgcucagcucucauucuucuccuugcugcuaucauguaaaaaaggauauguuugcuuccccuuccaccaugaucguaaguuuccugagaccuccccagccaugcugaacugugagucaauuaaaccucuuuccuuuauaaauuacccagucuuggguaugucuuuauuagcagcaugagaacggacuauuacacccaguaacuugugaccguauggugguaacugugaauuaaaaacuuauuuauagcuucacauaccuugaagaagcuuuccacauacugcaauaaauauacuccacaaucacugcuauuguccuguuuaggaacuuuagggcauagauccaccauguuuguuuugcugaauugacgaugaguuuuuaguuuaacuucccacucuaccucuaaauaccugaaauaaucaacaaauaagagugacuaaaguagaaaucuauuuaucaguaugcaacauuuucagaaaggcggaaaaacauuuguugccagaugugcugucucaagccaaauuuccacacugaauuuuagcagugcaaccuacauuuuauaaggcucacaaguacuacuuuaaagaaaauauguaaugugauuuucaaaguaaaagcuagacuuuuuucaacaacucaacuuucauaacucaacaaaguaaacuaagaaaucauuuuaaaaguuucaucauuaguuuuuuccaaguacuacaguaaauuacaaaauuacacauacauacauauacauaauuauacaaaugugaaagaguucuuauuuuuuucuaaagugguacuuuugauaaucaaugcaaugcuucuuuguaaaacuauacuuucuguucaauuaugaauacaaauucugaauuuaccuuuaauauaauccuuuagaaauauuaauacuugaauauuaacagaauagaagauauuuauuauugauuaaauuuauaggauuguugaaauagauaauaaaauauaauuccugauauagucuuuucaauaauucugaagguaacuucaaaauuacugagguuuuagauaacagacuggaaugguaaaauugucauuacuuacucucguaaauucugaacuguguuuuguacagaagcagcuuucaaggagucuaguauaagaauacauggccuaugaaaagcaaaggacaaaaucaagauuuacauacuuguauacaaaguauaucuaaauaccucaaaaaacuguauuauuauuacagcauguaccuaccuuuuacacauuuucuuugguacugacauauucgacucgguacucugaaauaacauaaauuuuuaugacugcaauuaaagcuauuuugaauaauuuacuauucaguuacuccuuuaaaguguuucaaacuuugaaguuaaaauuucaaguaauaguuaucuucaucaucaaaagugagcuaacuucauuuuccacaaauuuauuauacugcuaaaacaguaggcuauauacuuuuacaugcagucucaagcaguuaaggaguuuuaacuuuuccuaaaaagcaaucuggaacuuuaauuacuuccauuccaaguuauuaucuuaagcaaagauaaacaaguuaauuuaacgugucuuuacauacauucuccaauuuaugaugucaguagagacacauuucuucccuuugaagccuaagaugcagaaccuuaaucuauauuaagggaaaagggauagggaauuuuguuuuguugauguuguuuguuuucuucauaaguuugagaaacuacagaucaaacuuaagcacauuuauuuaaugcagaccuucucagugccuuuauuauucuaacauaaacacuggcucucuaagacagaaagaguauacaaaguuugcccaacuuaauugaccuuggaauccugcuuaucacgaacugagucuuagaaugaauauucuaagaaacucaauuugagaaaucuggcccuacaggcaagaaggaaugcuccuauuuugccgccgugacagcaggaaaggaagccuuccuccguaagaagugacaguucguaucagugacaguaaagacauaggccugugccagggagucugcugcuauuuguacauauaaaaaaaaaaaaucauuaaguggcaaucuuaauuuagaacacugaaucuaggcuaugcagaucuguuuggagcuccaaauaaggaagaguuaaugauaacuauuuuagccuaaggaguuacauggauucacuuucagucuaccuugaaugauuuuuaccaauaauuuucuggccgggcucgguggcucacgccucuaaucucagcacuuugggaggcccaggcaggcagaucaccugaggugaggaguucaagacaagucuagccaacauggcaaaaccccaucucuacuaaaaaaaaaaaaaaaaaaaaaauacaaaaauuagccaggcaugguggugggcaccuguaaucccagcuacuugagaggcugaggcaggagaaucgcuugaauccaggagggggagguugcacugagcugagauuguaccauugcacuccagccugggugucagcaagaccccaucacaaagaaaaaaaaaaaaaaggaagaaagaaagaaaauaaaguagaauauauaaugugcuuaagaugauuaauuaccuaaguucaaaaaguuacugacauaaauaaaagugaaucugauccuuagaaauuagaaaaguaguuaaccaagaugaacaucagauaaacuacuaaauaaccuaaaaguuaaagcaagcuaaacagauauaagaauaauaacuaaucucguucucuuccccagccccacaaaaacugucaaagaaucacaaagcagcacaaucuaaugaugggccagcauagcccaccuagcuaugcucuauuuuacagauaacauuauuauauucaugaguuuuccuuccuucccaucuguaaagaacacacuuacuugggaauccucugcacucaaagacagugucgaaguaguacguagaucauuaucuaguuagaaauaauuaagcaguuaugaguguuuauugcauguuuuuauacagguaacuuagaaaagcuuaaaauuauaauuuuuaugcaguuacuggaugcacaguaaaaauacuugagauuuaauuuuuuucaugauuaauguuaugaauaaaauucaaucaacagauaaaacugacaaugguuggcuguuaucaaauaacagguaaaccccagagccaugauuggaaauaccaguuagcuaggcaaauucucuauaaaaagauaaucuucaaaaauagcucauuaaucaaaaugucugcuauuuaaugcagaagguaguuaaucugccuaauaauggugcuucuaacuaugaccauauaguuuuguguaaguacacauuugagguuucaagauaauuaaacauaaucaguugcuucaucaguuuuucuuuuuccccacauggguuuuggccaguauuaaugcuaauggcuauuuuucaaucagcuuacugcuuaggcuacagcuauaaaacauuuaauuuuguuacuuuuuucucaaagaaaguaggcuuauuuacuuuagauuuuggcuuguaagaaaacucguggaagaauuauaagagauccuauauuaccuagccaaauuaauggagucuacaggaaauuagauuaaguaaaaaugggggauuucaagcauugucuggaaaucaaaggcauaaauuccuagucauguuagcaaaccuaguguauuuuuuaaaaugguauaauacuauuaauuagcuagauuuugucauucuacaauguauauguauuucaaaauaucauguuguagccaggugugguggcucaugccuauaaucccaauacuuuaggagccugcggugugaggacugcuugaggccaggaguuccagacccaccugggcaacauagugagauccuaucuuuacaaaaaaaaauuuaaaaauaagccagguaagguggugcaccccuguaguccugacuaaucaggaggguaaggcaggaggauuacuugagcccaggaguucgagguugcaaugagcuauaacugagccacugcacuacaccaagacaacgucucuuaaaaaaaaaaaaaaaguauguuguacauaguaaauacaugcaauuuuaucugucaauuuuuuuaaguuaaaacaagcaaaaaaugucaauggaaauaauaauaauacauggaauaaacauaaaauuuaggguagugguuacuucuggauuaaagaaagagaaaugggaguggucacagaggagauuauuauuauaucagaaaaguuuuaauuucuuaauccaggugaaacagguauugauguuggucauauuaguuauacuuuuuuguauguuugaaauauuucauaagaucaauaaguaguaauuuuaagugccauaauaaaacuugauauaacaguacaacuucagaauuauauuuugucuaucauuaaaaauuucagauuuuuuauucauccuguuaaaguagguuuaaugauaguaaauaacuauacuaccguuaacuucauuuucuucccuguaaccauuaaauuauugucaucauuauuaaaaacaccaucuacguuauggaugucaccuauuguuuuguugucauuuugggacugcugagccugggacugcugggauacaguuuguggaaaaucuucauacacagcuucuucuaaccauggaaaacaaaugacugcgagauaccagugagaccuguugaaaaagaacuacaaucuuaauaccaugcaaagucuaaacaacauauaauauauucuagagauacaucugagaaagugagaauaaauuucauauuaauuuugaagacauccacuguaacaucucauuauaauauagagcauacauaucaacacuaaauauccagaguuaccaaggcauaaguaacacuauuuaggguaacagcugaguaguucaaauuuauuuacuuucauacaaucgguguuuccuauuaaggaucugccuuaauaaauagacucauagcauuauuuuuuuuguauuggugcuugaagaguuuguuuucuuaaguauuugaagauucacucaaaaauauuuuuauuuuuuuauuuagaaaauuuuuucuuaaauccaaacaaaaaaacauucaaugucucagucauuauagucuuguggucauuugucacuuuauuuuuuuuucacuacuuuuacaacauaaccauugucaaaccaaaauccaagauaaggaauucauugccuuagcuacuuuuauuuaaaaaaauuaaaauaauaccugagauguauguggccauaauuuuuacugauuaugaaucuaaaaacacuacaaaauuuuuuucugaauucuuuccaauauguucuuaaauaaucugaaauacuuacgacucauuuacagguacaaagauguaaucuuuauuaaaaauguuuaugugacgaguccauguucuuacucuuuuaugucuucucugugccauucugagaguaugaaagacagauuugauauauaaaaauuuuuucauuuaagauagggacuucaagagccauuuuuauauauugaaauaucuuaaauuuaguuuaaccaucuucuuuaagauauaucauauuuaacacauuauaaauauaucuccuuauaguaaccccugguuauucuuaaauuuaauaacuauaaacaauaaugaaauggacagaauaaaggcagcaauuuauuaaaugcuuuucagauuccaaaacuggcugugcaacuuaguauaaacacaguuaaaucuacuuauuuugcuuagcuccaucugggcaugauauaaaauacugucauuaaaccuuaacagaauucuccaacuguuauaucugucauuagggagguuuuaaaacucaaugggcugagugugguggcucaugccugugauuccagcuacuuaggaugcuaagguaggaggaucacuugagaucaggaguucaacacuagccugggcaacauagcgagacuccugucacuaaaaauauaaagaaaauuagccaggguggugacacacaccaauaaucagucccagcuacuugggggauugcuuaaucucaggaguuugaggcugugaucacaccacugcacucuggccucaguaacaagggaagacccuaucucuaaaaaauaaauuaaucaguuaacuuaauuuaauuaaaaaucuuaauggaggaggaaaaaugaggcuuuuauucucagauucuuuaaaauaaaauucaucucccuuccuuucauacacaaggaaacuacaggaugauguuaaauguaccuaccacucauccaucuuuccuuuuauuucuucaacaaauauuuauuagguuccuaaaaacaaauaaugaaagucaccuacacugcccuagaaguauucauaaucuaauaugggcagaaaaaacuauaacaaauaacuaaaaugugucauaagagguacaaaggaauuaugguaaugcagcaguccccaaccuuuuuggcaccagggacugguuuuguggaagacaauuuuuccagggacaagguuaggggggaugguuucaagaugaaacuguuccuccucagaccgucaggcauuaguuagauucucauaaggagcacgcaaccuagaucccuugcacgcacuguucacaacaggguucgcgcuccugugaguaucuaacgcugccacugaucugauaggaggcagagcuuaggcaguaaugcucgcucacugcugcucaccuccugcugaguggccuggcuccuaacaggccacagacugguaccagucugaagcccagggguuggggacccccuuauuaaaccaucugagacagccaccuugaacaggguuggcuugcauacacacaaauacuaguuucuuuucuuuaccuaaucaggggaguuaaaagagaaggauauaaaaccaaguuugacugucaaaagaaagguuuuaggaaggaagaaaaugacauuuaacagggggauaaaggugguaugugacuucuggcucagucccuuggauggaacucuuauugcaggaaaaaaaaaaggcaaaccauuacauucuuauauaauuuuuaucaagucauauaggaaacugaaaucauugccccaucuuguucauuugaauaauaucuagccaaaacucuauggguaaacaucaggaguaacauaggauccagaaugagcuaaaagauuugacagcaauuagacacuauguggaagauuaaccacauaaaaaaaucaaagucacguuuauugaauuuucucauuucaaaaggacccaaccauuauaaucaguauaaacaauuacuuucaacuaguguauagucuguuaauuuguuuucuauuugaaaaucuuaaggauagacaucugguuuuauauugguauuuggucgauuuccugauuaugcuaaccuuauuugauugagaauauauuagacauagaaugaggcaaggaggauaggagagaauaugagggccaaacauaaucuccuauucucaguuccuguguagaaaaucuucaacuaaaugucuaacaguucucucaguaaucaauaauaggcacuguuaucaucucauauuuugaguuccuaauauguuccaagcaccgagcaagguacugaggauagaguggaaaauaagacagauaaagucccuaacuucauguagcuucaaaugagaaacagaaaaugaagacguaaacaaacgaauaaaaugauuacagaucacgcugugaaacaaauuuuuuaaaugccaggauaaguuguuucaggcagaaaauaggaaagcggucagcauauuugaaaauggaaaugagguagguugaacuuaaguaugguaaaugagaggaaacaauauuaugagaugaguuuaaggagauggaaagaaaccagaucuuucaggaucucauaaagcaugauaaggaaucuguagcuucucaacacuaguaguuagagccuuuugauguggauuuauuggccauuaaaauucauaucucuugcugcucugaugacuuuuaaaaacugauuuguagggauucuuuguguaaacacuaaugcuugaucugauauaucaaauugugugaaugcuuaacagaccaagcauuaguauucacacauucaugugcauguguacauguguguguguguguaguaucuuaugcaucuuacccuagaggaugccacucacguaacuuuauuuuuauuauguauauaauaaucagguacacaauaucuguuuuuugaaaagcuuacuaauacagcagaaucuaucuacuuucauuuccuuaguuugaaggugaguauacaaaauucacaaucucuacuuugaauaaucuugaaauaaaacaugagauuaagugcaugguaccaaucauuaaauucuguauacauaaaacagaacaggagggcaucagaaauguuaccuaauuuauuuaauaaaucucccccuuccauauaucccucuccuagcccugauuaucagaaauauuuucaaauugcaguuuucuccuuaacugauccucgcaggucuuguccaucaggacaaauuccaaaccuguaaagacacucaaaauggaguuaaucauacaucccaguuugucuagaaaagcccugguauacgcacucguugucuaguguacccacuaagacagccuccuauuauucucacaagcaucccaauuuagaccauuaauuauauaaucacaacacuaugaacaacagaaagaguugaacuuugaaacuggaaagcuauauccaacuuugaaaaacucauauaacuuccuuaagcuucaauucauaaagacaaugacaauaauacuguagaaucaaauaacuuuauguucaccgucuuaguuccuagcaggcacucaauaaauauuaauuagugucccuauuccuacccucuuucuccaacaauauaucaaauucaagcaguuuauccauuaauccucuucuaacucuuguuuauuacuccuguuauuuuaacgagaugaaacaaacucucauagccauuuuuuaaagcaaucuaguacaauaaaaacuuuggacuagaaguuaaaagguaaagauuuaaguaccaacuaguucugccacucacuagcuguucaucuuaaguaaaauuuauuaaucuucauuagacugcuuccucauaugaaaaauugggauacaguuuauaugcccuaucaaaagguacugucaugauaggaaaaacugaaauaaugucaauaaauggaguuguaaauuguaaagcaguagagaaauguuuacacuaacuuuuaaaauaacaauaacucagcuuuaucaugagucuacucagauagauuaucauacaaauuguuaaguauggggaaaggggagaaaugccucauguugcaacaacuauccaaguuucuacugucuaagaaauaccuccuuuuugccuaucccuagccacugcuccacaguuuuaguauuaaccaaaaaaauacuugggcaaaaaucagcuaaauugugcaaacaaauaggguauuucguauaauguagcauagguuuaauuaaauagucugucauuggggauccaaccaggaaaacaaaaacagcccuauauaacagauagaauucaaugcaggaaauuggcuauagcauugacaaaaaaagaaaaacaaaaaaacacaaagccaaaaacggggacagugagacagcaaagauuagcagaggaggaaacugcuauaccuguaggguagagggcaaagagaggaagcaguaccuccagaugaaagcuggaguuauagcaggucuguccugugagagguggacucacagaggaaauacagccacugucagaaucauuucccaaugcaaagagaguagggaagaaauaaccuagcuucuuucuuccuugcccuccaacuuccaggauuucccccagggacaugcaauuggaaaugcagacugcaagugucagccucccugucaugggcagcaaaacaguggaaggaugagaaauggcucucauggcaaacagacccaggaccugaacaaaugguaguacugccuacuugaggaaauacuauaaagaagccacuuuacuaggagcaucaaaaauaguacauuuucucuuaaaacuuaaguacauuagaggauuaacuuacgaaagauuuggauuaucuucuguuaaauuauuuuccuuucuugucaagcauuuauagaaaaagcuacuaaaaaugugacuucguucaacaaguucaucugaugccuucuccaauauaagauaccuguaaaguaguaaccccacaaaaguaaauuauuuuuagauuuuacuuggucgucccccaguugucuuauguguucuggaaaucuuuauuuuuuaucuauuuugauucaaagcaaucuugcaguuuccucugauuucagcuuucaguuugguuaguuaccuagccuuccaucauguaaagcagaaauuacccacuuauucauucauuuacuuaacaaauauuuaucaaauuccuaacauguggccaggcacgguggcucacgccuguaauccaagcacuuugggaggccgaggcgggcagaucacgaggucaagagaucgagaccauucugaccaacauggugaaaccccgucucuacuaaaaauacaaaaauuagcugggugugguggugugcaccuguggucccagcuacucagagggcugaggcaggagaaucacuugaacccgagaggcagagguuguagugagcugagaucacaucacugcacuguagccugggugacacagcgagacucugucucaaaaaaaaaaaaaaaaauuaaaaaacuuuuaaaaauuccuaacaugugccaaacaccauguuuacacuagagacacaaaacaagaggggaaaaauaaaguaccugccccuguagagccuauaauccagaggagugaggguagaaaauauuaaucaaauaaucauauacucaaauauaaaagugaaauugugacacugcuaaacaaaucuagaaaaauguuaauaacugugugauaugauucaucucuaaauucuuaguccauuucuguacuaaaacaauccuuccauauaagcuuauaauccaaucacuuaguaauuaaccccuucaugauuagaaaacucugcuauucuuuauaguuuaugcaggcuugaaaaugugugauuguuuuuuaaaaauggaguagcuagaguuugcagaucagaauacuggaaaggaaagagcuauacagagaacuccagacagcugcaaaguccucuucaaguauucaggagaguauuaaacaccgaauguaugugaggaaaguacccagggauagggaaagaacuacccaaaaagaucagagagaaugauaccaagugcucacagagaccaagaauggugccuguuccuaucagccaaauuggaaacuucguaauuccugagacauuggguagaauacucaaaaaggucuuuccucaguaguaagauuaaguuauuggccucaucuaacaaaucuuaaaggcaucaaacauuuuccaaauaauuuuacugugucccaaaacaaaauucaagcauauuuauaaauacaaaaauauccagcacccaaucaaaaaauuaccagacaugcaaaagugcaaagaaaugacucauaaugaagagaaaaaucagucaauugaacccagaacugacagaguuguuagaauuagcagaaaauaauauuaaaacaauuauaacuguauuccauauguucaaaaagaaacauggaagauauaaaaaagacccacauuuaauuccuagagauuaaaucuacagugucuguaaauauaaugugagacuuugaccugaguuacugggauaaagauuacuaguauuauuaguaaaacaauagagcuuagguaagauuauaauaaauuugguuugggagagauguguaaaauaauuaggagauaucuccaucaacuguugggaaucuaggucuagagauacaguacaaaaugacggcuagaagcaaauuuccuuugcauaaaguuuuaaauguuuucauaccaauuccugcagcucuggcuauacaaaaaguugggggagaaauuaagugauauggauucuuaaaaugauaguuaacucuuagggaggccaaggagggcagaucaccugaggucaggaguucaagaccagccuggccaacaugaaaccccaucucuacuaaaaguacaaaaauuagccgggcgugguggcgggcgccuguaaucccagcuacucaggaggcugaggcaggaaaauagcuugaacccaggaggcagagguugcagugagccgagauugugccacuggacuccagccugggugacaagagugagacuccaucucaaacaaaaaaaaaaagauacaacagauaucucaauagagcugcuguuuuuuaguucccaaaaugauuuguaauuuguaaguaacuucuuucaccaccauaauacaauaguuaaagaaauuuacaucaaaaacuaacaaaagcuaaaaaagcaaaaaagcagcaacucuucuuaacuauauagcauccacaguaaguaaagcaaugaaacugaauaagucaauucuagaaaaccuugguaagcaaaaauuuuccaaaucugaaaucuuggcaggcuacuuuuaacagaauuuaaaauaauucagagauaaagacauuuauuuuaaguuucucaguaaaaucuguaaaauauguaggaucauuuaucauuguacuuacuuaagguaaaaaucaaugauuacaucauuaagaaacucuccuucuucuaaacacuccagaucuucauuaguuacuccuaauccccccuuaguaggugguggaggauauacaaucaaccuuaaaaguaaaaauaaaguuaacauauacugauauugaaaauccuauuaucuaagagauuucuuauaugaaacaauaacugggcagugguauucuguaacucaaaucuguaggguaaaaaacauuugaccaggcauaaauaaugauauuuuccuuccuuuauccucacaagcuacuaaugguacuccgauugaguauuaucuuuucuuuuccaauacuucccaugugggcuagucuuaauaggcuacuaucugaauuagucucuaaucaauagguuuuaucucacaaucaguuauaccauugaagauguugcucuucuucauaauuuuuaacuuugaauaaacugauguaauaaaauauagcuuuuccuuucuccgcuuucuaaguuugaauccucaagacuaguucccuuccuuucagaaaagccagcagucaaaaauugugcucugcuccugguggcuaaucuauaccagcagcuggacaaaaaagaaauaacaugggagcuuaggaggcaagucuccccauaaaaagugccugccacauaaaacuuaagagaccacaaaggagacauauaauuuaaucacaaccagaaaguaguagagaagagaugacaacuaauuagucauccuccugcuggcauucucucuuaaagcuuagaaauaagaccaguugugaauuccgggcuauaaucuuggaauagguagagcaguacucaaugaaaaauguagucaguaaugaagguauaauauguacuucuugcgccagaaagguucaguaugguaagagucauccacauugauuuaaucuuaguaucauggcaccuaaaucaaaaaagaaaacuguaaauuuaaagugcuaauaugauaguuucuaccuuauuggcuauuuuccuauccuagucuuucaagugucuuuuuucaaaacaaagaaauagaaucacauggagguacagaaaucaccauuaaaugcacagacuccauauucuuccuuagcaccaugagaagacauggaugaaauaugaacaaagaagcaauuucugaaagagaacuuguaacaaacuccaaaguaccuuaaauugaagcauauuucaguaagcaauuucauuuucccuaucauauguucagauaaggaauguagaauuuuuaaaaucauacauugcuacucaaauguuuuuaauaaacacuuuaaucuuaccaaauaugacacuuugucugccauuuaugucuuacugacauaaaaguaaaauggcaccuauuguuuucuuaauaaauuuuuuaacuuccucauaauuucuuuaaaaaaaccuauuuccauuacuaucagcaugaaaguaaaacuuaaaacauuucaaaaguuaaacuacugaaaagcagcaacaugaauaaaaacuacuaauaugcccaucuacuacaaacaugcuaugacaguacauacuucugaacaaguccagugugccugacuucucgccauucuucaucuggauuagauguaauagaaagggaguagcaaccgcuacuuugcuucugcaggaagguguaaguaggcuuggccgcaucuguguuugagggcugacagaaaguggcaagaaaaagggucucaaacaucauaacuuucaaaagaacaaagucaaaacguagacgugugagagaaaaugugacuuuaaaaaucccuaugaauuauaucuauacuuuuagauuuuccauagauauaaccaaaccaaaauaauacuggugaugaaaagauauuguauaaacaauggucaaagauuaacuugaaguacuauuugcagauauggacuacagaauuaaagaagaauauaacaauuuugcaguucaaaauaaucaaaaaauguaauaaauaggaggaaauaaaauuuaaaauuaagaggcuacauuuauaauaauguaauuccacuaaauggaaaauauauaaacaauauaauuaggaugcaaaauauugacaacauuauacauaaagaaagauagagaugaagucuuauacuuuaucuaacacuaauguggcuuucuauaggccuuuugaauaaaagauuagccucuggccaaacccguguaugugcaugcaugugcacagguguauauaugaguaugccauagcuucuuaauaaauucuuuucuuucuagaacuauuuggcagagauauacaagcuacauguauauuaccaaccuccuauaaaaauaaacauagcauuuuaaaacuuacuauuguuuucaagauaauuuuagacuuacaaaagaguugaaagaaaucaaccuugcccaaauuccccuaaucuuaucauacacaaccauaauacaaugaccaaaacuaaaaaauuaacauuggccuaauaguauuaacuaagcuacagacuucauuuugauuucacuuuuccauuaauauccuuuuucuguuacaggauccuacaauuccuuagucuuuccuuguuuuucaugaccuuaguaccuuuuuuuuuuuuuagacagucucacucuguagccaggcuggagugcaguggcacaaucucgaucacugcaaucuccaccucccggguucaagcgauucuccugccucagccgccugaguaacugggauuacaggaaugcgccaccacacccagcuaauuuuuguauuuuuaguagagacaggauuucaccauguuggccaagauggucucaaugucuugaccucucgugauccaccugccucggccucccaaagugcugggauuacagguguaagccacugcguccggccaaccuugauacuucuaaagaguacuggucaauuauuuuguaacaggacuugucucauuuuucucauaauuauauugagauuacauauuacuggaaagaacaccacagaagugaugugguacuucucagugcaugauacgaagggguguguuaugucaacaugucuuauuacuggugauguucauuuugauaacuugguuaaagugaugucuacaagguuucuccacugcaaaguuaccacuuuucuuuuuguaaauaauacauauuuuaugcuagagacuuugagauuaugcauauauuuuguuucuacuuaaauuuuuacucauuaaauuuagcaucuguugguggacuuugcaauacucauaaacauaguguucuacuugugguuuuguauuucucuuauuccuuuucauuuauuaauuggauuuuuuucuaagauauaauugucccuuauccaccauguauuauuuauucauucauuuacucaguuaucuauuuauauaaauauagacuaauauuuauuuuuuauuugguuauaaucccaugcugucauuauugauuuuguuuaacaaauuguuccagcauuggcaacgggaguucuuuuggguugguuccuaugcccuuuucacaaaauguagcauuugaaagcagccuaauaucaaugaauaaauguuuucugaaccucccccuucucugccaauuauauuaaugauaugcuaaccugagauacugauuucagcuucauuucuucagcaacagcaacaccagcagggaaagaacaaguugaaacacaguaauaaugaauaaaagaacuuucuuuugaagagagguucugaaacaaaggaaaugccugaacccaagacaacggguaagaaagcucuaauucuccacugauuauacuuauuuccgucauaauaucuuucagcuucaauucuucucuuugugaaacaggauuguguaguucaaggaaaaugaauucacuagauuuugcuacaaaaggaaaaaauaauuuguaucaauaguauuauuuuucaagaggauuauaauacaaguaauuuaauuauuaauaauaguaagguuggaauauaaccccaaguauuuuguauuuuagguaauaaccaaggcaaauuaauaucccaaaaguaggccauuaguaauccagaaccaaaacucacaauugguggacuccuguucuacugcacuaaaaugucauaauaguacugauugcuauaucugcagugccugacauuuaguaauaaacauuuguuaaugaauguaugaaugaauaauuaauaauuauuuuucucuagccuccuuuaugaaucaacucuaucaacuagaaacauauuccaauuaaacaccuccuacauuuucuccucagucauuucaauggugaucugaagacauucucuucccacagaaugcuuauaaauggcuguuucuauuuuccccaccuucucugcuauuuaaucaugaauuuuccuaguagaaguaauuaggacaggaaaauaacaaauuugaaaguuauaaaauuuaguucacuacuuaacaucuuuacugugcaggagaguaggaaaaagguagagggaucaaacagguaagaaagaaccuuacuaaauuugauugauguaguucuaaacccaacuccuucaggagcuggagacuaaacaaagcugaaaaauaucucaagauguauauuauauagauaaguguuauaggugcauaugggaaaguauucaaccgaaucuuaaaggaauaauauauaaguaaacugaauuucacuuuuuagaaacuaaagacugaaggcaaagacuucuauauuuuauuuaacuuugcugcaaauucugucagaguuugucaugaccaagggcaagaaacucauaagaaagguaguuggccaggcaugguggcucacacuuguaacacuaaaacuuugggaggccaaggcaggaggauagcuugaagccaggugcuugagaccagccugaggaacauaucgagagcccaucucuagaaaaaaagaaagcaaaaaaaaaaaaaaaaaaaaaaaaaaggagaagaaagaauuugggcuuauucuggguucucuauucuguuucauuggucuauuugccuauuuuuauaccaguaccauacuguuuuggugacuauggccuuauaguuugaaaucagguaauaugaugacuccagauuuguucuuuuugcuuagucuugcuuuggcuaugugagcucuuuuuugguuccauaugaauuuuaggauuguuuuuucuaguucuaugaaguaugauggugguauuuugaugggaauugcauugaauuuguagauugcuuuuggcaguauggucauuugcacaauauugauucuacccauccaugagcaugggauguguuuccauuuguuuguguugucuaugauuucuuucagcaguguuuuguaguuuuccuuguagagguuagcuauauuccuccuuggcuagcuauauuccuccuuggcuagcuauauuccuaaguauuuuauuuuuauuuuuugcagcuguuguaaaagggguugaguucuugauuugauucucaauuuggucgcuguugguguauagcagagcuacugauuuguguacauuaauuuuguauccugaaacagugacaguuugacuuccccuuuacagauuuggauuguccaacaaagcaaacacaaacaaaguggggaaaggacaccuuauucaacaaauggugcuggguaaauggcaagccacauguaggagaaugaaacuggagccucaucucucaccuuauacaaaaaucaacucaaaauggaucaaagacuuaaaucuaugacauggaacuauaaaaauucuagaagauaacauuggaaaaacccuucuagacauuggcuuaggcaaagauuucaugaccaagaacccaaaagcgaaugcaaccaaaacaacaauaaauaggugggacuuaauuaaacuaaagagcuuuugcauggcaaaaagaacagucagcagaguaaauagacaacccacagagugggaaaaaaauguucacaaucuaugcauccaacaaaggacuaauauucagaaucuacaaggaacucaaacauuaauuagcaagaaaaaaacaaacccaucaaaaagugggcuaaggacaugaauagacaauucucaaaagaagauacacaaaugaccaauaaacaugaaaaaaugcucaacaucacuaauaaucagagaaaugaaaaccacaaugcgauaccaccuuacucccacaagaauggucauuaucaaagaaugaaaaaauaauagaaguugguguggauacagugaaaagggaacacuucuacacugcuggugggaauguaaacuaguacacccacuauggaagaguguggagauuccuuaaagaacuaaaaguagaacuaccauuugauccagcaaucccacuacuggguaucuacccagaggaaaggaagucaauauacaaaaaagauacuugcacacacguuuauagcagcacaauucacaauuccaaaaauguggaagcagcccaaaugcccaucaaucaaugaguggauaaagaaacugugguacauauauaugauggaauacuacucagccauaaaaaggaaugaauuaauggcauucacagcaaccuggauaggauuagagacuauuauucuaagugaaguaacucaggaauggaaaaccaaucagcccauguucucaguuauaagugggagcuaagcuaugaggaugcaaaggcauaaaaaugauacaauagacuuugggggcucagggggaaaggguaggaagggggugagggauaaaagacuauaaauuggguucaguguauacugcucggguuaugggugcacuaauaucucacaaauuaccacuaaagaacuuauguaaucaaauaccaccgguuucccaaaaacccauggaaauaaaaaaaaaauuuaauaaaagauuucaaucuguuuaaaaaaaggaggaggagggaggaggaaaggaggaggaggaaggagggaggaaggaggaagaaagaggaggaaggaggaggaagaaaauggaagaaggaagaaaaaaggaagaaagaagaaagaaggauagaaauugccagguauggugcugcaccccuguagucccagcuacuugggaggcugaggugggaggaucacaugagcccaggaguuugagguugugggaagcuaugaacaugccacuguacuguagcccaggcaacagaguaagauucugucucaaacaaaaagaaaaaaaggaaggaaaguagucaaacauggcaaaugacuaaaagauaaggcauucuuuuuuuaagaacuuaaaauuuucaagguaaacauuuaagauuuuuuaagcuauucuuuuuauuuuagaugagaauuucaauugguugaauacaacuauaaggagaaauuaugugaauuaaauaaucuauccuaaaauuaagaaacaaaauuagggccaggcgcaguggcucacgccuguaaucccagcacuuugggaggcugaggcgggcggaucacaaggucaggagaucgagaccauccuggcuaacacgaugaaaccccgucucuacuaaaaauacaaaaaauuagccgggcacgguggcgggcaccuguagucccagcuacucaggaggcugaggcaggagaauggcgugaacccgggaggcagagcuugcggugagcagagauagugccacugcacuccagccugggugacaaagcgagacuccaucucaaaaaaaaaaaaaaaaagaaacaaaauuauuuucacuaaauaaaauuaauuucaauucacugaaauaacauucuauuaaauuauuuuaggaaaaaacuauuuaugacaauuucaaguuauccugaaauuuagaaaucauuuuauacucacauugcuggcuuaauacagaguguucuaauugggucugaaucucuugaagauaaucugaagagacccagaagaaaagaauagcaugacuccuuuuacugugauuaucauccuuacuuuuccauaacccaaaccgcuuuaaaugugugguauccacuagcaaugaaaucucauucagggacacugaaacaaauaaaagacaacaauuuaaaaaauuaauccauuuaagaauacaccacuuaaacauuauaugacacuuguuaauacacuacuuuuuuuaaaaaaaagagaauuauauaguuuuuucaaaaauauauuuccagugcacuuugcuaaccuuagcuaaaaugcccccagcaguauuauuagaguaaaaauaaaucacauuacaauuaggaagggcuaaauaauuauuaaaugacaauuaaauagagauugaaucucucacauuauaugauuucaguuauaaccagagagggaaaauuugagauuaaauauucauagcauaaaaacucugucuggagagaauucucuccaggaauucugauaaucguuagcaaaaaggaaaaaaaugucuaucagugcagaaaacuaagcacaguauaacucagaaaaugauauauuuccaccuuuucuauauuggucaauacuauauaaaccaagaucacaagugcuaucauaggccaauuccugcccaucuuucuucuccuaaggcauuugcauuccgcuauacagauaagccacuaucaaaagagucucaagaaaauuaggagguucugaauggucuaaggagacauuucuuuuaaaauuccuccagguuuuauuucucaaaacuucuagaugaucauucuaaauuauuggucuuucucccucuuagggagcuaaaggaaucuccucugaggacuuuuacucuuuaauucaaagaaacauuaaaaaaaaaaaaacugauuuaaagaaguccugaaggucacuuaguucaacugcaagacagcaagcaacugaacuggaauacaaauaucagucaagcguaaacccaagaugggcaccuauuugaaacacaccucuuaguauuccucccagcauuauuuccuagaacuuuguuacucaaaguauagucuaagcugagcuugugacauuaguaucagcaacaucuggaagacuguuagaaaugcagaguaucaggccccaccuuacaucuacugaaccagcagaucucaguuuaauagcccacuccaaccccgugauucacaugaacauuaaaauaugaaaaucuuuccaugaugaguauuuaccagucaucuuaauguucccaagccagucauucuauucuucauacuguaacucuuccauucugaaaacugucaguaaaaacuggcagcaaagcuuaaaucaaaaccagaaugagagcccucagaaugcuacucagcauuucuuucucaugaagcucacagccccauagguacauuugauccuauuucugugaaaucuacacaacuacuacuaaucuaauuguucuugguguuuagaaugaaagcuaaauuuucuuuaggaagacaacuuuaaaagauuaucuuuuuccuguguccauguguucucauuguucaauucccaccuaugagugagaacaugugguguuugguuuuuuguccuugcaauaguuugcugagaaugaugguuuccggggagggauagcauuaggagauauaccuaaugcuaaaugacgaguuaaugggugcagcauaccaacauggcacauguauacauauguaacagaccugcacguugugcacauguacccuaaaacuuaaaguauaauaauaauaauuuaaaaaaagauuaucuuuuuaaaaaaagggaauuuaacaccaucaugagaaaaauuuauaccucauuaccaagucugcccccaauauaugguuuauucuguuacagguguauagcagauacuaaaagugggaguugccuacccacuuauccauuucuucuucuuccucaguaacagaacccuaauuuuacugagggaagcaagauacacaguuuugaaaacucuauuuccuagcuuccuuuacaaacgggugugugggcuugacuagcuagcuaauaaaauguaagcagaaaagguuaugucgcauggacauccaagaaggcuccuuaaaagggcaagagauugguagcaugugcucuguuuacgguuuccccuuccuacugcuuucugucuaaaauaucaauaugaugauggagucugagcuacaauaauggccaugagauaaacuugaggaugcaagucauacgucaggaaugacagaauagaaaaaugcaacucaugugucagggucaugugcccccgaugaccaaggaaacaucacaucaguucagauuacuucuggauuucuucuaugugaaagaaaaauaaaauauuuucuuuaugcauuguuacuaacagccaaacauaauuaauaccuaauauaaauacggauaaaucaauuuuuccccagcugcacagaaaaaguggaaacauuuagacccucagguucccaccuacaaaaaccuuuauaugcaugcuuuguuuuaaaaagauuuaugggaacuuggacaggacuugaggaagaagacuaauauuuucuucuuucauuauaaaauuauaaaccuauuaucacugaagagaguauuuuuccacaaucuguaauaaaauuucuuuuaaaaauuauaugcaauagaaaaguuauaaaauaagaaagcaauauuauaaauauuaacugugaaaaucuaaaauaucguuuuugauguuuguaucgcaagaauuugagaggcagcucuguuacccaggucuuuaacuauaaacuguagugcuaucuuuucugaaauuaucauccccuuuuaaaaucacaugacuuuuuuuguuucuucuacagaacaaauauuauuccuuaauaauuuauuaauauuuccuauuuaggacuaucaauauacuuauucugugcccuuuauauucuuaauacuuaauuaagauacaguaagcaaucaaauuauuagaacaauuaucauaacauaguuuuggauucuguacauaaaguaucuguggaauccaacuaaauccaacuaauccaacuaaagcuacuuugauagcaucuccaaucuuggaacagaagccucuucuucucuaauuccuaucuaugccauuuguguguuuuucuuccuuguucuuuuuagaauucauuauauaaauagauuauccucuauuguauauugguuuucuuagugucauaauuuauucugaaagguuuucaguugggaagagaaugagaaaauggugugagucucuauaaguuacagguacauuuuccagucuacuuucccuuacuaagauaugcaauuguauaacauucucuuacccucuaugcaaaaacauuuuacauguuugugugcaauauuaaacauuuuccuuaugcuucuuuucuuauaguuacuauuguuauccauuuuuauauauaccaaaauauuguugcuaucuaucagaacuguguuucuguuaauccuaagaaaucaccaugaauccuuuaacacuguuugauuuauagucauuaaaacaauagcauacgauuuucagaacaaguccauuauaaaacauuuuuacuccauuuggaauugcuaaaaaauauuaaggugaaacauuauuaaacuuaguuuuacuuaaauuuauacuaaaaacuauaguaaaaagacaaguucauaagagaaugauaacuuaccuugaaaugggaucuuaauauauuuuuuugugaucugaagaaaaaauuaaaaagcaaacaaugaguuaccacucaaaauguguuacuauucaaauuuuuuuuuucaaaucacaaguacauauucaaagucuacauuauaagugcucaagccuuuuuaucaauaaaccaauaaaauauuucacuacaaagacuuaguuuuauggaaauuuuaagaaccccauguaaguaauuuaauucucaauaugcucauuuacaaaaaccaguaagacuaauaaauauauuuuucaaaaauguuuucugaaaauguaaagacuaagacaaagcccagaagaaacugccaagagaccucuaaguagcagugacucugguaaauauaaauaguccauaaaacagaguuucauuuuuggcuuugcugacucagcagcugacgaugauucccuuggugaugaacucacacuaaccaaacucacaagaaacugcuaaacaaaccaaaaugccaacauacuauuuuauaaugagaaauuaaaauugucagaaggcuuguguccaaccugaugugaauauucuguuucuguacaaaaacuaccaauuauaauuuuaaaauuugcuuuuaccacauaaaagcagaacuaaaaaauucaguuguuuaaugugaaauggcuacaaaagucauagauucaacuucauucacagcagugaugcaccugucaaaaugguaauauaaauuaagucccuaagccagaacaaccucuucccuggaugacuuuuaggugggcaccaccgucuucauuccuagcauucaucuuucuuuguuucauguuauaaauucccuuccaacugagguucuugcucuuucugcuccuucugucccaggacacuuauuuucucuagguaccuuuuguauauaucugacuuccuuaagagcugcuuuuauaauaggguuguggagcaccuagcuaaaucuuacauguacuaucuaaagcagacuucugcuuugaaguuuguguuuccauuaauaucaaaugaauuuguaccuauuuauuuauuacuugguuaaguuuuguuguuguuguucaauacauuuuguugaucaaaucggguauggucugugagcacaaaacgaaaucaaaauguucuugguaugugagcuccauuuaaguaucaaacaauguucagugaaaccacagguuuauuuugacuccacuuauuuuccaauuuaaaaauuauuucaucuuguacuuucacaaauauaaaacccuauauuccauagaguaagugagccaugaaaaccaaaugugaggcaauagaucauaauuaacuaaaagcugagcuuggaguuaaaauccugccucuacugucucuaccacuuacacaaguaguaaguagguaaacuuagguaacuuauugaacuuuuuccagcuuuaguaagauccuuaaucaaggaaguuguuaucauuagacacuagcaucugaucaagaauguuacauaauuuaaucaaauaucuaauuauuguuacuuucauauaacugccaccauauuuaauguauacugccccuuuccaaacucuuucuggcauguuucacagggucuuuaauccuauaaaauauaucuuggcaaacguaaaucauuaguacuaaaaaauaaacagaagcgguguuugccuuucagaauuugcacagccauaacuuccaaauuauaaaguagaaguagugcaucugcauguccccacccacuacuuacuacacuauucucucacuuucccccaucaaaugcucgggagcuaucaaauguuucuacuuggcaaggaucugauauucauuuaucccucugaauaaugacuaagccaauagguuaccucuccagaguuaaaacccuacucccagcagacuuaaccccuagauuuaaaaauaagaaaaauuuuguggcaguaagguaaaccuaguucucugaaaucauaccaacuuuguuuaaacuuaagaauaaagcuaauaauaagagcuauuuuauaauuucuuacaauagcuaauaguuaucugaauauaguauuacuuaauuucucguacuaucaacaaagacuuuuaagaaagacaauguuuacauuuauugcagcauuugcuacacuaaaaaaauaaccagugucuaacuauaggaacauggcucuaauuuauguaauaauuuccagcuauaaguauuuuucuaauucagcuaaauuguaacuacugugagagucagaacaguaucuccagugucuacaauaaugcuuaacacauaguagguagucacugaauauauggagaauaaauuaauuuaauucucuaauaucuuuacccaccaaaaaagaaaaaaaaguucuuuaauuucuguuacagugcauccugaacugucugaaaaagaauauaccuaaaaaccugaaaaaccugaaauuuuuacccuuuucccuuuuuuagguuauucauuauacuuaaaauuuuuuuuaauugcuuauauucucuccaucauaacuguccuaauuuuuguaggauucuucucagccuuuguucacaugcauauauuuacuuugaauugcuaaaucacuuuccuauaauuaaacauuuaaguuuuuaaucuaauuauaugaaauguuccagcaaacauaaauaaaauuuguuaccuuuuauuuuagguucagggguacauguacaggucugcuauacauguaaaccugugucacagggguuuguuguacagauuguuuugaaacccagguauuaagccuaguacucgauaguuauuuuuucugcucuucucccuccucccaccuucaaguaggcuccagagucuguuacucccuucuuuguguccaugaguuuucaucauuuagcucccacuuauaacugagaauaugcgguauuugguuaucuguuccuauguuaguuugcuaaggauaauagccuccagcucuauccacauucccgcaaaagacaugaucuuauucuuuuccuagcugcauaguacucccacuacauguucuuuauccaaucugucauuguugggcacuuagguugauuccauauguuuccuauuaugaauagugcugcaauucacauguauaugucuuuaugguagaaugacuuauauuugucuggguauaauaccaguaaugggauugcuggguugaaugguaauucuguuuuuagcucuuugagggaucgccacauuacuuuccacaaugauugaacuaauuugcaucccccaacaagugugucccuuuuuucugcaaccucgucagcauguuguugaccuuuuaacaauagccauucugacugguaugagaugguaucucacugugguuuugauuuggauuucucuaaugaucagugauauugagcuuuuuuaccauaugcuucuuggccacauguaugucuuuggaaaagugucugcucaugucccuuguccacuuuuucauaggguuguuuuuuuccuguaaauuuaaguuccuuauagaugcuagauauuagaccuuugucagaugccuacuuugcaaauauuuccucccauucuguagguugucuguuuacucugcugauaguuucuuuugcugugcagaaguucuuuaguuuaacuagauccauuugucaauuuuuguuuuuguugugauuuugacauccucgucaugaaaucuuugccugugccuauauucagaaugauacugccuagguugucuuccaggguuuuuauaguuuuggguuucacauuuaagucucuaauccaucuugaguugauuuuuguguaugguauaaggaagggguccagcuucagucuucugcauauggcuagccaguuaucuuagcaccguuuauugaauagugagugcuuuccccauugcuuguuuuugucugcuuugucaaagaucagauggucauaggugugcagcuuuauuuccaggcucuauauucuguuucauugaccuaugugucuguuuuuguaccaguaccauacuguuuugguuacuauagcucuauagcacaguuugaagcuggguaacaugaugccuccagcuuuguuccuuuugcuuaggauugccuuggcaaucaggccucuuuuuuuuggcuccauaugaauuuuaaaauacuuuuucauauuucugugaauaucauugauaauuugauaggaauagcacugaaucuauaaacugcuuugcgcaagauggccauuuuaauucuauugauucuuccuauccaugaacauggaauguuuuuccauuuguuugugucauacugauuucuuggagcaguguuuugcaguuuucauuguagagaucuuucaccucccugguuagcuguauucauagguauuuuauucauuuuguggcaauugugagugggauugcauuccugauuuggcucuuggcuuuguugcuguugguguauaugagugcuagugauuuuuuuuuaauguacugcauuuuauuacauaaaaguacaauuaguaaaauaauauaguaauuuauuugaauauacuuuuaacuauaauuaaucauuccuuccucucacuauaauguugaaaaguauuacucugaacaccuaccuuauacguuacuuaauguaaguuaacuacaaagagccucuccacuuacauuuucaucaugcaucucacauuuuaaucuccuuauucauuuauagaaaaggucauaaauaaugcccaacuaauaaaaaagaauuucuaauaucucugaugcagcaacaauugaucauaugcuuucccaugugaauacaauaggaauaaaauaacagcauaaaguaauuugaaagcuguauuacaucauuauucacuuuucaaaaaaauuuuuucaaggaaacaaguacauuuucaauguaauuacaauacuucaaaaaaucuacucccuuuaaaguuauauacaaauaauuuaacaacuuuaguuguagauuaguuuuuauacucaacacucugauuucguguaaugucugaagugucaguaccuuauucuacuguaaauucuuugauauuuacauagaaucaauuuugaauuaaauauuuuuucauauuuacugcaucggcaaaaauauauuuucauauaaacucugguguuuucuaagcaguaauuuuugaaaaaaaaaaguguuuccaaauucauuacauuugcaggacucuucuccaauauaaauucccugaugcugaaaaaagcuugagcaauugcuugaggguuuuccucuaguacaaaaugugugcaauaagaucugugauacaaguaaagguacuacaacccccuuuauauuuguaacgguugucuucagaauaaauacucuucuucacuuuaaaggcuuauauuuucugaaagaauuuuugacaguaauugcacuuuuaaugcuuuuauuaacuaugaacauucuuuuuuuuuuugagacagaguuucgcugugucacccaggcuggagugcaauggcgcaaucucggcucacugcaaccuccgccuccuggguucaagcaauucuccugccucagccucccaaguaggugggacaacaggcaugccccaccaugcccagucaauuuuugcauucucaguagagacaagguuucaccauguuggucaggcuggucucgcacuccugaccucaggugauccaccuaccucagccucccaaagugcugagauuacaggcgugagccaccgcgaggaguggcauugccuggacacugcacaguggaauuuauauaaggaugugauguuagagaacuacagaaaccuguucuuccuugguauuguugucucuaagccagaccugaugaccugucuggaacaagggaaaaaaccuuugacuacgaagagacauaagaugauugccagacccccaguuauauguucucauuuugcccaagaucuuuggccagagcagagcauaaaagauucuuuccaaaaagugauacugagaagauaugaaaaauguggacaugacaauuuacaguuuaaaaaaagcuguaaaaguguggaugaguguaaggugcacaaaagcgguuauaauggacuuaaccaauguuugacaacuacccagagaaaaauauuucaaugugauaaauaugugaaagucucucauaaauuuucaaagucaaacagacauaagacauacuggaaaaaaaacuuuuaaauguaaagaaugaggcaaagcuuuuaaccaguccucaacccuuacuacacauaagaaaguucauacuggagagaaacgcuacagaugugaagaaucuggcaaagccuuuaagcugccucuaaccuuacuacacauaagauaauucacacuggagagaaacccuacagauguagagaacguggcaaagcuuuuaaccaccccucaccccuuuuuucacauaagaaaauucuuauuggagagaaaccauacaaguguguuaaauguggcaaagccuucauuucauccucaacccuuauuaaacaugagauaauucauagaaacucuacaaaugugaagaauguggcaaaauuuuaacuguuccucaaacccuacuaaacauaagauaauucauacuggagauauacccuacaaaugugaucaauguggcaaaaccuucaccugguuuagucaagccucacuaaacauaagagaacucauacuagagagaaaccuuacaaaugugaagaauguggcaaagcuuuuaacugguccucagcccuuaauaaacauaaaauaauucauauugcacaggaaaccuacagagucaauaauguggcaaaucuuuuaaauguuccucaacccuuaauaagcauaagauaauuuauacuggagagaaacccuauaaaugugaugaaugugggaaaaccuuuaaccagcccucaacucuuaguaaauaugagaauuuauauggaacauaaacccuacaaauauaaagaaugugacaaagcuuuuuaaggaaguucucaacccuuauuacacauaauucauacuggacagaaacucuacaaguguaaagaacguggcaaagccuacaacaaauucucaauucuuuuuuuuucuucuuuuuuugagacagaguuuugcucuuaucacccagguuggagggcaauggcaugauuucaccucacugcaaccuccgccuccuggguucaagccauucuccugccucggccucccaaguagcugggauugcaggugcccaccacuaugccuggcuaauuuuuguguuuuuaguagagaggggguuucaccuuguuggccgugcuagucucaaacuccugaccucagaugauccacuugccucagucuccuaaagugcugggauuacaggcaugagccaccaugccuagucauaaguucucaauucuuaagagacaaacgauaauucaugcugaaaaggaacucuacaaaccugaaagaugugacaguacuuguacaaacaccuccaacuuugcaauacauuaaaaaaaaaaguuauacuagugugaaacccuagaaauguauaaaacgugacaaagccuuuauaugguugccacacuugauuguagguaagauaauucauacuggcaaaacuccuacaaguauaaagaauguggcaaaacuuuuaaucugugcuuacaccuuauuucacaggaaagcuauuacccuugagaaaaauuguccacauauaaagaauauggaaaagccauuaaugcuagugauuuuuguacacugauuuuguguccuaaaacuuugcugaaguuguuuaucagcugaaagagcuuuugggcugagauccuauaucuagaaaauuuauauauaauauauauaaauauauauauagaauccagacauagaaucauaucaucugcaaacagggauaguuugacuuccucuccuccaauuugaauguacuuucuuucuuucucuugccugauggcccuggccaggacuucugacaauuaauuuuuaggaccacuuuacaaugcuuacugaauauuugcaguucccuacuguuuguaauaguaaaauauugggacaauuugaaaugaccaacaauuaaaaauuuuuaaagacaacccaaauaucccaaaauaaguagaggaauuaaauuaaugaaauuaugguaaguuacaaaauaguacauauuauguaauaucccuuuguuuuaauguaucuauauauguaugaagaauaugcaacgauauauacuauacagugaauggcaguugucucuaaauaggcaagauuauauguguuuguaauauuguuccuuuacuaauuuguuugugguuuuuugcuugaucuugguuuuugagcauaacauguccaccugacuguguaauaauauaauuaauauauuaauuaauagaaaucccauuguuuaauauuuauauuggauuuuccuucccccggcuaaucaucacucucauauauuuagguuauccaacuuuuugccaucaaaaagaacucaacagaaauaacuggguaaaccugaauuuaaaauaauaaaguaaaauaggggagaaaauccugaaaaaugaauaaaauuccuuaaagaaaaagaauuguaaaaucaccccagacaugccaaaaucaguuaaaaccaguggccaaaaaaauguuaauuuuaauucauucuugagcuuucgaagcaauggugacuguaucacaaacuacuauuauuugcaguucccagaauuugggauuaggucuuugucugcauggguaccaaguaaacaacagguacuucaugucuuauucaugugcugucuucucugugaagccuuuccugauuccuccagacauugauagauauccauugccauaugcacccuucuuguacauauuucuguuuuauauuuuaccauaauguaaaguaaauauuuaugugucugucucuuccauuagauuaaaagcucccugaaagcagaaaccauaucuuagcauuuuuauauucucugccuuaucccuaacacagugaaauaugaaugaaacugcuauaaaaaaugccugaguuacuaaaucugacacagucacuucaacaaacauuuaagugccugcuuagaguggaaacauuuauggaagcuauaaaaggaacuaaaacuguggcucuucaccauaagcagcuuaaaagguuaauggagaaguuuauauaagaauauagguaauuauaaaacacacagaauaaaucuuagaagucaaaugaaguguuauaaguguauagcaaagggagaaguuaauuccgucuaaaaaggagggauuagggaaaguuuccuggaagagucaguauaucagagaagcuuuaaaagaugauuaggauuuuaaaaggucaaaaugguaagaaaauauagagaacuggcugggcacaguggcucacaccuguaauccgagcacuuugggaggcugaggcagguggaucacuugaggccaagaguucaagaccggcuuggcgaacauggugaagcuccaucucuaccaaaaaauacaaaaauuagccagguguggugccacgcaccuguagucccagcuacucgggaggcugaggcacaagaaucgcuugaauacagaaggcagaaguugcagugagccaagaucaguggagugcgccccugcacuccagccugggugaaacagugagacucuguccgcccccccaaaaaaaaaaaauagagaaccgaguagaauccagucucacuuucauauacagugggugaggaggaguauuuucuuuuuuaauuagaaaaacagcguaggauuaguuccuggauauccuuaauuuagaaauuuggagaagucaguuuacaaccguuuaaacugguaaaacaagauuucuucuuuaugcuccaaacuauaccuugaaaaaaauuuuacuuuaccaucaaauaacuuuuagaacccaaagauuaucaauacaugugauuuuuuuucacacaugauuuucauuagaguagucagauuagguaggauuuuaggaggggagaaugaaagacacauuucaaauuagguauaaugacuuucaacauauccaaagugucccauauaaaauaaaucuuaauucuauucuuauuugugcuaagaaaaaaaaggaaaaaaauuaaaaugccuuguccaagauccaaacuaaaagaaaauuaaagaaaauauacuuacuguaacacaaccuuuagaagcuccuuuuauuuuaccaauauaaacagaaguaaauauaaaauccaguuguagauccaucucauuacuaggcauaauacuggaaauguucuccaugacaggauuauaugggcauaauucagaugacaucuaacaaggaauaaaucauaaaaugcauauaauucuuaaguacuauauaaaugcugaaaaugacuuucaccaucaaauucuucuuuaaauuacuauuagugaauuuuugaagaacuuuauacuguucuuacugugaagaaauagcuaucuagauuuuuuuucugaaaaaauauaugacuuaccuuugagaaaauuacacuaaauagcugaauccaaaauuaauuccacagccuaagcuccagaaauauauacuccucuguaucaaagccaugguuucacauucaauagucucuaauagguuuuauucauuuuuaacuugacagaagaaaguuuuaaacauauauuguacuuuuguuuaaaauagguuuuuaaauauauuaucucuuuuaauccccacaaccacccuauaggcagguuuuucaguuucccauuucauaaauaaaguuaacagauguuuagauugguuaagcgaccugccuaaaaucaugcgauuaguaagaagcaaaacaaagauucaaaugcacguuucucucuccagguccagugucacuucaaccacauaaaauuguuuccauuaaccaaaauaauguucuugcuacugcacuuuaaaauuuuuuuauuuuagauucagggggcauaugugcagauuuguuacaaggauaauauugcgugaugcugaggguugggcuucuauugaaccugucacccagauaauacccaacaggaaguuuuauggcccuggcucuccucaacccucccccuacuuuuggaguuuccaaugucuauuguucccaucuuuaugccugugugcuacugcacuuuuaauaugccgugaaggaauguaaguaccuaagaaccaucuguuaucucaaauuuauaugcuuuauuguauacucuauguuugaagacaaccaaccagaaauggcuuauacuugccuaaaaccucaaaaaucauaucacuuccacucaagugacuauauaacuuugcuuuuaaauuauaauagaaaaccaggcaauaucagcagcaacucuuucccacuguuucuucugaaauuuacacuacuuucagaugacuuuuucaacuuuuucaaaugugccuaaccucugcacauuauccguaacaucacacauuaccaaacagauuacuacuaaagcaguuauuaugcauauguacucacuccccucuuaccucucgcaaaugugacuaauccuuaucuaaaacauauaucauacucauuauuuuaaacccagcucauaacgccauuuaccugcuuaauugaauuucuuugucauucucauguuuuauugcuuaguauacuauuaauaucuucuuauucccuaaguaaaaaagggaaucaaucaaucaaaucaaaucagguagcuccaacaucagucagacaaauaacugugggcuuuuuuagugauaaaaugagaaguugguauagaaauaauuucucauuggguuucacauuuuguaaaaacuagcuggcuccuaaaaaugaccaauccauauuucucauaauucauuuaaaacuggaacaagagagagcauagagauguggcauucugccuuauaugucuuuguagaucuccacaguauuggcugcuugguugugauuaugaauguaguaaauuccacaagauauguuauuuucuuauaauaugaucauuucauacuacauugucaauuuauacccugccaagaccuaauucuucuacaaguuuaaauucauuaucaauaaugacacuuuuaauuauauauacaacuaaaccaucaaguaggauauugaccccaucugguaaaaaugguuacauuuuugcaaaaauucagaacaaagcugcugaggugauuucuacguggaauaccaaauacaaaagaaaauacccaugaaacaauaaucagaccaaacuguuuucauagaucgggccaacucuucaccauacucugcaaaauaacagccucugacauuauucaaaaacaaaacaagauaaguuuaccauaauucugcacugguggucaaugaucuuuucuuacaaauagaauaaucacagacuaauaauaagaaagaguaccagcugggagcgguagcucaugcaugugauccuagcacuuugggagguggagguaggaggauugcuugagcccaguaguuagagaccagccuggacaacaaagagagacccucaucucuaaaaauaguauauauuuuaaaaacauuagccaggcuugcuggcaugagccuauggugccagcuaccugagaggcugaaugagagggaugcuugagcccaagagguugaggcugcagugagccaugaucaugucacugcacuccagccugggugacagggcaagaccuugucucaaaaagaaagaaagaaagaaagaaagaaagaauacugauaauaaaugauuugaaccuuauuuuagaccuacucucuucaaaggacugaauuaaucgacugauauuaaacuaacacacuuccauuuaugauuuucuauaagaaugaagaggcagaggacuuaccaaacuugauagguuucugaccuauaucuccaaagccauguucuuuccucuauaucauacugccuucauaguaugugaggaaaaggaguaauuccaaguagccauaauacuccaagaccagacauauaaauacuagaaaauguguuuaauucuacaaaauguuagugaaauguccaaugaaagccauaaaaaaagaaaaauauucaaguaauagacuauucagacugaaaaauauaaaucaccagaagaaaauggcauaaucuuuucauuucaaaauaaagacaacuacguauuucacucaaacuacuauaaaaguugucugaaaauucaaacuaagaaaauuuguaauuuucauuacaauauucagcuugauaaaacaaauaacagucauuaaccaauaguguacauuucauuguuaaucuaugagaagacagaaauaaauuaccuguacagauucacauguaaucaaugguaguucuaacaaugcugauucagaaguacucucauuuucauuaguugucucacggucuugcuuagauuguaacuuaagaauuucugaacuuuuauguucaacagguccuucuucaucacuggaaacaacaacuaaaacggaaaagaaaaauguauuuuuguuuauuuauuuauuuauuuauuuauuuuuugagacacagucuccccaucucggcucacugcaaccuccaccucccgggcucaggcaauucuccuaccucagccucccgaguagcuggaauuacaggcaugcgccaccaugcccagcuaauuuuuguauuuuuaguagagacaggguuucaccauguucgccaggcuggucucaaacuccugaccucaggugauccuccugccuuggccucccaaagugcugggauuauaggugugggucacugcacccagacgaaaaauguauuuuaaauguguaacaaucacauaucaaaaaaagaacuuuuggccgggagcaguggcucacuccuguaaucccagcacuuugggaggcugagguggguagauucccugaggucaggaguucaagaucagccaggccaacauggugaaacccugucucuagcaaaaauacaaaaauuagccgggcauggugguacaugccuauaaucccagcuacuugggaggcugauuaaggagauuacuugagcccaggagggggagguugcagugagccaagaucgcaccacugcacucuagccuggccgacagagagagacucugucucaaaaaaaaaaaaaaaaaaaaaaagaacuuucuaauuaaugcaauuuauuuuuaauaauccuguuaaacugaaucaucuaaauuuauucaauuuagaaacaggccuaucaguuguuaucugauuuauaguaguuacagacaaugacucuauaucagcgcaauuauucagcaguuaccuguacccuuaccuucuaaagaauaaagauguuuaaaaauggauaaagccaugaggaggccuuaguaacaaauucuaguucuaacaguguauugugccaucacucuaaauuguacuuuuaaguccuguuacaugaauugcuucaaggaaugggaaauuaauaacuaggggaagaugugggcgaguauucacuggagauccuuuaaaaccuuuggaauuucuuuguaccaugugauggcaucaacuacucagaagcugauuaaaugaaaauuaaugauaauaaucagauagcacuuaaacucugcauaauucaucaaccaaaugacaguaaugauggucuuuaaauaaucuauuuuaaaacuauugagaugacaguguacuuacuaaucuaagaaaaaaauuacuucuguuuucaaguccuccauuaguuuaccuaaaucgauauuuuaaaacucaugaaggagaccccaaaccccaagcccuuuuuuccuaaaguuaauauauuccacaaugaugucauaaacagcuuauggccuuagccaaauuuguucaagaagaauaaaaaaauaacuaaguaaagcagaggaaauuaaguaacuuuauaauccuccugucacuuacuugguucagcugagaucagugauugguucccuucauuauguccucuuagaauaggcuuuucuaugguauucaacucauucucauccuucucaaccagggaagaaauccccacaauaucaauggaauuagaguucucaacgguuucagugguugaaccggcagaggcacuuuugguggcauuacucaaagucaacuccugacuguuaagugaggauaguuuaguaaaaucacuuuuuguagguuuaguuguaauuucuucaggcaguuuuggauccugaugauaguuuucacuuggcuuuucaaacucaguggauauuguugagucaucuucuuguuuuuucuaaacauaaacacauagaaaaaaauagcauuuuucaaauuuggcuugcuuaaaccauuuuuaaauuccuaaaaaaaaguaaaaauauuauaucacuucuauaacuacauggauagaaaacuaaacaauuauacuacauuauacuugccaaugucucccaaauuuaaagauacaggauuuggucuguccaaucugaugccugauaauuuuuuaaagggugaaauugggagauuuccaucauuacaaaugcuuugucagacggucucccaugaucuaagucaacuuuagaaugagaagauguauuuacauauuuuuauuuugcaaaaguaauaaugccaaugugacuacuuugguaaaacuacuuugguaaaaaaauuuaaaaaucaacaauauaacaacauuaaaaauuaugaaaaucaaccacugccuucaauaucucauuuacuauauaaaucugaaucauguuuauaauuacaacccaaaaacauuacaagguccugaaaugauuuauggaucaaagaaauugaaaagcugucuuacuguuuuauugcuacuuauauacuaagucuuugaaaauagaaaauguauguauuuaauaugauaauucuuuacuuagaauaaauucccuaaacucuagauaaacagaagcuuaaagaauuugauaaguaaauugcuacugauaaaauaaaucuaauaauaauuuuacagagcaagcaaaaaaaaaugacuagacaguaugaauaguauuuggcugaaauaaagaaaaagaaaagucugaaggauguacaacuaccuacuaaggaaagagcgauacaagaaaauaagcaauuuuaacuuuuuuaaucauucauaguauuugaaauguguuccaauaacucuguaucaccaagaaaaguuacauuuagaauuguuuuuuaauaauaaagcuaacagugaaccaaaaacuaaagaaaucucauaauaaaagcugaaagcuagaggaacauuauuuggccacagucaacucguuuuuaucauagcaugaaauuauuuccuauaauaucuaaauaccucuacuuacugucuguucuguugacuuauccaaagaaguacaauauugagaaucagguaaauuauuucuaagccuucucuuugucuuccuggaaaucagagugaguuccacuuuugaaucagaauauuuaacauccuuguuucugcuuuccuguucgagaugaucacaaccucuacuuccacuguuaaggucuuaaaaaacaaaugaagcauaaauauggacaaaaaaguauagagagaaucucuuuuagaaaagcucgaaguaacaucaucaggauugcuauacuacuuccaaagcucauuaaaacagaaauguacuguuaaauucucauacugacacuggaugaagguaaaggcaugcccuauuuuaauugguauauaccaaguaaauguucauuauacaauaguugugaggugagaaaaauauauaaagaagaaauauccuuuuucauaguagccaaagcaaagccaccaaacuguuuuuccauuugcuauaaaugcauuuggcuguacuaucaaaaaaaaaaggggauuaagaaaauguggcccauauacaccauggaauacuauacagccauaaaaaaggaugaguucauguccuuuguagggauauggaugaagcuggaaaccaucauucucagcaaacuaucacaaggacaaaaaacuaaacaccacauguucucacucauaggugggaacugaacaaugagaacacuuggacgcaggaaagggaacaucacacacugggccuguuguagggugggggguggggggaggggggagggauagcauuaggagauauaccuaaugugaaagaugaguuaaugggugcagcacaccaacauggcacauguauacauauguaacuaaccugcacguugugcacacguacccuaggacuuaaaguauaauaauaauaauaaaaaagggggggucuuauuaaaauccagaaaauucaugucuuaaaguuugauaauucaaugugacuuuauaaacuaagucuuuuaaaauguaauuuacauaaauacauauuuuuaguggaaagggacuauaauuugaaagaguguugaucacugcucuuuaaaaggagacaaaauaccuuugcucuguaguuggcuauaauaugugaucauucacaagguuaccaauuuacuugccaguuuauuucuucuuuucaauaaucaagacccugucauuuuaagucuccaauaaauccaucauucuagagaaguacuuccuuuuuuaagucaacaagacaucauuuugaaacucaugccaaucauuacuaaaaauauuuaauauuuguuaucaaauauauguacuguacaaaaauaccuuccaaaaguuuccaccuaauugacuaaaaguuauccugaauuauuuugcuuucugaaucuaugucauacaaguaccaacucaaaguuuauacacagcaagucacaaagcaguugccuuuaauucacaauuuucaauucaucugacuggccugacuuuuccauucacggaacguucuucaacaccauacaucuucucuucaaacuauucuugcuuuuacuguagcuucaacaauuccuaauaacuaauauucaugauaauuugucuuugacauuacuuaaaggaaggcacuggaacaggauugaggguaaaaauuccaagauagucaaucgccuuucaauuuccagagaaaacaccuuacucccuaaggaaaauaaaacuccccccaaaucaucaacacaauauuuaggauagcacauuaaauuuuauauguaauauuguaaacuauaaaaguggucuaauacaauuucuacacacaauguaucaaacuauaauuucuaaacauaaauauuauacuacaguaaaaugauucaugaaaggaaaggggcuugagaaaaacuugauuauacaggaguuuucuuuuaaacaauuuauuauuugcauaucagucaagccugucucauggaaaaaggaauaacuuuauuauauagaaugaaauauuguaaaaauagaauuccaccugcauaauauauaauucaaccugcaaauauuacuagcauauaaaacuaaagaggugacaaaauccuguaaacaaaagaauacuaaguauuuccaagguauuauguuggugaaagcaaauuccacaaggcaaacuuaaugugcuauggaaaaaaaugguacaccuaagauuucauucagaauuuccauuaauuuacagguuuuuaaaaaauaacugguaucagauguaggagaguaaacacugcuuuaauaaagauucaauagcuaauuguauuagaaacacuuucccuaccaguagugguaccuucagggauacugaaaaacuaaaaaauguuucuuuugucauguacucuucccugaugcaugucuaaaaugccacugugaucuugagguaacacuccuggguacaaaucagaaaguauuuuauucaagucaaugugaggacuguuaguccucacauucuacugcuuuccuggguagaguaggaaucuuugucuugauaguaccugaacugagcccacuuguacaaauacuuacauuuuuacuugguaaucaauacagucaucccucaguauccucaggggauuggucccagggacccaggauaccaaacuccauggauccauaagccccuaaagguauaguauuugcauauaaccuauauacauucuccuguauaguuuaaauaaucucuagauuacuuauaauacccaauacaacauaaauguuauguaguuguuauauguauuuuuuaugauuguauuauuuuuauugaaguuuuuuucaaauauuuuccaucuuugcuagguugaaucuacagaugcagaacacaaagauacacagagaugauuguaauuacuucuaagaaaaguacaguuuauaagaaaauaaauguuuuucauuauacacugacagugacuaauuggaagcuugucugaacaaagucacagcacauucuccaaagacugccuuuauaagaguuucagcugguuucuuguacaaauaaaaguuauuacuguaguuucauuuuaaauuuuuuucuauuaaaaaggcuacuaaaaagaaucuuuaaauagcugugcuccaaaugaaguguaaugaauuuuugcacagcaucaucaaaagauuuuuuuguauugugaauaacuuaugaaaucacucaaaaauaaaacaguggccaagcgcgguggcucuugccuauaaucccagcauuuugggaagccgaggcaggcagaucacuggagcccaggaguuugagaccagccugggcaacacggcaagaccuugucucugcaaaauacaaaaaauuagccaggcgugguggugcaugacuauagucucaacuacucgggaggcugaugugggaggaucacuugagcccaggagguagauagaggcugaagugggcugugaucaugugugaucaugccacuguacaccagccugggugacagagugaggcccugucuuaaaaagaaaaagagaaagagaaaagcaagaaagaaagcaagcaacaaagagacuucaacaacauuugaagcuaucaauaauccaacagaccccuaaagguguuaguuucacaaauaaauaauguaguaaaauuguuuuucuucaaguaucaguaaaauauuuuuaauucuugaaagagaggcaaaaaagaaaaagaagucgaaucauaaauccuauaugcaaggaggccuacaaaaaauuuucacaagucuaggaaguauuuaccuucaaauuugcuaauaguggcuuguuuggcauccuccugaaguugagagaaauucuaaugaauagagaauguauuucaugguaggcaaauagacagugauuagcuaauaauaaaaacccaguuagcaguaacauuaauauccauggaaacaacacuuagaaacagcuaaaugaacauaacuucauagcuauauccaagucuccccaaagaagaaaaaaauauauuaaaauuuaacuuuugggauuaguaaauaaaucuagaaaugaguacuacgcuacauaaagaguagguuuagcaauuuuauuuguguugccaaauaaucucccuuuacuuucacauauccuuucaaaguaaaauaaaauaauuuauuuauaacaaaaauuauuauuaauacaauaagaaaaaauucaaauuccaacaguuuucuaagguucacaaaccuucaggcugaguaucagauauuaaaagagaaaugccaucauccuuucuucguuuuucuuuauugugcgcagucugcuuugcagaauugucaucuacugucuuacuucguugugagccccugcaaaagagaacuguauuauacucaauucuaauaaagcccaaaugaauuuagaagccaacuagcauguauuuaaaaauccaacacauuacaaacacagucccacauggcagacuauaagaucuggguaguaaaaaaaauauugaacucagauuuaagaaauaaguuauccucccuuuucuaccuuuaaauuccccauguguguuuagggggaaaaaaaaugagauaucaacauuggaggauuguguacaugcaaaaugagcaaaagaguaauacuauacaaguauuaaauuagguuuaaaaaguaaaauuccaaggacacaaguaccucaauaauuaaaccuauguauaggcaaacaauuauaagccaaagcugaauguuaauauauuucaagcgugguucauauaccaaaaguaugguaacaaauuuucaguaguaugugguaauaaauuuuaccuacagagaaaauaauuuaaagucuaagguacugguaaaauaacaaauuuuggaaugauagucacaauguuacuacuaaggaaaauuuagaaauauaaaacauacuauaauguauaagugcauacauaugaaacaaaauauaaaaacuuagacuggaaggauucaagccuauuuggguaguagauaacucuaaagagggagaguauuagaaucagggaauauaaaauaaauaaguuuucaacuuucuauaauacuucuuuaaaaacaaauuuaaaucugaaaaaauaggaauuauauugguuaaaucugagugauauguauuggcauauuauucucuauacuuauguacauauuugaaguauuucauaauuuuaaaauauauaaauuauuuacaacuaaggcaacuaguauaagucaaaaacaaggacuauaaagaccaauuacacguaaugcuuccuuguuuugagagaauuauuuggaaggcuaaaaaugacuuauaaauuaaaaaaagcuacaguauccaaacaucaccaguguagugucauaguuaaagaaaggguuauugcugcuauuacacugcucauuuucauauuuacuuugguaaaauuuucuuuauuuucagauuggaaauuaaaaggccaaaauaaucaaaaucguaagggugagccaauuucacuugcaaagagguucugacugagucaaaucauuccacuccucaacccucaagaaucauucuugaagaauaagggcaucuaagcaaauuuauaccauagaguuuuguuuacugaaaaugaaaaccaaaagagaagucaaaaaaaauuuguccucccugaaagaauuaucacuacaggcacuauaaacaaaaauaaaaugugaccuaaaagacgaucuaaaaagaugcuuagguacuuauguuuccccugauauaagaagcaaacaguguaauaguccuuguuuuucuagcacaaugaacacugaaaaacaaaauaagauuucacauguaaaucacauuaaaaguuauaugguuguagaaaaaagacuuuauaacagaggauuuucuugacuaaacgcuaagcauuaaguaguuggcaugaaaccaaaaauaaaaaugaguauuuucaaaagguaaugucauaugauucaaaugcacaacagugaagccaaacacaucuguaauauaaucucaauccaaauaacaguuuuuugcagaauaugacaaucugguucuaaacuguacaugguggaaagucacguguuuaaagauaaggacagcaauguucaaacacuguuagcuuccauccucuuauaagaaaaggaaaugaauggacuggaaacacccaaguuccugaacaagaaauauaaauauucacauuauucaaguuaacaaguaaauguaauaaaagcucaaaauaaauauuuuccaaugcaacaaaauucuaagaauuuuuuuaaauagccaagcaaauauacuuuaaaauuauaaaaauguauuaaaauagcgugguacuagaauaaagagagacauaucgaccauagaaauagaaaacagaacccaggaacaaacuuucaaauauaugcucaaaagauuuuugacaaggaugcugaaaccauucaauagggaagggacagucuuuucaauaaagggugcugugaacauaggauagucauaugcaaaaggaagaaguuggacaguuaucuaacaccaucuacaaaaauuaacucaaaguggaucaaacaccuaaauauaaggcagaaaacuauaaaacucuuagaagaaugcauaggggaaaucuuuaugacauuagauuuggcagugauuucuuugauauaacaacaaaaacacagucaacaacaaagauaaauuggaguucauuaaaauugaaaacuuauggcugggcaugguaguugacgccuguaaucccagcuacucgagaggcugaggagugaggauugcuugaggccaggaguucaagaacagccuggggaacauaauucauuaugggguuucaccccacccacacacacacacacacaaaauuuaauaauuagcugggcaugaugguaugccccuguagucuuagcuacucaggaagcugaggggagaaucacuugaucccaggaguucaagguggcagcuacaauugugccacugcacuccagccugggcaauagaaugaggcucugucucaaaaaaaaaaaaaaaaaaucaaaaauuuuuguuuaucaaaggacacuagugaaaagacaacccacagaaugggagaaaauaucucccacccacauauauauuaaaggauuaauacugauaauaauaaagaccuccuacagcucaacaacaaaaaauaaauaacaauuaaaaaaugggcaaaguauuugaagagauguuucuccaaagacauacaaauggccaauuagcaugaaaagauguucaacgucacuaaucacuaaggaaaugcaagcccaaacaacaauauaccauuucacacagauuaggacagaguaauuuaaaaaaaaauuuuuuuuucauuaaaaaaaguuaaacauuggcaaaaauguagaaaaauuggaaccucuguacauuguuggugggaauguucaacagugcagucacuguggaaugguuuggugguuccucaaaaagcuaaauagagaacugcgauauaagaagcuaaacacaggccgagcacaguggcucacgccuguaaucccagcacuuugggaggcugaggcgggcggaucaccugaggucgagaguucaagaccagccuuuccaacauggagaaacuccgucucuacuacuaauacaaaaauuagccaggcgugguggcgcacgccuguaaucccagcuacucagaggcugaggcaugagaaucgcuugaacccgggaggcggagauugcggugagccaagaucaugccauugcacuccagcgugggcaacaagagcgaaauuccaucuccaaaaaaaaaaaaaaaaaaaaaaaaagaagcuaaacacauaaucacaaaguuaccaagcaaucccacuccuagguauauacccaaaggaauugaaagcagguacaugaacagauucuuguacuccacuguucacuguggcacacuauucacaauagccaaaaggugaaaacaaccuuaggguccaucaagaaaugaaaagaaaaacaaaaugugguauauucauacaauaaaauauuauugggccauaaaaaggaaugaacuugugauaagugcuacaugaaugaacuuugaacacauuaugcuaaguaaacucagccaaacacaaaaggacaaauauugugugauuccacuuaaagagguaacuaaaauagacaaauucacagagacagaaaguagauuagaggcuacuaggggauuaggagaggggagaauggggaauuauuauuuaaugguaacacaguuucugcuugagaugaaaaaguugugauaaugguugcacaacaauauggaugaacuuugaggacauuaugcuaagaaaaaauaagccacuaacuaaaagacaaauacugauauuccauucauaugaugacauauuuagaauagucaaauucauacaggcagaaaguagaauggugauugccagggacuggaagaagggaaaaauagggaguuagaguuuaauagauacagaguuucaguuugggaagauggaaaaaguccuggaaaagaaugguggugauggcugcacaaauaugugacuguacuuaauggcagugaacuguacacuuaaaaaugguuaaaauggcaauuuuuagguuacugauauucuauuacaaucuuuaaaauacaaaaaagguauuaaaauauacaauaaaugaagggaauaggagaacuaguucuacuaauuucauaauaaaacauaauacagaguaacaucaacaaguaaaguauaguauuacagacuaguauauaagaaauggcuggcaaacagcaaaaaaccaaacaccgcauguucucacucauaggugggaauugaacaaugagaacacauggacacaggaaggggaauaucacacucuggggacuguugugggguggggggagcggggagggauagcauuaggagauacaccuaauguuaaaugacgaguuaaugggugcagcacaccaacauggcacauguauacauauguaacaaaccugcacguugugcacauguacccuaaaacuuaaaguauaauuuaaaaaaaugcaaaaagaaaaaaaaacagaagaauuugaaacaaagcugggaaacaaagcuuucaaauucaguuguaguggacuaacuggguaacaacagagaaaaaaaagaauucagaacuacauccaauacucuaagguaaaaugaacuaucauaugcuaaugacuaaaaguuguaagauuuuuuuuaaacaaccaucagaagaaaaacacuauauuuauuagccuuguggaagaagaauuucuugagaauggaaguaaagaaauuauagagaaaaauaugaucggauucaaccacauacaugguaaacuuuuaauaaaugauaaacuaagagcaucaaaauaaaaaagagaaauuaaacccaaaacugcaucaaacgaagugcaauacacaggaguucccaguccaacaugaaaggagcuuggaaguuaucuauccuaacggguaaaacugaaaaaucaacaacucuuccuggacgugacagaaaagugaagucacaggaugaauggcugcccccaaaaugggagaaagacagccaggugaauacagagaaucgcaacuuacuaaagcaaaaacccacaagcagaaacagucccaguaacuacuauuggaguaugaagaccuaaacugcaauugacaaauugcugaggguucaguguacauaagucuaagaguuaaaaaucccagaggacuuagucauaaagggggucgcacacuuuugugaguuuuaucuccaggaguucaaccagguucucacagugaauaucagaaaaauccccucaugguucagcagaggaaggaaaacauuuucaaauauaucagagcauucuguucuuaacaaggccugcccucaagaaaaacuauuucaccagagccuaaacuaugaguuauuuuuuagagccuaaucaagcaggggaaauaaaaaauacccaacucuagcuccgucuagcauucugugugaggaaaagcaaggaaaauacacaauuccaagaccaucuagcuuuccaugugggagaagggaaauaucuaacuucauuauauuccagguaugcuguugcaccaaagcauucagaagagaaugagaagcacuuguaaaguuaacaggccaaggacaaaggcucauuaacgccugagguugcaauuuuuugaauuuuugcaaucacagcuuggugauaaccuuuagcaguaggauauaaauaacuuccacaugccuagcguuccaguaauagaacacuaagcauaaauggguuaaaagacugaaaccuaacaggacuacagaaugcuuuucuuccucucacaucuuaccaccacauuccuaaaggucuauuuacaguaguugcuuuuaucuaguacgucauguccaacuauccaaaaaaaaacaaaaaacaaaaagaaaauuaaaagccacucuaaaagaaaaaaaaccacaguuugacaacaaguaucagaaccagaaccagacaugucagagauguugaauuaucagauuaggaauuuaaaacaaauaugaucaacagauaaaguauacagcauauaagcacuuaugggcaauguuagcagagagaaaguguaaugaagaaugaaaaagaaauacuaaagaucaaaacacuguaacagaaaugaacaaugccuuggaugggcucacuaguagacaggauauggaaaaggaaagaaucucugaacuugaguauauagaaauagaaaauuccaacacaggaaagcaaagagaaaaaaagacuaaaaaaacccguaacagaauauugaagaaaugugggacaacuacaauagguguagcauaggcauaaugggaauaucauaagaagaaagagguaaagaaacagaggaaaaaugcaaagcaauaaugcaugagaauuuccccaaauuaaugucagacaccaaaucacagacuggcaaguucagagaacaccaaagagaauaaaugcccaaaaaauaacaccuaggcauaucauauuaaacugcaaaaaaaucaaagauuuaaaaacaguuaauaaaauccagaaaaaaauaagcccuuaacuauagaaaaacaaagacaagaauuguaucucauuucucagaaaccaugcaaguaagaacacuguggagugaaaucuuuuaaguguucagagaaaaaaaaccuaccaauaaauaaauaaaguacaaaguugcaggauuaauacucucugauuucaaaacuuucuguaaagcuacgguaaucaaaacagugugguacuaguauaaaaacagacacauaaaccaacagaacagaauagagaucccagaaauaaacccucaaauacauggucaaaugauuuucaacaaggguaccaagaccauucaaugaggaaagggcagccuuuucaacaaaugaugcuggaaaaacugaauagccacaugcaaaacaaugaaucuguacccuuaccuaacaccauauacaauaauuaacacaaaauggaucagagaccuaagcauaaggcauaaagcuauuuugaaaauucuuggaagaaaacauaggggaaaaucuucacauuagauuuguuaacauuucugaauaugacaacaaaagcacagucaacuaaagaaacagauuacguagacuucaucagaguaaaaaggcaacccacagaaugagacgaaauauuugcaaaucccauaucuauuaagggaucaguauccagaauauauaaagaaauccuacaacuuacaaaaaaaauccaauucaaaagcaggcaaaguacuugaauaaacauuucucuaaagaagacauauaaauggccaacaacacgaaaagauguucaauaucacuauucauuaggaaaaugaaaaucaaaaucacaaugagauuccaccucacaugcauuaggaugguuauuaucaaaaaaacgaaaacaaguauuggcgagauauggaguaacuggaacccuugugcacugcugguggcaauguaacauggugcagccacuaugaauaauaguaugauguuuccucaaaaagcuaaaaauagauugccauaugauccagcacuucuacuucuggauauauacccaaaagaacuuaaaggagagauacaaacacacacugaacacccauguucauaauggcauuacacacaauagccaaaauguagaagcaacaccacuaucuaucaacagaugaauagaacaaaauuuaguugauacauaaaauggaauauagucagccuuaaaaaggaagaacauucugacacaugcugcaacauagaugaacuuuuaagacacuaugcuaagcgagauaagucaguuagcaaaggacaaauacugugauuccacuuauuuaagguacuuagggucaugaaauaaaucauagaaacugaaaguagaaugguggcugucaggguuuagggggagagaggaaugaggaguuccuguuucauagauacagaguuucaguuugguaaaaaugaaaaaaguucugaaaaugaauggugguaaugguuguacaauaaugugaauguacuuaaaauagauuaaagucccuauuauucaaaaugagaacacagauacuaauuaacuuuggacuuugauaggucuaucaaguauauuauaauuuauagaaaacuauuuaaaaauagaaagagucuaaaucuucuagaacguaaagcaaaccaccgcccccccccccacacacacacacaaaacaaaacauaacuaauuuuuaaaauacaagaauggguggggcacaguggugcacaccuauagugugcuacuucgaaggcugacuugaggccaggaguucaaggcuguagugcacuauaaucaugccuguaaauagccacugcacuccagccugggcaacauagcaagaccuaucucuaaaaaaaaaaaaaauacaagaaaggaaaaaaagucaagcagaccaaauaaaaagcauaaagaaaaauaguaguauaaaauauaaacagacuaugccuuauaguuaaaaauaaauguagacugaauguaaaaagagaaguauccagauacauacuauuuacuggcaacacauauaaaaugaaaauguccaaaggagcauuguuuaugagagaaaaaaaacuggauacaauccaaacuccaucaauaaaaaguagguagaucuauuuuuaauauuaauacaauaaauacauaaguaaaacuggaugaucucuagcucuaugcaucaacaugaaugaaucucacaaaaauguuaggcaaaaaaaaugcaugccauguaauacauauuguucaguaaccugaaucauuuuucuaaaguucacaauuauauaaaacuuaaaauucagaaaagugguuaauucuaaggcgaaugcaugggaaugggacagaaugggcaaaguggggaacacagaaggcuucggugaugcugauaauagucuauuuuuuaauagaaggugaacauuuggguguuuauuuuaacauuauguuuuuuaacuuaaaugcaucucauauauauuagaccuguguuauaguucuaccucugccacuuaaucucuuugaaccucaaaaaguuuccacauuuauaaaauagaaauauuaacugcucuccuaucuaucucauaggccuaaaguaaagauuaauaucaaaagaggauagugugaaaugaauaaaaauaacacuauuuuucaugauuauaaucauuuaauccagaaaaauauuuagaugaaagcauaucaaaauauuaucaaugcuuauuauugaggaauggauuauggguaauaucaauuucauacuuuucuauauaucucuuaauauaaauaugcauuauuguucaaauuaggaaaaaguuuaaauguuuacauaaauuacauauagauaauaaugaaauauuauuuugaaaagagugauaaccauauaaugcaaauguucaagaguuaaccgugcaaaugaguaucauuauuaguaauuuuauucaaaacugacuaauguuucuagcauaaaggaguugaacuuaggauauaugcacuauuuguaucaguguuuuucaaauugcuagucagaagaaaauuuaugacauaaaacauagaagagaaauuuuaaguuaacaggggaaaaugaucucaaaauagaguaucuucuuuaguguuuauguggauuauugucauuaccaaauuaccaaaggaaagcuuaaaaagaaaaucaacugacaugaauauaggaaacuaugacagagcuggaauacauuaauaaaaaugaaaccuccuccacuuccauuuaaaagcuuugggcucccucuguuggaagucuauauuagagucuugcaauuuaaaauagcaauuugaucccuuucacucaaggcuaauuaccaaucccugcugaguggcuagcuacaauaaaaccuuuauuacuuuuguaaaacauaauuuuaugaaauauuuuucuucuuuuuuuuauuuuuagguacagggucucacucugucacccaugcuggagugcaguggcuugaucaucgcucauuguaaccucuaacuccugggcucaagcaaccuuccagcuucagcuuucuuaguagauaggacuacaggcacacaguacugcaccugacuaauucuuuuuuuaaaaguuuuuuguagagacagggucuugcuaugcuucccaggcugaucuugaacuccugaccucaagccauccuccuaucuuggccucccaaagcacugagauuacagguaugagucaccacacccaagccuauuuucuaauacaauucgguauauauuauuuggaaauuaaauuagacuucuuuacauuagcaguuauaaaguauuucuaaaaaucccaaugggaaguaaaauuuaaaaauacuaaaacauucugcucagucugaccuaaaagggaguucuuaauaaauauuuauaauggaagggcaaaaaaagaaucagaacuucaauuaggaaaguaaucuacagacuuguucaggaauugauagcucaucuaaagcaguacaaaugagaacaguagcuggcugacuuaucuccauauuugggguuaaagaggucuugccagggauaagccaaaacacaggaauuaaacacuaacauauuuugcaaaauaaacuaaaagucuucuauaucaaagauacuauaaagaaaguguaguauagcaaacuugaaaaacaauuuacaauacauauuacaaagagucaauaccuuuaaugagaguuuuuaaaaugaauaagagaugagcacccuaauaaggacaaauacuaacagaaacucauauaagaaauuuuuuaaaacauauucacuaaaaaugauuaaguuuggauaauugucccugaccaaaucucauagugaacuauauccccaugcuagaggugaggccuggugagagguguuuaggucaugggagcagauccuucagggcuuggugccgucuucaugauaagugagugaguucuugcuacaucugguuaagaguguguagcagccuccccacucuuucucuugcuccugcuuucaccaugugaugugccugcucccccuuugcuuuccacugauggcagcagcagcagcccaucuggagcagcugcugcaaagaggccggcugcagugggggaggcacagccgggacugcaaauuccacagagcuggugggagcugggaacaggcagaagccccacccuccuuccaaguuggaggggcgggaguccugccuuccccagcacugcugcagccacauagccacagcugcaaaccugggcauuccuguacucuaaggagcccaggaaggcccccaugcccccgcacacucagaagugucugcucccacugcccagccucuccacucucagugcccacuccaauucuagagcaaaguugaggccaaggcgaggcacugucacaaccuggccagguguacacaugcucggguacacgccagcccccugccaccucagcccccucuggacuuugggggccaaugagcacaggagggaaggggaugcugagggcagcucagugugggccugcaggcaccccucagcaugaacugccugggcacuggggauaggagguugauggcagugggaggcagaccaguuccugggcagaaaggggaguguccccagugaagccccuccuucaggccugggacagccugaagucuggggcccaggcucccaguuccguggaccagagugacaacuuauggugcuuucuccaggcugagccauggcugccuauggaccaauaagcgugcacuuccuacccuccaaaggccauaaaaaccccuggacucagccagacuugggcagauaucaggacuaccugccugcagagagaagcuacccacuguggguccccucucagcugagagcuguauacucgacaggaucaccugccugcaaauaggagcuauccacuucaggucuccugagagcuguacugucacucaauaaaacaccacuuuaccuuacucacccuccaguuguccacauaccuaauucuuccugaacacaggacaagaauucaggacuugccaaguggcaggacuggaagagcuauaauacaaacagggcuaaaaagggugcuacacacucuugccacguugcgggugacuagaagaagagaagacagaaggaaagaagagcuguggcccuuaagggagcccaccuaagaguuccccuagccagggcugugacacccucuuuggggcucugcaguuccuggugucuccaagcuucugggcaccaccucaauccccagugccagcaguggaagccacuugcaguacgacugguccaacugcagucuugugggaagccagcacccgugccagcaccuggagcugcccgucccaccacagccgacaugccuggcugugcacaguggccagacccagcacucacucgcucacacaccccucgccacucugcaccuggcucgccguuggcagguauggaauccgggccaguagugggagccaagcacagccugccaggccaagugggcagaacaagcccagcagacccaaguaaaacucaggcaaagaggucaccagcuggcgaagcaacaccacaaggauccugugacaucaccacgauuguaagcuuccugaggucuccccagaagcagaugcugcuaugcuuccuguacagucuguagaacugugagccuauuaaaccucauuucuuacauacuacccaguauuggguauuucacuaauagcagugcaagaauggccuaauacaaaaaauaaaagacgaaugaaaugaagacaauuuaaugaaaacaauuauauauuuuugccuacggcuuaucaaaaaaaguuuaaucguaacaccuaaucuuguuagaguauaacagauucaaacugaaaggauuuacuagaauaaauauauggagaugugugugugugcauguguguguguauauauacaguauauauauaugugccacuuacugaagcauugacauauagacaaaaaaaauaccuugaaugucuucucaugaggaauuacacauaaguaaaugaagugaacacaccccacaaccucaaagcccacccucagaccccacccaaggacaaggaugaccacuacagcagauuuuggcaaaaggcaggggcuaaaucugccacauuuaggagauuaaacagugcucaguccagcuucaaagccuacaccaaggccccacauaggcagagucuaacgucaacuaugcauuuuuacuuagcaaagcaggugguccuauccaucugaugggcaacuccaccuaaacuuagggccucuccugcaaccccguccaacugcugaacucaaauagcaguaucacacagccagagaauacaucuugugacccucuccaucuaagacaauugcacuaccauccagagcucaaaugaauugcagagcuccuccagugcucucagucgauagcaaagcccagucagcugaccuacccaaacucagagcaaaggcagcagcccagucaucuagagaacccaacagcaaacucugucuaccaaggaucauuaccagcugacacaucuagaauuauaagccagacuaaauggagaagguccaucucugccaaaacuguaaaaacuaaaaaagguagcucuccucaaaugagcagacaacaagacaaggacacaaggaccagaaaaaucaggauaucaagacaccuccaaaauaaaaugagcaaagccgcuaacaacaggaccuugaagaaagaucugugaaaggacagauaggaaauacagaauaauccucuuaaagaacgucagugaacuacaagaauacauggauaaaaaaaaaauuaaugaggggcuucaagaggcugacuagagguaucuggcacuugccuccuccacaauuaagaaccaaaacagcuguuagauaaccaccuaucaaauagagcuccuaaaaaauaacacuguaauucagcagagaacugacagggaaucucucaggcacagaaaaagggaaaugaagcaauuguccuggcuaagaugcacucagagccaggacagacuccuugcugugaagaaaagguaagcaagaaauccccggaaguccauguuccacugaagacucuuguaauccuagguaaaggagagccccuuggcccuggcaggaccugagacuaauaugggggcugccuggaguccacauaacugcacuguucaacagggagagaucaugcuggaucccacacauccccugagacucaagcagcugcaacgcaguaccauuuugagagccuaguuaccaacagacgacaucaugcccugaggcccaacagccccucuauuuccacaucccugaaggccugcuaacauuccccaaauccaccuagaaggcugcagcauugcaagguuggcuggaaccaguaguguggccagauccccagcacucuagcccagacaguauccugcgugccagaaaacaaguagugcaaugcuccaggaagguugcccccaggacaaaaggagucaaagcauguucucccaaagucugagaggugccugccuaggcacuaacagcaacccagcucccuccaggggcagagcugcuacaacaucugcacacaucuucagagggucuggggaccagccuucccagcugacaucccaggcccccagaauaagugucuccuaccuguugcaggcacuagcacaugccauacaggggccuaaaaauaggcaagcccugccaacgccaccaauguuggcacccaaguacaucaucugggagccugggaaucaauggacccuaacaacugcugcugcuggcacccaugugcaccauacaggggacugaguacaugccuucccuggccacugccaccaucaccagggccugagugcaugguucagggaccugggaagcaaccagcccuacccaaugcagccggugcccacaugcacaaucagagagcauaagacuaggucagcccugcucacugccaccauuagcacaugaaugugcuguccagggauuaaaaaaaucaacccaccauaccaacuaccaccaguaccagcacauaccauugagaggccugacaauaggccuaccccacccaccaacaucacaggcagcaugagccauucuggggccugaaaacaggcccaccccacccaccaauaccacugcuggcacccaagugcacugucaacacgucuaaggauuaauccaacccacccauuauggccagagccuugcacacaccacuggggagccugacuagagaccugcccccucacaacuucugcuggcggcacccacacacaucauucagggaccuggggccuucccugcccaccacugcugguguccacagagccaucaugaccaccauugccagcaccacagugcgccauccagaggccugggaaaugacacacccagguugccacagccacugccugugcacuccaucagggagcaugaggacagguacuuccugccagccaccgcuuaagucauuacccccaugauucuuccgggagccugaaaaucaaccugccccaucuguaaccaucugcacacaccaucaguggggcuagaggacaaguccaucuuacccacugccaucacugccaaugagcacauguauugucagggggacuagggaucgacuagggagcacaccaccaauggcuccugcacauggcuucuggcggacugaguacaagccuaccugacaugcacugucugggagccuaggcauaggcccacccagccugcuggcaguuccugcagaugccuccuggaaguucggggacuggcuagcccagccaccacagacacccacuugugcagugcuuaaggaauaaggauugaccagacacagcuacuaccaucaccaaugccacucacacaucacaaaagucuaugaaccaccacugccaccaugacaccugagcaagcccaccugaaggcccaagaacuggcccaccaggaccugccaccaccagcacaacuguuagaagccuggggguccaaggaccagcacauccagccugccaccaccaccacagguaucuaagggccagcuugcuuggagucuccaucucagcagagccucaccacagccuccacuaacaacaaaaaccuaagccacugaggaacacagccaccacugacguugauuauagccaaaaaaauuauacacagacugcaccauaaugcccauucagacagaaucaaagccauagcaucuuacucaagcaacacuauauauacacaucuacaggaaaaaguuucccuacaaaagcuaauacauaaaauuggaagaaauaacuguucaaccagaugugcagauaucaauguaagaacauaagaaacaugaaaaaggaaacaugacauguacaaaggaauauaauaauucuccaauaacauauuucaaugaaaaggaaauccauaaaauaucugaaaaagaauucaaaauaaugauuuuuuuaaacugagagagauauaagagaacacaaauaaauaauaugaagaaauuaggaaaacaauucaggaucugaaggggaaauucaggaaauaaauagauauccagaaaaaaaaaagaacuaaacagaaauccuggaacuuaagaauccaauuaaugaaacaaaaaauacaaucaaaagcuucaacaauagacuagaccaagaagaauuucugaacuugaagacagaucuucugaaaaaacagacacauaaaaaaagaaaaaaagaauuaaaaaaugaagaaagccuacaugacauauaagacaucauaaaaugaccaaauauuccauuuucaaugucccagaaggcaaagagaaaaaacaaagggauagaaaacauacuucaagaaauaauagcugaaaacuucccaaguugagcaaaagauuuauuuuuauuauuuuauuuuuaauuuuuacuuuuuuagagguggggucucccucagccacccaagcuagaguagaguggugcaauccuagcucacugcggccuugaacuccugggcucaagcaauccucccaccucagccuucaaauccagcaagagauuuagacauacagacacaggaaauacagagauccucaaauagauacaauacaaaggucuucuccgcagcacaucauggucaaacuaccaagucagagacaacaagaaaauucuaagaacagcaaaagaaacaugucuagacacuuauaagagaaucuccaucaaacaaacagcagauuucuccacagaaaacaugcaggccagaagagaaugagaugauauauucaaaguacuaaaagaaaaaaaaaacugccagccaaggauaccauaccuagcaaaguuauccuucauaaaugaguaagaguuuuucccagacaagcaaaagcugagggaacucuucaccacuagacaggcccuacuuacauuaaaugcuuaagaaaauccuacacccagaagcaaaauggcacuaucuaaaauaaugaacauaccuaaaaguacaaaacuaacuguugaacagauauacaaaugaaaaugacaaaggaguugaacacugucacuacagaaaaccaccaaacugaagugauaaaugauaaaaguggaagaaagaaaaaaaggauauacaaaacacccagaaaacaauuuacaaaaugcaggaguuaaguccucaucuauuaauaauagccugaauguaaaggaauuaaauugccaacuugaaauauaugagccaggcacaguggcucaugcuuguaaucccagcacuuugggaggcugaggcggguggaucaccugaggucaggaguuagagaccagccugaccaauauggugaaaccccaucucuacuaaaaauacaaaaauuagccaggcaugguggugggcaucuguagucccagcuacuugggagucugagacagaagaacugcuugaaccugggaggcggaaguugcagugagucgagauugugccacugcacucuagcuugggcaacagagcgagacucugucucaaaaaaaaaaaaaaaaaaaaaaaacccagaaagacaugaacuggcugaauccauuuuuuuaaaaugacccaauucaacuguaugcucccuacucacgucaccaauaaagacauacauugaccgaaaaaaaaaaaaaaauacauuccacacaaauggaaaccaaaagcaugcaagagcagcuauacauacaucaaacuuuaagacugcuuucgguuuccauuugcaaauuuuaagucaugcuuuugguuuccuuuuguagacuuuaagucaaaaacuguaaaaagagacaaagaacuacauuauauaaugauaaagagauaagcuaagaggauauaauuccaaauauacaugcacuuaauauuagagaacacagaaauauaaagcaaauauuauuagaucuaaaagaagagacagacuccaauacaaaaauaaugggggauuucaacacccuacucucagcaguggacagaucaucaagacagaaauugaacaacaaaguaucagacuuaaucuacacuauugaucaaaugggccuaacagacauuuacaaaacauuucacccauggcugcagaauauacauucuucucaucagcauauggaacauucuccaggauagaccauauguuaagacacaaaacaaaucucaauaacuuuuuaaaaaucaaaaucauaucaacuaucuucugagacugcaaugaaauaaaacuagaaaucaguaacaaaggaacuuuagaaacuguacauggaacuuaaacaacaugcuccugaagaaccacuggaucaagggaaaaaauaaaaaauaaauuuaaaaaguauuaaaacaaaugaaaacagaaauacagcauaccauaacauaugggauccagcaaaagcagugcuaagagggaaauuuauagcaguaaacaccuaaaucaaaaaguagaaagauuucaaauaaacaaccaaaugaugcaucucaaaaaacuagaaaagcaauaacaaacuaaacccaaaauuaguagaaacaaaaagauaauaaagucauagaagaacuaaaugaaauauaguaagaaaaauuaaaaggaucaacauaauaaaaauuguuuuuuaaagacaaacaaaaaucacuggcuacaccaaccaagauuaaaaaaaaaaacaagaaagaacacugaaauaaauacaaucagaaacaaaaaaaggaggcauuaaaacugauaccacagaaauacaaagaauaauuagaggauauuaugaacaaguauaugccagcaaacuggaaaaucucaaggaaacugaaaaauuccuagagacauacaaccuacaagauugaaucaggaagaaagagaaaaccugaacauaccaguaacaagcaacaagaucaaagcaguaauaaaaggucuaucaacaaagaaaagcccaggacuggacgguuuuauugcugaauucuaucaaucuuauagagaggaacuaacaccaauucuucucaaaccacuccaaacaacuuaagaggaggaaauuuuaucuaacucauucuacaaggccagcacuacccugauaacaaaacuauacaaggacaugagaaaaaaaguucaggccaauaugagcaacacagaugcaaaaauccucaacagaauacuagcaaacagaauccaaccacacaucaaaaaagauaaugcaccaugaucaagugagauuuaucucagggaugcaagacacacacaaaucaauaauugugauaccucauauuagaacgaagggcaaaaaccaugugaucaccucaacagaugcaaaaaaagcauuugauaauauucaauauccccccaugauaaaaacccucaaaauaauaggcacagaaguaacacacugcaacaugauuaaggcccuauaugacaaauccacagccaaauuauacugauugaauaaaaucuggaagccuuuccucaaagaacuggaacaagacaaggaugcccaccuucacgacucuuauucagcacaguccuagaaguccuauccagagcaauuagguaagagaaagaaauaaagggcauccaaauuagaaaagagauagucaaauuaucccucuuuccagaugacaugaccauacauauagaaaaaccuaaauacuccauccaaaaacuaauaaauucauuaaaauugcaggacacugaaucaacauagaaaaaucaguagcauauaccagcaacgaacuagcuggaaaaaaaauaaaguaauuccacuuagaauagcuacagaauaaaauaacuacgaauaaauuuaaccauagaguugaaagaucucuaaauuggaaauuacaaaacaccaaugaaagaaauuaaagaggacauaaacaaauggaaagauaucccaagcucauggauuagaacuaauaguguuaaaaugaccauacuucccaaaguaaucuacaaauaaaaugcaaucccaaucaaaaugccaaugauauucuuccuagaaacagaaaaaccaauccaaaaauucacauggaaccacaaaagacaccaaauaaccaaagcaauacugagcaaaaagaacaaugcuggaggcaucacacuaucugacuucaaaauauauuacaaagcuauaguaaccaaaacagcaugacauugguauaaaaauagcuggguguggugguacacaucuguagucccagcuauucaggaggcugaggagggaagauugcuugaagucaggaguucaaggguacagugagcuaugaucauggacugcacuacagucuggaugacaaagcaagaccccaucucuuuaaaaaacaaauacauagaccaauggaacagaauagaaaacccagaaauaaauccccauauuuagagccaauugacuuucaacaaaggcaccaagaacauauacugcaaaaggauacccucuucaauaaauguugcuggaaaaacuaaauacccauaugcagaagaaugaaacuauaccccuauuucucaccauauacaaaaaucuacucaaaauggguuaaaaauuuaaccauaagaccugaaaauguaaaauuuccaaaacaggggaauaacuauaugacauuggucugagcaaugauuuuuuagauuucacccaaaaagcacagguaacaaaagcaaaaaacagacaaaagggauuacaucaaaauuaaaagcuuuuguacaaccaaugaaaucauuuucagaguggagagacaaccuauagauugggagauagucucaaaucauacaucucacuagggauacguacauaucuaaaauauguaaggaaacucaaacaacucuauaaaaagaaaacaaauaauccaauuuaaaaaauggguaacagaaugaauagacauuuaucaaaagaagauauacaaauguccaauagacauaugaaaaaaugcucaacuucacuaauuagggaaauauaaaugucuuagucuguuucguguugcuguaacugaauaccugagaccagguaauacaauauaaugaauagaaauuuauuuagcucacaguuaaucaagcugaaaaguuugagacuggguggcuacaucuggcagcuucuagugagggcuuccugcucuucauagcaugguagaaaaguguaagaggaagcagaagugcgcaaaaagacuaaauaggacaaacagguuuauaacaacucauucucacggguacauaugguauuugguacaugcacagaauguguaaugaucaagucaaauuaucugggguauccaucaccucaaguauuuaucauuuccauguguugggaacauuucaauuccucucuucuagcuauuuuaaaauauacaaugcacuacagucacccuacucugcuacuggauauuaaaacauauuauuucuaacuauauaguagccauuaaccaaauucucuccauugccccccaccacacauacacuucccagccucuaguguuuauaauucuacucucugccucuaugagaucaacuuauuuaagcucucacaugugagagagaacauccaacauuuaucuuucugugccugucuuauuucauguaaugaccucuaguuccauccauguugcugcacaugacaggauuucauucuuuuuuauggcugaaugguauuccauuguguauacagacaccguauuuccauuauccacugaugggacacuuaaguugauucuguaucuuugcuauggugaauaguacugcaaaaaaacaugguaggugcauguaucucuuugguauauugacuuccuuuccuuuagauaaauacuaguagcaggacuacuggauuguacagugguucuauuuuuauguuucuuuuuaaaaauuuuuuuuuuuuuugagacggagucuggcucugucgcccaggcuggagugcaguggcgcaaucucggcccacuguaagcuccgccucccagguucacgccauucuccugccucagccucccgaguagcugggacuucuuuuuaaaauuuguuuuuuucuuuuuuguuucuuuuuuuuaaucuauuuuaguuuucugagaaaucuccauacugcuuuccauaauaguuacaccaauuuacauucccaccaacaguguaugagaguucccucuucuccacauccuugccaacaucugcuauucuuugucuuucuaaccgccauucuagcuaagguaagaugauaucucauuguaguuuugauuugcuuuucccuuacacuuagcaaugcugggcacuguucacauaccuguuugucauuuguaugucuuuuuuugagaaaugucuuuuuaugucacuugcacacuuuuuagugggauuauuuguuuauuuuuacuguucaguuguuuggauuccucauauauucuggguaucagucccuucuuggaugaauaguuuacaaacauuuucucccauucuggaaguugucucuuuacucuguugauggguuggcuccuuagcugugcagaagccauucagcuuaauauagucucauuuauguauuuuuuguuguugccugugugaggucuaagucaaaaaaucuuugccuagaccaauguccacaagcauguccccuauguuuucuuccagcaguuuuauaguuucaggucuuacguuuaaaguauuuaauuuaucuuggguugauuuuuuauauguggugagagacaggggucuaguuucacucuucugcauauuuucccaggaucacuacugaagaggguguccuuuccccaguguauguucuuggcaccuuuugcugaaaaucagcuggcuguaaauauauggauuuauuuauagguucucuguucuguuccguuggccuaugggucuguuuuuauaccaugcuguuuugguuacuauagccuuguaauauauuuugaagucagguaguguaaugccuccaguuuuauucuuuucacucaggacugcuuuggcuauuugggcucuuuuuuaauuccauaugaucuuaggguuaagauuaacaaauucaucuuaagggaagaaagaacuaaagcuugguuuaaggaguucaguauuugcuaaauuaaauggggaggcuaacaaagccauaacaauugcuuuggcagcaauggugaugacgauaaguggacucaggaacacauguuggcacccucauuguagaagauuucaguaacaucaacuauaguaauauccuuuuauaauacuucugauaucagcaccaauaagagagacacaaaaauaaugacuaacuuuuaauaaucaccuacuaacuuccuggcauuauacuugggacuuuacauggaucaucuccuuauaucugcacacuaacccaauaagguguguauuauuaucccugcuuuaaagacacgguaagaaaccuguccaagguaagucaguguauuagcaguauagcuaauaucuuaauccagaugucuggcuccaaaguucaugcuuauuccaaauacaugaaucaaauaaaauugucacuaagggaaugaauuuucaagguccacaucaaaaccaccuggaaauuccacaucuauuuagaaaggauuuaaaggagagcuaguguucccacugaauaguuuuggggaaugaccagaaauauuauaccuauuaauauuauuaaaccuuagccccagaauggcauaaaggcagaagcguacagauuacaauuugauuguuucauacaaucuucaaaagugugauuuuucuuaacaacauaaaugugcacugacaucaucugaguuccaugggcaauggcacaucauaaguuuuuucuuuuaaucuuuuucuuuuuuuuuugcucaucauuugacuuaaagcucaaucaucacaacuuuuucuccaacagaaaguaccuuccuuaauauuuucauuuauuuuaugggcucaaagaauucucagaagugagauuuaaaagaaaagaaaaauaacauuuuugugagguacauagggcauucaaaauuacuucucuguuuacaacucagaaaacugaauuuuacauuaaaugacauaagcauuaacccaagagcaaaaaauuuaguauacauugagcuaaguccuagguauaaaugcaaauaagacacaauaccucuucuucucaaggagcucaugguauagcagaggagguggaaauaaacagcuauacugcaacguggauagguacuuuuguuguuguuguuauuguuuuuuguguguuuuuugagaugaaauuuugcucuuguugcccaggcuggagugcaauggugcggucucagcucacugcaaccuccaccuccuggguucaagcaauucuccugccucagccucccaagugguugggauuauaggccccugccaccacgcccagcuaauuuuguauuuucgguagagacaagguuucaccauguuggucaggcuggccucgaacuccugaccucagaugauccacccgccucagccucccaaagugcugggauuacaggcgugagccaccauacccggcuguuguuuuugagacagagucuugcccugucacccaggcuaggaugcaguggcuaucauagcucacugcaaucuugaauuccugggcucaagcgauccucccaccucagccucccaaguagcugagacuacaagcaugcaccaucacaucuggcucauuuuuuucauuuuuagcagaaacaagaucucacuaugccuccuaggcuggucuugaacuccucgccucaagugauccucgugccucagccucccaaagggcuaggauuauaggcaugagccacuugauagauacauaggcaugagccacuugauagauacauuacuaauuuccccaauuacacauuaaauuuaguaacugaauaaugccacugaaauucucauuuuggggggaaaacuuagcaagagaccuaauaaaauauaaaguuaaaauugucguuacugauucacuaaguagaaccuaggugaaaauauuuuccaaaagaagaaaaauucaagaauucauagaaaauaaagaguuuuaaauaauaaaauuuguuguagauauuuaaaaaggcaacuauaaguacuauuuaauguaauuaggcuuacaauagaaauacaaaccagaaguuagcuuuggauaguuuggggggaaaaaaauuaggauaaucaacuuuucaucuauauaaaaaguauccuacaggcugaacacagaaaauaaaaagagaagcuucagaagcuuguagcaaauggaaguuuauaaaucuaacagaauguacuaacugaccaucccuagcuuugugccacagauuuuuucuuauuuccaguccacacacaauccucuccuagagcuuaaaacaaaggcaacuucagaucugcauuucucuuauuggcacaacaagcuacauuugucaauggaauucagcuuuuccauuuguuaauggaaaaucucaaaccauuuuuuuaaggaauguguucagccauucauucaaaaacuauuuacugagcacuaaguacuaguuaaaauucuagagucugaauauaaaaauaacggacaaggccgggggcaguggcucacgccuguaaugccagcccuuugggaggcugaagcaggcagaucacaaggucaggagaucgagaccauccuggcuaacacggugaaacccugucucuacuaaaaaauacaaaaaauuagcugggcgugguggcacgugccuguagucccagcuacuugggaggcugagguaggagaaucgcuugaaccugggaggcagagguugcagugagccgagaucaugccacugcacuccagccugggcgacagaacgagacuccgccucaaaaaaauuaaaguaaaacaaaauaacagacaagacugaauggguagauggauagauggacaaauagaacagaaaaagagagggcaauagacuaaugucagaggaauggauuucaauuacaccagacaaacugggauacugaaauagguuaccagauuuucauuaagugucuguauccauuuuuccaaaauacaaguaugguggccagugcuucugaaacacauuauuagccauggacuguugguuccaauagccauuccagccacccggggagaaaaauaauaccagcuaucagagcacauuuaccucacauuuagcaauaauguaucugugaaaaagaacagggaaggauacauaaaaauaaauauaauuauuuugaguaaaguuaucacuaaacauaccuuucagauaaauaacagcucuugugaggguuuagauuuugauaagauucuaggcugccaucagaugaugaagaaaguugcucugauugcaaguugucuguaucacucaaacuucccucaguuacaggugggguccuuauguauuuucuuccuaacuccguucccaggacauucgucaauauaacucuggguauccugucacauagaauaacaaacacuguacuguacugaaguuuucaguuaaaaaaaaauguauuccaggaaggugaauuuucaaucauugccaucuuagcacaagaaagcuguucgaacuacaccacccuagaaauuaacccauaaauacuuaaaaauuuagaaaaacacaaucuuuugguuuauagaagcacuuguuucuuaucacuuauaacauagauuagccugccacuacaauaucuuuaauuauacuaauggaugccauugagaggcuuaaaauuuuaacaaauucuucucuaaaaaugcuuucuuuccuuuuccagaaauuauuaaaaacacagcuuacuacaaaucaauucaagaaaucuuuguucuucucauuuaacagaaaugucuuugauaaguaauuuacauacuugcaauugggaaaugacaaauaauaaauccaacaagacaucauucagauugcaucucugguaaugaaagauuccguaacugaaacagcacauauaauggugauaacauauaugcuaauauguaauagcaucaggaaaagagucaauacauuuaaauguuuagaaaauuaaaguuuuuguuuaguugguuuuucuuuuuugagacugcagugcagugacacaaucacagcucacugcagccucgaucuccuggcccaaguaauccuccuaccucagccucuuaaguagcugggacuauaggcacaagccaccacgcccagguaacuuuuuuauuuucuguagugacuaugucucauuauguuguccaggcugguuucaaacuccugggcucaagcaauccucccacuucagccucccaaaauucugagauuacacgugugagccacugcaucuagccuggacuguauuuuuaagucuccagaccuuaaauuggugaguuuuauaucaaaugcacuauauaagccugauaucuucuuaaacagaagauguacauuugauauauaaagaaguacauuugguauaaaauuagugcaauauuuacucugcuggccagucauuauuaugaacauuacuuugccacacuacaauaaugccuucaauauugauauucagcccagaauucacuggcccaagccaaauuauugugauuuuuuuaaguuccuguuauguaauuuuaaaguuuuccuaacuccucuuuauuagaugcccaguugacuguuaucaauaugccacuagcaauacuuuacuuauacuuuguuuguaagaaacaauauauagaaagagccagaguacgagcauaccucauuuuauugugcuucacuuuacugcacuucacagauacuguguuuuucacaaaugcaagguuuguggcaaccuugaguagaacacaucuaucagcaugacuuuuccaacagcaugugcucacuuugugugucugugucacauuucgguaacucucaaaauauuucaaucuuuucauuauuauuauaucuaguaugaugaucuguaaucagugauauuugauggcacaauuguaauugcuuugaagcaccacaaaccaugcaugcauaagacauugaacuuaauuaacaaaugcuguguguguucugacugcuucaccuaccaaccauuccccuaucucucucucucuccucaggccuccucccuauccccugagacacagcaauguugaaauuaugccaauuccagcacuaccauggccucuaaauauucacgugaaaggaagagucucaaguuucucacuuuaaaucaaaagcuagaaauggcugggugugguggcucacaccugcaaucccagcacuuugggaggucaaggugggacaaucacuugaggccaggagacugaggccagccugggaaacacggcaagacuccaucucuacaaaacauaauuaacgagccauccagccauggcaguacaugccuguaguccgagcuacuugggaagcugagagaggagcaucacuugaccccaggaguucaaggcugcagagagcuaggauugcgccaccucuguuugccugggaaagagagcaaguccuugucucaaaaaaaaaaaaaaagaacuaaaaauuacuaaaccuaguguggaaggcauguugaaagcugagacaggcugaaagcaagacugcuugcugcagagucaaguugugaaugagaaagaauaguucuugaacaaauuuaaaagugcuacuccuggccaggugcaguggcucacaccuauaauccuagcacuuagggaggcugaggcaggaggaucacuugaggucaggaauucaagaccagccuugccaacauggugaaaccccgucucuacuaaaaauacagaaauuagccaggugugguggcaggcaccugcaaucccagcuacucgggaggcugaggcagaagaaugacuugaacccaggaggcugaaguugcagugagccaagauacugccacugcauucuagccugggcgacagagcaacacuccaucucaaaaaaaaaaaggaaaaaaaaggaaaaaaaagugcuacuccuaugaacacacaaauaauaagaaagcaaaacagucuuacugaugauauggagaaaguuauaguagucugaauacaacaucaaaucagccacagcauucccuuaagccaaagccuaacucagagcaagauacucucuucaauucuaugaagacugagagagguuaggaagcugcagaagaaaaguugguuuacaagcuuuaagaaaagaaguugucucagccugagcaacauagugagacccugucucuacaaaaaauagaaaauauuagcuuaguaugguggcaugcaccuguagccucagcuacucgggagacugaagugagaggaucacuuuagccugggagaucaaggcuguagugagccaugaugacgcuagcugggaggucaaagcugaaaugagucaugcugggcaacagaaugagacccugccucaaaaaaaaaaaaaaaaaacuaucuccauaacaugaaaugcaaggugaagcagcaaguacugauggagaagcugcagcaaguuauccagaagaucuagcuaagauaagugaugaagguggcuacacuaaacaacagauuuucaauguagaugaaagauccuucuauuggaauaaaaugacaucuaggaauuccauaccuagaaaggaaaagucaaugcauaaguucgaaagacaggcugacucucuuguuaggggcuaaugaagcuggugucuuaucugugaagccagugcucaauuaccaugcaaaagauccaauggcccuuaagaauuaugcuaaauugggccaagcaugguggcucaugccuguaaucccagcacuuugggcggcagaggccggcggauaacuugaggucaggaguucgagaccagccuggccaacauggugaaaccccaccucuacuaaaaaaaacaauuugccaggcaugguggugcacaccuguagucccagcuacuucagaggcugaggcaggagaaucgcuugaaccugggaggcggagguugcaaugagaucaugccacugcauuacagccugggcgacagagcaagacuccgucucaaaaaaaaaaaaaaaaaaaugcuaaaucuacuuugccuguacucuaaaaauggaacuacaaugucuggaugacuggaugacagcacaucuguuuacagcguggaucacugaaucacuuaacaccaucuuugagaacugccacucagaaaaaaaauaaauaaaauuccuuucaaaauauuacagcucguugacaaugcaccuagucacccaagagcucugauggggagguacaagagaauucguguuguuuucaugccugcuaauaaaacauccauucuauagcccauggaucaagaaguaauuucaaguuucaagucuuacaauuuaagaaauacauuucauauagcuaccacaaacagugauuuccucugaugggucugggaaaaguaaacugaaaaucuuccggaaaggauucaucauucuagaugccucugcauaaaacaacaaagguaacaaaguacagugaaguucacauuuucacuuaaacaaaaguauacgcauauacuuggagacagggccaguucaguuccagacccccgccauaaagugaguaucacaauaaaacacgucacacaaauuuuguggcuuccuagugaauauauaauuauguuuacacuauacuguagucuauuaagugugcaauggcacuaugacuaaaacaaugcacauccccuaauuaaaaauuuuacuauuuuucccuacauaaagacacuauguucauuucauuauguuccagacagcauaaaauuuuagauccuuggagaacuuuaaaauaaauuaguccucucuuuauuguaaacaugaagaacccaacgcucagaaaaguuaaauaagcugcccaaguauaaguagcuuuccuaguggaagaaccugggccuguuaucuuuggggguuuuuugucuguccuauuacauuauacuacauccucaaugcuaauuugccaaaggauuccagauaacugagauugccaacagauacuucaggaaacucuugaaaauauccauuuauaccauaaucagaauaaaaagugcugcaacaacuaucuagaaaacccgauagucucagcacaaaagcuccuucagcugauaaaacaacuugaacaagguuucaggauaaaaaaaaucaauguacaaaaaucacuagcauuccuauauaccaacaacagccaaguggagaaccaaaucacaaaggcaaucucauucauaacagccacaaaaagaauaauauaccucugaauacagcuaaccagggaggugaaagaucucuauaaggagaacuauaaaacauuacuuuaaaaaaucagagaagacacaaacaaauggaaaaacaucccaggcucauggauagaaaguaucaauauuaaaauggccauauaucccaaagcaauuuacagauucaaugcuauuccuaucauacuaccaacaacauucuucauagaauuagaaaaaacuacuuuaaaauucauauggaaccaaaaagaaccccauauaaccaaggcaauccuaagcaaaaagaagaaaacuggaagaaucaccuuacaucccuucaaaccauguuauagggcuauaguaaccaaaacagcaugguacugguacaaaaauaaacacacagacuaauggaaaagaauaaagagcccagaaguaauacuacacaccuacaauucugugaucuuugacaaaccugacaaaaacaagcaauggacaaagggcuccauauuuaauaaaugaugcugggaaaagaacuagccauaugcaaaaaauugaaauugaacccgauuuuuacaccauauauaaaaauuaucucaagauggauuaaagacuuaaauguaaaaccuaaaaguauaaaaaaccuagaagaaaauuuaggcaauaccaugcaggacguaggcaggcacgggcaaagauuucaugacaaaaaugccaaaagcaauugcaacaaaagcaaaaauugacaaaugggaucuaauuaaacuaaggagcuucugcacagcaaaagaaacuaucauuagagugaacagacacccuauagaaugggagaaaguuuuugcaaucuauccaucuaacaaaugucuaauuuccagaguuuacaaggaacuuaaacaaauuaacaugaaaaaaagcaaacaaucccauuacaaagugggcaaaggacaugaacagacacguuucuaaagaagauacacaugcagacaauaaucauauuuuaaaagcacaacaucacugaucauuagagaaauaaaaaucaaaaccacaaugagacgcacagugagaaaacaaugugaagagacacagggagaagacagccaucuacaagccaaagagagaggccuggcacaggcguucucucacagcccucaaaacaccuugauuggauuucuugccuccagaauugggaacaaaaggggauaaugguggaugggaggcagacuagauugcagcucugacucgacagacagagcagcauguggaagcucgcaucgugaauuuuugcuccagaacaacugcaggaauaaaucaggaagccuaagaggacccacacaccuccugaaggaagcagaguacaccagcaugacccaggacaccccaaauacuaugcugguauccauggcugagagacccauagaugguucaggucacaagacucugugcagacaaccgccaguaccagcccagagccugguagaauagcuggguggcuagauccaaaagaaagauaacaaucacuacagcuccgcucucaggaagccacauccauaggaaaagggcgagaguacuauaauaagggaacaccccaugggacaaaggaaucugaacaacagccuucagcccuagaccuucccucugacagagccuacucaaaugacaaggaaccagaaaaccaacucugguaauaugacaaaauaagguuaacaccucugaaaaaucauacuagcucaccagcaauggacucaaaccaagaagaaaucccugauuuaccugaaaaagaauucaggagguuaguuauuaagcuaaucagggaggcaccaaagaaaggugaagcccaguguaaggaaguccaaaaaaugauacaagaggugaagggagaaauauucaaggaaauagauagcauaaauaaaaaacaaucaaaacuucaggaaacuuuggacacacuuauagaaaugcaaaaugcucuggaaagucucagcaauagaauugaacaaguggaagaaagaaauucagagcuugaaaacaaggucuucaaauuaacccaauccaacaaagacaaagaaaaaagaauaagaaaauaugaacaaagccuccaagaagucugggauuauguuaaaugaccaaaucuaagaauaauagguguuccucuuuuacacuguuggugggacuguaaacuaguucaaccacuguggaagagaguguggugauuccucaaggaucuagaacuagaaauacuauuugacccagcaaucccauuacuggguauauacccaaagaauuauaaaucaugcuacuauaaagacauaugcacacauauguuuauuguugcacuauucacaauagcaaagacuuggaaccaagccaaauguccaucaaagauagauuggauuaaaaaauguggcacauauacaccauggaauacuaugcagccauaaaaaaggaugaguucauguccuuuguaggcacacggaugaagcuggaaaccaucauucucagcaaacuauugcaaggacaaaaaaccaaacaccgcauguucucacucauaggugggaauugaacaaugagaacaccuggacacaggaaggggaacaucacacaccagggccuguuguggaguggggggaggggggaaggauagcauuaggagauauaucuaauguaaaugacgaguuaaugggugcagcacaccaacauggcacauguauacauauguaacaaaccugcacgugugcacauguacccuaaaacuuaaaguauaaaaaaaaaaaaagaauaauagguguuccugaggaaaaagagaaaucuaaaaguuuggaagauauauuuuggggaauaauugaggaaagcuucccuggccuugcuagagaccuagacauccaaauacaagaaacucaaagaacaccuggaaaauucaucacaaaaagaucaucaccuagucacauugucaucagguuaucuaaaguuaauaugaaggaaagaaucuuaagagcugugaggcaaaagcaccagguaaccuguaaagaaaaacuaucagauuaacagcagauuucucagcaaaaacccuacaagcuagaagggacuggagcccuaucuucacccuccucaaacaaaacaauuaucagccaagaauuuuguaugcagcgaaacuaagcuucauauacaaaggaaagauacagucuuuuucagacaaacaaaugggaagagaauucgccauuaccaagcacuaaaagaacugcuaaaaggagcucuaaaccuuaaaacaaauccuagaaacacaucaaaacagaaccucuuuaaaacauaaaucucacaggaccagcuauucuuauaucagacaaaacaaacuuuaaagaaacagcaguuagaaaagacaaagaggggcauuauauaaggacaaaaggauuaguccaacaggaaaauauaaacauauaugcaccuaacacuggagcucccaaauuuauaaaacaacuacuaauagaccuacgaaaugagauagacagcaacacaguaauaguaggggacuucaauauuccacucacagcacuagacaggccaucaagacagaaagucaacaaagaaacaguggauuuaaacuauacacuggaacaaauggacuuaauggauauauacagaacauuccauccaacaaccgcagaauauauguucuauucaacagcacauggaccuuucuccaagacagaccauaugauaggccacaaaacaagccucaauaaauuugagaaaacugaaauuacaccaagcacucucucagaccacaguggaauaaaacauggaaaucaacucuaaaaagaaccuucaaaaccaugcaaacacauggaaauuaaauaaccugcuccuggugaucacugggucaaaaaugaaaucaagauggaaauuaaaaaacuuuuccaacugaacaacaauagugacacaaccuaucaaaaccucugggacacagcaaaggcgaugcuaagaggaaaguucauagccuuaaaugccuacaucagaaagucugaaagagcacagacaaucuaaggucacaccucaaaaaacuagagaaacaagaacaaaucaaacccaaacccagcagaacaaaagaaacaagcaagaucagagcagaacuaaaugaaauuaaaacaaaaaaaauacaaaagauaaaugaaacaaaaagcugguuuucugaaaagagaaauaaaauugauagaccauuagcaauauuaaccaagaaaagaggagagaaaauccaaauaagcucaauaagaaacaaaacgggagauauuacaacugacaacacagaaauacaaaagaucauucaaggcuacuauaaacaccuuuauacucauaaacuagaaaaccuagaagagaagaauaaauuccuggaaagauagaacccuccuagcuuaaaucgggaagaauuagguacccugaacagaccaauaacaagcagugagauugaaaugguaauuuaaacauuaccaacaacaaaaaaaagcccaggaccagacggauucacagcagaauucuacuggacauucaaagaaaaacugguaccaauccuauugacacuauucgacaagauagagaaagagggaaccuucccuaaaccaucccaugaagacagcaucaccuuaauaccaaaaccaagaaaggacauuaaaaaaagaaaacuacagaccaauaccccugaugaacacagaugcaaaaguccuuaacaaaauaugagcuaucugaauccaacaacaugucaaaaagauaauccaccaugaucacauagguuucauauuaggaaugcaaggaugguuuaacauacguaagucaauaaaugugacacaccacauaaacagaauuaaaaacaaaaaucccaugaucaccucaaucgaugcagaaaaauauucaacaaaauccggcaucucuuuaugauuaaaacucucagcaaaaucggcauacaagggacauaccucaauauaauaaaagccaucuaugacaaacccacagccaacauaauacugaauggggaaaaguugaaagcauucccucugagaacuggaacaagacaaggaugcccacucucaccacuccucuucaacauaguacuggaaguccuggccagagcaaucacacaagagaaaaaauaaagggcauccaaaucgauaaagaggaugucaagcugucccuauuugcugacgcuaugaucauuuaccuugaaaacccuaaggacuccuccagaaaacuccuagaacugauaaaagaauucgguaaaguuucuggauacaagauuaauguacauaaaucagcagcucuucuauacaccaacagcgaccaagcagagaaucaaaucaaaaacucaaccccuuuuacaauagcugccaaaaaauaaaaauaaaauacuuaggaauauaucuaaccaaagagucaaaaggccucuucuacaaggaaaacuacaaaacacugcugaaagaaaucacagacaacacaaacaacuggaaacacaucccauacucauggauggguagaaucaauauugugaaaaugaccauauugcuacaagcaaucuacaaauucaaugcaauuccuaucaaaauaccgccaucauucuucacagaauuagaaaaaacaauuauaaaauucaaaugaaaucaaaaaagugccugaauacccaaagcaagacuaagcaaagagaacaaaucuacaggcaucacauuaccugaucucauaccauaaggccaaagucaccaaaacagcaugguacugauauaaaaauaaacaccuagaucaagggaagagaauagagaacacagaaauaaacccaaauacuuacagccaaguggaucuuugacaaagcaaacaaaaacauaaagugaggaaagaacacucuuuucaacaaauggugcugggauaauuggcuagccacauguaggagaaugaaacuggagccucaucucucaccuuguacaaaaaucaacucaagauggauuaaggacuuaaaucuaagaccugaaucuauaaaaauuuuagaagaugacauuggaaaaacccuucuagacauuggcuuaggcaaggauuuuaugaccaagaacccaaaacaaaugcaauaaaaacaaaguuaaauugcucggaguuaacugaacuaaagagcuuuugcauaccaaaaggaacagucagcagaguaaacggauaacccacagagugggaaaaaaucuucacaauguauacaucugacaaaggacuaauauccagaaucuauaaugaaugcaaacaaaucaacaagaaaaaaacaaacaaucucaucaaaaagugggguaaggauaugaauagacaauucucaaagaagauauacaaauggccaaaaaacauaugaaaaagugcucaacaucacaaaugaucagggaaaugcaaaucaaaaccacagugcgguaccaccuuauuccugcuagaauggccauaaucaaaaaauaguagauguuggcauggaugugaugaaaagggaacuuuucuacacugcuggugggaauguaaacuaggacaaccacuguggaaaacagugcggagauuccuuaaagaacuaaaaguagaaccaccauuugauccagcaaucccacuccuggauaucuacccagaggaaaggaaguauaggaaaaagcuacuugcacacguguuuauaggagcacaauucacaacugcaaaaauguggaacuaacccaaaugcccauccaucaacaaguggauaaagaaaccaugguauaggccgggcacaguggcugacgccuguaaucccagcacuuugggacaccaagauggguggaucaccugaggucaggaguucgagaccagcuuagccaacauggcaaaacuccaucuacuaaaaauacaaagauuagccgggcaugguggcacacaccugcgaucccagcuacucgggaggcugaggcacaagaaucacuugaaccuggaaggcggagguugcagugagcagagacugcgccacugcacucuagccuggaugacagagugagauucugucucaaaaauaaaauaaaauaaaauaaaauaaaauaaaauaaaauaaaagaauuagauaugguaucuguagcaaaguccaauuccuacuuuacugaugacaaaaauuaaaguucagaagggugaaaaugcaaagagaagcaguauggcacaggaauuaacagcaaggacuuugaaguuagaccaacauagguuuggauucuuauuuuaccaccuuauaacuauaaauccuugggcaaguuaauuaccauaauuucuaccucuacacauugaucuucucaucucuaaaaugggaagaauaauaucucccuuacaaaguuguuaagauucaaugagauaauagauggaaagcaguuagcauaauuccuggcacauaguaaauacacaauaaauggaauaucacuuaauuuucauauuucuguaauaauuuucauauuauuguagucuugcucaaagcuauaaacuacccuuucaaauaauacuuauaauuuacuaugcucugcaaucuugauaaaaaaucuuauuagauguuugcaauuuucaauauacaauuaaaguauauaauuaaacaguuagcaaugacuacaguacacauagcucuucauagcacacagccacagcccaaacaccuuucaucaacuauugaaaacuuauccaguuuggguacccugaggaaacaaggaacuuugugugauaggcuugaagaacacaaaucuauaaacugagagcuaaauuaacaauaccuagcugucuuuugcaguacagguuuauaaauuagcacagucaaggacauuccagggcuagccagcauuucagaaguucugaauuucugcaaggaauugaaguauauaaagguguauacuucaucuuucauacuaucugaaucuggaaggaagaacuaaaguugucauuucacacauuuacccaauuuuuuccuaaguauguaaacaguaucaguacguaagguauuauuuauuuaauuuuauuuacuaauacuaugaaaucccacuucgaaauaucauaaauacacuaaaccaaagcagaaacaaauuuugaaaugcagugagagguagcagaaaguauacuggccugagaaguaguaucauuuucugacugugucucugcaugauuauucucucugacucuuaguuuucucaauugcaaacuacagguuccuuccuuguuuaaauagcaaggaaacugucauauucaaauaacuuaauaaugcagggaaaacucugaggaacuagaaagagcuauuaacauacaacuucauauauagagcaaauuuuuagagaaaugaagucuuugcugaaagauaacauaauuauauccauuaauaaaucuauaaugagccaaaaauuacaauacuaauuuaguuuucauuuugcugcaaugaauuccuuucuaaaauugugcuauguggcauuuuaagaggauucucauaacucuaugcuugucccagaugauauaauuuaaaauauaccuucuaaaucagcaucuuaaagguauguauaaaaaauuuaaucuuugaguaacuuuauuaaagagauucacagauuaguuucuaaauuuguucuuuuauuaagcuaaauuuuaagugaauaauuaucacucaacuagauuacuggcuuuaaaaaucuuaaaaugacaggaacacugcaauauccaaauaguuuuaccaucacauaucuggaauacguaauucuuuuuaauuuuaaacacauauaaauuuaagacaaagauaaauaaauauauuuacagaaauuccaaguaccagcagcuaacucuucuuaauggaauauggguacacuaucuccauauuucucuaacgaucucugguacaaacugaugaaagcagaagaaagauaguuuauuuucucaaaagccuuguauaagugucccacuagguucuuucuuuccuauugacaaagacuuauagaugucuggaauuuucucccaggaaaauagauaugaaccauacauggagauaaaacuaacacuaaaaugcaguuuacauauuuuuaaaaaauaaaugugcauuccacauacugcuaguuugauauuucuaaaacucuuuugauacugcuaaaacccuuuucuccauuacuuacaagauugauuugaacugucuuuucuauuuuucuucucaauuuuauccugaaaucaaaaagccaaacugcccucacauaaaaggcaagauacuuaguucacuacuuuagauuccagaaagcaaauaaaauguccaacaaaauaccauuucuggaacugaaugaguaauuucaguuuacucaaugauuaaacuuuaggauaaaauuaaaaugcaaaaauaaauguuucucccucuuaucuuucuaaaauuuuaaguccugaguagaaaugaaaauaaaacaaaaagccucauaucaaaguuaagcaaagacugaaaaaagccuaagucuccuauuauauauagcaaguaucagguagaaaacaucuauccaaagccauacacaagaguucuccaguuuccuuauuugacgcuuguaauaucucuuuuccugguugucaccaaaauuacugaguauauaauugguucuuacagggaaaauauauguuagacaaagagucuagagauguaacucuggugagaagcaaucucuuucuuuuauccagcaaacauuaauugagcauuuaauaaguguccaguacuauauuaggaauaaagaaaaaauaagaaauaaaauauaguuccuauccucaggaaguuugcuacagggaggaagagaacuaaaaaucacaacauagugugauaagcguuaugauauacuaacaagcuguuuagcaagaaaaagaaagggaucauauauagauuuggaggguggaaucaaggaaggcuuccuuaaaaaaaaaaagggaggggggggauaguuuccaagacaagaaaacaaacaggauguauacaacaguauauacauucaguaagcugaaaauaguucccuaaaccugaaguacauugugaauauggaggaacagacagacacaaagcuagagauaagcaaaggcgagaucauuaagggccuugugugccaaacuaagaaguuugaacuuuauccagaagauuauguggagccauugaaagauguuaaacuaguaaguggcaaguaagaucugccuuuuagaauaaauauuuugacaacaacauaaagaauaaaacaagaagaaaaagacuacguaaaggaaaccuaaucaaguuacuaccauaguaauaaaggcacgaaguuauuagggcuugaacugaugcacuggcaauaaagauggagaacagauccuuuaaaagacagauuuagggguuaaaaauaacuauauauggccgcacagcauggggcaguguggggucaccauaacagcuacagcagcugcaggugacgagugguagaaucgauggugaagagucuggagagagagaacauccggaagaugcagggucucauguuccggugcagcaccagcugcugugaggacagccaggccucccugcagcaggugcaccagugcaucaagcacugccaugugcuucuggcucaagcccaggcuuuggucaccagugaguuggagaaguuccaggaccaccuggcccaguguaccacgcaaugcaacaacaaagccaaagauucaauagcugcugggaguaaggagcuucaggugaagcagcagcuggacgguugugugaccaaguguguggaugaccacaugcaccucaucccaacuaugaccaagaagaugaaggaagcucucuuagccauugggaaauaaaagucuuugccaguggccaugggggcugagggcaagaauauauuuuuuauaaggcauuugggaacuuuaguauuuuaagcaaaguuuaugaaugaagaaauuaaggauggccacaaguguaaugcauaugucacuugccucuagacacugguucuuucauguuucaguccuaaaacaugaaauggaaaaaagugguguuaaauugggucagagauuuacaggagaguuuuagaucuuauauuuccuguggccagugcuuguccuggcaguaaggaucuccccuguaacaggccagagcccuccaacacaccagacucuucuuacuacacagguaccaauaggcuggcagguuagaguugguggaguuugaagaaagauauuuucucuuuguugccaacauccuguuuaccagaagugucaccacaccauuuuccauaagcugugaaacaaaauccaugaggucacuaacuuagaagggaaaaaaaaguuuucugggucuuuguuuucuugguuuuguguaauuuauacaagggcauacaaguugauuuuaagauguggaauugggagggagacuaguuuagauaagaacuuugaaagguuccuugauccccauuucuggucaucaagauguggauguacauuucuuaaaauuauuacaugcugcaucuuucagccuggagaccaugcaaaaacaugagaggcgaggacacacuaauuacgggaagcauaauuacugccugauggacccugaggcuguguguagcaaaaugacaggacaaucuugcaguaacacuuuccccuuggaagagaaagggguuuugauugugauauauacuaguaucuaggaaugaacaguaaaagaggagcaguuggcuacuugauuauaaaaguuaugaaguacuggauuuggaaaaaccugguuuuuauagaacagauagaaugaaagccuaaaccuagcauuacauacuuagcccccugaauuaacagagcacaacuaagacaaaccccuggcagcaggaaauucaaggaagaaaaaguaagcaacuugggcuaggaugagcugacuucuuuaaagcaaaggagaggcagcccccauuaccaaauaccauuuuugccuggggcuuuugcaacacaguguuccugccccagcauggcaccuuauuguuuugauagcaaccucauuguauuuucaccaacuuauuacuugaagugauaacacagccuguccauuuacuguuuccaggcuaugauauauuuuccuagugguuugguuuuaaaauuaaauaagguuuaauuuucuaccgccccccaaaaaaauauauauauguauauauguuaaaugacuggauauaaggauaaggaaaaaagaggagucaaagacaauucccaaguucuaauuuguaaguagugucaaucacucagauagaggggaauacaaaaacaggcacaaguuugagaaaagaugagguucucacuuuacaacaaguugaguuuaggacaccuggagcugaggaaagaggucuggacuagcugguagcucacccacuaacugaacaauagacaacaacaauuuuaaaacacagcaaaaaacaaauuagaaucuuacugggacucuuuacuucauauuauauuugaauuucaugagcacauaaucuaugugcuaaaaauuccuagugguaaaacuauuauucugagagaauggacuaccacacuguucugauuggaaaaaggacagauguaggaugaggcgauugaugaguuuguugucauuugaagagaguuuaaagguuccuuucaaaagagucaaagauauuagaaagccauuccuuuaaguagcccuuuuauuuacaucugucagugcaguaagagauuaaccuguacuggggaagaaaucugcuagaacauagaaugagagcaagcugcuucauaaauuacugaugcuaagcugucugacucuuaagauuuacaguguuuuagaaaauuaaauuuauaucagguaugagcuaguaagaaauuucuucguuaaacuuggcuuuuuaugauuuugucuuuuuaaaagaaguauucucuuuaaaaauuaauguguaauaucuucagauguuuugacaagaauucuacuuuuauuuuaaaaauaacuguguugaaaguuagcaguuuuuaucugggucuugguuuaaaguacuuauauacugucauucagauuacagaccauauaaccaaaguacugucucgcuaauuguaaguuauucuaacugaaaauaaaguaccuucccuccaaaacauucauuuaauggcugaaauuguaaaucgugauguauaaaagauauuauguuauagauuccuagagcuaauuccuaguuuucagccccaaacucccauauaauucuuucaaaaaacacaaaacagaaauuggucuuguuacucuacaaaauuaaacugaacauuuacuauuaaaaaccuagaggcaauauuuuaacaucaucuccuguuuuaaaaauucauuuaaaauacaagcucaaaaaagucaaaagugguuaggaucuagauuagauaacauuuugaaagaauguuaaagaugaagaaaauauuaaugcacauauauacacacacauuuauaugcauauaauacauauacacacacguauauauauguaucuucauuuuaaucauaaaauaaucccuaaaaagauguguacauguaucaaauuuaaauaaguuaaauguacuaaugauacucguuuuuaaauauaauuccaugucaaucugcuuaaugaaguacagaaacaucagcuaacucuguaaauuaagauaggcagcuuuaagauuugcuuuagagugugguaugccuauauaugcaaaucuccuuucaggucauuucaacaauuuuaucauuaggaguacgggauucauauuauuucaaaugugguaaguugaacaaaaucaauacugaacaacauaccuuucagauaaauuaaggcuuuggcgaagagguucuaauuuuugacaugucucuaggcugucaacagaugucgaaggcaaugagucugauugcaccuuguuggcaucacauaaauuagcaucguuucuagguagggucuuucugaauuuucguccuaaauccguccauaggacauucgucaacauaacuuugaguugccuguuauacacauaaauaauuaguauauaugguacuacacauuguagaauacaugaauucaucacaaacuaauaucuccagaaacuguaaacuucaguuccucaagcaacuauaguaaauacccuaagaaaaaagaaaaaaugccuaacuauuaucaaagauaccuuaaaaaguaaaaucuauuucacuuaaguugggauuuucuucagaauucugucaaguuuacuacaacuaucauuacacauguacagcugcuagacuccuggcaaugcauucauguuuauuaacaauguuaguugaaggacaguguucauuugcagaucucaucacagauguaaccacuguuugugcuaaaaauguguuuuuguuuuagcauuuguugauucagaaaacauuauuaaaacuaaggguccacuacugcaucacuuacauucuuaaggcuauacagucuuaagauacagauuuaauuuuaucuuauuucuaaaauaggucaacuuaaaaaauuuaccuuacuguaccuauaccaauuucaaaaaaaaaaaaagacugacaaaugcaagcaguuccagcaacacuuuugcccaucauguuuuacccaucuucucauucaauacaucuuuaugcugaauauuugaauaacuauguuuaguucuggaauuccaaaaacuauggaauauaguuucugcaguggugugaacaggcuaccaagugcauuuaaaacaaugucaagugaggaauggcugaaaguacugggaaauguuuaaucagaagagugucuauuuuacuaccuaugaaacaguuuuaggcacuuuuuguuuguuugcuuaacaaacacaagaauauuaagaaacagcaauauguucacauauuuucaagauaaaacgggaacucucaaaaaaaaaaaccacuuguuugcagcagccauuugaguguauauccccaaaccaucuagugggaagaggguacaaguucccaggguacuuccauagaacacugaaaacuccaaacauguugcacacacacaaaaaaaaauuaagcuauuaguuuuaaaauuauuaaaaaauaaaugacaucucuauggaucaauaauaauucauucuacaagcacuuacugaacaucuuccagcaaaacaacgaugcuaguauaaucuggaguuucagcuacaaacaaaauaguugaguuuuugccuucaugggguguacauuacagagaauaaaccaauucauuauuuaauuagaauucuaauaugugcuaugaagaagaaauacagauguugcacuucuucugagccaaguuucugagaauaugaccuugaagcugaagucucaaagaaggacaggcacuauccaaaggaaacaaguaaaaaauggagaaagguccaaaaaacaggacaaaaugcaaauguuuugaguaaagcuucuucaaagaaauuaaaggacuuaccugacucauguacuuagaauaaagagguaaugugucuaagaaugggcaguuaggcaggacuuagcaaaccauauuaaggaugugagacuuuaugucaacaacaauggaaauccacuagucuuaauuaggaaacacugagaucagagcuacacuuuuaaaagaucauuuugauguuuaugaagaauaaaauggaagugcuaggaauaaugaggaauaaaaauuaauuuacggagaugaugacuuuaucagagguaguuuagaagaauggugggagcagaaaccagaauacagugggaucagcaaagggaaaggagcaaagggauauagcaaaugaaaguaguugagaaauaugguugugaaaguggaaaauaagacaagaccugaaaauagacaugagaagcaggaaaggguuuuuagucaguuacugguugauuaguuaaagauaggaaagauuuguguaaguuuaaaugcuuaugggaagcacguaaggguuaaagacacagaaggcaggauaauuaacacaguaaguuucccaagaaauugcauuaagugcuaauauuuauugaacauguacuauauaccaggcacugugcuaagcauuuuacaaugauuuauuucauuuaauccucacaaccacuccaugaggggcuuacaaauuauucuucucaugcagcugaggagaccaagauaggcugauuaauaucuaaguaaaacgagugaguagugaaaaugcgauucagaaccacacacucucaaauuucuugccagcacucuuaacugcuucacacuacacugguuuaugacaggagaagaggcauuccaaccaagaccuucucuuaaaagugauaggaggccaggcgcuguggcucacgccuguaaucccagcacuuugggaggccaaggcagguggaucacgaggugaggagaucgagaccauccuggcuaacauggugaaaccccgucucuacuaaaaaauacaaaaaauuagccgggcaugguggcgggcaccuguagucccagcuacucaggaggcugaggcaagagaauggcgugaacccaggaggcggagcuugcaguaagccgagauugcgccacugcacuccagccugggcgacagagcgagacuccgucucaaaaaaaaaaagugauaggaaagauaaaggaacauagguuugaaaaaaguuuucaaauaauccuuguagagagggggaacacaagcuuacuaaagaaacacacguugucuuacaguuaagaaaucccugugagauuaacacauuuauaaugccacaaauauccuuuuuuccugcaaacagauaauugaguucacagaugauuauuaauugcaaagaagaaaaggugucuuuacaaugaacagaucuggcaggcaccaucuuaugcaagugaucaaacauaggaguacuaagagugaaacaaccagaaauuauguuacccccugauaugugcaguaagaaguacaugacaucagguaugaaauauuccugccaaaaauguaaccuggaccuaaucauaugggcaagaccaauaaaauaauaaaaauauagacugugaggcauucuacagaacaacuggucuggacuccucaaaacucaaugugaugguuaaaagggaaagggcagagcaggugggaacucuucuagauuaagagacuaaugggguauaauaaccaaauacaaugcaugaaccugaacuugauucuauuagguagguacaaaaguaacugcaguuuuggccaaauagauuuaaaaauaaauaaauaaaagacauuuugggaauacucgggaaauucugauuguggacuuuauagcagaugaugauaugaaauuacuguuaauuuucuugauaguauauuauaauuguuauguaagagaauguuauuguucuuaggaaaagcaagcugaaguaucugaagauaaaauaccaugaugccugcaacuuacucucaaaugguuccccaaaaaauguauguauaugugcauguauauauguauauaugugaugcccaucuauauacaugcauaaagagacaccgagagacggcaaaugugccaaaauguuuaaagacuaccagucuauuauuuauacauuuuacaacuguacaauuuaaaauucuaaaugaccaaauaaaaaugcaaacaaaacuuuaaggaaauuuauuuuaaggauaaaauguaauuaagucuaauggaaaaacuauaugacuuagguauuugcuaaauuauugaggaaauuauuaucucaaugguaauuuuaauaauuucaaauaugagacuauucaauguuggaaaaagccauuuuucuauucacucagaccaaauaagaauuuauauuggaaaauaacaaaucauugguaauuuuacugauuauucuaauagugaggcucuaaaugagacggacaauuuggcuucuccgggaaaauacuuauuucacauuugacuuuauuauaauuugucugacuaaaaauauccggcaacagaagucaguaaucuuuuuccccccaaacuaguaaggugaaaaaauucuaaacaucuacaacauuuaagugucauaagauuucucuguauaccagaagagaaacuuaagaguaaagaacaacauucaaaccaggcaaaauaaaaccuaaauuuaguauuuagggauauauacuuagguaacaauacuauccaacaaaacuaagaaaguaauuacuuugaaaguuaggugagugguuaucguuaaagcagggguccccagcccccagacugccuuguaccagucuguggucuguuaggaacugggccacacagcaggaggugaacggugggugagcgagcauuaccgccugagcucugccuccugucagaucagcagcagcauuagauucgcauaggagcacgaacccuauugugaacuucacaugcgagggaucuaacuugugcacuccuuaugagaaucuaaugccugaugaucugagguggaacaguuucaugccuaaaccacuccccacaacaccaacccaccccacucucaaccccauccguggaaaaauuggcuuccaugaaaccagucccuggugccaaaaagguuggggacugcugcuuuaaaggguuaucauuugcagggguugagaacuucuggggcaguuuucuguuuuguaccucaguggugguuaaaaucuaccuuauuaaaaauagauuaaauuuaaugaauaauucauugaacuguuuaccuuuuagucauuuuuuguuaauuacauuauauuucacagcaaaaaugaaaaguaaaaggcagcuaaacagagaacuccaccuaacccaacaaucuauauacuuagguaggcugguuccuguuacuugccuaggcuuuuuagaaccauccaacugucuauuuauaaaguguuccuuugaaagcuccaaaccauuauacuaauacucacuuaauuuuuuaugaggggaaaugaucauugauccauauacucagauucuuuaaaaaaucgcauuccuaaaaaauaagaaauauacuguaucuuuucuauuuuacauaugagaaauuuuauaauuguaggaagacccagcauaaucacagcagaaaaaaaauaacauguuugccuaugaauaaaaaaaaauacacugguuuuccagaaaaccucaauuuuuuaaaaauuuuucaacaaaaguaguuuaucaaugaauacauaaacaugacuuaauuauauagcuuggccaaauaaauucagaaaucagaaaaaagaauucucccucagacuuggaguccuacauuuugauuccggaaaauaaacuaacaauugggaugaaggcauuguuuucaugccuuuugucauaauuuuauuuagaguauuucuuguccuucaaaaaaaaauggacaaaacauuuggacacuucaccaaaaaaaugcacaaauggccaacaugcauacaaaaagacauucaauaucauuaaucuuauuuuucuggucuuuaaaaaaaguuuuaaaaaagaggaaggaacaaaagaaauucaacagauauccuagagaagauuucuuaaaguucaauaaagcacaugaaaaaauguucaacaucaucagucaucaaggaaaugcaauuaaaaccacaaagagauacugcuacaccuccauuagaaagggugauaauaaagaagaugaccauguaaguguuggcagggguguggagaaaaugaaacccuucuacauggcuaguggugggaauauaauacggcacaaucacuuauggcagcuuggcaguuucuuacaaaguuaaaaaugcaccuaccauaugacccagcaauccaacuccuagguauuuacccaaaagaaaugaaaacaggcucccaacacaguggcugacuagacacagccaaguggaauggcuaccaccaagggaccaagacgaugggugcacuccuaauagaucuucagagggaaggcacagagacuggauggagggaagacacagaagcuaggcugaagagggaggaaggugggaaccuugcacaggcuuaccauguaccaggacucauucauagcccccagugacucuggggggcaaugggugaguugaacuggcaaggggcaauccacucucccgaagggucucuggaaucccagcaggaggagaccccucaaccaccacggacacuucaguuggcagggagagcugcuuagagaagugguaggggcagcacaccagcugauguggagcccagaagguuuggugcgggagagucugcagcagagcauggccagugagggccaucccucuaggcuugacuugcucccauaagagacuuuagcccuaggggaacuguuggaccugaacucugcaggguugucuugccuaucaaacaaggccagucugaccugaccauccuuggucuguggccacucccagggccgcagccugguggugucuacuugcagggcagcauugggugcccugggguccuguaucacugggggaccugccuaacaggcagagagcuccagugggguggcccccaaaaccaugcacaagccugccacucccuccacacaccgcagcuuccccuuggcccauggcaacccaccccccauccccgcacguugcuuugcugauguauaugugugcaggaggguuuugcuuucuuugccccagcagcaugugacugugcaugcacccugcccugccacugugugagugcaguccaccccgcucccacaacugaccaccauugcagugcaaaccauggcgagcacaaagccagccagccuugccccuggaaguaccucacccuugcaccaacacugacaggaagugaagccagacacaaagaacagcacaccuuccccccacacugagcaaccaccccugccuacagcgcacagagaaagcacaaagaccuguacccaccaguaccaccacacccgugccaacaucaccaacagcacaaccacacacacagucaccagcagggacuccugcuccccaucagccacauugccgcugccacuguggugaacacucauaugaagacaggcacccuggcacccauuagcaccuugccacagccaacagacaugcacuaggccacacugcgugauacaguuuggcuguguucccacccaaaucucaucuucccacguguugugggagggaccuagugggaguucacugaaucauagugucaguuuccccauacuguucucauggaagugaauacgccucaugagaucuaaugguuuuauaaagggaaaccccuuucacuugguuuucauucccucuuguccaccgccauguaagauguuccuuucaccuucugccauaauugugaguccccccauagucacauggaacugugagucuauuaaaccucuuuuucuuuauaaauuacccagucagggguaugccuuuaucaacagccuaagaacacacuaauacacuaccacugcugcuggcacaugcaaaugaggauacauccagcugccacugcacuacugcacuaugaaaugcuuuagcugacaccacccauuggagaguagugaccagcaguccaggagcaccucagccccccaacacaguggauuccuaaccuugagguaacagagaacaaaguuggggucugauacaagucccacagaguuagagcacacaguccaggagaaguugggagcugagcacugguacccuaaaaucuuccagaaacaaagccaguuggcugacuccacuuuuuaccacaaucaaacccucaaagucaucaagauaaaagaaaaagacucuacccaaagguuagcaacuucaaagacugaaggaacuuaagcccacaaagaugagaaagaaccagcaaaagaacacugaaaacucaaaaagcccgagugccuucuuucuuccaaagaaccgaaccaucucuccagcaaggguucugaacuaggcugagauggcugaaaugacagaaauagaauucagaauaugaguaggaaugaaaaucauugagaugcaagaguauguugaaaaccaauccaaggaagcuaagaaucacaauaaaaaaaugcaggagcuaacagacaaaauagccaguacacaaagaaaccaacuaacaugauauagcugaaaaauauacaagaauuucauaaugcaaucgcaaguauuaauagcagaauagaccaaguggagcaaagaaucucagugccugaagacugacuuucugaaauaagacagucagacaaaaauagagaaaaaagaaugaaaagaaacaaacaaaaccucugagaaauaagggauuauguaaagagacuaaaccuacaacucacuaguguaccugaaagagauggagagaugguaaccaacauggaaaacauauuucugaauaucauccaugagaacuuccccaaccuagucagagaggccaacauuccccaaccuaucauucaugaguucugucacccaugagaacuuccccagccuagcuagagaggccuagcagagaacccgaguaagauauuucacaagaucaucccaaagacacauaaucaucagauucuccaaggucaaaaucaaagaaaaaauguuacaggcagcuaaaaaggucaggucaccuacaaagggaagcccaucagacuaacagcagacaucucagcagaaaccauaaaagccagaacagauugaggaacaguauucaauguucuuaaagaaaauaaauuauaacccaaaaugugauaugcagccaaacuaagcuucauaagugaaggagaaauaagauuuuuuuuuuuuuuuagauagagucucgcucugcugcccaggauggaguucaguggcaccaucuugacucacugcaaccucugccucccaggcucaagugauuguccugccucagccucccgaguagcugggauuacaggcacccaccaccaugcccagcuaauuuuuuuuauuuucaguagggacggggguuucaucauguuggccagccugaucuugaacgccagaccucaagugauccucccaccucagccucccaaagugcugggauuacaggcaugagccauggcacccagccuaagaagauucuuuucagacaagcaaaugcugaggaaauugauuaccacacgaccugccuuggaagagcuccugaaagaagcacuaaauauggaaaggaaacaauguuaccagccacuacagaaacacacugaaguacacagaccagugacaccauaaagcaacuacagaaacaagucugcauaauaacuagcuaacauccccaacucauucuaugaggccagcaucauccugauacaaaaacuuggcagagacaaaaugaaaaauuuaaggccaauauccuuuaugaacaucaaugcaaaaguccucaacaaaauacaggcaaaucaaauccaccagcauaccaaaaagcuuauucaucacgaucaagcaggcuuuacaccugggaugaaacggggguucaacauaugcaaaucagaaauuugaggccaggugcaguggcucacuccuguaguccuagcacuuggggagaccgaggcaagaggauugccugagcucaggaguuugagaccagccugggcaacauggcaaaacccugucuuuacugaaaauacaaaaaacuacccgggagugguggugcacaccuuuagucucagcuacucgggaagcuaaagcacgagaauugcuuaaacccgggagguggcgguugcagugagcccagauagcaccacugaacuccagguugggugacagagcaagacacugucuccaaaaaaaaaaaaaaaaaaauuugauuuaucacauaaacagagcuaaagucaaaaaccacaugauuaccucaauacaugcaaaauuaaauuucugugggaccuggcaaaaugcaccucugcuuucauucagguacaaugcaucagcacagaauuuccuuuuucuuuuucuuuuuuuucuuuugaagaaaagaauaucaaauaaauuuuuuauuuauuauuauuauacuuuaaguucugggguacaugugcacaacaugcaggucuguuacauagguauacaugugccauggugcuuugcugcacucauccacucaucauuuacauuagguauuucuccuaacgcuaucccucccccagccccccacuccccaacaggcccuggugugugauguucccugcccuguguccauguguucucauuguucaacucccacuuaugagugagaacaugcaguguuuuguuuucucuucuuguguuucuuuugugagaaugaugguuuccaguuucauccauguccuggcaaaggacaugaaaucauccuuuuuuauggcugcauaguauuccaugguguauaugugccauguuuucuuuauccagucuaucauugaugggcauucggguugguuccaagacuuuauuauuaugaauagugcugcaauaaacauacaugugcaugugucuuuacaguagaaugaucuauaauccuuuggguauauacccaguaaugggauugcuaggucaaaugguauuucuaguuuuacauccuugaggagucaccacacagucuuccacaaugguugaacuaauuuacacucccaccaacaauguaaaaguguuccuauuucuccauauccucuccagcaucugcuguuuccugacuuuuuaaugaucaccauucuaacuggcgugagaugguaucucauuaugguuuuaauuugcauuucucuaaugaccagugaugaugagaauuuuuuucagaaguuuguuggcugcguaaaugucuucuuuugagaagugucuguucauacccuucaccuacuuuuugaugagguucucuuuuucuucuuguaaauuuguuuaaauucuuuguagauucuggauauuagcccuuugucagauggacagauugcaaaaauuuucucccauuccauagguugccuguucacucagcugauaguuucuuuugcugugcagaagcucuuuaauuagaucccauuugucaauuuuggcuuuuguugccauugcuuuugguguuuuagucaugaaaucuuugcccaugccuauguccugaaugauauugccuagguuuucuucuaggguuuuuaugguuuuaggucuuacaguuaagucuuuaauccaucuugaguuaauuuuuguauaaggucuaaggaaggagucauuucaguuuccugcauauggcuagccaguuuacacaacaccauuuauuaaauagggaauccuuuccccauugcuuguuuuugucagguuugucaaagaucugaugguuguagauguguggugugauuucugaggccucuguucuguuccauuggucuaucuaucuguuuugguaccaguaccaugcuguuuugguuacuguagccuuguaguauaguuugaagucagguagcaugaugccuccagcuuuguucuuuuggcuuaggauugucuuggcuacgcgggcucuuuuuugguuccauacgaaauuuaaaguaguucuuuuuccaauucugugaagaaagucauugguagcuugauagggauagcauugaaucuauaaauuacuuugggcauuauggccacuuucacaauacugauucuuccuauccaugagcauggaauguuuuuccauuuguuuguguccucuuuuauuuccuggaguagugguuuguaguucuccgugaagagguccuucacaucccuuguaaguuggauuccuagguauuuuauucucuuuguagcaauugugaaugggaauucacucaugauuuggcuguuuaucaguuauugguguauaggaaugcuugugauuuuugcacauugauuuuguaucccgagacuuugcugaaguugcuucucagcuuaaggagauuuugggcugagacgaugggguuuccuaaauauacaaucaugccaucuguaaacagagacaauuugacuuccucccuuccuaucugaacacccuuuauuucuuucucuugccugauugcccuggccagaacuuccaauacuacguugaauaggaguaguaagagagggcauccuugucuugcgccaguugucaaauggaaugcuuccaguuuuugcccauucaguaugauauuggcuguggguuugucauaaauagcucuuauuauuuugagauauguuccaucgauaccuaguuuacugagaguuuuuagcaugaagggcugaauuuugucaaaggccuuuucugcaucuauugagauaaucaugugguuuuugucguugguucuguuuaugugauggauuacguuuauugauuuguguauguugaaccagcuuugcaucccagugaugaagcauacuugaucaugguggauaaguuuuuugaugugcugcuggauucgguuugcccauauuuuauugaggauuuucauaucgauguucaucagagauauuggccuaaaauuuucuuuuuuuguugugucucugccagguuuugguaucaggaugaugcuggccucauaaaaugaguuagggagauuuuccucuuuuucuaucgauuggaauaguuucagaaggaaugguaccagcucuucuuuguauuucugauagaauucagcugugaauccaucugguucuagacuuuuuuugguuggcaggcuauuaguuauugccucaauuucagagccuguuauuggucuauucagagauucaauuucuuccugguuuaaucuuaggaggguauauuuguccaggaauuuauccauuucuucuagauuuucuaguuuauuugcauagaaguguuuauaguauucucugaugguaguuuguauuucugugggaucgguggugauauccccuuuaucauuuuuuauugcauuuauuugauucuuugcucuuuucuucuuuauuagucuggcuauugguuuaucuauuuuguugaucuuuucaaaaaaaccagcuccuggauucacugauuuuuugaaggguuuuuugugucuccaucuccuucaguucugcucugaucuauuucucgccuucuucuagcuuuugaauuuguuugcucuuccuucuguaguucuuuuaauuuugauguuagggugucgauuuuagaucuuuccugcuuucucuugacauuuagugcuauaaauuucccucuacacacugcuuuaaaugugucccagagauucugguauguugugccuuuguucucauugguuuuaaagaacaucuuuauuucugccuucauuucguuauuuacccagcagucauucaggagcagguugcucaguuuccauguaguugugcaguaugagcggguuucuuaauccugaguucuaauuugauugaacuguggucugagagacaguuuguugugauuucuguucuuuuacauuugcugaggaguguuuuacuuccaauuauguggucaauuuuggaauaggugcaauguggugcugagaagaauguauauucuguugauuuggggugaagaguucuuuagaugucuauuaggucugcuugguccagagcugaguucaaguccuggauauccuuguuaaccuucugucucauugaucugucuaauauuaacaguaggguguuaaagucucccacuauuauuguuugggagucuaagucucuuuguaggucucuaagaacuugcuuuaugaaucugggugguccuguaguaggugcauauauauuuaggauaguuagcucuucuuguugcauugaucccuuuaccauuauguaaugcccuucuuugguuuuucugaucuugguugguuuaaagucuguuuuaucagagauuaugauugcaaccccugcuuuuuuuuuuuuuuuuuuuuuugcuuuccauuugccugguagaucuuccuacaucacuugaggucaagagaucgagaccauccuggccaacauggugaaacccugucucgacuaaaaauacaaaaauuagcugggugugguggcgugggucuguaguccuagcuacucgggaggcugaggaaggagaaucgcuugaacccgggaggcagagguugcagugcaccaagauugcgccauugcacuccagccuggcggacagagccagacuucgucucaaaaaaaaucauccaucccugaggucugccuuagacucuaccuuuccagcacaugcauuuguuacuugacaacuggccaaauacuaaagaagcaguuuuugaaagaaaaggaguuaucuuauucuuugaaauuaaaaggggauuuugucuugcaccuuugguaccagcauggccacagcggaguagagcaccaaagaggcucuuggggucccuaauuccaggacgugacccuaugauggcacuuuuggaccugaccuggagcagaggggagcucacugcccuaaagguugagucccaggccaggcagcauucacaacaagccaucuuaagagauuucgggccuuaagggaaauuguagguagucuggccauacuccuuguggccugggauagcaauggcuauggggugaggcucuucugcuuuugggaaagugagggaagaguggggaggacugcaucuugucauuugagugccagcucaaccauaauacaauagaacacuagguagacuucuaagguuuuugacuccagucccugacucccggacagcacuucuggacugaccaagggcuugggagaucuugccauccugaagggaagaacacaggccuggcuggcuuugccacuugcugaucauagagcccuggacccuuaagcaaacauaggcaguagccagggaguagugacagcaggucuugggagagacccaggcugugcuggcuucaggucugacccagcacagucacaaugcugguggccacaggggugcuugagucacuccacccccaucuuuagguggcuuggaauagagacuguauguuugguagaaaguaagggaaaagaacaagagucucugccugguaauccagagaauucucccaguucuuguacaagacuaucaagacaguaucucuaugagucuguaagaaucacagcauuacugaguuggggugcacccuaaagcuuagagcauaacacccagcuccuuucaaauaucugaaaagccuucccaaaaaggauggcuacaaguaagcacagauagagaagacuacaauaaaaaccuaacucuucaaugcccagacaaugaagaacaucuacuagcaucaacaucaccaaggaaaauaaucacuggaagcuacaaaacucacugguaauaaguacauagaaaaagaaagaauaucauaacacuguaacugugguguguaaacuacucuuauccuacguagaaagacuacaggauaaaccaaccaaaaauaauaacuacaauaacuuuucaagacagucaauacaauaaagauauaaauagaagcaacaaaaaaguuaaaaagcagggagacaaaguuaaggcauagaguuuuuauuaauuuuuauuuugcuuguuguuuaugcaaauaguguuguuaucggguuaacauaaaggguaauaagauaguauuuucaagccucaugguaaccucaaaccaaaaaacauacaauggauacacaaaaaauaaaaagcauuaaaccaaaucauauuaaaaaucaccuucacuagaggaagacaggaaggaaaaaaaaaaggaaaaaaaaaaacaagaaagagaagaccacaaaacaaucagaaaacaauuaacaaaauggcaggaaauaaguucuuacuuaucaauaauaacauugaauauaaauggacuaaauucuccaacuuaaaaacacagacuggcugaauggaugaaaaacccauugaucuguugccuaaaagaaacacacuucaccuauaaagacacacauaaacuaaaaauaaagggauagaaaaauguacuccauuccaaugaaaaccaaaaaagaacaggagucacuauacuucuaugagacaaaacagaucucaagacuaaaaugauaagaagagacaaaugggucacuauauaaugauaaagaggucaauucagcaagaggauauaacaauuuaaaauauauagucacccaacccuggagcacccagauauaccaaggaaauaauauuagagcuaaagugagagauagaccucaauaaaauaauagcuggagacuucagcaccccacuuucagcacuggacagaucuuccagacagaaaaucaacaaacaaacaaacaaacaaacaaacaucagacuuaauccacacuauagaccaaauggaucuaauacacauuuauaggccauuucauccaacagcugcagaauacauucuuuuccucagcacauagaccauucuuaaggacagaccauauguuaggucaauaaacgagucuuaaaacuuuccaaaaaacugaaauaauaugaagcaucuucucugaccacaaaggaaaauuagaaaucaauaacaagaggaauuuuagauacuauacaaauauauggaaauaaaacaauauguuccugaauggccaaugggccaaugaagacauuaagaaagaaaacugaaaaauuucuugaaacaaaugauauuggaaacacaauacagcaaaaccuauaggauacagaaaaaguaauauucagaggaaaguuuauaguuuuaaaugcauacaucaaaaaaaagaaaaaaacuucaaauaaacuaucuaaugaugcaucuuaaaaaacuaaaauagcaagagcaaaccaaacccaaaauuagaagagaaaaaauaaagagagaaaaaaacaaaugaaauugaaauuuuaaaaauacaaaagauuaaugaaacaaaaaguugguuuuuucaaaaguuaaaacaaaauugaccaaccuuuagccaaccuaaagaaaaacaaaaagagaaaauacaaacaaaaucagaaauuaaaaaggaggcauuacaacugauacuacagaaauucagaggaucauuaguggcuacaaugagcaauuauaugccaauaaauuggaaaaucuagaagaaauggacaaauuucugaauacauacaaucuaacaagauugaaccacgaagaaauccaaaaucugaacagaccaauagcaagcaaugagaucaaagcuguaauuaaaagucucccaguaaaggaaagcccgggacccaauggguucacugcuaaauucuaccaaacauuuaaauaagaacaaaugccaauccuacucaaacuauucugaaaaagagaggaggagggaauacuuccaaacucauucuacaaguccaguauuacccuaacaccaaaaccaaacaaagaaacaucaaaaaaagaaaacuacaggccagcaucucugaugaacacugaugcaaaaauccucaacaaaauacuagcaaaccaaauucaacaauacauuagacagcucauucaucauaaccaugugggauuuaucccuaugaugcaaagaugguucaacuuacaaaaaucaaucaacaugauucaucauaucaacagaaugaaggauaaaaaucauauggucauuucuguucaugcugaaaaaccauuugauaaaauucaacaguucuucauaauaaaaaaaaaacugagaauaaaaggaacaugccucacauaauaaaagccauauaugacagacccacuagcuaucauaguuaguauccuagcuaguaucauacuaaauagggaaacacugaaagccuuucccuuaagaucuagaacacaacaaggaugucuacugucaccacuguuauuuaacauaguauuggaaguccuagcuagagcaaucagauaacagaaagauauaaagggcauccaaauugcaaaggaagaagucaaauuacucguuugcugaugacaugauccaauguuuggaaaaaccuacagacuccaugaaaaaacuauuagaacugauaaacaaauucaguaaaguugcaggacacaaaaucaacauacaaaagucagcagcauuucuguaugccaacagcaaaaaacacgaaaaaaaauuaaaaaguaaucucauuuacaauaauagccacauauaaaauuaccuaggaauuaaccaaagaagggaaagaucucuacaauaaaaacuauaaaacaauuauuaagaaauaugagaacacuaaaaaauagaaaauuacuccauguucauagauugaaagaaucaauauuguuaaaaucuccauaccacccaaagcaaucuacagauucaaugcaauccccaucaaaacaccagugacauucuucacagaaauagaaaaacuaauccuaaaauuuauauggaaccacaaaagacccagaauaggcaaagcuaucuugagcaaaaagaacaaaacuggaagaaucacauuaccugacuucauauuauacuacagagcuauacuaaccaaaacagcauggaaauggcauaaaaacaaacacauagaucaauggaacaaaauagagaacccagaaacaaacccauacaccuacagugaacucauuuuugacacaggugccaagaacauacacugauggaaagacaccucuucauuaagugauccugggaaaacugaauauugauaggcaaaacaauaaacuagaccccuaucucucaucauauacauaaaucaaaucaaaauggauuaaagacugaaaucuaaaaccccaaacuaugaaacuacuacaagaaaacacuggggaaaaucuccaggacauuggucugggcuaauauuucuucagcaauaccccacaagcacagacaaccaaagcaaaaauggacaaauaagaucacaucaaguuaaaaagcuucuguacaugaaaggauacaaucaacaaagugaagagacaacccacagaaugugagaaaauauuugcaaacuacccaucugacaagggaucaauaaccagaauauacaaagaguccaaacaacccuacaggaaacaaucuaauaaugugagcaaaaaaauaggcaaaagauuugaauagauauuuuuccaaaaaaaaagacauacaaauggcaaacaggcauaugaaaagguguucaacaucauugaucaucagagaaaugcaaaucaaaacuacaaugagauaucaucucaccccaguuaaaauggcuuauagccaaaaaacaggcaauaacaaaugcuggcaaggauguggagaaaagggaacacuuacacacuuuaggugggaauguaaauuaauauaaccacuauggaaaacacguuggagguuccuuaaaaaacugaaaauugaacuaccguaugauccagccauuccacugcugguauacaccagaaaaaggaaaucaguagauuuggaagugaucuaagugcccauuaauagaugaauggauaaauaaaauguaguacauauauacaauggaguauauucagccauaaaagaaaaugagauucaaucaugugcaacaacacagaugggauuagagaucauuacguuaagugaaacaagccaggcacagaaagacaaacaucacauguucucacuuauuugugggaucuaaaaaucaaaacaauugaauucauggaccuagagaguagaaggaugguuaccaaaggcugggaagagaacuagugggcugaggggggcagguggggacaguuaauggcuauaauaaaaauagaaugaauaaaaccuacuauugauaguacaauagaguaauauagucaauauuacuuaaucauauauuuuuaaauaccuuaacaaauguaacuggauuguucauaacucaaaggauaaaugcuugaggggauggauaccccauucuccaugacgugcuuauuucacauugcaugccuauauaucaaaacaucucauguagcccauaaauauauacaccuaauauguacccacaaaaaaauuuuuaaaugauuuuaaauuucuaaaaaagaauaaaaaauaaaauagcuaggcaugguggcaugugccuguaguccuagcuacuugggaggcugaggugggagggcuugagcccaggaggaugaggcuacagugagcuaugugaucacaccacugcacuccagccugggcaacacagcaagacccagucucaaaaaaagaaaaaauauccuaaaacucaacaauaaaaaaccaaaaaagccaauuuaaaaauaagcauagggcuuguguagccguuucuccaaagaagauauaugaaucucuaauaaauacauaaaaagaugcuuaguaucauuuauaaauaggaaaaugcaauuaagacuacaaugaaaugccaccucauaccauuaggauggcuacuacaaauuuaaaaaaaaaaaaacagaaaguaacaaguguugauguggaugugaagaaacuggaaauuuacucacugcuagcaggaacauaaaaugagguacggccauugcagaaaauaauacagcaguuguucaagaaauuaaaaauaucauuacuauaagaccaagcaauuccacuucuggauauacacccaaaaaaauuaaaaacagugagcugagguauuuguacacccauguuaacgauagcuaaaauauuaaaguaaaccaagugcccacagaugaauaaauauagaaacaaaauguggcauguaaauacaauggaaaauuauucaccuuucaaaaggaagaaaaucuggcauauucuacaacaugaaugaaccuugaggacauuaagcuaagugaaauuagcuagucacaaaaagacaaauacuguaugagguacuuuaaaaaguuaaaaucaucaaaacaaacagcaaacugguggucauaaggggaaugggguggagggagaaaugggaauuuauuuuuuuaauggguuucaguuuuacaagauggaaaguauuauggagauugaugaugguguuggcugcacauuaucaauuuauuuaacaacauuaaacuguacaauuaaaaaugauuaagaugauaaaauuuauguuaaguguauuuuacuacaauaaaaaaacuuuagagucuuaaaauucauuuaguacacuuguccaaaagcauacaaauuuauauuuaaaauagauacauguuauucuauguaaauuacacaucaauaaagucgguuucaacgaaugaguaaauagaaaacuugaauuguccuauaagggcgugaccagauggcuucacugaugaauucaacugaacauuuaaaaaagaaugaguaucggucuuugccgccgcgccggcgagcgccgcccgggaggcagcggcuggaggagcggacgggccccgcggggcccgagggcaaggagcagccgccugccuuggccucccaaagugccgagauugcagccucugcccggugccaccccgucugggaagugaggagugucucugccuggcugcccaucgucugggaugugaggagccccucugccuggcugcccagucuggaaagugaggagcgucuccgcccggccgccaucccaucuaggaagugaggagcgccucuucccagccgccaucacaucuaggaagugaggagcgucucugcccggccgcccaucgucugagauguggggagcgccucugccccgccgccccaucugggaugugaggagugccucugcccggccgagaccccgucugggaggugaggagcgucucugcccggccgccccgucugagaagugaggagacccucugccuggcaaccaccccgucugagaagugaggagccucuccgcccggcagccaccccaucugggaagugaggagcgucuccgccgggcagccaccccguccgggagggaggugggggggccagcccccccccggccagccgccccauccgggagggagguggggggucagcccccccgccuggccagccgugccauccgggagggaggugggggggucagccccccgccuggccagccgugccguccgggagggaggugggggggucagccccccgcccggccagccgccccguccgggaggugaggggcgccucugcccggccgccccuacugggaagugaggagccccucagcccggccagccaccccguccgggagggagaugggggggucagcccccccacccggccagccgccccguccgggagggagguaggggggucagccccccgccuggccagccgccccguccgggagggaggugggggggucagcccuccgcccggccagccgccccgucugggaggugaggggcgccucugcccagccgccccuacugggaagugaggagccccucugcccggccagccgccccguccgggagggagguggggggucagccccccgcccggccagccgcccuguccgggagggaggugggggggucagcccuccgcccggccagccgccccgucugggaggugaggggcgccucugcccggccgccccuacugggaagugaggagccccucugcccggccaccaccccgucugggaggugugcccaacagcucauugagaacgggccaggaugacaauggcggcuuuguggaauagaaaggcgggaaagguggggaaaagauugagaaaucggaugguugccgugucuguguagaaagaaguagacaugggagacuuuucauuuuguucugcacuaagaaaaauuccucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcucguuaagagucaucaccaaucccuaaucucaaguaaucagggacacaaacacugcggaaggccgcaggguccucugccuaggaaaaccagagaccuuuguucacuuguuuaucugcugaccuucccuccacuauugucccaugacccugccaaaucccccucugugagaaacacccaagaauuaucaauaaaaaaauaaauuaaaaaaaaaaaaaaaagaaugaguaucaauuuccccaaaaacucuuccagaaaacaaugaaggagagaaaguuuuccaacucauucuauaaugacaguauuagccuaauaccaaaaccagaaaaagacagcacaagaaaaaaaaccauauaugaaucucccucucguauacaaacauaaacauccucaagaaaacugaauccagcaacguauuaagaauauuauaaaucagaucaaggagauuuaucccaggaaugcaguuacuuuaauauaugaaaaugaauuuauccaauaaauuugaugaguaaaauaaagaauauaaauuaccauaugagaaugcaggaaauucaaacaugcauacauuauuuugaaagccgcuaccaaauuaagaauagaaaggaaauucuccaacaugauaaaguacaucuauggaggccugcccagcucaccaccaccaucagcacccacacccgccauccaggugccuaaagacaagugagaccugccuacuccaaacagcacacaagcaugucaucccagaaccaaauaguaacacuucauuugcugccaccaguguuuacauguacaguacagggccugaggacaagcccaugcccaugcuguccagaagcaugaguacuggccaggcccacucauugcugccagugcccaacagcaccaauaacuugaaaaacagcugccaccacccaccacuauggauggcuacagccaacacccaugcacaccaccuggggacccaaggacaggugcacccugccccugcaaacaguauccgcaggcacugucccaggaagaaagaacaggcccacccaaucugcugccaccaggaccugcccgcacaauacugugccuaaagacagggcugcccuguccacugccaccaccacagcccauacacacugucaaggggccuaagcacuagcccacccuacucaccauugccaaugcccaaguacacugccaaugcccaaguacauugccaaugcccaaguggccugagaacccacccauuguuuccugucaccuaccucggccacagcuggcaccaaacaugcugaccagggacccaagaacugaccugccuggacccuaaccaccacccuaacccauguuaccaccaggaaucccaagaacuggcacaaauggcucaucccuaccaugacuggugcucauacaugccacccagggguccaaagacuauuguaccuguccccaguaaagccuugccacagucuccguuagaaaccacagauucacuuccugcugacgagucugaaaauuuuaaaaauaaauaaauaaauugcagcauaagacaauaaggaccuugcagacaccaauaucacugauuaugaccaaagaaauaacauggagacuauaccacugcauccacucagaauacaacccuaacaaacaucacagauacaucuacaggaaaaagucucuaccaaaugagguuaauccauaaaacugaaagaaacaacugucacaccagaugcauggauaucaacauaagaacauaagaaacaugacaaagcaagaaagcaugacaccuccaaaaaaauacaauaauucuccaguaacguaacacagagaaaaauauauguaugaaaugccugaaaacaaacucaaaauaauuaucuaaggcagcgauccccaacuucuuggcaccaggcaccaguuucagggaagacaauuuuuccacagaccacgggauggcaggggaguauggacuguuuuaggacgaaacuguuccaucucauaucaucaggcaugagauucucacuaggaacaugcaaccuaggucgccugcaugcacaguucacaauaggguucaugcuccugugagaaucuaaugcucccacauaucugacaggaggcagagcuaaggcaguaauauucacucaccugccacccacccccuggcucugcggccugguuccuaacaggccacggaccaguaccaguccauggcuccagggguuggggaucccaaucuaaggaaacucaaaaaguuacaagagaacacagaaaaacaauacaaaaaaaaaucagaaaagaaauucaggauauaagugagaaaucaacacagagauagguaucauuaaaaagaaccaaacaaaaauccugcaauagaagaguucaauuaaugaaauaaaaaacacaauuaagaacuucaacaauagacuaagcagaagaaaaaaauucugaacuugaagacauuucuuuugaaaugaaccagucagacaaaaaaaaaagaauuaauaaagccaacaggacacaugcuacauuauaaaaagaacaaauauugagauuucaguuguuucagaggagaagagaugggcaaagcgaaagaaaaccuauuuaacaaaauaauagcuuugguugccauugcuuuugguguuuuagacacgaagucccugcccaugccuauguccugaaugguaaugccgagguuuucuucuaggguuuuuaugguuuuaggucaaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuuguuagguuugucaaagaucagauaguuguagauaugcggcguuauuuccgagggcucuguucuguuccauugaucuauaucucuguuuugguaccaguaccaugcuguuuugguuacuguagccuuguaguauaguuugaagucagguagugugaugccuccagcuuuguucuuuuggcuuaggauugauuuggcgaugcgggcucuuuuuugguuccauaugaacuuuaaaguaguuuuuuccaauucugugaagaaaggcauugguagcuugauggggaugccauugaaucuauaaauuaccuugggcgguauggucauuuucacgauauugauucuuccuacccaugagcauggaauguucuuccauuuguuuguauccucuuuuauuucauugagcagugguuuguaguucuccuugaagagguccuucacaucacuuguaaguuggauuccuagguauuuuauucucuuugaagcaauugugaaugcgaguucacucaugauuuggcucucuguuugucuguugauuuuuguacauugugauuuuuguacauugacuuuguauccugagacuuugcugaaguugcuuaucagcuuaaggagauuuugggcugagacgaugggguuuucuagauauacaaucaugucgucugcaaacaggagcaauuugacuaaaaagcuucugcacagcaaaagaaacuaccaucagagugaacaggcaaccuacaaaaugggagaaaauuuuugcaaccuacucaucugacaaagggcuaauauccagaaucuacaaugaacucaaacaaauuuacaagaaaaaaacaaacaaccccaucaaaaagugggugaaggacaugaacagagacuucucaaaagaagacauuuaugcagccaaaaaacacaugaaaaaaugcucaucaucacuggccaucagagaaaugcaaaucaaaaccacagugagauaccaucucacaccaguuagaauggcgaucauuaaaaagucaggaaacaacaggugcuggagaggauguggagaaauaggaacacuuugacacugcuggugggauuguaaacuaguucaaccacuguggaagucaguguggcgauuucucagggaucuagaacuagaaauaccauuugacccagccaucccauuacuggguauauacccaaaggacuauaaaucaagcugauauaaagacacaugcacacguauguuuauugcggcauuauucacaauagcaaagacuuggaaccaacccaaauguccaacaaugauagacuggaugaagaaaauguggcacauauacaccauggaauacuaugcagccauaaaaaaugaugcguucauguccuuuguagggacauggaugaaauuggaaaucaucauucucaguaaacuaucgcaagaacaaaaaaccaaacaccguauacucucacucauaggugggaauugaacaaugagaacacauggacacaggaaggggaacaucacacucuggggacuguugugggguggggggaggggggaaagauagcauugggagauauaccuaaugcuagaugacgaguuagugggugcagcgcaccagcauggcacacguauacauauguaacuaaccugcacauugugcacauguacccuaaaacuuaaaguauaauaauaauaauaaaugaauaaauaaauaaaaauaauaauagcuaaaauuucccaacucuuaugagagacauacacauuaagauacaguaaacucaaauuuuaccaaauagauucaauccaagacacuaaacuucucccagacauuaugcucaaacugucaaaaaucaaaggcagagacagaaaucuaaaaauagcaagagaagagcaucaagucacauauaagggaaucuccaucagacuaacuaaauuucucaacaaaaacuuucuaggccaggagagaaugggaugauaucuucaaagcgcugaaauaaagagcuaccagccaagaaugacauauucagcaaaacuauacuucagaaaugaagaauaaauaaagucuuucucagacaaacaaaaacaggcaauuuauaacugcuugacugaugcugugaaaaaugcuuaagggagucauacaucuagaagcaaaaaguaucuaccaucaugaaaacacacaaaaguauaaaacuaacuggaagagcagacacaaaugagagagaggaaucagucauuaucacuauagaaagccaccaagacauaagaguaaacaauaaagagaaagaaaggaacaaaggauauacaaaacaaucagagagcuaacaaaaugacaaaugucuuuacacuaccaauaacaaccuuacauguaaaugguuuaaauucuccaauuuaaaaauguuaacaggcuaaguggauuuaaaaaaacaagaccaaacuauacucuuccuagauaaagacacacauaaacugaaagugaagggauaaaaaauauauauaucacacaaaugaaaacaaaacauaugcauuaguagcuauacacacuuaugucagacaaaauagacauucagucaaaaaacuuacaaagaaacaaaaaggucaucacauacugauacaagcauaaauucagcaagaaaauaaagauucugaauacauacagccaacaucaaagcacacagaaauauaaaguacauauuauuagaguuaaaaagaaaacagaccucaauacaauaauaguuuggaacuucaacauccucuuauaugguuugggucuguguccccacccaaaucucaugucauauuguaauccccaauguuggaagaggggccuuaugggaggugauugguucgugggggagaaugucucccuugauguucuccuaauagugagugaguucuaacgaaaucugguuauuuauaaaaguguagugccucucccuucguucucucuuucuccugcuccagccauguacaaugcacuagcuuccuccucaccuucugccaugauuguaaguuuccugaggcuuccccagaaacagaagccuggacagccugcagaaccauaagccaauuaaaccuccuuucuuuauaaauuacccagucucagguaguucuuuauagcaaugugagaauggacuaauacacucucuuugaacacuaaacagaucauccagacagaaaacaucagguuuaaucugcacuauagaccuaauagaccuaacagacauuuacaaaacauuucauccaauagcugcagaauacacauuuuuuucaccagugcaagaaacauucuccagggcagauccuaugaaaggacacaaaacaaaucucaauaauuuuuuaaaaacugaaaucauauaaaguaucuccugagaccacauuggaauacaaccauaaaucaaguaacaaguggaacaccggaaacuguacaaaccccuggaaauuaaacaacaugcuccugaacagccacuaggucugaagaaauuaaaagaaaaaaauuuuuuuuacuuccugaaacaaaugaaaacagaaacacaacauaccaaaacuauggacaaucaaaagcaguguugagagagaaaugcacagcaauaaaugcuuauauaaaaagugguuauuucaaauaaaaagugguuacaaugaaccucaauggacuagaaaagcaagaacaaacauaacgagaauuaguaggaggaaagaaaugguaaagaucagaguagaaauaaacaaaaugaagacuuaaaaaaaaucaaacauaaaguugacauugugcaaaaauaaaacugauauaccacuagcuagaccaaccaagaaaaaaagacccaaguaagaucgaaaacaaaaagugagacauaaaaauugauaccauacaaauacaaaggaucauuagacacuacuauuaauaucaacaacuauaugcuaaaaaguuggaaauccaagaguaaaugaaugaagagaacaauuccaggcccaauggcucacaccuauaauacuaacacucugggaagccaaggaaggaggauugcuugagaccagguguucaagaccaaccugggcaacacaaugagaccccgucucuacaaauucaaaaaauuggccaagcgugguggcaugcaccgguggucccagagacuuggaggcugaggaaugaggaucacuuaagcccaggaggucaagaccacagugaguuaugaccauggcacuguacuccaguccacgcaacagaacaagauccugucucaaaaaaaauaaauaaauacaaaucuaaaaauagaaaacaauuccauucauaauagcuucagaaauaagaaaguauuuaggaauaaacuuaacaaaaaaaagucaaagacacacugaaaaccacaaaacacuauugaaaaaaauuguaaaggacauaaauggaaagacaucccauguuuauuaaucugaacacaguauuguuaaaauggcaauauuccccaauuuagucuacagauucaauacaaucucugucaaaauccuugcugguuuuuugguuaaaaugauaagcugauucuaaaauucaacugaaaaugcaagaaacccagaacagcuccaaaaaaucuugaaaaaaaaauagcaaaguuguaagacccacacuucccaauuucaaaacuuacuacaaaguugcaauagcacauagcaguaccagcauauggacagacauacagaucaacagaauagaauugagaaugcagaaauaaacccuaacauuuacuaucaauugauaucucacaaagauuccaagacaauacaauggaaaauaaugaagacgcaccauuugucuuuucaacaaauggugcuggcacaaaugaauauccaaaggcaaaaauauuaauuaggguaccuauuucauuccauacccaaaaauuaacuuaaaauggaacaaagaccuaaaucuaagagcuaaaacuauaaaacucuuagaagaaaacacaguaguaauggaucaugaccuuggauuaggcagugguuucuuagauaugacaccaaaagcacagagacuaaagaaaaacagauaaaugggacuucaucaaaauuuaaaaacuuuuauguuucaaaggacaccaucaagagagugagaaacuugccaaaagaaugagauaaaauauaugaaaaucauauaccugauaagggacuuguaccaagaaaauauuuuuuaacucuuacaacaaaaagauaauccaauuuuaaaaugggcaaaggaucugaguagacaauucucaaaaugacauacaaacgacgaauuagcuccagacccuguuucccugaguaucagcagcagaggcugcagaacagcggauacuggugaacagcagauguugcugccugaucauuccucuggaaguuuugucucagagaguaagcggcugugugaggugucagucugccccuauuguggggugccucccaguuaggcuacucagcagaccugcagcugaggguccugacuguuagaaggaaaacuaacaaacagaaaggacauccacaccaaaaccccaucuguacgucaccaucaucaaagaccaaagguagaaaaaaccacaaagauggggaaaaaacagagcagaaaaacuggaaacucuaaaaaucagagcaccucuccuccuccaaaggaacgcagcuucucaccagcaacggaacaaagcuggacagagaaugacuuugacgaguugagagaagaaggcuucagaagaucaaacuacuccgagcuaaaggaggaaguucgaacccauggaaaagaaguuaaaaaccuugaaaaaaaauuagacgaauggcuaacuagaauaaccaaugcagagaaguccuuaaaagacgugauggagcugaaaaccaaggcacgagaaguacgcggcaaaugcacaagccucaguaccagauucgaucaacuggaagaaaggguaucagugauggaacaugaaaugaaugaaaugaagagagaaguuuagagaaaaaagaauaagaagaaacgaauaaagccuccaagaaauaugggacuaugugaaaagaccaaaucuacgucugauugguguaccugaaagugacggagagaauggaaccaaguuggaaaacacucugcaggauauuauccaggagaacuuccccaaucuagcaaggcaggccaacauucaaauucaggaaauacagagaacgccacaaagauacuccucgagaagagcaacuccaagacauaauuguaagauucaccaaaguugaaaugaaagaaaaaauguuaagggcagccagagaggaaggucggguuacccacaaagggaagcccaucagacuaacagcugaucucuuggcagaaacucuacaggccagaagagagugggggccaauauucaacauucucaaagaaaagaauuuacaacccagaauuucauauccagccaaacuaagcuucauaagugaaggagaaauaaaauccuuuacagacaagcaaaugcugagagauuuugucaccaccaggccugcccuacaacagcuccugauggaagcacuaaacauggaaaggaacaacugguaccagccacugcaaaaacaugccaaauuauaaagaccaucgaggcuaggaagaaacugcaacuaaugagcaaaauaaccagcuaacaucauaaugacaggaucaaauucacacauaacaauauuaaccuuaaauguaaaugggcuaaaugcuccaauuaaaauacacuggcaaauuggauaaagagucaagacccaucagugugcuauauucaggaaacccauuucacgugcagagacacacauaggcucaaaauaaagggauggaggaagaucuaccaagcaaauggaaaacaaaaaaggcagggguugcaauccuagucucggauaaaacagacuuuaaaccaacaaagaucaaaagagacaaagaaggccauugcauaaugguaaagggaucaauucaacaagaagagcuaacuauccuaaauauauaugcacccaacacaggaggacccagauucauaaagcaaguccuuagagaccuagaaagagaguuaagacucccacacaauaauaaugggagacuuuaacaccccacugucaacauuagacagaucaacaagacagaaaguuaacaaggauauccaggaauugaacucagcucugcaccaagcagaccuaauagacaucuacagaacucuccacccccaaucaacagaauauacauucuucucagcaccacaccgcacuuauuccaaaauugaucacauaguuggaaguaaagcacuccucagcaaauguaaaagaacagaaauuauaacaaacugucucucagaccacagugcaauuaaacaagaacucacgauuaagaaacucacucaaaaccacucaacuacauggaaacugaacaaccuaguccugaaugacuacuggguacauaacaaaaugaaggcagaaauaaagauguucuuugaaaccaacgaggacaaagacacaacacaccagaaucucugggacacauucaaagcaguguguagagggaaauuuauagcacuaaaugcucacaagagaaagcaggaaagaucuaauauugacacccugacaucacaauuaaaagaacuagagaagcaagagcaaacauauucaaaagcuagcagaaggcaagaaauaacuaagaucagggcagaacugaaggaaauagagacccaaaaaacccuucaaaaaaaauaaaugaauccaggagcugguuuuuugaaaagaucaacaaaauugauagaccacuagcaagacuaauaaagaagaaaagagagaaaaaucaaauagacacaauaaaaaaucauaaaggggauaucaccaccggucccacagaaauacaaacuaccaucagagaauacuauaaacaccucuacgcgaauaaacuagaaaaucuagaagaaauggauaaauuccucaacacauacacccucccaagacuaaaucaggaagaaguugaaucucugaauagaccaauaacagguucugaaauugaggcaauaauuaguagcuuaccaacccaaaaaaguccaggaccagauggauucacagccgaauucuaccagagguacaaagagaagcugguaccauuccuucugaaacuauuccaaucaacagaaaaagagggaauccucccuaacucauuuuaugaggccagcaucauccugauaccaaagccuggcagagacaacaaaaaaagagaauuuuagaccaauagcccugaugaacagcaaugcaaaaauccucaauagaacacuggcaaaccgaauccagcagcacaucaagaagcuuauccaccaugaucaagugggcuucaucccugagaugcaaggcugauucaacauacgaaaaucaauaaacguaauccagcauauaaacagaaccaaugacaaaaaccauaugauuaucucaacagaugcagaaaaggccuuugacaaaauuaaaaaccuucaugccaaaaacucucaauaaauuagguauugaugggacguaucucaaaauaauaagagcuaucuaugacaaacucacagccaauaucauacugaaugggcaaaaacuggaagcauucccuuugaaaacuggcacaagacagggaugcccucucucaccacuccuauucaacauuguguuggaaguucuggccagggcaaucaggcaagagaaggaaauaaaggguauucaauuaggaaaugaggaagucaaauugucccuguuugcagaugacaugauuguauaucuagaaaaccccauugucucagcccaaaaucuccuuaagcugauaggcaacuucagcaaagucucaggauacaaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaugaaauaaaagaggacacaaacaaauggaagaacauuccaugcucauggguaggaagaaucaauaucaugaaaauggccauacugcccaagguaauuuauagauucaauggcauccccaucaagcuaccaaugacuuucuuuacagaauuggaaaaaacuacuuuaaaguucauauggaaccaaaaaagagcccacauugccaagacaauccuaagccaaaagaacaaagcuggaggcaucaugcuaccugacuucaaacuauacuacaaggcuacaguaaccaaaacagcaugguacugguaccaaaacagagauauagaccaacggaacagaacagagcccucacaaauaaugccgcauaacuacaaccaucucaucuuugacaaaccuaacaaaaacaagaaauggggaaagcauucccuauuuaauaaauggugcugggaaaacuggcuagccauauguagaaagcugaaacuggaucccuuccuuacaccuuacacaaaaauuaauucaagauggauuaaagacuuacauguuagaccuaaaaccauaaaaacccuagaagaaaaccuaggcaauaucauucaggacauaggcaugggcaaggacuucaugucgaaaacaccaaaagcaauggcaacaaaagccaaaauugacaaaugggaucuacuuaaacuaaagagcuucuuuacagcaaaagaaacuaccaucagagugaacaggcaaccuacagaaugggagaaaauuuuugcaaccuacucaucugacagagggcuaauauccagaaucuacaauaaacucaaacaaauuuauaagaaaaaaacaaacaaccccaucaaaaagugggugaaggauaugaacagacacuucucaaaagaagacauuuaugcagccaaaagacacaugaaaaaaugcucaucaucaauggccaucagagaaaugcaaaucaaaaccacaaugagauaccaucucacaccaguuagaauggcaaucauuaaaaagucaggaaacaacaggugcuggagagaauguggagaaacuggaauacuuuuacacuguuggugggacuguaaacuaguucaaccauuguggaagucaguguggcgauuccucagggaucuagaacaagaaauaccauuugacccagccaucccacuacuggguauauacccaaaggauuauaaaucaugcugcaauaaagacacgugcacaccuauguuuauugcagcacuauucacaauagcaaagacuuggaaccaacccaaauguccaacaaugguagacuggaugaagaaaauguggcacauauacaccauggaauacuaugcagccauaaaaaaugaugaguucauguccuuuguagggacauggaugaagcuggaaaccaucauucucaguaaacuaucgcaaggacaaaaaacuaaacaccgcauguucucacucauaggugggaauugaacaaugagaacacauggacacaggaaggggaacaucacacaccggggccuguuguggggugggggcaggggggaggaauagcauuaggagauauaccuaauguuaaaugaugaguuaaugggugcagcacaccaacauggcacauguauacauauguaacuaaccugcacguugugcacauguacccuaaaacuuaaaguauaauuuaaaaaauuaaaaaaaaaaaacaaaugaccaauuagcacaugaaaagauaaucaacaucauuuaguuauuaggaaauggcaaacaaaaccacaaugagauaccacuucacacucacuaggauggaaagauggaaggaaagaaaagaaagagagaggaaagaagaacggaaggagauaagcacuggugaggauguagaaaaacaugaauccuucauacauugcuggugggaaugcaaaaucguacagucauuuugaaaaaaaguucagcaguugcucagaaaguuaaacaauauuaaugcaugacacagcaauucuaauccuaguuaucuauucaagauaaaugaaaacauauguaugucuaagaaugggcacaguggcucacgccuguaaucccagcaauuugggaggccaagguggguagaucacuugagcucaggaguucaagaccagccugggcaacauaacaaaaccucaaauauacaaaaaacagaauaauuggccaagcaugguggugcgugccuguagucccaacuacuuggugggcugaggcgggaggaucgcuugagccugggagauggaggcugcagugagcuguuuuccaccacuacacuccagccugggcaacaaagugagacuccaucucaaaagaaaaaaagaaaaagaaaaaagaaaacauaugucuacacaaacacuugcaaacacuuguauaggaauguuuaugacaauauuauucauaauagcuaagaaguggaaacaacauaaaaauccaacuggugaauaaacacaaugugguauaaaaagaaaugaaauacugauauaugcuacaauauuaauaaaccucaaaaacauuaugcucagugaaagccagaugaaaaagaucaaacauauuguaugauucugucuauaugaaauguccaaaaaaucaaaucuuauagagacagaaaguagguuagugguugcuuacagcuguaggugagaauggaaagugguuguaaaugaguaguuucuuuuggagcaugaugggauguucuaaaaccaucaccagacuguagugauggcucacaauucuguaaauauacuaaaaauuauuuaauuauugaauuaaaaugggugaauuuuaugauauguaaauuauaucacaauaaaacuuaauuuuuaaaaaagcacuaaaaaguauuacaaucuuuaaaguaagaucaaacacaggagauagagucagcaguuccaaaguaauacaaacauauggaaacuuucccccuccccagguguauuuuuguuguuugauuucccuuagcacagcagcgauuuauaaaauguuucagauagcccaggagaauucaauguuauuaaaacaaaaauuuaagucuguuaauacugaacuagguuuccuagagaugcauuaacaacauuccucuccauuauaguaagaaggccuaaauuuccucaacuaugagauaaggccaaugcuacuuacaucucacagacuuaugaaaauuaaauaagacaguuuaggcuuagccuaaugccuaacauauaauaaguauuuaauagauauuagcugccguaauuauaaauagaggguuuucaguuccaaacugauauugcucauguacucuuaugacugauaugccaaauaauuaguggaguaggaagaacagcauaauuugauuuaaaaaaaaauacgcuacaagagaacuaaaucuguagauacaaauuauguaagcucauugauagugaaaaugagaucaagcgaggaauaaagaaucccauuaaaagagaaaaaccaaacugguucucuucuaaaaauaaucugcccaagagaauuuuacaaaauucuugugcugugaagcaaauacaucauaauuucucauuccuguuguuuugaaccaagucacuuccuaauucugccugcuaacuuaacugucauaauccaguuucaucuaaauaacucaucauguucuaucccaccuuaguuuccagauauucuagauauccuaaccaucccauuucaccuaccuuuuagaaguagaacauucagaaaaagguuaagaaucaaaagcuccagaacuuucaguagagaaaaacuaaaguauagacaagaugccugcuccuagcuuaagacaacuaggauuuggaaaugacucagguccuuucuaccauacaacagagauacuuuuuuaaauuccacuuuuuaauauucauacacauuccccggaaauauuuuaugaacauuuuaacauugugaauuugaacuaauuauguauuaauacagauaauuaguuauauauauaaaagacauauauaugugucuuugguacaaaauuuugaaaugauacaaagcccucuagauuuuaaaaaucugucaaaaaucacauucuauuauucaaaaauuggcugaguaaacuauaaaacuaauuaauuacacuauugccuguuggcuacaucacuuuuaucaguuuaaaaaauacaucauuuuccuuugucaggaucacgucaaccacauuguucuuuauuaagaagauggugauuugggucauuauuguauuuuuaauucaauuucuacugcuauugaauuuuaaaaucuuuuuauccccuaacaauaucauuaaguguauauuaaauagauguuauaauguuaaugcugugaccaugccugaaaaucacuaacucuggaacagaagucagaugucguaaauucuauaaggaaggccaaacaauuaucuuuuuaugcuaggcugauaauuuagcagaaaauaaacugaaaaaaauauuagagauaaugccagaaaacuaaaaaacaaaauuaaaauaauaauauguaacaaaauuauugauuguuaucccaaagaaccugugcccaccacuuuacaagcauucuuauggaaaagugagauuuaaauaauauaaguauuuuuuaaauuuuacuuuuauuaguuuuuuguagagaugguguuucgccauguugccuaagccguacuugaacuccugcacucaagugauccaccugccuuggucucccaaagugcugggacuacaggugugagccacugcgccuggccuuaaugauauaagcuuuuuguuuuguuuuguuuuguuuuguuuuguuuuguuuuguuuuacuaggcaaagaacuuuauuaaccuuuguuucaaaguuuauucucaggcuucuucggcuuuauuagcugcaaagaaugaauuguguauaagcaaaaccugaaaagagcugcaguguccaaagggcuugggcuuaaaaauauuagagaucuagauuuuaucagauccauaaacaaaaauucuuaaaaaguagucauaauauaaaauagcagcucccaguaacuucuucaaguuuuaucuucagaaguugacucaauucaguuugccucauucuuggaagccucaucaaaauucuccacaagaucaggaacuucaucaucaucauccuccccaguagcaaguggugcuuuuccauccauggauuguuugggcaaagcuucagccagucugcuuaaacuguucagacugucuacaccaagcugguuuaagauguuggguagcauuucugucagcugcuuugucucggcauggccuguaauggugaaaguguuugcugccagagaugccugaacuuuaggguuguuaaaguggaucacuguuccuugguuuguaaacauaugcaccucuucaauaccaaagauauuguuuaccccuaacuucuuuaaggagaacugaaguuuuuuaucaucugcuguggcuguucuaugaaccaccuucuuccuucuacgagcaguuccuuucccaccaaugcacacuugugccugcaguuuggcaaguuuuuccugauucaugauuguuucuuucauccuaucagagcagauaaggggccaugcagagaacuaggguuggugcuaagaggguccuggguggaccagcugagauuaggcgcacacaugcggagaugcaagacggcagcuaaaggggaaugauguauguugugaagcaugcaaagucuucaggauaugucucccauaagauaaaacaacuuuguaugugcaaaccuuuccgaaaauguggcuugguuuuuauuaauuaaaaauuaccauuccuuuacuucuagcauuccaucucucaaaccaaguauaauuauuuauguaaaucuuuuugggaaaccaagucugaaaacugagugugugcuuguucuaaggaugaaagcaucaucauugcaucaauagaccugccuuauucaccuugacaauuuauccaugguaugguaauaaugucaaaaggcucauaaacugcuauggagucaccaauauauguuuauauuuccuacacacaauuuaccugaaaagggagaauuagacuaaguaguuuauagaaguacuuugacauaaauucaaggaccccaaugagucuucuaaauuugugugacuuuccaauaauuauaauuugcuauugucauuuuuucauucacuauguuaaaaagaaaauucaauacucuuuuuaaaauaacuuucuaauaauugauuuauguccaauucugaaaugcucuaaauuauuuccaguaacaacuguaauuugaauccuccagauauuuaauuccccuauacaaauaauuuaacacuaugacuauaggaccauaguugcuaaacagagcauuuuuggcuggcccaaguacagagguguuuacaaccaguugauuacaaguugcagaugucuguuucugccccacucccacugcuucauuugacuagccuuuaaaaaauaaaaaagaagaagcagcagaaauggaacacccuuucucacugcugaucgcaaacaaugauucaaucaucauuaucagucuauguauaacucuugcauuaucagcgaaagcuuaucaagauguuccaaaugcacaaaaacaagggaguuaagauacuuaaaaucacagaaaguuagagacugaaagaaucuuagaguccacugaauucaaaccuucuauuuuaaacauguggucauaauugagaaccaacaagcuuaaaugaaucauuuauggucaacuuuauagguuaagcccauacuaugucgcacacacacauaucuuaccuuucuggugaugacuuggaaguaacaggacacccucggauauguuuuuuauuuuuauggucuagagagaugacuuuauuccuuaggcuucuuucccacuaggaaaaaaaaaaugaaauuuuaauaauaaacauaucaauaugacaagaggcauuuaaacuguucuuuuuuauuuggaaauuuguuauaaacgaucaaauacauaguucacagagaaaaauaauaagugcaaucuauggaauaucuggcucuuuuacuaaugcauaaauguaaguccaccaaaaaauacuaggaagacauuuuaaaguaccaagguaacuuuaaucaaaaaaucaacacuuugagauuccaaagcuuaaacagcuauuaaaaucuggaauguacuuaaaggaauaaaaauuauuacauagaagguuaaauagggccuaugauucuaaaguaacuguacuuauaacaauugaaagauauuaaaauuaguuaccuaggaacugccauguggaaaauuuuaggaaagagccggacaccuuauugacagaguuuagauuaaauaugacuagaauaaaagguucaaauuaauuuauuuaauacacaguguuagccuaggcaaauaagucauuuauauucucuaugccuuaguuucuuuaucugaaaagggauauaguaacaguagcuaccucacaaagauauacaaugauuacaucuguauuaaguuuugguuuuacuuccacaucacagaacagacauuuguaguaaauuuacaagacugucuucauaaaagagauauuuguacaaucauguuuguaguccacgauucgcaauaaccaaaagagggaagaauccaccaaaaagaaaauguuaagguugcucgacuaauucagaaaacuugcaggauauaagaucgaaaggccaaaaucaguuguauuucuauuuaauagcaaugagaaaucugaaagagaaauuaagaaaaaaaauuccacuuacaauagcauaucaaaaagaauaaaauacucaauaauaaauuuagucaaggcaauguaagacuuuucugcugaaaauaucaaaacaugcuguaagaaauuaaagaaacccuaaauaaaugaaaagacauccccuaaucaaggacugaaagacuuuauuaacuauaucaacuauuuugguuagcaguugggcauuacuccccaaaaugaccuccagauuccauucacucccuaccaaaauuccaacagccuguuuugcagaaauggacaaacugaucugaugauuaauugcuagaggcucagaagaaccaaaacaaucuugaagaaggagagcaaaauuagaggacucacauuucaguuucaaaauuuacuaugaagcuagaguaaucaaaauaauguuggcaacggguaaacauacagauuuaugggacagaauugaaagucuagaaauaaacccauauaucuaggaccaauaauugauuuucagcaaggaugccaaaaccauucaugagagaaaaauaaacuuucaacaaauaguucuagaacaacugaaccgccacaugcaaaagcaggaacuugcacacuugcuucacaucauauucaaaaaugaauucaaauggagagaagaccuaaacauuauacaagagcuaaaauuaugaaacucuuagaaaaaaaaacacagcaguacauuuucaugacuuguauuuggcaaugacuucacagauaugaccaaaaaaccacaaguaacaagagaaaaaugauaaaguggacaucagcaaaauuugaaacuuuuauucauuacuggaauagugaaaaggcaaccaacccaccaaaugggaggaaauauuugcaaauaauauaacugauaaaaguauaguauccaggucaaccacaauggcucacaccuguaaucccagcacucuggaaggccaaggcaggaggauugcuugaggccaagaguuucaggucagccugggcaacauaguaagaccccaucucuuaaaagaaaaaaagguauaguauucaaaauuuaaaaaaaaaaacucuuacaauucaguaagauaaagacaaaaauaguuuuuaaugggcaaagaaugugaauagauauuucuccaaaaaacuacacaaaugacaaaaagcacauuagaagacacucagugucauuagucauuaggaaaugcaaauccaaaccaaagaagugaaagaucuccacaaugaaaaccauaaaacauugaugaaagaaacuggagaaugucaaaauaauggaaagauaacuccacggucaugguuugaaucaauauuguuuaucuccuucaagaacaaaaaaagaaaaaugaaaaaagaaucaauguuguuaaaauguccacaccaaaugaagaaaucuauagauucaccaaaaucccuauaaaaauaucaauaacauucuucccagaagaaggaaaaauaccccuaaaauuuauauggaaacacaaaaaaaugcaagucaaaaccacagugacauaccauuucguacccacuaggaugaagaaugaaggaagagaggagaaggaaaacgaaguaaaagagcaagagagaaaaaaaauuaaguguugcugaguauaugaagaacauggaaccuucauacauugcuagugggaauguaaaugguacagguaccguaagaaaaaaaaaaacaguauugcaguuccucgauaacuuaaacauaaaauuaccacaugacacagcaauucucacccuaaguauaaaacaaaagaauggaaaacagguuuucgaacagaugcuuguaguucauagaagcauuauucaauaacagaaaaaaaggugaaaacaauacaaacagaugaacagauaaacaaaugugauauauccauacaauggaauauuauuagaccauaaaaagaacuaaacuacuaccacauacuauaacauggaugaacuuugaaagcauuugugcuaagugaaagaagccauagacacaaaagaucauauauugagugauucuguuuuugugaaauaucuagaacaggaaaauccaggcaacagaaaacaaaguaguaauuuccaggggcugggaaguuggcagaauagagagauaaauuaagaagugaaugcuuaaugguuaaagaguuuccauuugggguaaugaaaaaguucugaaacuagacagagaaagugguugcacaacacugugagugaacuaaaugccacuaaauugaaugccauaaaacggcuaacaugguaaauuuuguguuguauguauuuugucacaacaauagcaaaaaagcauaugacuaaaucuccaguaagaaauacagcauuaagaaaccacuaagaauacaguggcucacaccuguaaucccagcacuuggagaggcugaggcuggcagaucaccucaggucaugaguuugagaccagccugaccaacauggagaaaccccgucucuacuaaaaauacaaaauuagccaggcgugguggcacaugccuauaaucccagcuacucgggaggcugaggcagaagaaucacuugaacccaggagguggaggcuggggugagccgagaucgcgccauuacacuccagccugggcaacaagagugaaacucugucucaaaaaaaaaaaagaaagaaagaaaagaaacacuaagaauaaagagaccaggugcaguggcucacaucuguaaucccagcacuuugggaggccaagguggauggaucgcuagaggccaggaguucgagaccagccugggcaacacgaugaaacccugucucuacuaaaaauacaaaaauuagcugggcgugguggugcaugccuguagucccagcuacuggggaggcugaggcaugagaaucgcuggaacccaggaggcagagguugcagugagccgagaucaugccacugcacuccagucugggcaaaagagcgagacucugucuaaaaaaaaaaagaagaaaccacuaagaauaaaggaaaagacugauaaacuacauucaucaaaaucaaauauuucugcucaucaaaagacauacaauuaagaaauaaaacagcuacagauugaaaguauuugcaauacacauacugacaacagacucauauccuuauuauacaaagaauuucuacacaucaauaacaaagacuaaaaacucagacuugagccagguacaguggcuuaugccuguaaucccaacacuuugggaggcugaggcaggaagaucacuugacgucagaaguuugagaccagucugauaaauacagugagacccuaugucuacaauaaaggucguggcacaugucuguagucccagcuacucagaaggcugaggcaggaggaucacuugagccuaggaguuugaggcugcagugagcuauaaucguaccacugcagucaggccucggugacacagcaaaaccauguaucauaaauaaauaaauaaauauauauauauauauauauauauauauauauacauauauauauauauauauacacacacauauaaaauaaaaacucagauuuaaaaaaugagcaagaauucuacuugaaauaaaauggaauaagaauaaucuucucugcuucucccacugagugcaacuaagaauucuagacagacuucauggagaagcuaucuuaggacccugaagaguauaugcuaagaaugacauuggugaacucaaaguaauaccaaaccugcaaucuaaccaagacccagagaccugcaacuuaauauucaaaauguccaggauauaauccaaaaacugcuuggcauauaaaaagccuaggaaaucucaacaacucacaaaagaugaguaucaagagcagccaaguagaagaagacagagauguugaaauuaccagaaaaaaacuucauuuauuuauuuacguauuuauucauucauuuauuuauuuauuugagauggaguuuuacucuuguugcccagccuggagugcaguggcgcgaucucggcucacugcaaccuccgccucccagguucaagcacuucuccugccucagccucccaaguaguugggauuacaggcacccacuaccaugcccagcuaauuuuuuguauuuuuaguagagacuggguuucaccauguuggccaggcuggucuccaacucaugacuucaggugauccagccacucagccuccaaaagugcuggaauuacaggugugagccaccacacccagccaggaaaaagcuuuaaaguggcuauuauacuguucucugagaggaugaacucucugaaagaaguaaaaagacagaaaaucucaacagaggaacaaaauuaaaaaagaaacaaauggcaauuugagaacuacaaaguaacaugaccaaauuuuaaaaagcacugaauggccuaaagcaggagucccuaaccccaggccauggacugguauugguccauggccuguuaggaaccaggccgcacagcaggaggugagcggcaagugagcaacugaaacuucaccuguauuuacagccacuccccauuacucacauuaccaccugagcuccaccaccugucaggucaguggcagcauuagauucucaaagcacaaacccuauuaugaacugugcauaugagugauacugguugcaugcuccuuaugagaaucuaaugacugaugaucuguuacugucucccaucaccuccagaugggaucaucuaguugcaggaaaucaagcucaggucucccacugauucuacauuaugguaaguuguauauuuauuuaauuauauacuacaauguaauaauaacagaaauaaagugcacaauaaauguaacaugcuugaaucauuccaaaaccaucccaccugccccacuaccuggauccauagaaaaauugucuuccaugaaaccugaugccaaaaagguuggggaccgcuggccuaaaaagcagaaaggagacuaaaaagggguaaguggaucuggaaauagauagaccaauagaaauauucaaucugaagaacagaaaggaaacagaugcuuauguaaauuuaauguuaugcuuuauuuaaaaaagaaugaaaauacauuauaacaaaaaacuuaaaguggcccacccaccacuacuggcacccacacaugucauccggagaaacaaaaaucaauccacauuccucaaugucaccaauguacaucaucaggguuccuagggaacaaccuacccaccuacugcuaccaagacccacacacaccauuagggggguggagggggcaugaagggagacccacucugcccaccaucagcaccugugcacaucauccuccagaggccuagggaucaauccaccccccucacccccgccacuggcucagacacaugccuuccaaaaaccugaggacaagccaacuccaccuauagcugccacugccauugccuacacaaaucauuuagaggucuggggauuggcucaacacacccagccauacuggcauccacacacaccacucaggcaacuaaugacaaguccaccuagcccacugccauuacuacuggugcuuaaggaacagcccaccuggaguccucaugcucagcaaagccucaccauggcugccauuaacaaaagcagucugcaucacuuaggaacugugacacugcugacaugaguuacaauccaaaaaaucauaaaagauuacaugacugugucuauguaaaaaucagacaaaccacuucacagaaccagcacuauaaauauaucuauaggaaaaaguuuuucccuaccaauguuaaugguaaauuggaagaaaacagcuguugaaauaaacacagacacuaacaaaaagacaugagaaacaugaaaaagcaaggaaacaagacaccuccaaagaaacaaaauaauuuuccaauaagagacccauaagaaaaggaaauguauggaaugcuggaaaaaaaaucaaaauucugauacaaaagaaacuaagugagauauuuuuuaaaaaguaaauaauccaaaaaauuaugaaaacaauuuaugaucucgauuagaaauucaacaaagauugauaucauuuaaaacguccuacaacugaagauuucaaugaaauauaaaauacaguugagagccucaacaauagacaaaauuaagcagaagaauuucugaacuugaaaacagauuuuuaaaaaaauaacccauucagacauaacaguaaaaaacaacuuuaaaaaaugaagaaagccuacauaacauaugagaugccauaaagcgaccaaauauucaaauuaugggaguuucagaagaaagagaaauggaagaaaacauuugaaaaaaauaauagcugaaaacuucccaagucuugcaaaagacaaaaacaugaagauacaggaguacaaaauuccucaaauagauucaauccauaaaaggcuucuacaagguauaucauagucaaacugugaaaagucaaagacacaauucuaaaaauagcaagaaaaauaucaaaucacacauaagaaaauccccauaagauuaaaaacaaauuucucagcagaaaccuuacaggcauaugaugauauauuacaagugcugaaaauaaaaugucagucaauaauaccagauccacaaaccuauccuucaaaaaugaaggacaaauaacaucuuucccagacaagcaaaagcuaagggaauuuaucacacuacacuacaaaaaugcuuaauagagucuuaaaacucucaaagaaacacacaaaaguauaaaacucaauaguagagcagacacacaaauaagacagagaauggagucacauguuaucacuacaaaaagccacaaaaucgggcauuccaagauggcuaaauaggaacagcuccagucugcggcucccagcaugauugacgcagaagaugggugauuucugcauuuccaacuucgguaccugguucaucucacugggacuggcuggacaguaggugcagcucacagagggcaagcugaagcagggcggggagucgccucacccgggaagugcaaggagucaggggacuucccuuuccuagccaagggaagcugugacaggcuacguggaaaaaugggacagucccgcccaaauacugcacuuuucccaaggucuuagcaaccagcagacaaggugauucucuccccgugccuggcucggcaggucccacgcccacaaagccuugcucacugcuagcacagcacucugagaucaaacugcaagacggcagccuggcugggggaggggcauccgccauugcugaggcuugaguagguaaacaaaguggccgggcagcuagaacagggcagagcccaccacaguucaacaaggccuacugccucuagacuccaccucugcgggcagggcauggcugaacaaaaggcagcagacaacuucugcagauguaaacgucccugucugacagcucugaagagagcagugguucucccagcacagcguuugagcuuugagaacagacagacugccuccucaagugggucaaugaccccaguguagccuaacugggagacgccucccauuaggggaugacagacaccucauauagguggcugccccucugggacgaagcuuccagaggaaggaucaggcagcaauauuugcucuucugcaauauuugcuguucugcagccuccauuggugauacccaggcaaacugggccuggaguggaccuccagcaaacuccaacagaccugcagcugagggaccugacuguuagaaggaaaacuaacaaacagagaggaauagcaucaacaucaacaaaaaggucaucuacaccaaaaccucaucuguaggucaccaacaucaaagaccaaagguagauaaaaccacaaagggggagaaacuagagcagaaaagcugaaaauucuaaaaaucggagcaccucgucuccuccaaaggaucacagcuccucaccagcaacggaacaaagcuggauggagaaugacuuuaacgagcugacagaaauaggcuucagaagaucaguaauaacaaacuauuccaagcuaaagaaggauguuugaacccaucgcaaggaagcuaaaaaccuugaaaaaacauuagacaaauggcuaacuagaauaaagaguguagagaagauuuuaaaugaccucauggaggugaaaaccauggcacgagagcuucgugacacaugcacaagcuucgauagacaauucagucaaguggaagaaaggguaucagugauugaagaucagauuaaugaaauaaagcaagaagacaagguuagagaaaaaagaguaaaaagaaacaaacaaagccuccaagaaauaugggacuaugugaaaagaccaaaucuacauuugauugcuguaccugaaagugauggagagaauguaaccaaguuggaaaacacuccucaggauauuauccaggagaacuuccccaacuuagcaaggcaggccaacauucaaauucaggaaauacagagaacaccacaaagauacucugugagaagagcaaccccaagacgcauaauugucagauucaccaaggcugaaaugaagggaaaaguguuaagggcagccagagagaaaggucgaguuacucacaaagggaagcccaucaaacuaaugguggaucucucggaagaaacccuauaagccagaagagagugggggccaauauucaacauucuuaaagaaaagaauuuucaauccagaauuuaauauccagccaaacuaagcuucauaagugaaggagacauaaaauccuuuacagacaagcaaaugcugagagauuucgucacuaccaggccugccuuacaagagcuccugaaggaagcacuaaacauggaaagaaacaaccgguaccaaccacugcaaaaacaugccaaauuguaaacaccaccagugcuaugaagaaacugcauaaauuaacgggcaaaauaaccagcgaacaucauaaugacaggaucaaauucacacuaacaauauuaaccuuaaauguaaaugggcuaaauaccccaauuaaaagacacagacuggcaaauuggauagagucacugaugggaagacccauuagugugcuguauucaggagacccaucucacaugcaaagacgcacuuaggcucaaaauaaagggauggaggaagaucuaccaagcaaauggaaagcaaaaaaaaagcagggguugcaauccuagucucugauaaacagacuuuaaaccaacaaagaucaagagacaaagaaggccauuacauaaugguaaagggaucaauucaacaagaagagcuaacuauccuaaauauauacacacccaauaaaggagcacccagauucauaaagcaaguccuuagagaauacaggagcacccagauucauaaagcaaguccuuagagaccuacaaagagacuuacacccccacacaacaauaaugagagacuuuaacacaccacugucaauauuacacagauaaacgagacagaugguuaauaaggauauccaggacuugaacucagcucugcaacaaacagaccuaauagacaucuacagaacuuuccaccccaaaucaacagaauauacauucuucucagcaccacaucacacuuauucuaaaauugaccacauaauucgaaguaaagcacuccucagcaaauguaaaagaacagauaucacggccgggcgcgauggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaaccugggaagcggagcuugcagugagccgagauugcgccacugcaguccguaguccggccugggcgacagagcaagacuccgucucaaaaaaaaaaaaaaaaaaaaaagaacagaaaucacaacaaacugucucucagaccacagugcaaucaaauuagaugucagaauuaagaaacucauucaaaaccacacaacuacauggaaagugaacaacuugcuccugaaugacuacuauguaaguaacaaaaugaaggcagaaauaaagauguucuuugaaaccaaugagaacaaagacacaacauacaagaaucucugggacauauuuaaagcaguguguagagggaaauuuauagcacuaaauguccacaagagaaagcaggaaagaucuaaaaucgacacacuaacaucacaauuaaaagaacuacagaaggaagagcaaacaaauucaaaagcuagcagaaggcaagaaauaacuaagaucagagcagaacugaaggagauagagacacaaggagauucggcaaaccgaauccagcagcacaucaaaaagcguauccaccacaaucaagucggcuucaucccuggcaugcaaagcugguucaacauaugcaaaucaauaaacguaaugcaucacguaaacagaaacaaugacaaaaaccacgauuaucucaauagaugcagaaaaggccuuugacaaaauuaaaaaccuucaugccaaaaacucucaauaaacgagguaucaauggaacguaucucaaaauaauaagagcuaucuaugacagacccacagccaauaucauacugaauaggcaaaaacuggaagcauucccuuugaaaacgggcacaagacaggcaugcccucucucaccacuccuauucaacauaguauuggaaguucuggccagggcaaucgggcaagagaaagaaauaaagaguauucaauuaggaaaugaggaagucaaauugucccuguuugcagaugacaugauucuguauuuagaaaaccccauugucucagcccaaaaucuccuuaagcugagaagcaacuucagcaaagucucaggauacaaaauaaaugugcaaaaaucacaagcauucuuauacacccuuaacagacaaacaaagagccaaaucaugagugaacucccauucacaauugcuucaaagagaauaaaauaccuaggaauccaacuuacaagggaugugaaggaccucuucaaggagaacuacaaaccacugcucaaugaaauaaaagaggacacaaacaaauggaagaauauuccaugcucauggauagggagaaucaauagcaugaaaauggccauacugcucaaaguaauuuauagauucaaugccauccccaucaagcuaccaaugacuuucuucacagaauuggaaaaaacuacuuuaaaguucauacggaaccaaaaaagagcccacauugccaagacaauccuaagcaaaaagaacaaagcuggaggcaucacacuaccugacuucaaacuauacuacaaggcuacaguaaccaaaacagcaugguacugguaccaaaacagagauauagaccaauggaacagaacagaggccucagaaauaacaccacacauuuacaaucaucugaucuuugacaaacaugacaaaaacaagaaauggggaaaggauucccuauuuaauaaauggugcugggaaaacuggcuagccauauguagaaaacugaaacuggaucccuuccugacaccuuauacaaaaauuaauucaagacggauuaaagacuucaauguuagaccuaaaaccauaaaaacccuagaagaaaaccuagggaauaccauucaggauauaggcauaggcaagaacuucaucacuaaaacaccaaaagcaauggcaacaaaagccaaaauagacaaaugcgaucuaauuaaacuaaagagccucugcauggcaaaagaaacuaccaucagcgugaacaggcaaccuacagaaugggagaaaauuuuuacaaucuacccaucugacacagggcuaauauccagaaucuacaaagaacucaaauuuacaagaaaaaaacaaacaacccccucaucaaaaagugggcaaaggauaugaacagacacuucucaaaagaagacaucuaugcagccaacagacacaugaaaaaacacucaucaucacuggucaucagagaaaugcaaaucaaaaccacaaugagauaccaucucacgccaguuacaauggcaaucauuaaaaagucagcaaacaacagaugcuggagagaauguggagaaauaggaaugcuuuuacacuguuggugggaauguaaauuaguucaaccauuguagaagacaguguggcgaauccucaaggaucuagaccuggaauuaccauuugacugagcaaucccauuacuggguauacacccaaaggauuauaaaucaugcuacuauaaagacacacgcacacauauguuuauugcagcacuauccacaauagcaaagacuuggaaccaacccaaauguccaucaaugauagacuggauuaagaaaauguggcacauauacaccauggaauacuaugcagccuuaaaaaaaaugaguucauguucuuugcagggacauggaugaagcuggaaaccaucauucucagcaaacuaucacaaggacagaaaaccaaacaccgcauguucucacucguaggugggaacugaacaaugagaucacuuggacacagggcggggaacaucacacacugggaccugucgcgggguggggagcugggggagggauagcauuaggagaaauaccuaauguaaaugaugaguugaugggugcagcaaaccaacauggcacauguauaccuauguaucaaaccugcacauuaugcacauguacccuagagcuuaaaguauaauaaaaaauaauuuuuuaaaaaccaccaaaucauaaagguaaacaauaaaagaauagagaaauagagauauaaaagcagucagaaaaucauuaacaaaaugaguaaguccuuuuuuuaaaacuuuuaauuucagagguaccuguguagguuuguuacauagguaaacuuaugucaugggggguuguuauacagaauauuuaugacccagauauuaggccuaguacucauuagcuauuuuaccugaugcucuccccuccucacacccuccaccuucugaaaggcucuagcauguguuguccccuucuguguccauguauucucauaacuuagcucccacuuauaagugagaacaugcaguguuugguuuucuguccuccauuaguuugcuaaggauaauggccuccagcuccauucaagucccugcaacagacaugaucucauuuuaugguguauaugugccacauuuucuuuauccaguaaaacauuacugggcauuuagauugauuccaugucuuugcuauuauaaauacugcugcaauaaacauaugugugcaugugucuuuauaauagaacaauguauauuccuuuggguaaauacccaguaaugggacugcuggagugaaugguacuucugucuuuacaucuuugaggaauggccacauugucuuccacaaugggugaacuaauuuacacucccaccaacacuuuauaaccauuccuuuuucuccacaaccucaccaccaucuguuacuuuuggaguuuuuaauaguagcaauuuugacuagugugagaugguaucucacugugguuuugauuugcauuucucuaaugauuagugauguugagcuuucuuucauaugauuguuggcugcauguacgucuucuuuggaaaagcacuuguucaugccccccuuggcccacuuuauaaugggguuguuuuuugcuuguaaauuuguuuaaguuaauuauagaugcaguauauucgacuucugucagaugcauaguuugcaaaaauuuucucccauucuguacacugucuguuuacucuguugacaguuucuuuuggugugcagaagcucuuuaguuuaguuagaucccauuugucaauuuuugcuuuugucccaauugcuuuugguaucuuuaucaugaaaucuuugcacgugccuaucuccugaaugguacugccuaggcugucuuccagaguuuucaguuugagguuuuacauuuaagucuuuaauccaucucgagcuaauuuuuguauaugggcuaaggaaggggucuaguuuuaauuuucugcauauggcuaaccaguuaucccagcaccauuuauugaauaaggaauccuuuccccauugcuuguuuuugucagguuugccaaagaucagauaguuguagguaugcagucuuauuucugggcucucuauucuguuccauuggucagugugccuguagcauagcuugaaguuggauagcaugaugccuccagcuuuguucuuuuugcuuaggauugccuugaccauucaggcucuuuuuugguuccauaugaauuuuaaaauaguuuucucuaguucuguaaagaaugucauugguaguuucauaagaauagcauuaaaucuauaaauugcuuugggcaguauggccauuuuaaaaauauugauuguuccuauccaugagcauggaaugugcuugugucaucucugauuucuuugaacaguguuuuguaguucuccuugaagagaucuuucaccucccuccuuagauguauuccuagguauuuuauucuuuuuguggcaguucugaaugaguucguuccuagucuggcucucaguuugauuguuguugguauauaggagugcuagugauuuuuggacacugauuuuguaugcugagacuuugcugaaguugcuuaucaguuuaagaagccuuugggcugagaauaugggguuuucuagaucuaggaucaugcugucugcaaauaggaauaguuugacuucuucucuuccuauuuaggucccuuuauuucuuucucuuaccugacuguccuggccaggacuuccaauacuauguugaauaagagugaugacagugggcauccuggucuucuggcaguuuuuaaggggaauacuuccagcuuuugcccauucaguaugauguuggcugugggcuugucauacaugguucuuauuauuuugagguauaugagaggaauaagucuucacuaccaauaacaaccugaauguaacugguuuaaacuccacaauuagaagauuuagacuggcugaauagauaaaacacaagacccaacagaaugcugccuacaagaaacucacuucaccuauaaagacacacaugaagugaaagugaagggaugugauggauacauauauauaucccauguaaauggaaaccaaaaguaugcaggaguagccauacuuacaucagacaaauaggcauuaaguuaccaaaaaaacuuaaaaagagacaagacaguguggugauuccucaaagaucuagaagcagaaaugccauuugacccagcaaucccauuacuggguauacacccaaaggaauauaaaucauuuuauuauaaagauacaugcacacauauguucacugcagcauuauucacaauaaccaagacacggaaucaucccaaaugcccaucaaugacagacuggauuaaaaaaaugugguacauguacaucagggaauacuaugcagccauaaaaaggaaaaagaucauguccuuugcagggacauggauggagcuggaagccguuauccucagcaaacuaaugcaggaacagaaaaacaaacaccacauguccucacucauaagugggaguugaacaaugagaacacacugguggggaauaauacacacuggagccugucagggggacgaagggaaaaagaacaucaggaagaacagcuaauggaugcuggucuuaauaccuaggugaaggguugaucugugcagcaaaacaccauggcacacguuuaccuauuuaacaaaucugcacauccugcacguauacccuggaacuuaaaauaaaauugaaggaaaaaaauauauugcaaaacuugaaauaaaaauaaaaagaaacaaaaaggucaucauauauugaugaagagauaaauucagcaagagaacauaacaauuauaaacauauuuacacccaauacaggagcacucagauaaauaaagcaaauaugagaacuaaagagagagauaaaucccaauacaaugauacuuggagaauuaaacaucccacuuucaacaugcagaaggaaaauaaaccaaaaaaaauugaacauuucugcacuauagaccaaauggaccuaagagacaucuacagaacauuucauccaccagcuacagauuacacacucuucucacgagcacaaagaacauucuccauauguuaggccacaaagguaacauugccaguuuuuuuauuauuauuauucuuuaaguucugagauacauguguagaacaugcagguuuguuacauaaguauacaugugccauggugguuugcugcacccaucaacccgucaucuacauuaaguauuucuccuaaugcuaucccuccccuuacccccaaucccccaaaggccccagugugugauguuccccgcccuguguccaugugcucucauuguucaacucccacuuaugagugagaacaugcagugucugguuuucuguuccuguguuaguuugcugaaaauaaugguuuccagcuucauccaugucccugcaaaggacaugaacucauucuuuuuauggcugcauagaauucuaugguguauaugugccacauuuucuuaauccagucuaucauugaugggcauuuggguugguuccaagucuuugcuauugugaauggugccacaauaaacauacaugugcauguaucuuuauaguagaaccauuuauaauccuuuggguauauauacccaguaaugggauugcuuggucaaaugguauuucugguuccagauccuugaggaaucgccacacugucuuccacaaggguuaaacuaacuuacacucccaccaacaguguaaaagcauuccuauuucucuacaaccucuccaguaucuguuguuuccugaguuuuuaaugauugccauucuaaauggcaugagaugguaucacauugugguuuugauuugcauuucucuaaugaccagugaugaugagcuuuuuuucauguuuguuggccgcauaaaugucuucuuuugagaagugucuguucauauccuucgcccacuuuuugaugggguuauuuguuuuuuucuuguaaauuuguuuaaguuccuuguagauucuggauaguaguccuuugucagauggauagauugcauaaauuuucucccauucuguagguugccuauucacucugaugauaguuucuuuugcugugcagaagcucuucaguuuaauuagaucccauuugucaauuuuggcuuuuguugcaauagcuuuuuguguuuuagucaugaagucuuugcccaugccuaugcccugaaugguauuaccuaaaaccucaccaaauuuuuaaaaaucaaaauaauaugaguaccuuugcagaccacaauggaaaaaaaaauuagaaaccaauaacaagaacuuuggaaacaauacaaauacauggaaauuaaacaacaugcuucugaaugaccagagucagggaagaaauuaagagggaaaucaagaaacaucuugaaacaaguaaaaauauaaauucagcauuuaaaaccuguaacugcaaaagcacuauuaagagagaaauuuauagcaauaaauacguaugacaaaaaaguauaaagauuuuaaguaaaaaaaaccuaauaaugcaccugaaaaaaauagaaaagucagaacaagccaaaacaaaauuaguaaauggccggacaugguagcucaugccugugaucccagcccuuugggaggcugauguggguggaucacuugaggucaggaguuugagaccaaccugguuaacauggugacacgcccucucuauuaaaaauacaaaaauuagcugagugugguggugggugccuguaaucccagcuacuugggagacugaggcaggagaaucacuugaaccugggagguagagguugcagugagccaagaucacgccacugcacuccagccuggguggcagagugagucuccaucucaaaaaaaaaaaaguuaguagagaaaaaaaaauaaacaucagagcaaaacuaaagaaaacagaaagacuaaaaauauaauacaaagaaucaaugaaaaaaagcguuguuuuuuuuaaagauaaucuugauaaacaacuggcuagacuggcuaacacacacacauacccuaauaaacaaaaucagaaaugaaaaaagagacauuccaauugauaccagagaaauacaaaagauuaucagagacuacuaugaacaacuacgagcuaacaaacugaaaaacuuagaaaaagauagauaaauuucuggacacauacaaccuaucgagacugaaccagaaagaaacagaaacccuaaacaacccaauaacaaauaacaagacugagugaguaggccagcacaguggcuuaugccugcaaucccagcgcuuugaaaggccaaguugggaggacugcuugaguccaggaguuuaagaacagccuaggcaauacagcaagaccccaccucuaccaaaaaaaaauuuuuaauuagccagccauggucgugcauaccugugauacuagcugcucaggaggcugaggugagaggaucacuugagcccaggaauucuaagcuaggcuacaaggagaaugaucaugccacuguacuacagccuggacaacagagcaagacccugucacuaaagaaaauuuuaaaagguugaauaauaaaaaggcucccaaaaaagaaaagcccacgaccugauggcuucauugccaauuucuaccaaacuuacaaagaagaauaccaaaucuucugaaacuauuccaaacaauagaagaugauggaauucuuccuaacucauucuacgaagucauuccuacccuuauaccaaaagaagacaaggaaaugcacacaaaaaagaaaacuuccagccaauaucccuuaugaaaacagacacaaaauaccucaacaaaauauuauuaauagcauaccgaauccaaaagcacuuuaaaaagauaauacaccauaaucuaagugagauuguauucagagaugcaagaaugguucaacauaugcaaaucaauaaacaugacacaucacaucaacaggaugaaaaacaaaaaccaugcagucaccucaacagaugcaaaaaaaaauuugauaaaauaaugucucacuuuaugauaaaaaugcucaagaaacuagcuauaaaaagaacauaccucagcaggauaaaggucauauauuacaaauccacagcuaacaucacacugaaugaagaaaagcuaaaagacuucccucuaagaacuggaacaaaacaggaugcacauauucaccaugcuuauucaacauaguaauggaaguccuagccggagcaaucaggcaagagaaaaaauaaaagacauccaaauugaaaaagaggaaguaaaauuaucccucuuugcagaagacacgaucuuauauuuagaaaaaccuaaaaacuucaccaaaaaagacucagaucucagcugggugcaguggcucacgccugcuguuccagcacuuugggaggccaaggcaggaauucaagaccagccugagcaacauggcaagacaccauccucugcaaaacaauuuuaaacaauaaaaauuagccaggcaugauggcacgugccuguagucccagcuacuugagaggcugaggcaggaggaugguuuccuugugcccaggaagaugcagugaacuugcagaugaucaugccacuauacuccagcuugggugacagagugaaacugugucaaaaaaaaaaaagaaagacucagaucucauaugcagauaugaugaacgacacaaaaucaacaucaaaaauguagugauuaugugcuagcuaauagggaggcugaggugggaucaccugagcccagaaaguggaggaugcagugagccgagaccaugccacugcacuccagccuggacaacagagugagacucugucaaaaaaaaaaaaaaaaguagugauuuuauacaccaacaaugaacuaacugaaaaugaaauccagauagcaauuccacuuacaacagcuacaaaaaaaaaaaaaaaaaaaaaaaaaaaaaacacacacacacacacacaaacaaaaaaaacuaggaauaaauuuaaccaaagaaguaaaagaccuccaugaggaaaacuacaaaacacuaauggaaaaaacugaagaggauaggaacaaaugcaagauauaucaugcuuaugaacuggaagaauucauauuguuaaaaugaccauacuaugcagcaaucuacagauucaaugcaaucccuaucaaaagaccaaugacuauuucauagcaaugaaagauaauaaaccuaaaauuuguauggaaacaagaauccaaauugccaaaacauuccugagaaaacagaacaaagcuagaggcaucauacuaccugacuucaaacuauauuauaaggcaauguaaccaaaacagcauaguacugguauuaaaaacagacccacagagcaauggaacagaauaaagaacucauaaauaaauccacguauuuaaaguaaaaugauuuucaacucaggcacccuaacauacacuggguaaggaacacccucuucaauaaauggugcugagaaaacaggauauccauacgcagaaaaauaaaaccagaccccuauuccucaccauauacaaaaaucaacuuaagauggauugacaacuuaaauauaauaccugaaacuauaaaacuacuaaaaggaaacaccucaggacaucggucuaggcaaagauuuuaugacuaagaccucaaaagcaaagcaacaaaaauagacaauggcuucuguacggcuaaggaaacaaucaauagaaugaagagacagucuaaagaauaggagaaauauuugcaaaauacucaucugauaagggacuaauauccagaauacacaaggaacucaaaaacucaacaaaaacaacaaaucccguuaaacagugggcaaagggcaugaauagacauuucuuaaaagacauacaaauggccaacagguacaugaaaaaaugcucaacaucacuaaccacuagggaaauguaaauaaaaccacaaugagauaucgucuuaucccagucagaauagcuauuaucagaaagacaaaaaaaaaaaacagaugcuggugaggaugcaggaaaaaaggaacucacauacacuguuggugggaauguaaauuaguauagcuauuaugaaaaacaguauggagauuuccccaaaaaaaaaaaaaaacuaaaaauagaacuaacccaugauacaguaaucccacuacuggguauuuauccaaaggaaaggaaaacaauauuucaauaagauacauacacucccauguuuacugcagcacuacucacaacagcaaugauauagaaccaaccaaacugcccaucaauggacaaacggauaaagaaaauaugguguauuuacacaauuaaacauaauuuggccauaaaaaagaauaaaauucugucauguacagaaacauggacgcaacugaaggucauuauguuaagugaaguaagccagaaacagaaagaaaaauauuccauguauucacucauaugugggugcugaaaaaguugaucucaugaagguagaggguagaauuauagauacuagaggcugggaaggguguagaggggagaggucacaauggagagagguugguuaauggcuacaaacauacagcuagauagaaggaguaaguucuaauauucaguaguagaauacggugacuauaguuaacaucaauguauuguauauuucaaaguaacuagaaguaagaacuugaaauguucucaauacauagaaauaauaaaugcuugugaugauggauauccucaacacccugauuuggucauuacacauucuucacauguaacaaaauaucacauguaugccauaaauauauacaaauauuuauaacuuuuuaaaaagauaugcugauugggaaauaaaacugucuuuguuugcagaugacguaacugucgauguggaaauuccaaaagaaugaacaaaaaaacugaaaccaauaagcaauuacagcgagguugcaugauacaagauuaauauacaaaagucaaucaccuuccuauaugccugcauaaauaacuggaauuugaaauuaaaaacacaauaucguuuacauuagcacauaaaaaaugaaauacuuggccaggcgcaguggcucaugucuguaaucccagcacuuugggauaccgaggugggcagaucaugaggucaggagaucgagaccauccuggcuaacaaggugaaacccugucucuacuaaaaauacaaaaaaaaauuagccaggugugguggcgggcaccuguagucccaacuacucgggaggcugaggcaggagaauggcaugaauccaggagacggagcuugcagugagccgagauugcaccacugcacuccagccugggcgacagagcgagacucugucucaacaaaaaaaaaaaaaagaaagaaauacuuugguauaacucuaacaaaauauguacaagaucuguaugaggaaagcuacaaaacugugaugaaagaaaucaaagaaccaaauacacagaaaaauauuccauguucauggauaagaagagucaauauuauucagaugucaugucuucacaaguugaucaacagauucaaugcaaugucaaucaaaaucccagcaaguuacuuuguggauaucaacaaacugacuagaaaguuuauagagaagcaaacgacuaggcauaaaaaacacaauuuuuaaagagaaaaacauagaggauugacacugccaaacuucaagacuuauuauaaagcuacacuaaucaagagagugugguaugggugaaagaauauuuuuuuauuuuuucuuagacacuauggugaccuaucuuuuuauuuuuuuuaauaaauagaucaaagaaacagaacauacagcccaaaaauagacccaaauaaauacagucaacugaucuuuggccaagaggcaaaagcaauagaaugaaaaaaguuccuuucaauccauaucaaaaccacaaggagauaccaucucacaccagucagaauggcuauuacuaaaaagucaaaacaacaacaacgaaugcuggcaaggcuguaaagaaaagggaaugcuuauccacuguuggugggaauuaguucugccacuguggaaagcaguuuggaaauuucucaaagaacuuaaaauagaccuaccauuugaaccagcaaucccauuacugaguauauguccaaaagaaaauaaaucauucugccaaaaagacacaugcagucaaauguuuacugcagcgcuauuuacaauagcaaagacauggaaucaaccuaggugcccaucagugguggacuggauuaaaaaaaagugguacauacacaccauggaaugcuaugcggccauaaaaaaagaacaagaucauguccugugcagcaacauaggaucaccuaagcuaauuaaugcaggaacagaaaacaaaauacuacauguucucacuuauggccacccaugccaucuuuauguccaugagcauccagugugggagcuaaacauuggguaaucauggacauaaagauggcaaaaacagacauuggggacuacuaguggggaauaaagggggugggaaaaggguugaaaaacuaacuauuggauacuaugcuuccuaccugcgugacgguauaauaguacccuaaaccucagcaucaagcaguauacccauguaacaaaccugcauauguacuagcugagucugaaaguucaaauuauuaaaaagaaaacgguauuuucaacaaacugugcuagagcaacugaauauccacaugcaaaagaaugaucuggacaaagaccucacauccuucauaaaaauuaacacaaacugggcugggcaugguggcuugcaccuguaaucccagcaguuugggaggccgaggcuggcugaucacuugaagucaggaguuugagaccagccuggccaacauggugaaaccucaccucuacuaaaaauacaaaaauuagccagguccagacaugguggcaggugccuguaaucccagcuacucagaagacuguggcaugagauugcuugaacccaggagacggcgguugcaguaagcugaaauuacaccacugcacuccagccugggcaacagagcaagacucugucuaaaaaaaaaaauuaacucaaacuggaucacaaaccugaaugcaaaaugcaaaaccauaaaacuccuagaagauaacauaggagaaaaucuagaugacuuugagucuaucaauggcuuuuuaaacaugacaccaaagccacaauccaugaaagaaugaauugauaagcugggcuucauuaaaauuaaaaauuucugcucuggaaagacaaugucaagagaaugagaaggcaagccaaagacugagagaaaauauuugaaaaugacguaucugcuacaggacuguuaucuaaauauacgaagaacucuuacaacucaacaguaagaaaaugaacagcuugaaaucaucaugguggacaggaggcaggaccagauugcagcuacaugcagagcagcuugcagaagcucucauuguggauuuuagccccagaucgacagcaacaacaaaccagcaaucccgagagggcccacagacccucuaaaggauguggacugcuccugcaggacccaggagacacuccaaauacugugagugccccaacugcggaagugggaaagggagaccucccucucccgaacacgugcccccaauggagaagcugaaggucuguuugcgggagaaguuuccgaccuaaccuggagcugagccaauuuagagagccaggugaaauacagggguagaggaagcagcaaaaaggcccugggagcucgcugcguccccuagcaagccauuccugccuggcaccacaggaauccauuggguggaugaccagaggagcagggguauaacuccacagggagaaggaaaucucuagcagaacuuucuaaccauuugaacggggugagaagcccauucacacccucagacuggaaacagacuugggacuguugaggggagcacagugggacagagaccggcccuucauuuuaccugguagcugggugaggucugugacugucagcuuucccccacugcccugacaaccugcaugacucagcaaaggcagccauaauccuccuagguacccaacuccaaugaccugggaaucucacccacaccccccacagcagccaaaacaagacccacccaaguagaaucugagcucagacacgccuagccccaccuccaccugaugguccuucccuauccacccugguagcauaagacaaaggacauauaaccuugggaguucuagagucucucccaccgccagugccucucuauccuaccauagcugaugcuuucuggaaagggucaccuccuggcaggaggucaaccagcacaaaaauagaacauuaaaacaccaaagcuaagaacccucauagaguccauugcaccccgccacuaccuccacuggaaaaggcauugguauccacggcugagagauccaucgaugacucacaucacaggacucuguccagacaacccccaguaugaggccagagcugggaagacucgcuggguggcuagacccagaagagagacaacaaucacugcaguucagcucacaggaagccacauccauaggaaaagggggagaguacuacaucaagggaauaugccaugggacaaaagaaucugagcaacagccuucagcccuagaccuucccucugacagagccuacccaaaugagaaggaaccagaaacaacucugauaauaugacaaaccaaggcucuucaacaaccccccaccaaaaucacacuaguucaccagcaauggauccaaacccagaagaaaucccugauuuaccugaaaaauaauucaggaggauagucauaaagcuaaucagggagggaccagagaaaggugaaguccaaugcaaggaaauccaaaaaaugauacaagaagugaagggagaaauauucaaggaaauagaucgcuuaaagaaaaaaaacaauaaaaaguucaggaaacuuuggacacacuuuuagaaacgugaaaugcucuggaaagucucagcaauagaauuaaacaaguaggaagaaagaaauucagaacucgaagacaaggucuuugaauuaacccaauccaacaaagacaaaagaacaagaaaauaugaacagagucuccaagaagucugagauuauguuaaacgaccaaacauaagaauaaucaguguugcugaggaagaagagaauucuaaaagcuuggaaaacauauucuggaauaaccaaggaaaacuucccuggccuugcuagagaccuagacauccaaacacaagaaguacaaagaacaccuggaaauuucaucacaaaaagaucuucaccuaggcacacggcaaucagguuaccgaaagacaagacaaaggaaagaaucuuaagagcugugagacagaagcaccagcuaaccuauaaggaaaaccuaucagauuaacaguggauuuaucaguagaaacccuagaagcuagaagggaauuggggcuaucuucagccuccucaaacaaacaauuaucagacaagaauucuguauccaacgaaaguaaguaucauuuaugaaggaaagauacaguuguuuucagacaagcaaacgcugagaaaauuugccacuaccaagccaccacuacaagaacugagaaaaggagcucuaaaucuugaaacaaauucuggaaacacaucaaaacagaaccucuucaaagcauaaauuacacagaaccuauaaaauaaaaauacaaguuaaaaagcaaaaacaaaaaacccaaguacaccagcaacaaaaguaugaugaaugcaaugguaccucacauuucaauacuaacauugaauguaaauggccuaaaugcuccauuuaaaagauacagaacugcagaauggauaagaacucaccaaccaucugcugccuucagaaaacucaccuagcacauaaggaaucacauaaacuuaagguaaagggguggaaaauggcauuucaugcaaauggacaccaaaagcgagcaggaguagcuauucuuauaugagacaaaacaaauuuuaaagcaacagcaguuaaaagagacaaagaugggcauuauauaaugguaaaaggcuuuguccaacaggaaaauaucacaauccuaaacauauacacaccuaacacuggcacucccaaauucauaaaacaauuacuaauagaccuaagaaaugaaauagacagcaacguaauauuagugggggacuuuaauacuccacugacagcacuauacaggucaugaagacagaaagucaaaaaagacacaauggauuuaaaccauaccuuaaaacaaauagacuuaccauuuacauauauauauguaaaaacauauauuauuuuuuaauaagguuauugguuuuucauuuguugauuuaaguuccuuacagaaucuggauauuagaccuuugucagagacaauaguuugugaauauuuucucccauuccuuagggauuuuguuuuguuuuuuugcugugcagaagcucuuuaauuaaauuaaguuucauuugucaauuuuguuuuuguugcaauugcuuuuggggaauuagccaaaaauucuuugccaaggcugauaacaagaaggguauuuccuagguauuuuuccuaagauuuuuauaguuugagguuuuacauuuaaaucuuuaauccaucuugaguuaauuuuuguauaugguaaaagguaaggguccaguuucauucuguugcauauggcuagccagcugucccagcagcauuuauugaauagggaauccuuuccccauuauuuguuuuugucagccuuucaaagaucagaugguuguaggugugcagcauuauuucugaguuuucuguucuuuuccauugcucuaugugucuguuuuuauaccuguaccaugcuguuuugguuacugugggcuuauaauauaauuugaagucagguacugugaugccuccagcuuuauucuuuuuguuuaggauugcuuuagcuauuugggcucuuuuuuguuccauaugaauuuuagaauaguuucuucuaauucucugaaaaaugacauugauaguaugauaggaauagcauugaaucuguagacugcuuugggcaguauggucauuuuugugacacugaugcuuccaauccacgcgcauggauuguuuuuccauuuauuugugucaucucugauuuuuuucugcagugucuugugguucuucuuguagacucuuucaccuucuuagucaacuguacuccuagguauuucauuuuuuuuaagccuauugcaaaugggauuguguucuugauuugacucucagccuggacauuauuuggugucuagaaaugcuacugauuuuuucuacauugauuuuguauccugaaagguugcuaaaguccuuuaucaguucuaggaacucuucaucagagucuucagaguuuuauagguauagaaacauuucaucaguggagggauaauuuaugugagauuauguaaagagacuaaaucuaucacucacuggcauuccugagaaagaaugggagagaauacgcaaacuggaaaauacauuugaggauaugguccacaaaaauuucccuaaucacaauagaaagguugacaugcaggccaggcgcgguggcucaugccugcaaucccagcacuuugggaggccgaggcagcuggauugccugagcucagaaguucgagaccagccugggcaacacagugaaaccuugucucuacuaaaacacaaaaaauuagcugggcauggcagcaugugccuguagucccagcuacuugggaggcugacgcaggagaauugcuugaaccugggagguggagguugcagugagccaagaucgcaccacuguacuccagccuggcgacagagagagccuugccugcgccaaggcacaucgucaucaaauucaccaaagucaacgcaaaagaaaaaaucuuaaaggcagcuagagagaagggucaggucauguacagaaggaacucccaucaggcuagcagcagacuucuuggcagaaaccuugcaaaccagaagagauugggggccucuuuuaggcaaccuuaaagaaaagauauuacaacuaagaauuucauauccuaccagcccaacauucauaagugaaagagaaauaaaauccuucucagacaagcaaauacugagggaauuugcuucaacuacaccagccuuacaagaaagagguccuuaagggaguacuaaacauggaaucagaagaaugacaccuacuaccacaaaaauacacuuaagcacauagcccacagacacuacaaagcaacuauacagucaagucuauacaacaaccaacaacauaaugacaggaucaaaaucucacauaucaauacuaauccugaguauaaauggcuaaacgucccucuuaaaagacauggagugucaagguggauaaaaagacaagacccaaccaucugcuaucuucaagauacccaucucacaucuaacaacauucacaggcucaaaguaaagggaaagagacagaucuaccaugcaaacagaaaauaaaaaagagcaggagccacuauucuuauaucagauaaaauagacuuuaaacaaauaacaauuaagaaggacaaagauggguauuacauaaugauaaaugguaaaauccaacaaaaagacuuaacuaauuauauaugcacccacuauugguacacccagauucauaaaacaaguuuugcuugaccuacaaaaagacuuaguuaggcaaccacaucauaauagugaaagacuucaacaccccacugacagcauuagacagaucauugaggcagaaagcucacaaagagacucucacuuaaacucggaagugauuaacuggaccuaauagacaucuacagaacacuccaccuaacagccacagaaaauguuuuuaacgucauuagucaucacaaaaaugcaaauuaaaaccaagcccaggccgggcacagugguucacgccuguaaugccagcauuuugggaggccaaggcaggcggaucaccugaggucaggaguucaagaccagccugaccaacauggauaaaccccaucucuacuaaaaauacaaaacuagcccgaugugguggugcaugccuguaaucccagcuacucgggaggcuguggugggagaaaucgcuugaauccgggaggcagagguuguggugagccaagaucgugccauugcacuccagccugggcaacaagggggaaacuccgucucaaaaaaaaaacaaacaaacaaacaaaaaaaaaaagagccuaaaagucagucaauagagaauuaaauaaaccauaauauauucacauaauggaauauuacauagcaauaaaaagaaacaaaccagugauagaugcaaaacauggauaaauguuagcaauauuauacugaauaaaaagaagccaaacacaaaagaguacauauuaugugauuccauuuuuaugaaauuuaagaacaggcaaaacuauggaaacagaaaucagaagaaugguugccagaaucaugguggagguacaagcaacagaagaggaaaagacacaaugguugagucauauacuugagucacauaaaaaagaaaaaugaauuaauuaaaaauauauuaaauucuuuugauuuuuuuaaaagauaaaaugaaaacaaggaaaauuucuggagcaugacaauauguuacucuagucagagcucaucuaacuuuacucuuaagauugccuguuuaauguaacuauaugucaauaaaaaucacaaacaaaucaauaaaugaguuaaaauucuccuaaagacuauggaaaggggcauuuauuccuuucucuuccauugaaaaccacuaaaaacaacaacaaaaaaguugaguaguggaaaugcggcaagauacuugcacagccucaaacacuacacaaaguaugagcaaauauuuagcaaauauggugaacuuuaagccaaccacagagcacaguaaggcugacauaugccacuuccaaucucaaacaggauuucgauuucccaaaauuuaaguaucacuuaacuuuugcgaauaucaaaaaacaguauaaacccauauauauggaaauaugcuuuuuucuagaaauaaaugaaaaaaacucauuaauagugguugccuuuagagaaaaaggacagaacgagauuuuauuugcuucauuuuauacuuuuuuuuuuuuuuuugagacagggucucauuguuucccaggcuggaguauaguggcacaaucauagcuuucuuuaaucuugaacuccugggcucaaaggauccucccaccucagccuccugaguagcuggaacuacaggugcacaagaccacgccuagcuuauuuuuuaauuuuuaguagaaacaggaucucgcuauauuuccuaggcuggucuccaaauccugggcucaagagauccucccaccucagccugcugaguagcuggaacuacaggugcacaagaccacgccuagauuauuuuuuaauuuuuaguagaaacaagaucucgcuauauuuccuaggcuggucuccaacuccugggcucaagagauccucccaccucagccucucaaagugcuaggauaacaggugugagccaccacacacagcccaccuuguaucuuucuacacagcccaaauuuucuaaccuuaugcaaauauauuauuuucuuuuuaaguaaacagaagucaccuggucuccuuuauuguuucccuuuuuauguacucuuuguauccaauacaaaccaacaaauguauuauuuaauaacaaaauuucuaaauguucuuuuacacuaauuuuaagcaaagaauacugaggacaaaucucuccuccaagaacaaauuuuagaaaugguuaauaggaggucgggcacggugccucaugccuguaauaccagcacuuugggaggccaaggcagguggaucaccugagguugggaguucgagaccagccugaccaacauggagaaaccacaccucuacuaaaaaauacaaaauuagccgggcgugguggcacaugccaguaaucccagcuacuggggaggcugaggcaggagaaucgcuugaacccggaaggcagagguugcggugagccgagaucgcgacauugcacuccagccugggcaacaagagcaaaacgccaucucaaaaaaaaaaaaaugguuaauagagccaagugcgggggcucacgccuguaaacccagcgcuucaggaggcugaggugggagguucaccuaagcaacacagcaaaacuuugucucugcaaaaaaauuuuagaaacuagcuaagcaugguggugcaugccucuaauccgagauacucaggaggcugaggugggagcacagcuugagcccaggaagcugaggcugcaaugagccgugagugugccagugcacuccagccugggugacagagcaagacccugucucaaaaaaaaaauacguaaauaaauaaggguuaauuuuacuuguaaccaaaaauauacauuuuaagauuacuuaaaacacguuauccuaaaauaaaugcuacaguuauggacugaauuguauucccccaaaauucauauguugaagccccaacucccagggccuuaaaagggguugagugaggucauguggguggagucccaauccaauaggacuaauguccuuauaagaagaagagacacuagggguacgugugcccagagaaaaagccaucugcaauccaaguaaagaggccucagaagacaacccugccagcaccuucaucuuggacuuccacauuccaaggccaggcauaauggcucauaccucuaaucccagcacucugggagaccaaaguaggaagacuucuuaaggccagaaguucaagacaagccuaggcaacauagcaagaucccaccucuacagaaaaaaaauuuuaaguagccaggcaccugcuuguauucccagcuacucaggaggcugggcagcaagaucacucgagcccaggaguucaaggauucaaugagcuaugagugugccacugcacuccagugugagcaacacagacccugacucuaaagaaccuaaaugcccuuccaugguaguuuagauaaagaaaaugugguacauauacaccacagaauacuaugcagccauaaaaaagaaugagaucauguccuuugcauggaugaagcuggagaccauuauccucagcaaacuaacacaggaacagaaaaccaaauacugcauguucucacuuaucagugagagcugaaugaucagaacacgcggacacauagagggaacaacacacacuggggccuuucagagguuggaggaugggaggagggagaggaacaggaaaaauaacuaauggguacuaggcuuaauaucugggcgaugaaauaaucuguacaauaaacccccaugacacaaguuaccuauggaacaaaccugcacuuguaccacuaaacuuaaaauaaaaguuaaaaaacaaaacacaaaaaacugcuaucuuaauccuuauucaucaaagucugauuauaaugcuuaaaaaugagauaaaguccagauuuauaaucaaaauagcuuuugaaauauaguuauauuacuccuuaaaacauacauuuuaaaacuuaaaaugggucaagugcauaagaacaaacaauucuauaaacauuaucguuuuaguaaacuuaaaacagaauuuauuuuacaauaauaagauuuaaauuucaugaaguaaucaauuaugcauaauuauauauacauaguuuuaaacgaagagccuaaccucaaaguaucauuucaacaugccaaaaaugaacuaaaaucugcaauuaaauaacacaagaaaaccaaaaaagggacauaucagaaaauaaacauucaguuuuauuacaauauuuuaaacauaccaaauaaaacuguauacuuaaaauaaauuaauuuuauuuaccaccugcaaagggagaguccagcguucugagcuucugaauuuggacaguggugauugaacauggacauccucugguuuugcauuuaacaucuuucuuaucugaaaauaggaugagaaaauaauuaguuuaauugaacuauauacaagagcuaauucagcuaacagaaccacuauacuacccugcaucaauaauuugcuaacuguuuuaaggaguuuuaaauucagugcuuaauuuauauacaauuaaauauaauuuuauucacaaaaaaccucuccuugacucugaaagucaaaugaaaguugaaugaagaaucagaagagcuuccuaacuauucucuugucugcugucucuuccccuuuuaaccuuucaaaugucagccccagaguucucuaauacauaaaaccuaauuauggcugcaauacuuaaaauucaacaaugguagccauuacuuacagauaaaacucuuaacaauuguaaaacucuuuaccauuugggcucuuucacaucacaucacuacaaaacuacaacccaaccacaaugaaugaaaucaaccuucuucaaacacaucauauuauuuuauaucucuaaaccuuugcauauacucuucccacaaucuagaaugcucuuccuucucucccuagugaaguacuccagauucuugucaaaauuacuauuuuaucuauacaaccaucaugccauaccacgcauuccuggaacagaaucaauggaacagaccaauggaacagaacagagaacucugaaauaagaccacacaccuacaacuaucugaucuucgacaaaccugacaaaaacaagcaauggggaaauaauucucuauuuaauaaauggugcugggagaacuggcuagccauaugcaaaaauugaaacuguaccccuuccuuauaccauauacaaaaauuaauucaagauggauuaaagacuuaaauguaaaacacaaaacuauaaaaacccuacaagaaaaucaaggcaauaccauucaggacauaggcacaagcaaauaucucauaacaaaaaugccaaaagcaauugcgauaaaagcaaaaauugauaaaugggaucuaauuaaacuaaggaacuucugcacagcaaaagagugaacagacaaccuacagauugggagaaaaauuuggcagucuauccgucugacaaacucuaauauccagagucuacaaggaacauaaauuuauaagaaaaaaaauucccauuaaaaagugggcaaaggauaugaacaaacaguucuuaaaggaagacacacauguggccgacaucacugaucauuagagaaaugcaaaucaaaacgacaacgagacaccaucucacaccacucagaauggcuauuauuaaaaagucaaaaaacaacagaugcuggcaauguagcagagaaaaaggaacacuuuuacaccacugcugggauuguaaauuaguucaaccauuguggaagacaguguggugauuccucaaagaccuagaggcaaacauaccauuugaccuagcaacaccauuacuggguauauacccaaaggaauauaaaucauucuauuacaaagauauaugcaugcacauguuugcugcaacacuauucacaauagcaaagacauggaaucaacccaaauccccaucaaugauagacugaauaaagaaaauauaaaacauauauacauaggauacuaugcagcccuaaaaaggaacacaaucgugucuuuugcagggacauggauggaguuggaagccauuaucuucagcaaacuaaugcagaaacagaaaaccaaacaaugcauguucucacuuuuaagugggagcugaaugaugagaacagauggacacaaugggggaacaacacacacuggggccugucagaccgguagagggagcaucaggaagaauagcuaauggaugcuggccuuaauaucuaggugauggguuguucuugcagcaaaccaccauggcacacauuuaccuaugcaaugauccuacacauccugcaaguguaccccgagcuuaaauaaaagucgaagaaaaaaauguucaccacuguuucccugguacuuaugccuaacacaguguccaauacauguugaauacccaauaaauaucuacugaccaaugcuuuaauaaauuagauuucagaaaauaauguucaugauauauagguaaguaggaaaaaagauuacaagacaguauuuugugguuuucuauuuuuuaauauguuucuuauaaacagacaaauaaacuagaaggauacacaccaaaguauuaauucugguugugucuggguggccuuaauucacccagugaaauaaguucuuaauugaacuuuagaauaucucuacaacaaucuagugucauuuuagaaauauuucuuaaacauguauuuauuuauucgagacagggucucgcucugucaccuaggcugguguguagugacucaaacauaacuuacuucugcuucuaccucuugggcccaggcaaucuuccugcaucagccuccuguguagcugggaccacaggcaugcaccaucauaucugacuaauuuuuuuauuuuuugcagacacagggucuuacuuuguugcccaggcuagucccaaauuccugggcucuguggcucaagcaauccucccaucuuggccucccuaagugcuggguuuagaggcaugagcucccacacccagccaaacacuucaaacacuuuuuuuuuuuuuuuuugagacagagucucguucuguuucccaggcugaaagugcaguggcacaaccucagcuaacugcaaccuccgcccccgaguucaaacaauccucccaccucagccuccgaaguagaugggacuacaaaaaugcaccaccauacccagcuaauuuuuguauuuucaguagagaugggcuugcaccaucuuggccaggcuggucuugaaguccugaccucaagugauccacccgccuuggccucccaaagugcugggauuauaggcaugagccaacccaccaggcccaggccaaacacuuuaaauucaacacguauuaguaucuucucccuauauccaucaaagcucuuauccuuuugguaacuuauuuccacuagcagccuggagggaaaaggcaguaauauaaacuacuaacaauaaugaaauaugcuaauuuucuaagaaagucuaccuuuuuuaaacacacuaacacaacuuuauauauaaauuacgggauuaagaaauaaguaaauauauuguagauaaugagagacagaaaaaaauaaggaaagaggaaaagcuagaauaagccuugugguguuggaccggaaucagaaguaucaguauuaauuuuuuauagauauauagauagagauacagaaauaaauauagauacauguguuugugugggaaaauaaauagacauauguauguuguaugugugaacauauauuuuucuagucuugucuguugagaaagccuaaaaacaaugacaucccaguugcaaguauaccuagcacacagacauggguuucuaaauaucauccuucaauugaaagaaccaaggcucccugggaaagugguugauuccaagccuggggcagggaaaacacaacauaagcaucuugcagugccaaaaaauauacagugucagaaaguaaguguucaaaaaaaaaaagauaggagcacgucacaaggguacagccaacaugaaagaucucccaaggcuggaauacuuugaccaacaaaucuguaaugacaguaguggauuauaacucauagaauaaacuaaauauucuaugaguccauauugauacaaauaaauaagugaagccaagcacaguggcucacaccuagaauccucacacuuugagaagcugaagcaggaggaucucuaaauaaauaaauaaguaaguaaguaagugggggaagaggaucagcucugccuuacauaagaauuuuuauuuuuuagagacagugucucacucuguuauccaggcuggaaugcaguggugcgaucacagcugaucacagccucaacuccccuggcucaaacgaucuuccuaugucagccucccaaguagcugggauuccaggcauaugccaacaugcccagcuaauuuuuuuuguagauauggggucucacuauguugcccaggcuggccucaaauuccugaccucaagugauccucccaccuuggccucccaaagugccaggauuacaguugugagccaccacacuggccccuuauagaagaauuuacauucauaaaucuauaaugaaugggcaaaagagaaaaccaccaaaauaccacauauauaaauuuggaggcaagauacacugauagaugcuaaaauaguaaacaaaaguuugagaagaaauaguauauuugcauagauucaaagcaucuccccuaagauauuuauuaauuauaaagaggaaaaaaguaacuuuacaauggaggaaacaggcagaucccaucuuaaccaaacaaucaaggcugauauuaccaguauuaagauauaucacuaucauguacccccugauauaaugcacuaagaaggucaucaucacuucugugguauuccucccaaaaagucauaaccuuaaucuaaucuugagaaaccugaaacaaacccaaagugagagauauucuacaaaauacuguccaguuuucuucaagagugucauggucaugaaagaaaaaagacugaagaauugucauagacuuaagaaaacuagggagaccuaacaacuaaaugcaaugugggauccuggauuggaucuggcaacagaaaaaggacauuagugaaacugaagaaauccaaaugaugucuauaguuuaaagcaggugugcccaacccccaggccaaggacaacacagcaggaggcgagcagcacgggagaauuagggccugcacuaccccuccugucagaucagcaguggcauuagauucucauaggagcacaaacacuauugugaacugugcaugcaagggaucuagguugcaugcuccucaugagaacccaaugccugaaaauuugagguagaacaguuucaucccgaaaccaucuucccgaccccuguccaugggaaaacugucuuccacgauacuggucccuggugccaaacagguuggggaccacugguuuaagguacuguaucaauauaaauuccuuguuuuuuguaaucauaccguaguuauauaagauaacauuaggagaaccugagugaauuuuacaggaacucuguaaaauuucuguaacuuuucuguaagucucaacuuccuuguaaacaaaaaguuuaagaaacacuguaguacaucuaaaaaucagagaaauggauuaacucaguauuaauuucuaauggcaggauuucagauuaauugcaugaauaaugcaauagucuaaagcacgauauuucacuucacuggauauaauaaaaacaaaaauagugguaguuaauacagagguauuucaaaguagauaugauaguauucauccuggcaauguaagguuuuuuuagggggcagcgggggacagagucucgcucugucacccagacuggagugcaauggcgcaaucucggcucacugcaaccucugccucccggguucaagcgauuuuccugccucagccucccaaguagcugggacuacaggcaccugccaucaugcccagcuaauuuuuuuuuuuuuucuuggagacagagucucgcucugucgcccagucuagagugcaguggcaugauuucagcucacugcaagcucugccucccagguucacaccauucuucuaccucagccucccgaguagcugggacuacaggcaccugccaccacaccccgcuaauuuuugguauuuuuaguugagaugggguuucaccguguuaaccaggauggucucgaucuccugaccucgugaucugcccaccucagccucccaaagugcugggauuacaggcaugagccacugcgcccggccaauuuuuguauuuuuguagagacgggguuucaccauguuggccaggcuggucuugaacuccugaccuaagaugauccgcccgccucagcacaagauuuuuuuuaaccuccuauuuaccccacuuaaacuaaauccagaguuuuaaauggagaaaccacaccaugcaaaucuuaagccaaaaaagaaaguguaucuaaagccauacuuucuauauggucuucuaagguacucuugauuuccucucauugucuuccuuuaugacuucuucuccuucuuuguuaaaugcuauaacuauauaacaugaagacguaucauauuaaaguucucugugcauaacuuagacugcuucagagaaaaggguuuaauaaauucuuauaauguaaaucgggauauuacugcauuuaaagaacaaaauucuagaaaaaaaauuaucucuauaugccagguaugguggcuuaugccauaaucccaacacuuugggaggccaaggcaggaggauugcuugaggccaggaaugugagaccagccugggcaacauagcaagaccccugucucuacaagaaaaaauuaaaauuagcuggucaugguggcacaucccuguauucccagcuacaugggaggcugaggcaggaggaucccuaaagcccaggaguucaaggcugcagugagcuguacuugagccugggcaacagagcaagacccugucucuuaaaaaaaaagaaaaagauuaucuuucuuaaaaggaauuaauuuuuuaaaacacuuccuauauagguagaaacuucguuuuguuuguuuugcuacucuuggcuuacguagaagaaauaaaugaaaaaaagaggcuuaaaaggacauauucccaauaguaauguucagcacauaccuugaguacaacuacucugcaucuauagcauuacuaaugaaugcacauugguacucuaauagauuaagucaucaaagaaauguugugcuauguuuuaaauaaaaucuaaaaugagcucuggaaaguauacuggucaucugguccagaaaguauacuagucaacuauuuaaacaaaguugguagaaaagucuccugguuaaccuucaguuaauuagaauacaccacucucccaaaacacugacuaaaguuuuauacuguuuucuuuaaaauguuauuaaaaagacaaacagcaaaauacuuucaauaucaguaacuccaaagauaauagguuaaaagcaaaacaaaugcauaccuccgauaaaucagaagaugacuuuuuccuuuuuccuucugugaugauuucuacaaaaaccaaagacgugguaaaaauuaucguuuaacaucuaaaugagauaaacaguuugacaaaggagauucuuucacauucauccuuuguuuuaaauuaacuuguuagauuuagaauuuacacauuuuacagaaacugaagggcuaaacauaaaagucaaaaaauaacuacaugugucagaagaauagcagauucucacaaaauguccccaguaaaauauuuauauauauaaauauauauauaaugacaauagaaaagaaagaggaaaacuuggcucuaagaacuaaacagaaauucccugaccaaagaccucacaccuaguaguagaaccauuugaucagacaaauucuuauaaugggggagguagaagcaggugaaauucuagaaguuagaaguugagaauauucuauaaaaacacuuucaguucuacuacauaucuaagcaugcugggcaacaugcuuagggaacagcuuaacucucuuuuacucaccaacauuuuucagacuugcuguggauuuuucugaguuauaacuuccaaccagcaaacauuaauucaaugucuauuaugugccugacacugugcuaggcaaugaguacaguauagugggcaaauuaggcaguacaguauagugggcaaauuccaaacuuuccuggaacuuagagucuacuggaauauaucacagauuuuacuaaaaaaauaaauggcagagauucaacauauggucagcugcuuaugacaaaugcacgacugcaauuccauaggaaagggaugauuuucaaaaugaugcugaggcaaucugauaaccaaaugggggaauaacacccuugacuaccucacaccauacacaaaauuaauuugaaaugaaucauagauugaaaugucaaagauaaaaacaaagcaucuagauuuaaguaggagaauauauucacgaccuuuggguaggcaaagauuuuucaaagaggacacaaguaguccuaaccacaaaugaaaacguuaauaaacuguacuucauuaaaauuaagaacuucugauccuacuguagcucaugagcaugaugacuggguguucacacgcaucugugagauaugccaccuugaaccuuguuaccaggucagcguauuacccaucugacaugaaagaaaaauaaagaaccacacuggauuagcauguuuuuuuguuuuguuuuguuuuguuuuugagauggaguuucacucauugcccaggcuggagugcaauggcacaaucucggcucacugcaaccuccaccucccgaguucaagcgauucuucugccucagccucccgaguagcugggauuacagguaugcgccaccaugccaggcuaauuuuguauuuuuaguagaggcgggguuucuccauguuggucaggcuggucuccugaccucaggugauccacccaccucggccacccaaaguguugggauuacaggcaugagccaccgcgccuggcuggauuugcuuugaaaaagaaaaaagaaaaaaaaaaaaggucaggcacagugguucaugccuguaaucccaacacuuuggaaggccagggcauggggaucacuugagcccaggaguucgagaccagccugggcaacacagugggaccccaucucuauaaaaauauuuaaaaaggagcuggacacgguagcacaugccuguaguuccagcuacucaggaggcugagauggaaggaucacucgagccugggagguuacagcugcagcgagccaugacugcaacacugcauuccagccugggugacagaguaagacccugucucagauuuaaaaaaaaaaaaaaaagaacuucuguucaucaaaaaucaucaagagugaaacggcaugucaagaauaaaagaaaaauauuuauaauacauguauuugucaaagaauucauaaccagaauauauaaagaacuccuacaaagcaaaagcaagauaauccuaucuucaaaauggacaaaagucugaauaggcacuucacaaaaaaagaauauccaaauggccaauaaacauauaaacaggugcucaauuucauaaucacuagggaaaugcaaaauuuaaauggcaaugaaaaccauuaaacagccuuuagaauggguaaaaguaaaaagauugacaacaccaaauauuggugagagacuggaacucauauacucuugcuaagaguguaaaugaguacaucugcuucaccagcaucuacugaaguuagacaccugccuaugcaauguccaacaauuacacuuuuagauaaauaaccaacagaaauaagaauauucagguauuuuuguucuuaauauccaaaaacuggaaacaacccaaauauccaucaaguauggauaaacauauucauauaauggaaaacuguauagcaauaaaagauaaugaauuacugcuacgcacaauauggauacauuucucaggcaugcucaaaggaaaccagaugcagaagaguauaugauucuauuucucagaaauucaagaagaguuaaaauaaaccuaugguaacacuaguuaaaacagugaugggggccaggcaugguggcacaugccuguaaucccagcaguuugggaggcugagguggguagaucgcuugagcucaggaguuugagaacagccugggcaaaagggugaaaccccgucugcauaaaaaaguacaaaaauuagcugagugugguggugugcaccugcacucccagcuacucaguaggcugaggugggaagaucacuugaaccaggcaguugaggcugcagugagccaugauggcaccacugcacuccagccugggcaacagagcaagacacugucucaaauuaaaaaaaaaaaaagucacugaacuauacacuaaagauauguguacuguaugguacuuaaaaucagaaauaauaauaauaacuaaugaaauauagacuacccagaaaucuauauugcugaaaugauuucuucuaaguucauaauacacagcauuaguuucacuacaugcacuugcugagaaaccauguaauguuuuccugaucuaaaaaauuauuuuugggccaggcgcgguggcugaugccuguaaucccagcacuaaugggaggccgaggugguuggaucacuugaggucaggaguucgagaccagccuggucaacauggggaaacccgucucuauuaaaaauacaaaaaaaaaaaaauuagcuggguguaguggcaggugccuauaaucccagcuacucaggaggcugagacaggaaaaucgcucaaacccaggaggcagagguugcagugagccaagaucacaccauugcacuccauccuaggcaacgagggcaaaauuccaucucaaaaaaaaaaaaaaauuauuuucaccucuacacuuaagcuuuugauaacuucaaauaauuuaaauaaacuaguacucaaguugacuaccaaaaauaaagaauuuuuuaaauaagugauaagaaaguauccuguagaaauucauuuucuagucaauuuuaaauuuaacaaaacacauaucuacauauacacaauggaauacuauuccggaaugaaaaaggaaugaacucacgucuuuuacaguaacacagaacuggagaccuucaucuucagugaaacaacucagauuagaagcucacaccuauaaucccaacacuuugggaggccaaggcaggaugacugcuugagcccaggaguuugggaccagccugcaccacauggugagacccugucucuaaaaauauuuauuugaauuagcuagguacagugacaccaccuguggucucagcugcuugggaggcugaggugggaaaaucgcuugagcccaggaggucaaggcugcagugaggcauguggagaaucgcuugagcccaggaggucgaggcugcagugggccguuuuugcaccacugcacuccagucuggacgacagagcgaaaccauuucaaaaagaaaaagaaaaaagaaaaaaaaagaacucagaaagucaaauaccacauauucucacuauaaguaggggcuaaauaauguguauacacauggacauagaguguggaauaacagucauugaagacuuggaaggcuaggagcagugcagugagggauaagaaauuacuuaauggguacaauguacacuauucaggugaugauuacacuaaaagcccagauuucaccaccacacaauauacccauauaacaaagcuguacuuguaacccuuaaauuuauacaaauaaaaaaguacaugucauuuuaaaaggaaugucaguuucuuaaauuuuaauuuacaaauuuauaucccaaaaaugucucacuggguuaaaagugcuuccauccuguuuuguaguauguuccccuauuuccuuucauuaaugcuacugugaauucccaaauauuuauguuuuuuucuucuuggccaacuuugucuaauaaaaaaauuuacaauuuuuuuauagcugacuugcuccaucuuauaccagguuagcucuggaguguuuaaauaagcauaugaugugccucgacuugagacuguaugguauaguuaccaugcucaagaguacauauuuuaaagcuagacaaccuaaauuuguaucucggcuuacuaguugugacuucucugagucucaguuucucaucuguaaaauggcggagaauaucugccuuuuuaaucguucagauuaaagcaugauaguccauauuaaggcauuuagcauuaugacuaacacauaguuagugcaaaagaaaugguaacuauaacauuuuauagucaaguaucucccuuuaaaagacuguaguauauuagcauuagcauauaggaaaaucucuccaauuacucucauucuaaauauaugagucaaaaaacuaaaagcauaacuuuucccacucauucacuuauuuauuccauaauuuuuuuuuuuuuuuuuugagacggagucuugcucugucacccacgcuggagugcaguggcacgaucucggcucacugcaaccuccaccucccagguucaagcgauucucccgcuucagccuccccaguaccugggacuacaggcaggaagcaccaugccuggcuaauuuuuuauguuuaguagagagagaguuucaccauauuggccaggcuggucucgaacuccugagcucaagugaucugcccaccuuggccucccaaagugcugggauuacaggcaugggccacagcacccagccuauuuauuugacauaauaguaauuaucauugccuggaauuaugcuaagugcuuuacacaaauuauuuuccuuaauccuuauaucaugaaaucaauaauguauaaucuccaucuuauagauuaagaaauuaagauuugaggaauccaaauaacuugcccaacguuaccauagugauccaucaccggucauauuccagagaugguacucuaaaccaguacacucuaggcauacuggaugcuauggggaaauaaaauuaaugacagucccugucacaguguuaauaguauagaaguagacauuagacaacucagcaagcuagaauauaugauggaaucugauaauuaucauauaagaggcauaaagaccaacagaagugcagaaacaggcauaaauuuaaguuugaauuaaucaaggaaaugguucuuggaaaggcacaacugaacugggcuugggcugagcaugguggcucaugccuauaaucccagcacuuugggaagccgaggugggaggaucgcuugaggcgaagaguucaagaacagcccagguaacacagugagacaccaucucuagaaaaacuaaguuuuuuuaaaaaauagccaggcaugauagugcgggccuguaguccuagcuacuccggagccugaaguaggaggauagccugagcccaggaguucaaggcugcauugagcuaugaucgugccacugcacuccagccuaggcaacagagcaagaucccaucucaaaaaaaaaaaaaaaaaaagagcugggcuuugaagaauaagguuuagacaggcagaaauggguggagccaggcacaacccaagggugauuuaccaauacgagcacacacgaacuaggaugaagcagaccacaucagccagauucauaaauuacugaaaacccaaaugaaaguuauucaucaggaaggcauuauaacagaauucuagucuggaucuuuggagcuacucaaucuuauucauaacccauucucuguguuaccauacccccuuaauuuacuuuucaauccucugccuuccaucaucaagccuaggaaucaccaccaaggugucaaucccuauagccuaucaccuucuuauuaucacaccucauauaauugaauucuacccccucaucuacaucuucuucaucucuucccuaguuuaccaaauucuuuuccaaagucaauacaguuuccuuaaauuuugaauauuuuccuugaauuucuccuccaccuuagguuaacuaaauccuagcuuuuuauuagauauauuacuuuguuaaaacucucccacuuauaaaacagaaguagagaugaacaaucuccauuguuuccuuuggggggaagacaaaaaaaaaaucuccuuccccaccgccaccaucuccuauuaauauucuaacuuuauuacaauaauuccuccuuuaaaauuaacauaaauuggauacauuccuggcugggcacaguggcucacaccuguaaucacagcacuuugggaggccaaggcagguggaccaugauaucaagagauagagaccauccuagccaacauggugaaaccccgucucuacuaaaaauacaaaaauuagcugggcaugguggcacucaccuguaguccuagcuacucaggaggcugaugcaggagaaucgcuugaacccaggaggcagaggucgcagugagcugagaucacgucacugcacuccagccuggcgacagagcgagacuccaucucaaaaaaaaaaaaaaaaaaaaaaauuggauauauucccuugcccauauuuaugacugccaucuacugacccaagauccuuuccaacaugucuagaauacucugauucuugguucauaguuuacguaucaucaaaauucaccaucauucugaagcacuaaaacauccauuaaucaacucacucaaaacaauggacucaucuucauuuaaugguacaaacuucuacauaucuccauuucagcaauacgcauucaagaauggcuuuaaggaggccaggcgcaguggcucacgucuguaaucccagcacuuugggaggccgaggcaggcagaucacgaggucaggagaucaagaccauccuggcuaacauggugaaaccccaucucuacuaaaaauacaaaaaaaaauuagccaggcgugguggcgggcuccuguagucccagcuacucgggaggcugaagcaggagaaugggaugaacccaggaggcggagcuugcagugagccgagaucgugccacugcacuccagccuggggggcagagugagaccccgucuccaaaaaaauaaaagaaaggcuuuaaggaaaacuguuccuuacagcuuuaaggaaaacucucaaguucucaaaugcaaaccuuucauucuauauacugucuuccucacugccacuaaauccacucuuugcccuuauaucuugccacacccuuuaaguaaaauuaaacucauuuuucuuccaaacucuugcucuuguaaugcuuggcacuacuaagucacaaaguacuaacagcuccaacuacuauaaaacucacacuugcuauaacuaagacugcaagaguacuuaauauauauucaucccuaauugaccuaucuugcauucccaguaccauuuaaaagccccuuucucaaaaaauuaccuuauuucauuuuagaagccaaaacugcaauaucuuuagcuucucaagaucugucuauaucuuuauccaucuuuucuccuuucccuauaucucaccaaacuguucuuugaugucaucccucucucccauuucuucugggaccucacuccauuaucuccuaccugauauauauucaaucuuucccucuccaccccuuucccacucccuaccaaccugauuuaagucucucauauuccuaaaaaaaacaagccuuucuaccuaauuuccuacucaagcuuguucuagaaauauuuccuucccaucucauuuucccagcuuacuuuugcugccccauuuccucacugccacucauuccucuagccuguugaaaucuggcuuuugucuacuagucuacuaaccacucuuaccaucaguaaaaguagccuccuaauugccaaauccaguacccucaugcuacuuuaacucucugaaaggcuaacauuuuuuuuacucuccucccuuucuucccgaaccugucacaauccuaaucagccuaucuaacugcuuaguaauaucucuuccuccgcacuuugaaauuaguuguaugugauuuaagaccuuccucacucuauacuauuuuuugugggcaauuccauucauuccaaugacuucaacuaagauugcugcaaauaaugcagcuuuaucauaacuaaucguuaaguucucaucuugagcuucaauuaucauucauuacacuuucaaugcaaagcaaacaucaccuggaccuacugaaagauuuaagaaaguuauaccaucagggacacuaguagcaguaaaugaaguuaaaacuauagauuuuguaauuagagaccacauuuugaauucuguuccuuacuagcuauuacuaaucuuuauccugccccuaaaucccgguuuucucaucuguaaaugaaaaacaauuaccuuauaaggcuuuugaaaauauugaaguuugugaaguucuuagcacaaugucuagugccuaaguacuuaaagaacauacguuauccuuaacuacaaaugagagugacacaggccuccaagaauguugccugaagcaaucaguugaaaacugguucaaauuuacuugacguuuccuauuuugauucaaaaauucacuugaaaauugcagucuaugauucuaauuuaucugugcuguauuuuuguuguuuaacacuuuuaauggucauucucccuugcucccagacacuuuaucauucaacuucagugaaccugucucugaugccagccguuuuuuaauguguaucaccaucuaauauacugcuuuaaaugguauaguuaucaguuacaugaguuacaaauacauguguuuagcuuaaaccaucuggaauuggguuucugcuacuugcaacugaaaaaguuuugagcgguacacugugaacauuuuacaguucuuccuuguuuagcagaaaguuuagggcagccuaauguagucucacagauaaaacuucaaauuuuguguuuuauuuuaucuuucuacugcuacccaccuuccuucuaccucuucuuccuguuuuauuaaucaaacucuucugcauacuuaggaaacuuugaugacuauaaaugucacuucauggccgggcacgguggcucacgccuguaauuccagcacuuugggaggccgaggcaaguggaucaccugagcucaggaguuugagaccagccuggccaacauugugaaaccccaucuuuacuaaaaguacaaaaauuaaccgggcauggugacaggcaccuguaaucucagcugcuagggaggcugaggcagaagaaucgcuugaaccugggaggcaggggugguagauugugccacugcgcuccagccugggcaacagagcgagacuccaucucaaaaaaaaaaaaaaaaaaaagucacuucauuuggguuccaguuagcaacaacuuacaaugaaauggcaacugcaugccuacaaccacuacacggaaucuuucaaccagccaauguuuuauuucugagaauuuauucaggaaauuaaauauacgcuauuaagaaaagcagaagcauacuuaaaaauuaauuagugcacaucuuaaaacuagaggcauacuggagaacagcuagguaacauuagauuuggguauggauuuuauuauaccuuacuuuucagaaaggacagcuccaaaagagagaucacgagaaaaagaaaacgcucucuagagauauaacuaacguaaauaucaaugucuuuuaaggauuaacagcuuuauuaucaaaauccacuucccacaacuacuuacaucaaguuacugugacaaauaaauaaaucuaaguguaaucagguaaaaaggaacgugacuuguugaauuacaaggcaaauaucuuaccuucccuccucaaaaauguauuaaaccuagaugaaaugcauuuauuuaaaaaagguugugcaucucaaaggaagauaugaucacaccuaaaguucuguguuaggaagcccgcaaaugacaccagcuaagcauugugcguuuuccuaauguguccauuuuacuuagagguuuggugggggguggagacuauuaaaacacucaucaguuggaggcauauaccuacauguauguauaaauauacauauauaucauuuauacaugugcuuucaaaggaaaaaacuauuaucuccagaauauacaccaagaacaucgauaacauugguugcauaugaaaagggauuucagguuuucaacugcuucaagcaguguccccagagauccauaaucacucuccuuugcaauuaaggcugaaagcaguuugagaugcacugccacagggcacuccuaaauaaauuuggaauugguuuuuuuuguuuuuuuuuuguuguuguuguuguuugauacagagucucgcucuguugcccaggcuggagugcaguggugcgaucucggcucacugcaagcuccgccucccggguucacgccauucuccugccucagccuccugaguagcugggacuacaggcgcccgccaccacgcccggcuaauuuuuugcauuuuuuaguagagacgggguuucacaauguuagccaggauggucucgaucuccugacuuugugauccgaccgccucggccucccaagguguuggcauuacaggcgugagccaccgcgcccggccaauaaaucuguaauuguuaacugucucugcagaaaccaacgguaccaucagaaacagaaaaaugaaaugaaauaauugauucauugggcguucguuuguguacuggacuguaagcauaugaguccucguccucuccuccuaccauccauaggacuuaacacaaggacuugaggacccccuaauggaugaaauguuugauaaaaacuucucaacugggaggagcucuaccucacguuuuuauaacuccacuuucuuguuuccaagacguuguacacaaaacugaagauagucauuuaaaacaaaguaacguccaaaacaaaaaauaugcugaaaauaaaaacacaacgaaagcacggcuucaaauccuuuguuugacuuuccaaucacuuuuggaagacgcaggguaggcuggaaaagaaaaaggcuauuaggcgggccuguucagcagaacgagacccggagaggcauuguaucaaagaaaaggagucuccggucgcaagccccaccuuuccuccccagcagcagcuaccugcugagggaaagaggagggagaggggaagggacgcaaagucgagaaucaaaggaagagaggaaaguggggucaggcgcugagaagccgaaaugaaauuggaacauugguggaauuacgaggaaggcguggcagagagugacaagccaaccgggaagauccaugggccgaugagacgcaaggaggguguucgcgggaggagggaaaaaauaaaagggguuuugaggugaagagcgcccgaggcuucgaugacagcucggaccgggucuucgacuccaggggcgggggcgacccgggagccuuccauugugcgcgccccuuccucuccccgcccccgcccucgcccccgcggcuucgggccgcaaccccagcugccgccugcgccucccguuucccccggguaggagacaauauguucagcccuucucugacccuuucucaccggaugaagauggccgucgcccgagcuuucucuuguccaucuucucccgcugcugaaauuucaguugcaggcgcugucaccucaggaccccuccggcuuggagagggagggggaggggaaaggaaaaaaaaaaaaaaaaaaaaaaaaaaaa

SEQ ID NO: 192640 - RNA, 101054 nt, Homo sapiens
uuuggaaacgucacacuguggaggaaaagcagcaacuagggagcuggugaagaaggaugucucagcaguguuuacuaggccuccaacacuagagcccaucccccagcuccgaaaagcuuccuggaaauguccuuguuaucacuuccccucucgggcugggcgcugggagcgggcggucuccuccgcccccggcuguuccgccgaggcucgcugggucgcuggcgccgccgcgcagcacggcucagaccgaggcgcacaggcucgcagcuccgcggcgccuagcgcuccgguccccgccgcgacgcgccaccgucccugccggcgccuccgcgcgcuucgaaaugaggguccugggugggcgcugcggggcgcugcuggcgugucuccuccuagugcuucccgucucagaggcaaacugugaguaaucaauagcgucucuucucccuuccccagcauugucgacugaacugcgugcccugguugguaggauuuucuucucuagagcugcagccuccuagaaaguuuccaguaaguaccgacagacacccagcggauggaaacagccguggauagagcaggcagugcaaugguggggcaggaucacuauuugcacaguugcgagaauguauugccuacaggacagaucuaagaaccuagaugacacuaaguaucaauggagggaugagaacaccugcccauuucccuucaaagcugaaguucccagucagagaacuaggaugagcagauucuagcuuaugaguagggaagaaaagguaacacacugugucuucccuuuguccaagcgccugcccccaaccugcacccgucuccugaaaccugccucccuuuugcaauuucuggacuuugagcuugguuugcuugucucacauuaacgaaauguuuuaggaugacugaggguuuguauagcaguagauauaugucacuuucuaacccugaaaucaaaaggacuguuaaauacuguauucuauuucucagaucguuuguacugaggauuuuuuaacacugcaugccacugaucugaggugguggcaugaauucuuuaucuuuguguuucagguucuuuauguccuuaugcccggauucaagacaggauauugaguuuucucugaaaaauauauaaggaauaccaaggcaauuaguacauuuuaguggucaguuaauuuguuuucuaaaguuguaaguguguuuauugaauaaaaacgccuuuuuguuuguuuguuugagggugagucucgcucugcugcccaggcuggacugcaguggcuggaucuccgcucaaugcaaccuccgccccccggcuucaagugauacucaugccucagccucccgagcagcugggauuacaggugccugcuucgacacccggcuauuuuuuuuuuuuuuuuguauuuuuacuagagacgggguuucaccauguuggccaggcuggucucgagcuccugaccuccggugauccauccgccuuggccucccaaagugcugggauuacaggcgugagccaccgcaccuggccaaaaaugacuucuuguucuauguuuuauuuucagggauuggaacaggagugagaacucugaauuacaaauaacuuuuaggagucuagagcuccaaaguaaacuuuuugaagauggaaauuucuagaaaauuauauaucaauuugcuaacauuccacuaguuucuauuaguuagucaucaggaugaaugcaguacuuuaaaaaucuaacuugggacuaaaacauuauuuuuugaucuuacauuaaacagcuacaauugcaaaacuucagcauucaaaccccuaucauucagccaauuuguaacuacaugcgcuuauuaccuaaauaguucauuaggacaauuaaauauuugcuucauagcuaguguuuuggagaggagaaaggcaaaguagcuugccacacuuaacuccuugucaucauagaaauuugcuaggcuuuuucucuuuguagagauuguuacauuuugacugaaucuaggcagagguaaaaauuauauggguuuguguauguguauuauauauaaacauauggggaauuacacuuguuauauauaacacugauagagcagauaaauuaauucuucaaguauaucacauaaagaauaguuggccccauaaugcuuucaguuaaaaguuuuugauugcuuaauuggauuaaaagucaucugugguuuacuuaugaggaaauuuggauauagaugugauguuuuuaauccauaugauuugauuuuacuuuauuuuuauuuauuuacuuuuuugagacggucuaguucugucacuaaggcuggagugcaguggcaugaucauagcucauggcaaccucccccucccgagcucaugggauccucccagaucagcaccuaucuagcaccgcacccagcuaauuuaugugugugugugugugugugugugugugugugugugugugugugguuuuuauuuuguuuuguuuuuuugguagaguugguguuuugccauauugccuaggcuggucuugaacuccaggguucaagcggccugccuacuuuggcugcccaaagugcugggauuacaggugugagccacugugcccagccuccauaugauuuuaaaucugagauauaauuagagcuguaaauauuuuauuuguaauucauuguguaguucuuuauuuagaauuauuuauuuauuuauuuauuuauuuauuuauuuauuuauuuauuuagagauggagucuugcucuguugcccaggcuggagugcaggagugcaguggcgugaucccagcucacugcaaccucugccuccuggguucaagugauccccccaccucagccucccaaguagcugguauugcaccagcuggcaugcaccaccauacccggcuaauuuuuguauuuuuaguagagacaggguuucacuauguuggccaggcuggucuugaacuccugaccuccagugaucugcccaccucagccucccaaagugcugggauuacaggagugagccaccuuauccagccuauaauucauuguuuaggccauagaaagcuaaggacgauuaaaaaaauauuuuugugauuaaaaaaaaucuugcccagaccggagugcaguggcuauucacaggcacuauuauagggcacuacagcuuugaacuccuggccucaaggaauccucccaucagccuucugagugucugggacuguagguaugcaccaccauggcuggcuuauaguugugauuuaaagaaaaacauuuacaaaucauagcuuuauuuuagaaagaguuauuagaaauaaucuaauucaacuuauuuguuuuaaaaauaaaaaaagaaauuguucagagauauuaacuaauuuuccagaauacauauauauacauacauauauguaugagagagagagaugagaaucucuauauuuaacauauauacugucacccggucauagccgcucaugccuguaaucccagcacuuugggaggcugaggaggaaggaucgcgugaagccaggaguucaagaccagccugggcagcauagugggaccccgucuuuacaaaagaaauuaaaaaaaaaaauuagccggauguguugguacacacuuguaggcccagcuacucaggggucuaaggugggaagaucacuugagcccaggagguugaggcugcagugagcaugauuaugccacugcacuccagccugggugauagagcgagauccugucuccaaaaauaauaaaaauaaaauagauacugucuacauauuuuaaucauuucccacuuaaggcauguggugaggaaauaggagaaagaggaugucccuuuggcugugcuaauuuggccuuaucuagacugccacccugggccagugcaggcuacucuagacacuacugacucauauuuuccuccucuuuuguacccucuucuuucuuucucuaacuauuccuuuuacuaguuaugaaggcuuaucuuuucuuaaauuaucuuuacuaaaaaguccaaaauguugcacugauggagagauuuuaucaagguuagguuacaguuggaguuugugcuggaagaguuagaaacaauuucuaauauacaguaauacaacaucaaacccuaugccacauucucuuacuauuaauucugugcuaagaaacaauagaccuuuucuguucaucaaguuuauauuuuugcagcuugagcgaucuauauacauacuuaaaccuucaaaauauuaugccugauaauacaguauucuuugccuauaagcaacaguaaugaacuauugcuaacuaaaggaaagaaaaaaggaaaagaaaaaagagaggaaggaaggaaggagcaguuaaauaauuuauuggaaggcuacugaauggcuagcugaacagccaggccuacagaagccaggccuacagaaggaaugcgaacauuuaggugaccuauacagugggaacucaugugacaguacuugaggagcugccaaucagaugacucaauucugucuuccaguccuaugugucucugugaacagcucaaauuccuaggaggcccugaucauuuuggcuuagccuggcacuggaguccugugaucgacagcucacuagaauugcacagagugccggaagaacaguucccacaaaagaauggaugcugggaaggacacagaaauaagaaaagucuacauauucuaauuauuggcugucuaacaaauacacuugcccuucuuuccauacacaccauuugaaaauauuuaucugauauaaugcaaauaacuacugcacagagaaagaacccucuccucaauugguuccaggcaccacauucagagaggaaggcuugaggcuuccauuuccuagguaucaucaagugauggccaugauuccuguauuucugugcuaugcuuuauggauaaaaugauacauuauaguguaccaacacaucuuauaugcaaaaaaaaaaaaaaaaaaagaaaacaaaagcaaaaacaaaaaaaacaggcaagggaauacagguaaugguuuuagggcuugccuuucucucccuugguuacaagcaugagcugguauuuaugacucuuucccuacccauuucauagcucucuugcccucaggaugcaagugccucauguuuguguuugcucaauaagaugaaccauagcauauucaggaagaauccgagcccuuauugucccuaccugugggugguccauccauuguuucuuuuccuauuucuccuguggacaguagucauccuggaggggcuucacaccuaacccugauuaguauguggcaacaacacuauuuugccuggauuauugucuuccuucuaacauaauccucugauuuuuauuucuuuauuuuuuuucagcagguaaagagcuucaaauggcaacacagcagucugagcuuauaauucaguggaaaauauguuagauccccuagugaaugcauuccuuggaaaccauucuugguuuccaaauuuguaggugagccgaaugcaguugugaggacggaauguaaaaaauuugagauuagguaacuguauuaguccccuaggacugccauaauaaaguaccacaaaguaggugguuuaaacaacagaaaguuguggucucacaauuuugaagucuagaaguccaaaaucaagguaucaggaagguugguuucuucugagggcugugaggggagaauauguuucaugcuuucuccuagcuccugguaaccucagauguuccuuggcuuugggguggcauuauuccugugucuucacaucguuuucccucuguacaugucugucucugugcccacauuuccccuuuuuauaaggacaccagacucacuggauuaaggccuacccuaaugaccucaucuuaauuugaucaucugcaaagacccuauuuccaaauaaggucauauuuacagguacuagggaauuacaacuucagcaucuuuuggggucagccauagcagucauuaaacaucauaucaugacaaguacuucuuuccuuuuucccuuuauucuggaucuguguauuuuggcuuuaguaaaauagugcuguauuuuauuuuauuuuaagccagucaaauuugccaguuggagguuguguaucaacuuaaugauacuaauauuaacaaguucugauaacccacuacuauuggaccagccuacaaucuuuuauuuauuuauuuauuuauuuuuugagacagggccucauucuguugcaugggcuggaggagugcaguagcacaaucaugucucacugcagccucgaccugccagguucaagggauccuuccaccucagccucccaaguaacuaggacuauaggugcaugccauuacaccaacuaauguucuuuuugauuuuuaguagagaugagaucuugcuauguuucccaggcugaucuuaaacuccuggacucaagggauucucuggccucagcuucccaaagugcugggauuacaggugugagccacuaugccuagauagcacuauauuuuaaugauugcugguacagagaacauaccauauuuuuuaaaaccauauuuugaaagauaguguugugucuuacagugagugagcccucuauaauuggugaguucaucauuccauaagguuagcuccuuccagauauuaggauauacacuaaggccaaggaaaacuauaauccuuccacugauuuguuuuaauugugguguuaaauccuuagagguaguguuguguggcuuagcauaaagcauugaauaagucuaccaauaguugugcugacagaaaaauuaaaucccaauaagugucucuaccuaugcugcuccuccaugauggaagagcccuucuuaaucaacaaucuaccggauaaucugauugaacuaugugauauguucaacuuuuagcagcucgaggaauagcaauccugcagaaaaauuugguguuuuuacuuuuauaaggagagucugggugggccuuagugaaggaaaguucauguggcagauccaguguggccaauguguagccuccauccuugccacuguggcuuccuuuuuaaauaaauauuggauaaacauuagacugggggcaacccgaaagccauauguggccuauaaacuucuguguuuggcccuuauacguuucaaaaauuggaacauuucaugucaacauuugguuuuauggcuucucuugagaaacaaugaaggaacaucugacaacacuggcgcacaucccaacaugguaagauucagcugaagcugauugugagcugccuucuucuuuuuuuuuuuuuuuuuuggaacagagucuugcucugucgcccugccucagccuccugaguggcugggacuacaggcauguugccaccacgcccagcuaauuuuuguauuuuuaguagagaugggguuccaccauguuggccaggcugguguugaacuccugacauugugauccacccgccuuggccucccaaagugcugggauuacagguguggugaucugccuucuuuagauagaaugugcccgcugcaguuugcuacaaugcugagcaucucccauugucuuuaaccaaauuaucuuccuuuguuuaugcugccuacuggacacuuagaauuuuuaguuugugguccuugcacuagauagucuugagaggaaacauaacugauggucauuaaguaggucauucugccaucauuauuacuaauaacuucucugguguggugcugucuugugaauguucaccuggaacacaaacauucucaucucugggacaauucuugcuugaacuucgucccuaagccugugaucuaccucuuuacaagucacugaaccucuggaaagaccauuugcaaccaucucaggcaauuucucauuguaggcaaagugaacaaugagaaaugccacuuauaugucugcccauagugaggguuuugcuucuccagugccucucaggaccaccccugagagagguuaguuuguuaguuuuuggcuguagcuuuauaggagguauacaucuggcucauauugguauaccacagagaggcgucuguugauaugguuaggauguuuuguccccuccauaucucauguugaaaagugacuucuggccaggcgcaguggcucaugccuguaaucucaagucuuuagcacuuugggaggccgaggcagguggaucacuugaggucaggaguuugggaucagucuggccaacaugaugaaacccugucuuuacuaaacauacaaaaauuagccagaugugguggugcccaccuguaauuccagcuacucaggaggcugaggcaggagaaucgcugggaccugggaggugaaggcugcagugaaucgagaucaugccacugcacuccagccuuggugacagaaugagacucuauaaaaaauaaaaauagaaaagaaaagaaaaguaucagguuguuaccgggggguccuugcucacagagcucccaagaugguggugagcugcuuccaagaugguggcaggcagcuuccaaggugguggcaagccuaguguucucugaccugggguucuuggccucauggauuccaaggaauguaaucuucggccaugcagugaguguuauagcucuauuagaagccuugggucacagaagagaaccguagaacccagugacuaguguucagcucgauuaggacaaacccgggcacuuagccaugcaggaacaauggcaagccuuuagccagaucaggagcggcaaugggcgccucgcuggaucaggagcacagcggacacccuuccggauccggagggaugggagucagcagcgggucugcgacggcggcaaacagcaguuguggacggcgagcaaaagcucagcuugagccguaacaaacacagaccagaagagggcaguugcaagauuuaauauugugaaauagagugaaaacagagcucccauacaaagggaggggacccaaaggggguugccauugccggcucgaaugccuggguuuuuaucccgauccuugucccucccgcugugcucucaggcaauaguugauugacuauuucuuuaccuccuguuuuugccuaauucgcauuuuagugagcucucugauuggucgggugugagcuaaguugcaagccccuuguuuaaagguggauguagucaccuucccagcuaggcuuagggauucuuaguuggccuaggaaauccgaaccugcccucaauauuucaacauagguucuuucuauuuuccauaaguguuggcuggcugagaaauaaagagaaagaguacaaagagaggaauuuuacagcugcaccuccgggggugacgccacguaucuguaggacugugaugcccaccugacccucaaaaccagcagguuuuuauuaaggauuucagaaggggaguggguguaagaacagggagcaggucacaaagaucacaugcuucaaagggcaaaagggagaacaaagaucacaaggcaaagggcaaaagcagaauuacugauaagggucuuuguuccguggugcacauauugucuugauaaacaucuuaaacaacagaaaauaggguucgagagcagagaaccagucugaccucaaauuuaccagggugagguuuuuuccccacccuaguaagccugaggguacugcaggagaccaggguguaucucaguccuuaucucaaccgcauaggacagacguucccagaguggccguuuauaagcggccccccaggaaugaauuccuuucacagggccuuaauauuaauauuccuugcuaggaaaagaauuuagcaauguucuccuacuugcucauccauuuauaggcucucugcaagaagaaaaauauggcuguuuuugcccaaccccgcagggaguaagaccuuaugguugucuucccuuguucccuaaaaucacuguuauucuguucuuuuucaaggugcacugauuucauauuguucaaacacacguuuuacaaucaauuuguacaguuaacacaauuaucauaguggcccugaggugauguacauccucagcuuaggaagauaacaggauuaagagauuaaaguaagacaagcauaagaaauuauaaaaguauuaauuugggaacugauaaauguccauauuaaaaugaaaucuucacaauucauguuccucugcuguggcuccagccggucccuccauucagggucccugacuuccugcaacagaaaagaaagaaaaggaaagggaacggaaggggaggggagggaaggcaccuccauuguaggagguggugccuggugggagguguuuuggucauggggguaggucccuuaugaauaacuuagcaccagccccuaggugaugagugacuucucauaugagauucacagagguucacgugagaucugguuguuuaaagucugggaccucuccuucuagcucgcgcucccauucuggccaugugauccacugcuccccuuuugccuucuaccaugauuggaagcuuccugaggcccucaccaggaguagaugcuggcaccaugcuucuuguacagccugcagaauggugauccuauuaaacuccuuuucuuuauaaauuauccacccucaaguauuccuuuguagugaugcagacagauuaacacaucuguaagccagagauuaguuggucauagaucucuucuuaugagaccaaugaggggguuugagggugaggaggaagucaagagagugaccaaccuguguuggcaacuaaguuaugccuuuaggcucaucuuauuuauaacaguugagcaugguuuaugcuaucacaacuacauagcucaauggaaaagacagcaucccgcuuaugaugagcuguuuacaucucauggucaccaggugucagauagucagauuuucagacuccacuuaagucccaaaaaacaaacaaacaacaaaaaacccaagagcaguuucucaaaagaaaacgaauugcuugcugaaggaaaugagacuugcacaaaucguggagaucucuacugaaauuucucuucuggaacuugcugcagcuucugaagaggaccuugcucuucagaaaauuugagcacaauuggaucugauggaucauuggcuaggccaagugacagaccacuugauuugaacuuugaacuagcuggagagcauucucuuacuaugguucccaucuauauuuggcagccuuucgacuccugugguaaauagaucauaguagaaaaccuuaaaauggaauaugccucaaaaauaagacaucuaccaaaauuuauucuucuaccuuagugauggacacucagguacauaacaacuucucucacuucugcaggaauguuccaacaugaccaaacucuugcugaagaguccacugagaguccacugcucucaguccuagggaaggaaugaaagcuuuggguuugagucugauuaggccuauaguuagaugguuuuaggacagaauucugcuuaucagcugacuugcauaagccucaauuccaaccagcauaccuuaaucagcauacauuaggucuuagacauuuugcuuccucaaagcccacuaucuaauaaucacuaaagguuuuugggauguuucucuucaguguaguuauucagguaagauacuuuaguuuggagaaacugggagaaaagcuuauaguaugaaacuguaacagaaggauacuuccuuaagggccucucuccucuccuucacucaagagguucuggaucagucagauaacucaaaauuggugauuaaggagaggcagugauuuauuuuuauugugguugaaguacagccucuauuugcuaguauagggaguuugugcaugaaacagugaagaaaucgguggguugucuauucaucucaaucucgugagaucucugcuuguuaauccuuucuccaaaaugugaucacuacacacaccccaguuuuuguucaggugaguaagagcugcuaacuaagcucagccaccccuguuucuucccauuccacuugaaaucugggggcucauuuccauugcugucccucccaccagcauguuugaucuagggagaacugccaguaaaaugcuuauuaaaaauuccagugguuucuccaauaaucguuuuucacaggaucagugaaaauguagucuucucuucuauauugggggagaguggggaugauugaggaggagagaauagguaggggugacguaaaaaauucaagccagaauuucugucuccuagucuuuuugaauucuuucuguuacauuaugccaaggaaugucuggcuuuucaauguuauuuggugugugccaagauuggucuaggauggcauuagccaaccaagccaacuguuagaacggaagcuggcagcccuagcuagcaaauggaaugaaagcagcaauauuaccacauucagccugauuaaaaauuaugcuaucucuuuuuguauucauuuucuauugcuuuguaacacauuaccaaaaauuuaacagcuuaggaaaacacaauuuauuaucucacaguugcauaggucaaaaguccaggcacaaauccaguuaaguugcucagaaucucacaaggcuaaaaucaauggguuggucaugguugagaucucauuugaagcuugaaguccacuuccaggcuuccugauuguugggagaauucaguuccucacaaguguaggauugaggcccucagcuccugagaccucucaccauucccgccauguggcccucaccauaacauggcaauuugcuucuauaaaaucaauuuuaaaagcaucagcugcugcuuuuugucuccuaucacuguuucugcaaucugaauuuggcaugcaaagcucaaaaucuaggggauuccagccuuaucucuuccuacaacugaccuuucccugcuucuccucucaaaauggaccauucucugucccuucuccccuauggccuuuucacaugcugguccuucuguuugaaagacaauuccucuuugucauccucccagucaugccaggugaucuauccaaagacuauucaaguuuuaacauacuuuaugauuuuguuucccuuuuuuagaaucaugaauugaacuaucauaaagcuuugcagggucuuaauuuuuccauuuaaaggauaauuuagaaaaguguuuuuuuuuucucaauagcuagucucuaauauuuaaaaaaccgccuuuguuuuuuuuucuuuugcccuuuuguuuuauugguuauuuuauucaaggaauaaaccugaacaacucuauuuuaucuauguguuuuuacuuuuauuagagcccucugauuuuuauuauuaacaaagaaacaagcacauuauugaauaaccucuguuacagguauuaguuuaaauguuucauaccuuuauauuaguuaagauaagauggucuaugaagugauaacacauuaauccucaaaucuccaaauugauuuucaaauuucuaaaucuugauggcuuggcaaaauaagagauuauuucuuaaccauauaaaguucagugugguuugcauaaaucucuuucaucuuuaguuauaccaucuggaacacauagcauccaaaguuccugcaaaaaaaaaaaaaaaaaaaaaaaaaaaaaagagcaauggaggugguguacuuguuuuuaacugccucagcuuaaaagugacaaacgcagccagacgcgguggcucacggcuguaaucccagcacuuugggaggccgaggcgggcggaucucagggucaggagauugagaccauccuagcuaacacagugaaacucaucucuacuaaaaauacaaaaaaauuagcugggcaugguggugggcaccuguagucccagcuacucaggaggcugaggcaggagaauggcgugaacccaggaggcugagcuugcagugagcuaagaucgugccacugcacuccagccugggcgacagagcgagacuccaucuccaaaaaaaaaaaaaaaaagugacaaacgcacuucugcuuauaguucaaauaguuaaaacucaaugaagcacauggaauauuucuucggcacuaugucuguuagaaacauuuucucuuaagguugaaauuaauguauuuuccucuaagagaaguauaaauacuuauugccuauuuaaccuuugguaauauauauuacaaagugugugguuguuuuaauuaucugaauaaacuuugugauagagggagggcauaauuuacuaugccugcuaacacaccagcugguaguuacuuaguauuauuacacugaguuggcuauuaauguagcagaacgaaaaaauaugguaacagcugauauugaaauuacuccuauggugagaacuguuguuacauuagaaauuaccuugaaaagaagcuugaguuuuggaaagugaagucccugaaacauggucuauaacuuugcuauuccaguaugguccguggaacaucagcaucagguuuaccuggggacuuaacuaaaaaugaaauauaucuggcccuacccuggauguacucauccagaauaugcauuuaaacaagacuuucagguaauuucuauccacauuuaaaguuugagacaaucuaguuuuuaaugagauagagaagauagauaagugaacaaauuuuugcagaauggccagagguggcaauuagggcaagagaagaggaaaugucagagaagggagaaagaaagcugagcaccauggcaagagaaugcagcuuguggagaaggucuccagugagaaauuacuagaugugagguggguaaagacuuuuaggaaugggcauuucuuuuuucuuucuuuuauuauuuuuaaauuccuuuuuuugguuguuguuauuuugagaaagagucuugcucugucccccagguuggagugcaguggugugaucacagcucaucgcagccucgaccuucugggcucaagcaauccuccugccucagcuccugaauagcugugacuacaggcuugagcuaccaugcccagcuaauuuuggccauguugccuaggcuggucuccaacuccugagcucaacggauccuucuaccucagccucccaaagugcugagauuacagaugugagccacugcacccaguaaaaguggcauuucuaaguuucaacuuuaaauuacaaaaguugcuuaaauauaaacaacugaacccugaauuccucugccucuaguguuuucaaaaagugucaauuuucacaucuaaauugauuacguacuccauuagucuguuuucaugcugcugauaaagacguacccgagucugggcaguuuaccaaagaaagagguauaacuggacuuucaguuccauguggcuggggaagccucacaaucacaguggaaggcaaggaagagcaagucccaucuuauaugaauggcagcaggcaaagagagaaugaggaagacgcaaaagcagaaaccccugauaaaaccaucagacuucaugagacuuauucaccaccaugagaacaguaugggggaaaccaccccagugauucaauuuucucccaccaguugccucccacaacauguggcaauuaugggaguucaauuaaagaugagauuuggauggggacacagagccaaaccauaucaaguacaaagaaaagagucucauaagaugcaagugaggaagagguuagugaaagcuaaucuacaaaaccaacagugacuauccacaagaaugaaggaaugcagagguuuugacagauguuggaauuuuaucaaauguaggauuggguuucauaucauuauucagugaaucaaaaagggcaggaugauguuugacauuagcaagaccuaaacuaucuuuacauuauuaagcuuugauugagauuaacauugcauuaaucuaaaagaaaacaaccuuugcgaugaaaaaaagucuugacccuuguucuguuagaugacacaaauucuuuuuaccuaaauauuccuguuuuauuagguuuuauuuuacauauaucuuacaaaaacauauaaguaaaaauaauaauuuagggggguugggugauaauucaauauuuuuauuuuauuuuauuuuauuauuauuauuuuuuugagauggauucuugcucuguugcccaggcuggagugcaguggcaugaucucggcucacugcaaccuccgcuuccuggguucaagugauucuccugccucagccuccugaguagcugggacuacaggcaugcaccacugugcccagcuaaguucuguauuuuuuuagagacaggguuucaccauguuggccaggcuggucucgaacuccugauccaggugauccacccgccucagccuccagcagaacugugagccaauuaagccucuuuuuaaaauaaauugcccagucuuagguauuucuucguagcaaugugagaauggccuaauacaauaagugauuugagcauccuuggauuuuuauaucugccgggguccuggagccaaucccccaagaauacuaaaggacaaccauguuuauaggguacaauguaguguuuugauauuuuuauacauugugaaacgaucaaaucgugcaaauuagcauauccaucacuucaaauauuuaucauuucuuuguguugagaacauaugaaguccucuuuuaguuguuuugaaacauacaauccauuauuaaccuuggaauuuagaccuuugggucucauuguauaacuuucccuggcuuacacugcuagcuguaagccagugauucucuaauauuuuaaaacuauucaagaaagccauguuuaaugcaaucuaauuugaaaauacagauaugcaauaaaaaaugcaucuguaguaccacugaccagagaccaauguaacauuuugcucuauguucuucuaagcuuuuguccacacauauauauucuuagaaaugaaaauacauggaauugugcucuauauaauuuuuguaacuugauguuucauaucauaaaacuaugaugauuguuuuuguaucaguaaguuaaagucuauaucacccuuuaaaauagauacauaauuuuccuuuauaugugcuuauuauaauauauuuaaccaaaacuauauuuucggacuuuuagauuauuuccaauguuuugcuuauaucaauuauauuguaaugaacauauucauauauaguucuucauauauauauauucauguuuauuuccucagguuaauuuucuagaaauagaauuguuagcugaaugucuauauagugugccuauuuugaagguuugggauacauauuguuaaauuuccuccugggaacgugcuuuugaagguagauuuaaagggugucuuguuccucucaucuuugccaaaguuggacauuaacuucauuuuaaaucuuuguuaaugcaagcauaguaaagauuuuuuagugagguagagggaguggauggaguggauguauuaguuugaugugagacuugcccaaaaugcuuuaaaaaacuuggcaaauacuggaaucucuggaucacaaagugaggguaagaagaccacaaaauucagucacaaauguuaauguacccuuguguauccacuaucuugugaggcuugaaagaauucugauaacguguguguguguguguguguguguguuuguguguguguguguguguguguguguguagagagagagagagagagagacagagagagagagagacagagagagaaucagucuguugcccaggcuggaaugcaguggcaugaucucagcuuacugcagccucagccucccaggcuuaggcaauccuccuaccucagccucuugaguagcugggacuacaggcaugagccaucaugcugagauaaauguuuauguuuauuucuuuuuuucuuugaaaauacacaauuuaauaguaaaauugcugcaccuuauaaaauucuugagaaccaaagaugaguuaaauuauuauucuuucuagaguauaaccaaaaguuucccauaaaaauuagcaaaauugaaagauaccaauaaaagauacuacuauccuaccgcuguauauuuguagauaccuuugaauagcauuaugaaaauuauuaaaauaagugcuucugaaucuucauuucacugagaccauuuauuuacuaucauggauggaaacuuucuucugauuauaauucagucuauuuacauuaaagcaaaaccaugggaauugaucuuuuuaaaucuucuguuauauagucaggauagagucaaauaguaaaccaaguguucaauauauggucaguucuguuaagcaaauucugcccauugugcauauucaucaguguaaaauugaauaucuguagauauagccaacuuaaaauauauauuuugauugucagacuagaugauuaucuuucguccuccaucugaacuguucaauacuccaaauuaaaauaaugguaaugacaauugccugcagaauuuucuuugccuuucuuuuuuuuuuuuauacuuuaaguucuaggguacauguacacaacgugcagguuuguuacauauguauacaugugccauguuggugugcugcacccauuaacucaucauuuacaucaggcauaucuccuaaugcuauccauccccccuccccccaucccaugacaggccguccuguguuauguucuccaucccguguccaacuguucucauuguucaauucccaccuaugagugagaacaugcaguguuugguuuucuguccuugcaauaguuugcugagaaugaugguuuccagcuucauccaugucccugcaaaggauaugaacucauccuuuuuuaugacugcauaguauuccaugguguauaugugccacauuuucuuaauccagucuaucauugaugggcauuuguguugguuccaagucuuugcuauugugaauagugccgcaauaaacaucuguaggcaugugucuuuauagcagcaugauuuauaauccuuuggguauauacccaguaaggggauggcugggucaauugguauuucuaguucuagauccuugaggaauugccacacugucuuccacaaugguugaacuaguuuacagucccaccaacgguguaaaaguguuccuauuucuccacauccucuccagcaccuguuguuuccugacuuuuuaaugguugccauucuaacuggugagagaugguaucucauugugguuuugauuugcauuucucugauggccagugaugaugagcauuuuucaugugucuguuggcugcauaaaugucuucuuuugagaaguuucuguucauauccuuugcccacuuuuugaugggguuguuugauuuuuucuuguaaauuuguugaaguucuuuguagauucuggauauuagcccuuugucagauggguagauuguaaaaauuuucucccauccuguagguugccuguucacucugaugguaguuucuuuugcugugcagaagcccuuuaguuuaauuagaucccauuugucaauuuuggcuuuuguugccauugcuuuugguacuuuagucaugaaguccuugaccaugccuauguccugaaugcuauugccuagguuaucuucuaggguuuuuaugguuuuaggucuaacauuuaagucuuuaauccaccuugaauuaauuuuuguauaagguguaaggaagggauccaguuucagcuuucuacauauggcuagccagcuuucccggcacuauuuauuaaauagggaauccuuuccccauuucuuguuuuugucagguuugucaaagaucaggugguuguagaugugugguauuauuucuaaggguucuguucuguuccauuggucuauaucucuguuuugguaccaguaccaugcuguuuugguuacuguagccuuuuaauauaguuugaagugagguagcaagaugccuccagcuuuguucuuuugucuuaggauugucuuggcaaugcgggcucuuuuuugguuccauauaaacuucaaaguaguuucuuccaguucugugaagaaagucaucgguagcuugauggggauggcauugaauccauaaauuaccuugggcaguauggccauuuucgugauauugauucuuccuacccaugagcauggaauguucuuccauuuuuuuguguguccucuuuuauuucguugagcagggguuuguauuucuccuugaagagcuccuucacaucccuuguaaguuggauucccagguauuuuauucucuuugaagcaauugugaaugggaguucacucaugauuuggcucucugucuguuauugguauauagaaaugcuugugauuuuugcauauugauuuuguauccugagacuuugcugaaguugcuuaucagcuuaaggagauuuugggcugagacgagggaguuuucuaaauauacagucaugucaucugcaaacaggggcaauuggacuuccucuuuuccuaauugaauacaauuuauuucuuucuccugccugauugcccuggccagaacuuccaacccuauuuugaauacaaguggugagagagggcaucccggucuugugccaauuuucaaagggaaugcuuccauuuuugcccauucaguaugauacuggcuguggguuugucauaaauagcucuuauuauuuugagauacaucccaucaauaccuaguuuauugagaguuuuuagcaugaagagcuguugaauuuugcugaaggccuuuucugcaucuauugauauaaucgugguuuuugucuuugguucuguuuauaugcuggauuacauuuauugauuuguguauguugaaccagccuugcuuuccagggaugaagccaacuugaucgggguggauaagcuuuuugaugugcugcuggauucgguuugccaguauuuuauugaggauuuuugcaucaauguucaucagggauauuggucuacaauucucuuuuuuuguuguugugucucugccaggcuuugguaucaggaugaugcuggccucauaaaaugaguuagggaggauuuccucuuuuucuauugauuggaauaguuccagaaggaaugguaacaacucuuuuuaugucugguagaauucagcugugaauccgucugguucuggucuuuuuuugguugguaggcuauucauuauugccucaauuucagagccuguuauugaucuauuaagggauucaacuucuuccugauguagucuugggaggguguaugugucuagcaauguauccauuucuucuagauuuucugguugauuugcauugagguguuuauaguuuucucugaugguaguuaguacuucugugggauugguggugauaucuccuuuaucauuuuuuauugugucuauuugauucuucucucuuuucuucuuuauuagucucacuaguggucuaacaauuuuguugaucuuuucaaaaagccagcucuuggauucacugauuuuuugaaggguuuuuugugucucuaucuccuucaguucugcucugaucuuaguuauuucuugccuucugcuagcuuuugaauguguuugcucuugcuuuucuaguucuuuuaguugugcuguuagggugucaauuuuagaucuuuccugcuuucuuuugugagccuuuaguucuauaaauuucccucuacacacugcuuuaaaugugucccagagauucugguacguugugucuuuguucucauugguuucaaagaacaucuuuauuucugccuucauuuuguuauguacccaguagucauucaggagcagguuguucaguuuccauguaguugagugguuuugagugaguuucuuaauccugaguucuaguuugauugcacuguggucugagagacaguuuguuauaauuucuguucuuuuagauuugcugaggagugcuuuucuuccaacuauguggucaauuuuggaauaagugugauguggugcugagaagaauguauauccuguugauuugggguggagaguucuguggaugucuauuagguccucuuggugcagagcugaguucaauuccuggauauccuuguuaacuuuuugucucauugaucuaauguugacagugggguguuaaagucucccauuauuauugugugggagucuaagucucuuucuaggucucuaaggacuugcuuugugaaucugggugcuccuguauugggugcauauauauuuaggguuguuagcucuucuuguugaauugaucccuuuaccauuauguaauggacuucuuugucucuuuugaucuuuguugguuaaaagucuguuuuaucagagacuaggauugcaaccccugcuuuuuuuuguuucccauuugcuugguagcucuuccuccaucccuuuauuuugagccuaugugugucugugcacaugagauuggucuccugaauacagcacacugaugggucuuaacucuuuauccaauuugccagucuaugucuuuuaauuggagcauuuagcccauuugcauuuaagguuaauauuguuauguuucauuaugauguuaacuguuuauuuugcucguuagcugaugcaguuucuuccuagcaucgaugguguuuacgauuuggcauguuuuugcaguggcugguacugguuguuccuuuccauguguaaugcuucccucaggagcucuuguaaggcaggauugguggugacaaaaucucucagcauuuacuugccuguaaaggauuuuauuucuccuucacuuaugaagcuucguuuggcuggauauaaaauuuuggguugaaaauucuuuucuuuaagaauguugaauauuggccccuacucucuucuggcuuguagauuuucugccgagagaucugcuauuagucugaugggauucccuuuguggguaaccucacguuucucucuggcugcccuuaauauuuuuuccuucauuucaacuuuggugaaucugacaguuauguuucuuggaguugcucuucucgaggagugucuuucuggcauucucuguauuuccugaauuugaauguuggccugccuugcuagguuggggaauuucuccuggauaauauccugaagaauguuuucccacuugguugcauucuccccuucacuuucagguacaccaaucagacauagauuuggccuuuucacauagucccauauuucuuggaggcuuucuucauuuauuuuuacucuuuuuucucuaaacuucucuucucacuucauuucauucauuugauccauuaggucauuuaagcucuucucuaugcuguuuauuccuguuagccauucaucuaaucuuuuuucaagguuuuuagcuucuuugcaauggauucgcacauccuccuuuaacuuggagaaguuuguuguuacugaucgucugaagccuucucucaacucaucaaagucauuguccauccagcuuuauucuguugccagugaggggcugcauuccuuuggaggagaagaggagcucugauuuuuagaauuuucagguuuucugcucugguuucucccgaucuuugugguuuuaucuaccuuuggucuuuaaugauggugauguacagaagggauuuuggugugaaugucuuuucuguuuguuaguuuuccuucuaacagucaggaaccucagcugcaggucuguugggcuuugauggauguccacuccaggcccuauuuuccuggguaucaccaguggaggcugcagaacagcaaauauugcagaacggcaaaugucgcugccucacccuuccucuggaagcuucgucucagagggacaccuggcuguaugaggugucagucggccacuacugggagaugucucccaguuaagcuacuugggggucagggacccacuugaggaggcagucugucgguucucagauaucaaacuccgugcugggagaaccacuacucucuugaaagcugucagacagggaugcuuaaguaugcagaaguuucugcugccuuuuguucagcuaagcccugccccuagagguggagucuacagagacaggcaggccuccuugaucugccaugggcuccacccaguucgagcuuccuggcugcuuuguuuaccuacucaagccucagcaauggcagacgcgcuuccccccagccuugcuucuggcuugcaauuugaucucagacugcugugcuagcagugagcaaagcucuaugggcgugggacccuccgagccaugggcgggauauaaucuccuggugugccauuugauaagaccauuggaaaagcgcaguauuagggugugagugucccuauuuuccagguacugucugucauggcuuccccuggcuaggaaagggaauuccccgaccccuugcacuucccgggugaggcaaugcccccccugcuuuggcucacacucugugggcugcacccacuguccaacaagucccagugacaugaacccgguaccucaguuggaaaugcagaaaucacccaucuucuguguugcucaugcugggagcuguagacugaagcuguuccuauuuggccaucuuggaacuccuuucucguuucuuucaacuucuuaaaauacccuuauuagucuuuuuuucccucuuuuaugaaaugccuaauuauguuguuaguuuauuuuuuuaguagagcuuuuuuucuuauagauuuguauauuuucuguauauauuaaaaguauuaaauuucuuucauguaaguggcaucuuuuuuccuacuuugcaccuugauuuuuacuaguacagauuguguuuuuggaugcagacauuuuugcuauuuaugagccaaaucuguuuuuguauuuuucuuuucaauuuugucuuuagugugguauaaaggaaugucucucccaucccaauaauguaucaauauaguaaaauccugccaaaugugguaagugggguacgaaauacucaauuuuauaaaaguaggugacauugauugugaguuuauaaaaaugacagaagugaaccuauguagcuaacuguccagguuucgggucuggcuucaauauauuaagguuccuauugugguguggcacugccuaauauugucugcuuagcuuaaauguugaugagaaugauucuugguccuggcccuuacugagacuuuaaggacagcagcgauguauucuaggaaucuccugcuuagugagugccuguuucuccagagcaauuuagagacauugguccaugagaauccuggagccugauaaacacauguuccaugaacuguuauucuguuacugugccaugcuugcaauguuuuuauuucucuggcacauuuuuaauaucugaaaaauguaacuaacaaccagauacuugcuaccagauauuuucauaaaaucaggaacauggaagaaaugaauaagagaaauguauagagcaaauaaccucaaaggaaauagaaguaauugaagucauggaagguaucuuuuaaaaauuguaacuaauauacuaaauaaaauaaaugugagcagaucuggcacgcauaaaacaaaaauaggcugcuauggaaaaggaaaauuagagaacuaaaauauaaucuuuagacuuaaaaaguuauuuucauuuauauucuguuucuaaacauuauuguuuauuguucuaaauagucuuuauaaacaacauaaaauucuaaaaaacaacaguuugugcuuuugagugaaauuacaucauauguuuauuggcugcauaaaagagacuuagacucccacacaauaauaaugggagacuuuaacaccccauugucaacauuagacagaucagcgagacagaaaguuaacaaggauauccaggaauugaacugagcucugcaccaagcagaccuaauagacaucuacagaacucuccaccccaaaucaacagaauauacauucuucucagcaccacauugcacuuauaacuucuuauuucaaucauacuuuaguucucaauuuuuuucuuuucauugcagccuacuuuuuuuuuuuauggauggcagagccucucaaauuuguuuaggauauuagcuacagauuuuaaaauguuuucuucugugucuucaauuaccucuauuuucuuuugggucauucuuguuuauuucuuccaugcuauuaacuguaugcaaauaucuggcgaucuuugauuguuaguuuauauguuuugaagaaaguccuaaguaagcuggguaaacuagguaguuggcauggguucuuuugcuuuuguuuacaucuguuuccccaacaggacuuucucuuaauucagaaaauuguuaucaguccuauaacugggcacauguaucaauaaccaggcuucuauuuaggugccuaugugaaaauugugcaagggcaaugccaagguaaggggggagaguauuuaucuuugaaaauaacucuuucuaggcugggugugguggcucacaccuguaauuccagcaacuuugagaggccgaggcgggcagaucacgagaucaggagauugagacaauccuggcuaacacggugaaaccccaucucuacuaaaaauacaaaaaaauuagccgggugugguggcaggcgccuguagucccagcuacucuggaggcugaggcaggagaauggugugaaccugggcgguggagcuugcagugagccgagaucacgccacugcacuccagccugagcgacagagcgagacugucucagaaaaaaaaaagaaaauaacucuuucuaguugcuuuaucggcuuucucccaaacuuuaagugagaugaaauuuggagugacuggaaguccugcucuuugucaucccagauccacagagggaaccuucccucaugauguuaucccuaucuuuagggagcaguuuuuagguuuuauuuuaagggcuagaauccugguuucugagcuucugcaaacagaagagggagagagggagacuuaaacuguuuuguuauucugaauggaguuguauaguuaaugugaugcuuauucucagcaucuguugauuccagauccuugagaaauugccacacugucuuccacaaugguugaucuaguucacagucccaccaacagaguaaaaguguuccuuccuauuucuccacauccucuccagcacuguuguuuccugacuuuguaaugauugccauucuaacuggugugagaugguaucucaucgugguuuugauuugcauuucgcugauggccagugaugaugagcauuuugucaugugucuguuggcugcauaaaugucuucuuuugagaaguuucuguucguaaccuuugcccacuuuuugauagagcuguuugauuuuuucuuguaaauuugcuuaaguucuuuguagauucuggauauuagcccuuugucagauggguagauuguaaaaauuuucucccauccuguagguugccuguucacucugaugauaguuuuuuuuuuuuuuuuuuuucugugcagaagcucuuuaguuuaauuagaucccauuugucaauuuuggcuuuuguugccacugcuuuugauguuuuagauaugaaguucuugcccaugccuguggccugaaugguauuccuuagguuuucuucuaggguuuuuaugguuuuaggucuaacauuuaagucuuuaauccaucuugaauuaaauuuuguauaagguguaaggaagggauccaguuucagcuuucuacauaugaguagccaguuuucccagcaccauuuuuuaaauagggaauccuuuccccauuucuuguuuuugucagguuugucaaagaucaggugguuguagaugugugguauuauuucuaagguuucuguucuguuccauuggucuauaucucuguuuugguaccaguaccaugcuguuuugguuacuguagccuuuuaauauaguuugaagucauguagcaugaugccucuagcuuuguucuuuugucuuaggauugucuuggcaaugcgggcucuuuuuugguuccauauaaacuucaaaauaguuucuucugauucugugaagaaagucauugguagcuugauggggauggcauugaauccauaaauuaccuugggcaguauggccauuuucgugauauugauucuuccuacccaugagcauggaauguucuuccauuuguuuguauccucuuuuauuucauugaggagugguguguaguucuccuugaagagguccuucacaucucuuguaaguuggauuccuagguauuuuauucucuuugaagcaauugugaauggcgguucacucaugauuuggcucucugucuguuauugguauauagaaaugcuugugauuuuugcauauugauuuuguauccugagacuuugcugaaguugcuuaucagcuuaaggagauuuugggcugagacgagggaguuuucuaaauauacagucaugucaucugcacacagggacaauuugacuuccucuuuuccuacuugaaugcccuuuauuuccuucuccugcccaauugcccaggccagaacuuccaacacuauuuugaauaggaguggugagagagggcaucccuguuuuaugccaguuuucaaagggagugcuuccauuuuugcccauucaguaugauauuggcuguggguuugucauaaauagcucuuauuauuuugagauacgucccaucaauaccuagcuuauugagaguuuuuagcaugaagagcuguugaauuuugcugaaggccuuuucugcaucuauugagauaaucaugugguuuuugucuuuaguucuguucauaugauggauuagauuuauugauuuacauauguugaaccagccuuccauuccagggaugaaccccacuugaucaugguggauagcuuuuugaugugcugcuggauucgguuugccaguauuuuauugaggauuucugcaucaauguucaucagggauauuggucuacaauucucuuuuuuuuguuguugugucucugccaggcuuugguaucaggaugaugcuggccucauaaaaugaguuagggaggauucccucuuuuucuauugauuggaauaguuucagaaggaaugguaccaguuccuguuuguaucucugguagaauucaucugugaauccgucugguccuggacuuuuuuuuauugguaggcucuuaacuauugucuuaauuuccaagcuuguuauucuucuauucagagauucaacuucuucuugggagggugcaugugucccagaauuuauccauuucuucuagauuuucuacuuuauuugcauagagguguucauaguauucucugaugguaguuuguauuucugugggaucggugguguuauccccuuuaucauuuuuuauugcgucuauuugauucuucucucuuuucuucuuuauuagucuugcaaucuucuuuauuauucuaucaauuuuguugaccuuuucaaaaaaccagcuccuagauucauugauuuuuuugaaggguuuuuugugucucuaucuccuucaguucugcucugaucuuaguuauuucuugccuucugcuagcuuuugaauguguuugcucuugcuucucuaguucuuuuaauugugauguuagggugucaauuuuagaucuuuccugcuuucucuugugggcauuuagugcuauaaauuucccuccaauauacugcuuuaaaugugucccagagauucugguauguugugucuuuguucucauugguuucaaagaacaucuuuauuucugccuucauuucguuauguacccaguagucauucaggagcagguuguucaguuuccauguaguugagugguuuugagugaguuucuuaauccugaguucuaguuugauugcauuguggucugagagacaguuuguuauaauuucuguucuuuuagauuugcugaggagugcuuuucuuccaacuauguggucauugauguggugcugagaagaauguauauuuuguugauuuuucucaagucaguuuucuuggucuuuuucauguuacuaauagcuguuuucuuccauauuucugaugauuuuuucguuguguuuucauauauaaacagcaaaacuggguuaguuuuagguggcagguguaguuuucuucugcuguuuuauguauuuaucugguuucguguuagucuuucuucuaaaugggagaguuaucaguuaguucucuguacauuuauuauuuucuuguauacauaugcaaugaauguuuauugggcccagucugauuauuuuacugucacacucaucugugugaagugacuaccaaacaggcuuugugugagcaauaaagcuuuuuaaucaccuaggugcaggcaggcugaguucaaaaagagagucagugaaggaagauagguguggggccauuuuauaggauuuggguagguaguggaaaauuacagucaaaaggguuguucucuggcggacaggggcaggggucacaaggugcucaaugggggagcuucugagccaggggaaguaauuucacaagguaaagucaucaguuaaggcaggaacaggccauuuucacuucuuuggugauucuucacuugcuucaggccaucugauucuauaugugcaggucacaggggauaugauggcuuagcuugggcucagaggccugacauuccugucuucuuauauuaauaagaaaaauaacauaaacuaauguugaaguguuagagcagcaaaaauuuugggggggugguauggagagauaauggucaauguuucucagggcagcuucgagugggauuaggggcaaugugggagccuagagugggagagauuuagcugaaggaagauuuugugguaaggggugauauugugggguuguuagaagugacauugguuguauagaaugguuggugauggccuggauacaguuuuguaugaauugagaaacuagacagaagacacaaggagaaagaggaaaacagguauuaaaggacuaagaauugggaggacccaggacauccaauuagagaguguccaagggguucaguguaauuacuugcuugguuggugaguuuuugggcucuauccuugacagaguccuccuuuuuaaguuggaggcugagcuuggugaggugugcuuuuaaaagaucauuaguccguucuaucuuuccuaaagauugagguugguaagggguaugaagguucuacugaauaccaagagacugagaaacugcuugggugauuugacuaauaaaggccgguccguuauuggacuguauagaggugggaagcccaaacugaagaauuaugucugacagaagggaagaaaugaccgcaguggacuucucagacccugagggaaaggccuuuacccauccagugaaagugucuacccagaccaagagguauuucaguuuccugacucauggcaugugaguaaagucaauuugccaguccugggcaggggcaaaucccugagccugauguguagggaagggagggggccugaguaaucccugaggaguaguagaagagcagauggaacacugagaagugauuuccuugaggauagauuuccaugauggaaagcaaaugagagguucuaagaggcgggcuaguggcuuguaaccuaaauggaagagguuuugaaaugacgacagaauagaaugggccugugaggcuggaaggagauauuuuccuugguccaagaaccauuugccuugugugggaagagauugauaggugaacguuucagugggggaauaggugggagugaccagugagaaagagaaaaacuggcacugaaggacagaaguuggaacacuagcugcuucuuuagcuaccuuaucagccuaagcacuguccugagcgaugggaucugaugccuuuugauggcccuugcaguauaugacuccagcuuccuuuggaaguaaagcagccuugagaagaguuuucauuaaagaggcauuaaugauggaggaccuuugcauagugaggcaaccucuuucugcccauauaacagcaugguagugcaggauauggacggaauauucagagucaguauaaauacugauguguagucccuuugcaagagugagggcucuaguuaaggcaaugaguucggcuugcggagagggaguggaggggggcagagcgguagccucaaugauagauguggaagauacuauagcauagccugccuuugcuggugaguggugauuuggccugguggaacugccaucgauaaaccaagugugaucagggugaggaacaggaaagaaggaaauauggggaaauggaaugaaugucaaguggaucagagagauacagucaugggggucaagugugguauucagaauaaugugggaggcuggauugaaguccaggccaggaacaauaguaauugugggagacucaacaaagggugaguauagcugaaggagccggguagcagaaagcauacgcaccaggugugaggaagaaaauagauuuuggaaguuaugagaauuguagagaguguguugagaauaguuugugauuuugagggccucuaaaaguguuauggcaguagcagcugccgcacggaggcaugauggccagccuaaaacaguaaggucaaguuguuuggacaaaaaggcuacaaggugugguccugguccuuguguaagaauuccaacugcacagcccugcacuuuggcuguguguaaugaaaaggguugggaugagucagggagagcuagugugggagcagucucuaaagcugucuucaaggaacggaaagaggagugggcaaaggauuuaggaucuauggggucagcuaaauuuccuuuugugaguuuaugugaugguuuuguuaggauggcaaaagcagguauccaaaggugaaaguauccaaucaugcccaggaaggaaaggagcuguuguuuuguagaagggguuggggucugagagaucaguuggucaugaucagcagggagagcacguggguuuucaugaagaacuaugccaaguuagguaauggauggagaagaaauuugagcuuuggaaggagauacuugauaucccauggagaauaaauguugaaggagcaggagggugucuuuuugagaagauucaaaggcagggcuacaaaguaggucaucaacauauugaauaaggugagaaguggaggaguggaaagaaaguaaaucaugagaaagagcuuggcugaaguaaugagggcugucccugaagccuugcagcaguacagcccagguaauuugcagggacugaugggugucaggguaaaggcaaagagaggcugggaugaggggugcaguggaauagugaaaaaaccaucguuaagaucaagaauggaauagugaguuguggaggaagguauugagggcaaaagaguguacggguugggcaccagaggguggauaggcaaaacaguuugguugauaaggcgcagaucuugaacuaaccuguaagacuugucugguuuuugaauagguaaaaugggggaauuguaaggagaguuuauaaguuuuagaagcccaugcuguagcaggugagugauaacaggcuuuaauccccuuaaagccuguugugggauaggauacugguguugagcaagguaauggugauuaggguuuaaugggauaguaauggacaugugaucaguugccagggagguaguagaaguagggggauaugagaggaagaugugaaggaggcuuuggguugggaagaaggguggcaucagggaagcagauaauuugcuuaagaugugucagucuaauaagggagcugggaagguggggauaacuaaaaaggagugcauaaaagaauauuguccaaguuggcaucagaguuggggaguuuuaagagauuuagaagcccagacgucaguacccacaacaguuauggaggcaagggaaacacgcccuugaaaagaagguaauguggaguggguagccuccauauugauuaagaaggugacagauguaccucucaauguaagaguuacccaaagcauaugugaugguccaggaggcuuccaggagacuuccgaggcaaucgggcagugucagucuucagccgcuaagcugagaaaaucugggaaggcgucaauccgagagccuugggccagaguuccaggggcucugggagugacugaugggugaguuggacuguccgauuuccagugggguucugcacagaugggacauggcuuaggagguaucccgggcugcgggcauuccuuggcccaguggccagauuuccggcacuugaagcaagauccugggggaggagguccugaaagaaugccugaccacuguggcuuaggcguuuugaaguucuugugugcuggagauguggcugggguuucucucacaguggaggcaaggaauugcaacucagaaauauguugcuacuuggccgccucuaacucuauuauuguaugccuugaaggugaaguuaguuaaguccuguugugggguuugagggccggaaucuaauuuuuggagcuuuuucuaaugucgggagcggauuggguaauaaaaugcuuauugagaauaagacggcuuucugaccuuuuagggucuagggugguaaagggucucaaguuugcugcuaaacaagccauaaacugggcuggauuuuuacauuugaugaaaaagagccuaaacacuaacugcuuugggagaggucagauaaagaaaaggagcauuaaccuugacuaugccuuuagcuccagccaccucuuuaagaggaaauuguugggcaggugggggagggcuagucucagaaugaaacuguaagccagagcagguguaaggaagggaggugauagaaggauuauagugucggggaguggaggccgaggaagaauuggagccugauucagccuggcggggagcaaacugaggaggagcacucuggggaagaggggagagaucagauugguugguagaaaaggaagauugaaaagacucagugacgcuugggguugggacugaggggacgggcgagagggaaagaaggaagauuugggaugaguugcauuaggaacagagacuagggagggacugauguguaaaagaaugccuggacgucaggcaccucagaccauuugcucauuuuaugacaagaacuaucuagaucauguaggauggagaaauugaaaguggauuuucuggcuauuuggaacaauugucgaguuuguauuggggucaaguggcauugcagaagaaaacaagguguuuagguuuuagaucaggugugaguugaagagauuuuaaguuuuugagaacacaagcuaagggagaagaagggggaauagaggguggaagguugcccauagugaaggaggcaagcccagagaaaagagaggguagagacauggagaagggggguggugagcagcccugggcugcagugugggugagcagccaaagcaggcauucccaccauugacaugccaccaagugaaugugggugaaugaaggcaggcauccccauggugaucaggcaacaauggagugugggugaauaaucaggcaggcguccccacagugauuaaacaccaagggaaggcugucuucccaaguccgugaccagcaccagaguuuuggguccacggaugaaaugugucuccuuugucucuacuagagaggaaaaaaaacuggaauuggaaggacagggagauugaaggauagcgagagagggagauugaaggguagcaagagaggcuggagaagagagugaaaagaccgcuuaaccgauuugaaauuggugagauguuccuugggcugguuggucugaggaccugaggucguggguggaucuccucacggagugaggacgaggacaggggacaagucucuggaaggaguccuccugucccaggucuuuggcaccaaaugucaugugcguccgugugaagagaccaccaaacaggcuuugugugagcaauaaagcuuuuuaaucaccugggugccagcgggcugaguccaaaaagagagucagcaaagggagauagggguggggccguuuuauaggauuuggguagguaguggaaaauuacagucaaagggguuguucucugguggcaggggcggggguuacaaggugcucaaugggggagcugcugagccaggagaaggaauuucacaagguaaugucaucaguuaaggcaggaaccagccauuuucacuucuuuugugauccuucacuugcuucaggccaucuggaucuauaugugcaggucacaggggauaugauggguuagcuugggcucagaggccugacaauuacuucauguacauugggauggggaaacuauuggugugucauugggagauuuucaaauuaaucccucugcuucuaguugccuucucccacccuccugcuaaagcuguguuaaagucuuucugaggccucuuuaggcaaaaggguucuuccuuucauuguaggcgucuuuaggcaaaaguguucuuauuuccauuauaacucugaguguguauauuggaucugagggaagagagagacccucucauauuguuuuauauuguuuuauacuaaguaccuguuucaagaaaaaaacaaggaagugaaaccaaagacaggcagcccagcgccaggcccaaaacugggccugggccugccuggccuaaaccuagugguuaaaaaucaacucaggcugagcauggugacucacgccuguaaucccaguacuuugggaggcugaggugggcggaucacgaggucaggagaucaagaccauccuggugaacauggugaaacccugucucuacuaaaaauacaaaaaauuagccaggugagguggcggguaccuguagucccagcuacucgggaggcugaggcaggagaauggcaugaacccaggaggcggagcuugcagugagcagagaucaugccacugcacuccagccugggcgacagagugagacuccaucucaaaaaaaaaaaaaaaaaucaacucaugacuuagaaaccaauguuauccauagauucccggcauuguguaaaagaacacugugaaacucccugcucuguucuguuucaaucugaccacuggugcaugcagccccugucacguacugccugcuugcucaaaucaaucacgacccuuucaugugaaaucuuuagucuugugagcccuuaaaagggacagaaacuguacacucagggagcucggauuuuaaggcaguagcuugcugaugcucccagcugaauaaagcccuuccuucuacaacucggugucugagagguuuugucuguggcucguccugcuacggaucaacucuuccugucccuuguuuauucaccaacagguucucaucagcuuuccagcuuggagaauuugaugaaaucacuuauuuaauaaugaccccuaccaugcugucaauuuguauauuuuuuaaacaaaaaacauguuuuuaaaaauucucuuacuccuuaaaauuuuuaaacauuuaucuuaauaucauuuuuaugugguccuagagggagaagccauaaauacucucugccaucauuaaccauaagcaucacuuuguaugccuuuacagagcagcuagaaauaguccaugacuaacuugccuuguguauuagucugcucaggcugcuacaacaaaacaacacagaguucauggcuuaaaccauagaaauuuauuuucuugcaguucuggagucuagaaaguccaauauuaaguucaguuaacucaguuucuggugcaggcuuuuuuccuggcuuccaaauggcugccuucucgcuggcuacucagauggccuuucuuuggugugugcacaggggauagagaaagcacaacagagcuauagagaacuccccugagucccuucuuauaaggacacuaauccuuuauuauuauuauugcuuuuauauuuauuuauuuauauaauuucaacuuucuauuuuagauucaggggauacaugugcagguuuguuacaugggcauauuacguggugcucagauuuggggcaaaaugauccugucacccaaauagugagcauagcaaacaacaguuaguuuuucaacucuuuucccucucuucccccuuuaauagucaucagagucuauuauugccauuuuuugguucacuaaucuuagggggucacauuaugaccccaucuagucuuaauuacuuccuuaaaggaccugucuccaaauauagccacacuggguguuagggcuucaacauaugaauuuggagcggggaaggggugugggggggagauggggacacauucaguccauaacaccuugccaaguacaaugaaaaugcuuauuuuaucauuuuacuuacuaugaaaaaaaaaacaguaguuuuuucauuuugucuguggcugacuuuuuuuuuuuuuuuaauguggacuugaguuucuauguuaacugccucuuuccuuucugcuuguuuuauuuuuauuuuuuuccuugauuccuuagcccaaugauauucucuccuuuccuuaaugaguuauuguuuuauuucacuguuauuuagacugugucuuaaagccuuuugguuauuugacagaggguucugagaugcugguagaaaccauugaauuagaaagacucacuugacgauauaccaauauuccaaguaaucucacuugcaaauaagcacuuuaaaaaauaaauuauauccuaagagucaaaggaaugccauugauaucugaaauccuucuaagccucuaagcacaguuucagacuugcuuauuucagggaucuaggggcuauugcaaguagggcgauauugcaaaauuaggagaauuauuuuacuguugccuuuuuaaguguccaggaacacuuugccuguugcuuuuccaaacauaaguacagacccaggccacagaacuaauauauugauguaauuguaacaaaauaagucaaauagaacaaaaacaaaacauuuucugugcaguaacuucuuggugcaugaugucaaaaucaaaugauguuuugggguccuaguggguaggagauaaaaaagacaaugaaagcugagugugggacuaucuugcugcaugucaugaaaaagaccuccuguuguagcauuaggaaacauaaccaguuugcaaucuaguagucaggagaaaaaaaauagaguuguagaaaauuccuucuuuauccuugccaacaucugagcucuugaaucccuucaaugaagcaucuucauugaucacugaccaagaacaaacaauucaaauaaaagaaauggccaguguaacuuuuuuucuggguaauaaagccguguauucuaucauucgaguaaagauauuugcuguuuggagggaauaacuaacguguacugcuuucucugucuaguuaaucaaagguuuuaaucuguggaaacaacgccagagugacuuuuuuuuuuuuuccuagaaaggggcuguaaauugaaguuauaauuaaaucuugguguaaggagagguccguuucacuucuguuguuguuaaacaguucaggcauugcuccuguacucauucaaugaucuguuccagaauggagggucaauggucacauuuuuuuuuuaauuccaccaguggcuuuucuacuucuaaauaaaugccagccuacacuccccuauccuuaauguuuuagaacucgccuuuauauguguaacauuucauucacagauuacuucuucuuuuucucucccuggauuuaaaucuuuauccacaccuaucucuuaaugaucuuugacucuaguaaaguauuucucaucagucaguauuuguucaguccuucaaaaagaccuagauacaguucauuacagaauguucuuuaacccauuccaacccuuaacacaauaugagaagaaaucguugcauagcagcauaauccucaaugugauacaaaauauaaaaucuagagaaaagcaaggauaauaguuggugaaucccuacauaaaaacccaucuuugaguuuuccuuaauccuggcaaccuucacauuuuuucaauugcuucuuuccuccaguuggaaauuuucugugguagaaaucuuuaugaaaaauaacugaaguauuuuauaguuaauguaauuauuuuaaauacauuuuugaauauacagccauuuuuaccauuauuauuauuauuuuuuuaccauuauuaacuagccuuuuuuuuuuuaaugugauggcgucuugcucugucacccaggcuggagugcaguggcgcaaucucugcucacuccagccuccgccuccuggguucaagugauucuccugccucagccuccugaguaacugggauuagaggugcccaccaccacuccugguuaaauuuuuuuuuuuuuuuuuuuuugagacagagucucuuucugucgcccaggcuggagugcagcagcacgaucucagcucacugcacccuccgccuccuggguucaagugauucuucugccucagccuccugaguagcugggguuacaagcacgcaccaccgugcccagcuaauuuuuguauuuuuaguagagacgggguuucaccauauuggccaggcugaucucaaacuccugaccucgugaucuguccuggcuaaauuuuguauuuuuaguagagauugcauuucaccauguuggccaggcuagucucgaacugcugacuucaagugaucagcucaccucggccucccagaguguugggauuacaggugugggccaccacgccagcccauuauuaauuaauuuuuuaaauaauauaugcaauucuuuuuucucaggcuuuuuuuuucuuuuuuuuugaggcaaggucuugugcuuucacccaggcuggagugcagugacacauucggggcucccuguaccucaaccuucugggcucaagcgauccuucagccucagccucucaaguagcugggauuccaggugugcgccaccaugcccagcuacuuuuuaaauuuuuuguagagaugguguuucccuaugaugcccaggcugguuucaaacucuuggguuuaagggauccucccaccucagccucccaauguguugggauuacaugugcgagccacaguacccagccucagucuugguuuaaacaaaauauacuguuucaucaauugagacuugugaagcacaguuaugucucaaaguaucaacuggugguucucuauauuuguaaagugaaagccauuuuccuucaccucauccaacacugaagcccacacaaagauaaaaauacuuggccaacccaagugcuagccaaagacucucuucucagaaacauucuuucaagggcaauuuuucauuuaugagaugccaaauaagaagagccuagggaaaagagagauggaaagcagaacuaaaagagagaugagcuuuuggagggaagaaugugagaaccaucuuugcaaaaaaacaagggagcaaaauggaagagcuucagaggauaagcuauccuaaaaccuggaugcuccuccaucugccaccucauccuuaaccugacugaucaguuuuggacaaccugcagaccuuugguccugcccuccuugaacagaggguggcauuagcagagggagugcuagcaucacugucauuacaggggcucuuaugaaaccaauaacaauaaauuauuuuuuggagguaagucaaucaaauuuacacucaaaaaacaaagacuuaccccccacaugaagagaacauaugaaggcugugaauacaauuucaaagagaauuccaguucauguuugcacaaugguuuuauuauugucauaauuguuccaccugcuuuggucauuauuuugaaggagugacucagauaaguuaaaaaaaucaaguugacucaguuguacuucuuaucuugaaagacucauaaacuccacauuauaaccuaaaauuuugaaucugaauguaacacuuuucaagcaacauaguuggguuuuaacaaggacuuucuugagauacuucuuaauauaaagaagugaaacaaaugaguaagggacagugugcuaauacaaaaagaggacaggguuuggaugcugguugucuguguucucagcugugggaacuugcuaaaauuaacucaacuuuaaauuuuagcuuauucauauauaaaacggaaaauuuuaaucuacuuagaacaguuaugauucagauuaaaggagauaauguaaaacagcauuuaugugcucauaugucaugguuauuaugguaaauaauggaacuuuuagauauugcugcaugucagcagggugaauauuuuugggcagaagaacuuugagccaauugcugaaagcacuucaaaccccaugcuugucucauccaacaguccuguaguuuuaauuuggguucaugaugucaugccuguaucuuucuggcaagaagcaguagacugcuucaaaagccauucucuuagauggauggguuuauuuuguaaaggacagcuaauuauuuaagauagugaccuuauccacugcacaaccacauaauuucuuuuacaaaaauuaaagucagcucauggcaguugugcaagagcagaguaugagcuguggcagcgggagucaugggagaccaaacacguagaaaguuucuucugcucuuugaccgaguguucuuuggcugaaaguggugcagccaaaaccguaaccaaagaaggcauuaugcuuccagaaaagucucaggaaaaguauugcaagcaacaguaguagcuguccgauugggcccuaaaggaaagggauucaagcagucagugugaaagcuggagauaaaguacuucucucagaauauggaggcaccaaaguaauucuagaccacaagcauuauuuuuuuauuuagagauggugacauucuuggaaaguagguagacugaaauaauucacuguugaaauggcaucaacaugaagcugcccauuccacugaaguucuaaaaucguacaucauauguuaauuacuaugucuuuuauuauaaaguaauuauaucuaaacuaaugacaucagugucucuauaauuuaguuucacuguauugauaaacacauuuccaaauaaaaauauguaaaugaaaaaaguuaaaucagguacaucauggacauuugaguagcagaauacacucaagaaaagagcacugggcuaaggggauggguauauuugaauuccauuagcacaacucguagcaaaucaugucaccucucucagcuucaauuucuucaauaggaaaauagggaugauaauucugucugauaguuuauuucagcaugugaaaaucaaaugaaauaauuaauucgugcuuugaacauuguuauguaucauaccaauguaaagcauuguugggcugaacuagaugaaauccaaauuuagugcaaauauauuuagacaaaauuuuuuguuguuguuagcuuaauuuuccuguaggacagaagcauaacaguuuuuguuuuuuuaauauuccucucaacaauugagacaauaaaacuuccugauuuuugaaaagcagcagacaauaaacaauggauugcaggucugagaguugggaugccuaugaucuagcuguaguuuuguuguuuauucacuuuacaauuauggaaaaauauguugcaugcuuuuuaccugaguuucaucaucucuuaaauaauaaaggugguuauguuuacuuuuauaaacuuaaguggacauucccaagaacucaaaaaccuuggcuauucugggugauuuagaccuuugcuuucacaagcaugaauacaguauguguuauuacaccugcuuuguacccuuuaguuggggcccauacggggaaagagauguucuuaaaaaucacuaucaaacuccuaauuccaaaaguuaauauuguguaaggaaaaaaugccaagaagugaauauauauggagcuuuauuuccuaagugcauuuaaccuugauuuuuaaaauugaaucaguguauucacccuucaaugaaaguguuauuguuuuccccagaaagaaucacauaguugcuguaaaguucaaaaaguccaaauuuuuugcuguauuuauuacaaacuagcaugcguaaaacuacuuaaaauaaaugagauaauugcccacgucaggcucuuucacuguugacaggacugucauugauaagucaauaacacacuuggcagauagcaugaucacagaguaccaucuuuuauauacguucugccuugacuuaaucucuauuuuaaugagcaugauaaacaugucaagagauaggguuacaaaucuaacccaaacaauuuauuuauuuauccauuacauuuaaaccucugcuuuggcaagucagagaaauaaaguaauauuacuucacucuugaaagauuuuuuuaguuacuuaacugauaaauauaguaacuguugauaaaucuuuuugcuuuuuucuuucuucuauugucaacuuuugaguauuuauugcuuauuguuuaccagguaauaagagacaagaaaagggaaagaaauucagacauuuauauuacuuguuuaucuucuuagugaaagaaccauuugugguuaagaucaggaaaaaaguuacuugcagauuuuauuuauguuuuuuacauuuuucauuaaaaagcuguauuaacaugcuaaaauaauaaaccaaaacucgacacucuccauacuuuucuccaaauauaauuguuguauuagcaguuugucuuuccaaacucuuuucuguguauuuuuccacaugauauuuacauauauacuacuuuagcugauuuguagagaauuaugcuaugaguguggcauuuuacaacuugcauuuuaacuuacuguaucuuugagaucuccaguacaagaguaucuuccuuuuagcaacugcauauuauuccacaguacggguuuauuauagcuuuuauuuccauuccccucuuuuuuuuuuaagucagggucuugcucugucacccacacuggagugcaguggugugaucauagcugacuauagccuugaccccccacaggcucaagugauccuccugccucagccuccugacuagcugggacuacaggugugcaccacuacaccuggacaauuguuaaaauuuuuuggagauguggggucucucuuugucauccaggcuggucuugaacuccuuggcucaagugauccuccugccuuggccucccaaagugcugggauuacaggcaugagccaccgugccugauccugugccccucuugauagauauuuaagucauuuuuaauuuuuugaucucacaaacagucuuucaauaaacaauucuauuuuuuccagcacaugggcauauauguaggacauacuuagaaucagaguuguugagaugacgaguauaugugcuuuaaauuuuaccaaaauaccuucaaauaaaaccugccaguuuaugcuccacuaccaguguacaagaaugcauguuuucccuuacucucaccaauaauugauauuaucauucuuuuaaaguuuugccagucuaauaugcaaaaauauaauuuuuaaaauaguuugauuugaacacuuuauaauguuuauuucccguuuauucucuguagugaugguuuauaugauuguuuauauuguuuucuuuauaguuuguuuauauuuuagaaaugauuuuauauacaaccgugcaugcauuucuguauuggucggcuuaucuggaugcaauuuuuucuauucuauaugcuguaaguauuuuccuccagucuguugcuugauauugaacuuuguuauguuauuuuuauuguugcuguucaacaacaaucuccacagagaucacaaagguuuuucauuaaaauugagaaaguuuauuacucuugcuuuaaagaugguauggcuuuuuuuuuuuuuuuuuugagacagagucuugcucuauugcccaggcuggagugcaguggcaggaucucagcucacuguaaccucuggcucccugguucaaaugauucucgugucucaguuucccaaauagcugggauuacaggcauguuccaccaggccuggcuaagacuauggcuuuugacauaggcauuucaucauguuuuuucuuuuuuuucagauuuuuuuuuuuagaaugagggucuuacuggcuggagugaagugguaugaucacagcucacuguaaccuugaauuccugcacucaaguggcacucccgccuuagccucccagguagcaaggacuauaagugcauaccaccaugaacaauuaauauuuuuuaugugguggcgcauucuaguaaucccagcuacucaggaggcugaugcaggagaaucacuugaaucuggcaggcagagguugcagugagccgagaucaugccacugcacuccagccugggcgacagagcgagacuccgucucaaaaaaaaaaaaaaaaaaaaauauauauauauauauauacacacacacacauauauauacacacauauauauauacacaaguauauauauauacauauauauauacacauauauauauacacacacacacacauauauauauauauacacauacacacauauauauauauauauauauauauguuuguuuuuuguagaaauggggucucacuauuuugcccaggcuggguuugaaccaccuggguucagguggaccucccacaucagccucccaaagugcugggauuacgaaggugagccaccacaccuggccucagcauguuuucucugauguagucauaauaaaggaaguauugaauauuaucugguguguuuaaccucaaguauaaaccugaauaauuuguguagaccaucauacaagggcugcagcugcacaccaaacccgcucucugaauuguuaaccaacgugcuucuguaucugcauuuuuuucuuaguucgaucauacugauuuuaaaugucauacaauucauaggcagaaaaugauuuuaacucuuauuguuuaauaaaacaauauauuuuacauggaaaaaugauuaauucauauaaacugauuguuuccuucaguuuugucaaagcaacaggcuucacaaguccugguuaggaagcgucgugcaaauucuuuacuugaagaaaccaaacaggguaaucuugaaagagaaugcaucgaagaacugugcaauaaagaagaagccagggaggucuuugaaaaugacccggaaacgguaagcauuuauggaaacuaucaaguucacacaucuagacauacaacuacagacugaacauuuccagccuguacuuccuucuguuccaucuuaaagucaauaauucuguguaucaccuuccacacauaaccacuuccauuucaggaggaaguaccuucaaaggaaagugggcuuguuaggcagacaugaucaccaauaacagcuuguucugacuaaacuauaguucaguuacaccucauuaucagcaaauaguauugaccucaugguuuguaaauauuuucuucuaaccagaauuugauaguguuagggggaggggagaggaaguaccuuuaaaggaaaaugggcuuuuuaggcagacaugaucaccaauaacagcuuguucugacuaaacuauaguucaguuacacuucauuaucagcaaauaguauugaccucaugguuugcaaauauuuucuucuaaccagaauuugauaguguuagagggaggggaaaggaugucugaaguauuaacgugugugugugugcgugugcgcgcgcacgcaugcaugcuaguuuggauuauuauuacaaugcuucauuaaauuucuccauuggcauuuauuuuuauuuuuauuuuuugaaacaaagucucuuucuguugcccaggcuagagugcaguggugcaaucucugcucacuguagcccccacuucccggguucaagagauucucaugccucagccaccugaguaggugggauuagaggcguaugccaccaugccuggcuaauuuuuguauuuuuaguagagacgggguuuugccauguuggccaggcaagucucaaacuccugggcuuaagcaauccaccugccuuggccuccuaaagugcugagauuacaggcaugagccacugcgcccggcccacuguuacuuuacaugaaagauuuuaagucacaauuguagguaucaucuaauauugaaauuuuaaauagauuuuaaauagaucucaaaguagagagaucaguguaauacauuucauuauaaaaacucccccaccccuuuaauaauaaucaacacucugccauucuuguuuuaccuauuuuuuuccccauccauucuaauuuuuguuuuguuauucuggaauauuguaaggcaugccugucugcccaagauaccauauuaguacaucacucauuaauauugaguguguauuucuaacacaauggauacauucuaucagcuuagccucuaagcagcaaaagcccagugagggagaagaccuugauguggaggaggaaagauagugaggaaggaaaacucauucaugugcuuccucccuuccacuaauucuagcauuggucucauugacagaagagaaaaaaaugacagaaagagcaagacagaaaggggagaaaugaaaaaaaaaguuacuuuuuuuuuuuuuuuuuuuagacagggucuugcucuguugcccaggcuagagugcaguggcaugaucaugguucacugcagcccugacccccccgcucaggcaauccucccgucucagccuccugugucgcugagacuacaggugugcagccccacaccuggcuaauuuugguauuuuuugucgagagggcguuuugccauguugcccagucugggcucgagcaaucugcccaccuuagucucccaaagugcuaggauuacacgugugaccacagugaucccucugccccacccccaccaaacauuuguuacuguguuacaauucucaugauuacaggugugaucauuuucgacccuacccaaccacucccuguccacaucccuaauaccacaguccacauuuccaguccccacaguacuacuuaugccucaacaucucuaauauauuccuuugacggucgcaauaucaccuuugaaucccauuaucuauuguguagguuuauaugagaggaggaaagaaugaggccuuugacucaguucuggaugagcuuauguucuguacuuacuaagugguaacauugaauaugucuuuguguagaaauucugguuucucaugagguauucuugugcuguuaaugguacacauuagauauauuauggcuuaagaaugcuuuuguggacuagccugagaaccuuacuaucagaaauuuuuaacauuuuucucuuuuuaagaaagcacauucuuuacuccaaauugacugauuuacagacaaacuuuugguacacaaccaauuuauagguaagguacuacauguacauaagauguauaagauaaaugucuacuuuaauucacuucaaaguaugucacuguuagcugggcaccuuggcucacaccuguaauuccagcacuuugggaggccaaggugggaggaucgcuugagcccaggaguuugaggccuaggcaacauagugagaccccaucucuacaaaaaaauaauuaacaacaaaaaaccagcugugcaugguggcauguaccuguaguuccagcuacuuggggggcugagaugggaggauuacuugagcccaggaggguaaggcugcagugagucauggucauaccacugcacucuagcaugggugacacagagaaaccucgucucaaaaaaaaaaaaaaaaagagaguacguuacugugauucaacauugaaucugguguaggugaccauuaugacauaaaaugugucaaaugguuaucuaaucauuauggaaaaauuaaaggauguacaaaaaagggcauguaugauuauauuuaccauccuaaauagagcuuguuuuuagauuagaagcuuuugaaacaugauuaauugaucaauauuucuuuaagccuaaguaucuuacuggcuuaauuuuauuguuuucucuugguauauuuuacuauauaaaaauuauaaugugaaaaugaugguuauauguaacuuauuugcaucuuuaauauaaaaacacauuauaaaauuaaguuuuaacucuauaaugaaauuuagguuugcuaagauauguuuucuuuuucuucuuucuaggauuauuuuuauccaaaauacuuagguaaguucaaaacaucucaauuauauaaucuuagaaauggaagggaacuuagauauguuccugucuaacucuccaccuaucuauuccauccaauguaauuucauuauccuugggagugagguuucauuuuauaugcaauuuugcugucuuuauauuuaacacauguugagaaauuuggaacgguucuuuaauuaccaugugacauuuuaaauuuuaguguuuuucuuucucaugucuuucucaugaagcucuugggcugaugcucaguuauauugaggugcuagacauagucuaugagcauaugcguuuucauggguuaacuguuuuuuuuuuuuugugaggcagcgccuugcugugucacccaggcuggagugcuguggccugcucucagcucacugcaacuucugucucccugguucaagugauucucaagugccucagccucccgaguagcugggauuacaggcaugugccaccacacccagcuaauuuuuguauuuuuaguagagacaggguuucgccauguuggccaggguagucuugaacuccugggcucaaguguccacucuccucagccucccaaagugcuaggauuacaggcaugacccacccugcccagccuuagcugcuguauuuuaaaagggcagugggauauggauauauccaugaaaaagauguuuucuuuuguaaaguuacaugcaagaauuuguacuauuaaaguguagaaaagauaguauaucaagacuauuucagcuuuuuaauuuuagauagaaauguaaauauuuuauaauaaaaauagacaauauuuggcuguuaaauauuauguguacauuaaaaaaacaguguuaacucuugcuucuuagggccauguaaugaggcugcauuuuugcacgcacaauacuguagaggauacauuccuuugaucagaguacauuuggauaaagauaaauaccaugcuaauacagcauuauguguucuggggaaguuccuuagauaaaauauuuuucauaauuuuauccuuguaucucucuuaacuuccgcuuuucuggcccugcccaacucuucucuuugccuaucucauuuggcaacaugguaaaaaaaaccaaaguauaaaauaaaacaaacuaaaacaaaaacacaagaugugggauccaggcucagaccuaaaaauuuuuaacuguuucagauuaaacaaguuguuuagcuuuccagcuucuguaguuuuaagugugcacuguaacuauauuuucuaacuucagagcuuuuaaaucaccaaauaugucaacguacauaaauaacuuaaugugucaaaauuucuucagauguauucuuguuuaaucaacccaucaugugaaacaaaaauauacuuuuuauuaugauuuuuuuuaauuuaaauuucauauuuuggucuuuauuuguauauaggcauguguggugaauuccacuguuaaaaacaauuuuuaaaaauguccugccuaaguuacacuuuuuuuguuauuugauguguauauucuauaggccaauggcucuaauuugaaaagcaaaacaaaacaguccuuucucugguaaaucuaacaguaguuuuacuaacuacaacagcucauacaggaaggucccuguagugagauaaggucaccaaagaaauuaaaaaauuguaacccauauauuuggggcaauauuuagacuucguuuucaggggcugauaaagcacuucaauuggccuacauauuccauguacuaucuugaaaacaugcgauuuggaaauaaguacucuggguuucauuauaguuuuuaaauuguguucuucucuuuuguaagaaguggaauaaauaacuaccauuuccauaggccuaguaucaccuaauagagugaguguuucuaguaaagagagagaaacuuccugggaagaauggugaacucugagccuaaauauaaacauuagaaaucauuuuuugaugugagcuggcaaaaaauaaaauaaggaaaaaaccugaaaaauaaaaaaaagaaauuauuuuuaguuucuaagauaaguuggugaauuaccucagaaugcugacucccucccuucaaaucuucucuaaagaaacaauaagauuccaagcacuaauaauaacaaaauaaaaugacaaaaagaaguuuaagaaaugccuggguaggcgaaaagcuggccugaccugcugguauguguggugggggauuggguucuaacugacaaggcaguagugacaaaacagauuugauaauuuaaaaaaugacaugaacuuuccaauugagaaaacaaacacaaaaaauacaauagagcaaaccccaaguaacaagaaguuuuaaaauaacaaaaacagagauagaaauaaguggaauagaaaaacaaaagugagcauuaacaaaagcacauucucauucuuugaaaagguuaguaagugagacugacaucuggcaggaauaaucaaggaaaaacaaaaaagagaaagaggaaaugccaauacauagaguacaagauagaaagggaaaauauucuaaacucaacacagauuaaaaauauuaucauaaaauauuacaaacagcuauauuaaauacacuuggaaaccuaaauaaaauggauguguuccuagaaaaacauaaaauaucuguaauuucacaggaagcaauagagaacuuaguuauacaaacgaguauuaaacaaguuaaaaccgcagccaaagcccucuucuuccuauuucucccgaaacccagauccagaugguuuuacaaaugaacucuuccaaauuuuaagaaauuguuaauguuucccuuauuaagauauuguccuuaaaaaaugagcuuauucuaagaggcuuauguaaucuugacuccaaaaucaaauaaagacauuuaguaaacucauuuuaaaauuuaagugagggaauaaaagaaaagaaaaauagcauuccuuuugauuuugaauuaauucuaaauaaaaugauauucaguccgaucuuaaguguguuaaaaauaauaucaugaucaaguagaauuauuccagaaauuuaaaggugaguuaacaucaggaaaucagcugggugcaguggcuuaugcccguaaucccagccacucaagaggcugaagugcgaggaucacuugaggccaggaguuugauaccagccuggauaacauaguaagaccccaccacuaaaaguauauuauuaccucaguucauacagaaaaagcaguugauagagaucacuacuuaguuaugauaaaaguuuuugucaaacuaagaauauaagaaaaguuucugagcuugauaaagguuaaaucuagaauaaccauauaauuaaucuuccaaauuuucacacuucaguucaggauuaauaaugcauaagguaaugucagcuagaacaagaauaagauaggguuguuuugagcaaauuagcaugagaaaggagggagggagggagagauggaaagagaaagagagagaaaagaaaaagaaagugaacaaaaucugcaguaaacauuauaccuaaugaauaaaauuuagguauaguuucuuuaugguugagaacaaaaagaaaaguacuggagguuacauucaaugcaauaagaaaagaaaaauagggauuguauagaucauaagcuauaguauauuccugucauuacuuuuaauagauauaauacuggaaaaaaauagaauccauagacaaaauauaggaacacauaagguauuuagauaauucuaugacucuccuauaaaaauccauaguaguucuuuaugcaagcaguagucuaguagaaauuaaaaagaugauagcauucacaauagcagcaaaucccauaacauaucuagaaauaucuuaagaacacauaaaaacccuauggagaaaauguuaauacucaaauugaagacuuagaaaaugaauuaaaaccauggaaagauauuucaugaucuugaauugagugauacuauacagugaucaguucuccucaaauugauuuuauuuuauuuuauuauauuuuauauuuuuagagauggggucucacuauguugcccacacuggucucaaacuccugggcucaagcaguccuccugccagggcuucccaaagugcugggguuauaggugugagguacuauguguggccauccucaaauuuauauguucagagcaaucuuguuuaaaaaaauauuuuugagaaacucaguaaacucauuuuaaaauuuaacugaggaacuaaaaguccacacaugucuaaaauacaaaagagagaaauaucuuaucaaauauuaauaauauaaagcuauagaaauaaaacuauaugguauuuucagaacaugaaacugaacagaaaguucagagaaaggcucauaucuaugacaaccuaauauuugauaaagaugauacuguaagucacuguggauuauuuaaagaugguauugcgaagaauggccagcuauuagcagacaaauaaacauggguuucuaauuaccaccaaguguaaaggugaauucuagauggaauaaagacaaaaauguuaaaauaaaaccaugaaauuaaagaaacaauaugggagaauaucuuugugacugaugacaugggggaaaauuuuaaauucacaagcuguaaggugaaauaauaaauuggauuauaacaaaauuaagaauuuaucuuacaagagagacaugaauaguaagauuaagagacaaaugacagaucugucucugucaaauaaauaucaaaaauauaaauaucaagaggugauauuuauaaauguuuauuuuuuuucaaauccgcaggaaaaacaaauaaggaucaauagaaaaaugguaaaaaaaaaaaauagggaaaauuuucaaagaagaaaacuuucagauuuggaaaaugacaugaaaauaugcugccucuccuuagaaaucagaaaaauaaugagauauuacuuuacuaccuauuagucugccaaaaauuagaaagcaaggauguagaaauccuuauacuccacuggugagaaugcaccucugagagccauuaaguacauuccuauuuaaugaucacacaauuccaccacuggguaucuauuccaaagaaauuguuaugcagguacuaaggagacaugcaugaggauguacuuuccgccuucuuguagagguagaaaguuggagguaauuugagugucuuaucauggguagagagaauuauaaaguggugguugcauacugugguguaacacuuagugguuaguagcaaugaauuauauguagcagcauggauugaucauaaaaaucaaguucugagaaaaaaauuagaggaugugauauauaacacaaaaccauuuacacacgugaaaaaaaacauggaaaugaaauuguaaauauauauuuucaagaacacuuacaaauuuuaaaaauacacauaaccacugggcaugaugucucaugccuguaauuccaacacuuugggaggcugaggaggaugauucacuugagguuaggaguucgagaccagccugaccagcaugaugaaaccccaucucuuguaaaaauauaaagauuagccaggaaggaaggagugguggcgaggccuguaaucccagcuguguccagaauugguggguucuuggucucacugacuucaagaaugaagccgccgacccucgcggugaguguuacaguucuuaaaggcggcguaucaggaguuuguuccuucugauguucggaguuucuuccuucugcuggguuuguggucucgcuggcucaggagugaagcuucggaccuucguggugaguguuacagcucauaaaggcaguguggacccaaagagugagcagcagcaagauuuauugcaaagagugaaagaacaaagcuuccacaguguggaaggggacccaguggguugccacugcuggcucgggcagccugcuuuuauucucuuaucuggccccacccacauccugcugauugauagagcgaguggucuguuuugacagggcgcugauuggugcguuuacaaucccugagcuagacacaaaguuucuccacguccccaccagauuagcuagauacagagugucaauugguguauucacaaacccugagcuagacacagggugcugauugguguguuuacaaaccuugagcuagauacagagugcggauuggugcguuuacaaucccugagcuagacauaaagguucuccaaggccccaccagacucaggagcgcagcuggcuuaacccaguggauccugcacuggggcugcagguggagcugccugccagucccaagccgugugcccgcacuccucagcccuuggguggucaaugggacugggcgcccuggagcaggggguggggcucaucaaggaggcuucauggcacaggagcccacagaggcgggggaggcucaggcauggugggcugcaggucccgaacccugcccugcagggaggcagcuaaggccuggcgagaaaucaagcgcagcgccagugggccagcacugcugggggaccuaguacacccuccacagcugcuggcccgggugcuaagccccucauugccccugcuggcagggccggccggcugcuccgagugccggcccgccaagcccacgcccaccaggaacuccagcuguucccccucgcgccuuucccuccacaccucccugcaagcugagggagccagcucugggcuuggccagcccagaaaggggcucccacagugcaguggugggcugaagggcuccucaagugccgccaaagugggagcccaggcagaaaaggugcccagagcagcgagggcugcaagggcugccagcacgcugucaccucucacagcuacuggggaggcugagggacaagaaucacuugaacccaggagguggagguugcggugagccaagaucgugccacugcacuccagccugggcgacagagacucugucucaaagaaaaaaacaaagaaacaaaaaacaaaacaaaacaaacaaacaaaaaaacaaaaaccacauaacccauuagaaugacugccuaaagggugaaugaaaguggaaauggaggaaauggagacagaaaggaauauguauguauuuuuugaaagcaaguaaugggauuuucaaacaccagcgaucauaauauacugucaaaggggcgggguaugaauaacucagccuugugcuccuccagucaaaacaagcaaacauucagccuuuuaugugaugcgucuucugugacuuaaagacagagggguauaaaguaguuucuuagagaaauaaaaaauuuaccugacucuugauccauuauaauuccaguacaaccuuugucuaggagucaguggcuguuugaacuauuuuuuagaauugacaaaucaagauagcuaggauaguggugccuauagaaagcggcaaaaggaaaccaguuugauuguuaauaaaacuaauagugaaaaauauaaguaaagguacauguagcaagaucuuuuccuaagaggucaugccuugaccaccagaaccucucuugaaagggucuguuucuuagccuuucucuccugugguccuaauuucuguuuuuaaucccuuuucuugugggagcuuccgcaucaguuuacagaagcagagacaaucucccuccaacuuucaccuuccuguuuacccuccucaauuuuuacuauuccuguugugugguaagaaagagaagugggaauaugaggguucuguauuacacugcuuuggaguagcaaagcaaauggcucuucacacuguaauucugaacacacuuuuccaugaaauuauuaucaugaauauuaauguaggcuucuauauaaugugccuuauguguuuaagcuaauguagucuggccugggguucuaaacucauaugaaacauuucacuugggucuccagccucagagcuuucaaauuuuggcuguauucacuguaaaauuugccagagaugcgaaaugaagcuuucucaaaaacgaugauucuaaugaagucuucacacaagaauaaaugaagucugaaaguagaugauucaagaagaaggacaaaugaaccaaagauaagacuacucgagaccuaaaacuacuuagguuuuacuggggcugaguuuggcucccuuccccucucuaucucuuguacccuuuugccuuacuaccuucugucaugggaugaugcuguaauaaggccuuuaccagaugauuagcaccuuaauauuggacuucccagccuccagaacuguaaaaaauaauuuuuuucuuuauaaauuacugagucugugguauucuguuauagcaauacaaaaaggccuaagacgaaacauuggugccagacauuggguugcugcuauaacaaauaccugaaaauauggaagcaguuuuggaacuggguaauggcuaaaggcuggaagaaucuggaggagcaggcuaggaagagccuagauugcugugaauggagcauugaggaugauucuggugaggggucaaaaaaaaagaagacaugcaggaaaagaauguaacuucuuagagauuacuuaagugucaugauuagauuguugguagaaauaugaaugcuaaagcccauucugaugagauccuagauggaaaugagaaacaaagcacuggaaacuagaguaaagaccaacauuguuacaagguagcaaagaaauuggcugaauuaucuccaugccugagggcuguagggaaggcugaauuuaagagauaaguacuaggauagcagagauuucuaagcaaaauauugaaggaacuguguggcugcauuaauuuauuuaucuauuuauuuauuuagagacagagucuugcuuugucauccaggcuggagugcaguggugugaucuuggcucacugcagccucugccucccagguucaagcaguucuuguaccucagccucccaaguagcuaggauuacaggugugugccaccacaccuggauaauuuuuguauuuuuaguagagacagcauuuugccauguuugccaggcagccucaaacuccuuaccuuaagugaucugcaugccucagccucccaaagagcugggauuacagguaugagcuaccgugcccagccuuuguggcuacuuuuaacugcauacaguaauauaugagaaaaagagaaaugauuuaaagcuuggauuuacaauuaaaagggaaucagggcaaaaauauuugggaaauucgcagccuggucauauaaagagugaaaaggucuuuaggagagcaaaccaagggugugucccaaguuaccauuucccaaagagacuaccaugaauagaaaggagccaggggcucuuuagucugagugaaguaacucaggaauggaaaaccaaacauuguauguucacagucauaagugggagcuaaacuaugaggaugcaaagguuuaagaauaauacaauggacuuuggggacuucggagaacugguggagguggggugaaagauaaaagacuacauauuggguacaguguacacugcuuggguaauggaugaaccaaaaucucaggaaucacuauuaaagaacuuacuuauacauguaaccaaacaccaccuauuccccccaaaaccuguugaaauuaaaauaaauaaauaaauaaaaggagccaggugcuguuuuucaaaacaaugggcgaaagaccucaaagacauuugagagauuuuugaagcugccucucccaucacuggcccagagcaagaccuugaugcaguuuccagaggggcaccugcaggaccaccacugcucugcacgaccuagggacucugcugcuugaauuucagcacagugucccuuggccaucccauccauggcucaagugggccuaggugcaucucaacccaccacucuggaauguacauaccucauaagccuugguggcauucaugugguguaaauuuugcaggugcacagaaugcaagagcuguggggucaagguggccuccaccuagauuucaaagguuauuaugggcagccuggggguguccaggcaaagacuuguuacagcagcagagccacuauagugagcccccaccagggcaaugccuaguggagccaugggaguugggaagccccgagagcccagaacuauagggcuaccaguaugcaacuucugucugggagagcugcuggcacaagacuccaaccugugagagccgcagcauggccuacgcccagcaaagccauagggaugggcuggccaagaccuugagggcucagccccuaccccugugugcucagaagucaggacauagagucaaggaaaacuauauuagagcuuuaacauuuuauguuguuuuucuuaauggguuuuggacuuccuuaggaccaguuacuguucuuaccuguuuuuccuuuuuguaauggaaacgucuaucaugcuuaucucauugcauuuuggaaacucauagcuggugggaauugccuuagggugaaucaugccuugagucucacccauaucugauuuagaugagacuuuggacuuuggacuuuugaguuggugcuaguaugaguuaauacauuggggcuuauauuagucuguuuucacucuauuauaaagacauacccaagacuggauaauuuauaaagaaaagagguuuaauugacuuauaguucagcauggcugaggaggccuugggaaacuuagaaucauggcggaaggcaaagggaaagcguauuaguucauuuucauguugcuaauaaagacauaccugagacuggguaauuuauaauguaaaagagguuuaauugacucacaguuccacauggcuggaaaggccucauagucaaggcagaaggugaauggggagcaaaguuacuucuuaccugguggcaggcaagagagcuugugcaggggaccucccauuuauaaaaccaucagaucuugugagauuuacucacuaccaugagcacaguaucggggaaauugcccccaugauucaauuaucuccaccuggcccugcccuugacacauggggauuauuacaauucaaaaugagauuuggguugggacacagccaaacuauaucaggaagcaaggcaucuucuucacaaggcagcaggaaggagaacgaaugcagaaggaacuaccaaacacuuaguaauaaucagaucucaugagaacucacucacuaucaugagaacagcauggggaaaaucgccccccugauucaauuaccuccaccuggucugucccuugacacauggggauuguggaggauuagaauucaagaugagauuuuucgguggggacacagcuaaaccauaucaggacuacugagauggaaugaacguauuuugcacaugagaaggacaugaauuuugggggcuggagcaaauacuaggcuuugaaugugacccucaaaaaguaugugcuggaaacuuaauucccaauggaacaguguugggagguggggccuaaugggagguguuuaggucauuaaggcuccaccaucaugaauagccuaacaccaauuauaaaagggcuugaggcugcaaauucagcgucuugcucuuucgcccucuuuugccaucugcugugggaugguguagcaagagggccuucaugagacacuaaagcaccuugauaucagacuucccagccuccagaacugggagaaguaaauuucuuucuuuaauaaauuagcccgucugugguauuuuguuauagcaacacaaaguggacucagauaggggcuccagaaacacccccacaauguguaagguaagacuuauuugggaaaauauucuaucucaccaugguaggcugaauaaugaccuccuuccuccacccugccugccccuccccgccccagacauaucuauguccuaauccuuagaacuugugacuguuaccuuauauggcaaauggagacuuugcagaugugaugaaagaucuuuccauggagacauuauccugggauaucugagaggacccgauaaaaccauaaggguccuuauaacaggauggcaggagauuagagucaguaguagauauggagucagauauggaaugauaaagcaagaacugguagacauacaaggaugaggccaugagcccaggaaugcagaugaccucuagaagcuggaaaaggcaaggaaagggauucuuccuugaagucuccagaaggaauggaucccugcuagcccuuuugguuuuggacucucggcacuguaaaacaauaaauuuuuauuauuuaaagcuacuaaauuugugguaauuugucauagcagccauagguaacuuaaacacauacugacuucaaaugaaucuuuuaaucugucugugauacacuguauuuuuccaaagaugguuuaaaaaugucuuccauuccacauacccuucuacagugucauuuugcuguguccucaucaagagguagaauaaaucccccacccacacccuacccuuugaaucuggguggacccugggaccccuuugaucaacagaauaugauagaaguuauacagugucccauaacugccauggcaguuugcuuucucugucuuagaagcuagcugucaugaaagaagugccacuuuaagaccagcaugcuaagagaaacacccacguggagaacuuugaagcaugaucuaucauauggaaagagagaugccaaagaacuuccaagaugcuccaucuuggaagcaguccccugccccagccauccugguugacuccauuggcagcagagacaaacaacccaaccaaacucugcaaauauuugacccgcaaaucaugagaaaaauacaaugauuacuuaagcuacuaauuuugggggugguuuguuccuuggcaaaagcuaaguaaaacaccaucuuuuuuauaguaagcuggugacugucugaacaaugaaguaauacauauggugucuuuagugccucuuaagaaauauauuuuuggcacuaaguaacuccuaguuacguuaaagucacaaaguauuucaucuuuacaauuccagcuguuauuucuuaguuuccuagcaauaucuaccagguugcuauaucugauuucacaggguuguagugaagaaugaagggaaugaaguaaaccugauuuguaauauagaagcauuauacaaauauuacuguauuaaucucagggcaacaugagaagaauuggaaguagccuauagcaaguagaaacacgaacugauucuauugacuuaauuacauauacuuuauaaaucagacucuggucaguagauuugagggcaacaucuuguuucugcuguggaauuaaaaacauagacuuauaugacaauaaauuucuaugcuaaaucaagguuuuuuucacuucugacuuuaagguucuucuccagagagaagaagcugucacagacuuauuuuuuauguuucuguaucuguugccaucuugcuuguagauuuuuaauuuuucagaaagguagauggaaacauuuaguguugcauuuugaagacugaaucuugugaaucuacaggagcauaaauguccuaccucuugggacaguuccuaccaugaauucagaucaaguaugugugucuacucuaagaagauuauguuuguuuuuauuuucaguuugucuucgcucuuuucaaacuggguuauucacugcugcacgucagucaacuaaugcuuauccugaccuaagaagcugugucaaugguaagcacuucuaccaucaauugaaaaaacaaaacaaaaacucuguagguaaaguacacccaugguaauauaaacuaacguuuaaaaauugagaaaugauccuuugauggguuguaugcccagcaaggaaguauuuucaaacugcauuucuaauacuuguuuauaguuguaaaugcuccuguauuacucaaaaugaauuuuuuugccuaauguuuaaacugaacaguguucucuguuccuaaagguuaucagcuucagaauuuuuauucccaacagcuuuauuuuggcuguuguugcauaaucauguagugugacuaaauguuacaguagauuaauagcucaaaguagagccauguuuauucuucuaacuuuuuggcacugauaauauaaacauggaaaauguuaugugaaucaaauuagcuuucuugcucugaaguucacaaggggccuaaugauaauucugguacauuauuuuugacucuuuuuugguaaauugguaaauuaguaaaagcaaauggugcaaucacaggauauaaauugugauguuuguucagagaauauuuuacauccaggauugaaauucucuagauauucuuuuaacuguguuuuucucuaauuuaaagugcuuguaauuacacagggaguacaguuugucugaauacguauauuuaaugauuuaauucaugcuuuaucuuuucuuaaaauuuacgaaagaacagaauaauaauaauuuugauaaaaauuuucuauuauuuucuaugauuuuaaacuaauaccuaauguauugccacauuucaaaaaaaacgauccuaugaagacuuuuuuaaaaaauuauggaauuaauuaggcguuagcuagguugguuauuuauuuauuuaacaacaaaaauuuucuuuggcuaacauaugcaaagagauagaaauauaggcaguauugggaguauuggaaguauuggaaggaugggaagaacauguacaguugacugggaaguuuagaggcugguguggauaugugcagaaaucaagggacuauugcagugucuaaagaggggacagaaauuacaaauaaaaaacaaauggcaugucauuugccauauugauaaagugcuucgauauuuuaggaagaaaauaaacaaggcacuauaauugaucuuuacuuguacguuuuuuuuuuuuuuuuuuuuuuagacaagcucuugcuuuguugcccaggcuggaguguaauggugcaaucauggcucacugcagccucaaccuccuagguucaagcaauccuccugccucagccgccugaguagcuggaacuauaggcacauaucaucacuccuggcuaauuuauuuuuuauagagauggggucuuggguguguucuccaggcuggucucagacuccuggccucaagcaauccuccuaccugggccucccaaagugcuaggauuacaggcaugaaacaccauuccaggcccuacuuuguacuucuuaauauugcucuuuuucucugguaauauuccuuauucuaaaaucuaucuuauauuaauguugucacucuggcuuucuuuuguuuaguguuuuuaugguuuacuuuuccauccauuaacuuugaacauaccaguguguuuauauuucaagugaguuucuuuugggucaguauacaaaauaaugguuuugaacauuggagaacaggaagcagaacacugugacuccuaaggaaaagaaaauaagcuuacagcuuauguugcuggguccuggauuuucuuugcuucuuccaaacaguguuugauuuuguuguggcauuuagguaacuuauguggaauacauuaaaaacaaaucuuuugagguuugauuuuaagcucuguuaaggcaaucuggaguagccguuagcuuaaaacuaauuuagccucaauaauaaguccuugugaggauuccaccugaugccauuuguacugugaaauauuuuaggucuggguagucuaaaacaaacuaucccuaucccucucugagcucuggaaauuuuccugugcaaaucaucauucagccaaagacccuacgggaucuuuuugcagaucucuggagacucuuucucuuuuccucuaucucucuuucucucucucuuuccauacacacacauuuuuucccucucucugccuuuauaguacucugaccagcagaauucuaauuugaucuccccaaacuccaauauuuguuuucucaacccagggagaccacugggaucuguuuguguuucuugcacuguugcauagaagcuaucuccaggcaguaaugugguccaauuguaggucucagcuuguuuauuuucuuuuccuuaggaauuacgguguucuccuuccuguucuccaauauuugaaaaaccauuauuuuacauaguuagacugaaguucuacuuauuuaaggcaggaagauaaaucuauuccuuguuacaucaucuuaguccaaauugaaaauuuuaauuucuuuuucuuuuuuuuugagagagagccuggcucuaucacaguggcaugaucucagcuuacugcagccucugccucccagguucaagcaauucuugcacuuuagacuccugaguagcugggacuacaggcaugugccaccacgccccgcuaaguuuuguauuuuucguaaagacaggguuucaccuuguugccuaggccucaagugaucugccugccugccuuggucucccaaagugcugggauuacaggugugagccaucacaccuagccucuuuuucucuuaauguugagaauaguauuguucugucuaccucauggaauuguucuaaggcucaaaugagguaauauauuuggaaaaauaucuaaauuacaguuaugaaauacuguauauacuugcaauccagaaguaguguuaugggaucuuugggguguugcuuuucuggcuggaaacuucuguggcugguggugccuuugccugaguucuuguccugcauccaugaagaaugagguaugcagaaaaguggagggugagcaagaugaacaggaacuuuacugagcauuagaacagcucagaggagacccucaguggguagcucaucucuguaggcagguugucccaucaaguguucagcccucagcagagaggagggcuugaagcagguggcuccucucuguagccaggucaucccauugucucugcagcuuucaguagagaggaggccuagaguggguggcuccugucugcagcugguugucccaucagcagcucucagcagaggagggccuggagacagugguucuucucuacagacaggucauucgaugucugcagcucccaguacaugggaggcccuggagaugguagcuccuuucugcagcugguugucuggauaucuguucugcucuggcugagucugggguuuuuauggucuucagagagggaaagugcaugcugacugguccaugggcugccaugggugggcccaggaaaaagcacccaguguucccccaucagucagcaggacugguagcccagcccacaggccucaggccuuccccagccugaaggugggacuucacaggggaccuacccuuuuccaccuaggaagcugucuaccuccugccacuguucauggcacccaggcuguuugugccaagggggugccugcaggccagcacugagcugcccucagcaugccccucagcucccuucccaugcuuguuggagcccaaagacuggaggggacagggugcuggcauguuagcgcugcccugagcuuaugcccacccagcuaggcugcgacaacagcuggcuucagcuccaaccuuguuccaugaccagagugggugccaggagagaggagaggucaggaagcaagagcaggcacuucugagccuguggugggcagaaugggccuccccaggcccucaagaguacagagaugcccagguuuccagccaggcuugggcagcugcagcugcacucaggggacucuugucccaccaguuuggaaggaguggagcucccccuuguccuuggcuuuuaccagcuccauggcacgugcagcccuggccaugccucuaagaucagaguggaugccugcugcggggagaagccuggcagcgggagcaggcccccaagagcacagagacacccggguccggagccacgacaggaaagcugcagcagcauccggggaguguggggcuccuaucugcucuguggagugggaggcccuggcccacauccccacugcagcuggcgucuuggcagcggccacucuacaugggccacugcugccaucuguaguuuauuuuuacaaaauaauuauaaagauuugccuaauaggcucacuuuuuaauuuaggaaaaguauuauuuaaagaaaggaguuguguguuuuuuuuucauugguucuaggcuucaggauuuuuauuauaguacacacaauuuuauuuuuccaugacaugagauaaaaaaaauaaauagaugucuauuuccuucagccauuccagaccaguguaguccucugccaugcaaugaagauggauauaugagcugcaaagauggaaaagcuucuuuuacuugcacuuguaaaccagguuggcaaggagaaaagugugaauuugguacguauaauaacccccgccccccagcucaucaggauuggucuccugaaaaguucucugcagguuauauuacuuuaaaaauaauuuauuuuuuuccuguuuuagacauaaaugaaugcaaagaucccucaaauauaaauggagguugcagucaaauuugugauaauacaccuggaaguuaccacuguuccuguaaaaaugguuuuguuaugcuuucaaauaagaaagauuguaaagguaagagcaggaugguagaauuaaaacacauuuacuaugugagaauaaucccaguuagagaaauuuuacuagcaaauuuuuggaaaaaugauauguaagugcuuauacuaacacauuuuuaucgacauugaagccuugugauacuguggaacugcuuuuuagcuuuuguuuguuuuugagagauagggucucacucugucucccagacuggaguagaguggcuccaucauggcucacuguagccuugaccucccgagcuuaauugauccucugacuucagccucccaaguagcugggacuacaagugcaugccaccaugcccagcuaguuuuguuuuguauuuuuuguagagaugggguuaaucauguugcccaaacugaucuugaacucaagugagccuccugucucagccucccaaaguguuugguuuacagaugggagcucucugccuggccugcauuuuaguuuacaguacugauaacacaauuuuuaaaaauuuucuuauuguaugugcguguacacacuuguguguauguuucaauaaggaauuucauuauaaagugauguuucaaugcaagucuuugcaugcuacaaacuuugcaaaaucauuguuuauccuguuuucagacauuauauuuuuuauucucuucuaguaagauacauagccauagaaagaaauccacugcaauaaccucuuccauuguauuuuauuuuuccuuuucagaaauacuuuucugauuuccaacaucagcccuucaucuggcaccucauuuccuguugugguuuugggaaaguaaaagaucuaguuuucuuucucuuuauaccuuuaagaucauaucauuggucauaacuccuuuuucuucuucagacuuaaauauucccuguuaguuuagcuuucuaacaagucauuuuacuaguguauuuguuuuguuuuucauuguuuuccuaucccuaaauuuugacuuuuuuucucuuuguauacugucuuucaguuuggcuguguuaaugcuaugacuaaaucuucaaguauucauaccagguguauggaugacuaaaaauaaaauuucccaccuggacuuaaaauuugccuuuagaaacuggauacaauauaauauccaaguucucuccuccaguacuuuuuguuugcuuguuuugcuaaaauguuaaaaaaaaaaguaaguuaaaaugugaauuucuuguucgacucuuuauuuuauauauauuuugguaaagcccuaaauuggauucauguucaaaucauccaucucuuacugaauagcaguguuuaguaugauaaaauguacuauaauauuauuuaaacugcaguuaaaugacucuaaagugaacuacauuaacaacaaauucuucuaaacaguuauccaauuugugaucauguaucuuucuuaucugccuauuugaaggucuguuugaguuuggauuuugagacuacuuagaauauauacccaaaggacuauaaaucaugcugcuauaaagacacaugcacacguauguuuauugcggcauuauucacaauagcagagacuuggaaccaacccaaauguccaacaaugauagacuggauuaagaaaauguggcacauauacaccauggaauacuaagcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaucacauggacacaggaaggggaauaucacacucuggggacuguuguaggguggggggagggggaagggauagcauugggagauauaccuaaugcuagaugacgaguuagugggugcagcgugccagcauggcacauguauacauauguaacuaaccugcacaaugugcacauguacccuagaacuuagaguauaauuaaaaaaaaaaagacugucauuaggacaugagugauagaaaaaccaucacaaugcuggauaccauaugcauuuuguaaacaaauaguacccauucuuacuucuacgcuuaaauacuuuaauagucucuuucuaaagaauuuguguuuuuauuguuuuuuuaagauagauaggguuuugcucugucaccuaggcuggagugcaguggaacgaucucaacucaauacagccucaaccuccugggagauccucccaccucagccucccaaguagcugggacuacaggugugcaccaccaugccuggcuaauguuuguagcuuuuguacagagacagauggaguuuugucauacuguccaggcuggucucaaauucuuggguugaagugauccauccacuucaaccucacaaggucgugggauuacaggcaugagccaccacaccuggccaaauuugugacuuuuuaaaaauuaaaaaguauuuaauucuuauccacucaguuaauacacauauauauguguaaaugauuacaaaagugcucuuauuaauaggaauguuccugaugaccacaucuguucuuauauucauuugcauuauuguuuagucaugauauguaaguaauaacguauaaaacagauagaagaauauauaaaaaacuguuacagccaggcacuguggcucaugcuuguaaucccagcacuuugggaggccgagguggguggaucaacaacaggucaggagaucgagaucauccuggcuaacacgcugaaaccccgucucuacuaaaaauacagaaaauuaaccagggugguggcgggugccuguagucccagcuacuccggaggcugaggcaggagaauagcgugaacccgggaggcagagcuugcagugagcugagaucacaacagaucugucucaaaacaaacaaacaaacaaacaaaccaaaaccacaaaaaacacuauuacaaugagaccuuugccaagauguagaaaugguugggauccaguugccaguaacugucuaaagaugaaagaauaaagcuuaacuuuucuuuucuucuucuucuucuuuuuuuuuuuugagacagagucucgcuaugaugcccaggcuggaauguagugugagcucggcucacugcaaccucuguuucccggguucaagugauucuccugccucagccucccgaguagcugggacuacagacgcaugccaccacgccuguccaauuuuguauuuuuugguaaagacgggguuuugccauguugaccaggcuggucuugaacgccugagcucaagugaucugcccaccuuggccuuccaaagugcugggauuacagacaugggccacugugcccagcugaaagaauacaaccuuucagucagacauuagaugucaguuuggagucauaaaaccaauguacuguaacuuaaacuuguaugaucuaaauaauucccugcaauaugccucaaaccaaauacacuuauugacauauuuuuacugauuuuauuuuauuuuauuauuuauuuauuuagugacagggucucccucuguugcccaggauggaguggaguggugcaaucauaguucaaggcaccccagcuucuggguucaagugauccucuugccuuauccuccuuaguaacaagaacacaugccaccacuccuggcuaauuuuuuucucuuuuccuuuuuuguuuuuaauauguagaagugggguuccaccauguugcucaggcuggucucgaacacuuugacccccaaagugcuaggauuacagcacugcugcugugcccggccacuccuggcuaaauuaagaaaaaaaacuuuguagagacagugucccacuguugcucaggcuuacuuuauuucaaaaacauagaguuuuuagcucuuuuuaaaaaucggauauuuuacuuugaauuaauuaaagauucacaugaaguuguaagaaguaauacagagagaugcuauauacccuuuaccccauuuucccuuagugguaagaguuuacaaaaugauaguacaauuucacacucaagacauugacaaugauacagucaaaauauagaaaaauuccuacaagggaacugguuuuauuauuuuugugcaaguuauuuuaaauaauauccuaaauuuugacuauuaaucuggaaaaaaagcugucaacuuuuagaauagaaaacauauuuucuguucugaauuugucuuucuccagagaguacacagaauaguucacuaauaauuccgucuccauugaacuauuucugucacauguuuuguuuucuucacaggugcucaucuaguaacuaauugcuaacaauauguuaucuccuucuucauuuggcaauauaauauaugcaucugaaauuucuggaauauucauuuagcacuaaauucauauuggauuaacugcagauuuauaaguacuuagagaccuuaaucuuauuuuaaauuugaaucacuauugucuacuuuagacaacaauaguaguguacuaauuagauguuuguucauuuccaaagaaacaagauagaagagaugagccuucccauguacaaaaaauacuugugauaauauggagugaaucuguuuucaagaccuccauuuauuuucgcaccacaaccuggcagauaagaaaauuucuaaagcuuucuccuucuuaacauaacuagaaaggaacauggcaaacaucaaucaaauuucccucugcauuuguagaaagaaaucauauuuagugagcuaacauaugaugauagauuuaauguuuuuugguccaaaggccaaucuguuaucucauuacauauauuaaacaagauccaggaaacacaaaucaaggguucuuugguagugucugcugguaugggaaaaauguuuuuuaauauagugauuuuauuuauagauguggaugaaugcucuuugaagccaagcauuuguggcacagcugugugcaagaacaucccaggagauuuugaaugugaaugccccgaaggcuacagauauaaucucaaaucaaagucuugugaagguaggaugauggugguaucauuacugaugguggagagggugggugugaacccugaacugauauuuaaaagcauuggcuuuguuugacaucaacagucauauuuucuuaucccuaauauagcuuguucaauuggguaaucauuggcuuccuuccuuccagagcaagaguauguaaggcauauggucuuuaaguuugguguuaggcacgccaguuggcccuuugagcuaccuaugaauuggagaccuccaugugugguaaaaacaagauaaacauauuuucacaucauuuauaucauauucaaagauaaagagaauuucacuuuggaaggaaaaacaguagauagaaaagaaagacacaagcuuaaaaaucaucuuauugagacaaugagcaugguuaaaacuuuaguuuuuauuccaagcuuuucagugauuuuucugugcauauauaaauaaaucauuuauucuaaaauaaaaaaugacacaguucuauuaucucaugauaaagaaaugauaacaauacucuagaaauuuaagaaauacugaucgguaaugucagagccuguggguuuggggcaaccccuuaaaggugcuguuacuucaugugacugcaguggcgcugcccugugugcaucaggaagcuucaacauauuauaguuguuuguuuguagguuuguuuauuaugauauacagauuaucucauaccuuccuuucgauuuuuuaaaauuuuaaaacagauuuacugccauggcuggaacuaaucaacacuaauuuuucuauuguaucuguauauauauauguauguauguauauucacacacauguauaauguaccuuuuaaaaaauagauuuaggggcuacaaguacaguuuuaauguacucuuuuaaccauuuuuaaauguacaguucaguggcauuaauuacauucaugccauuaugcagccaucacugcuauuuccaaaacuuuuucaucagccccaacagaaacucuuaagcaguaaccauuaagcagugaguuuucuuuuauuaguuaccuugauggcgguaaccucuaaucuuguuuucugucucuaugaaguugccuaaaucaauaauaauuuuacaauauauuuuuuaacuacguaugcugcuuuugagauuuugauguccuaucaucuccuuuugcaaucaccaaaaauauuccccugccagcccccgcaacacauuucuccuuucucaccauugcagauagaaauuaccguggaaaacucuagaugucugcggaauuaucauuagccaacuucaucacuuguauuguaguuuuauuuaaugaaugacauauuuuuuaaaaagauuuauauaugacucuuaucuauaacuuuaauaauaugcaauuuuaauacuaaggauuauuaauuuugggaaucuauuuuaaauuauuuuaugagaacauauucaauaauagcauuuaugagcuuguggaguuuuaaaggucauagggcauauccaaugaaaaugucaaugaucuuauauaacucugagauagauguuugcuucaacauaauauuauaaauuuccaagaaugauuuucucaaaauauggaguagggacagggaccauauagaagauuucauaauaugggagauuacaucacagugagguuuuuuaaaaaaaaaaaaacagauauuucccuaaauucacugccaacauuaauuaucgcauuaugaguguuccaauguucuugauauugucauuuaauuccugauuguaucaaccuucaguuaaaggggucuuuucuucccuucccuucccuaacuuuccuuuccuuuacuuccccaucaugcucucccuuccucuuucccuucucauuucuuuuuucuuuuuuucaaagcaaugaauugugagguaaucucaaugaaauucaaaugaucagaaaugacaguuaaguugagauucucaaucuuuuuuuucuucaaauucaaaaugagaaauuugguagaauuguuauacuuuacuuaaucacugaaaguuauaaauuaauuuuuguuucaaauauguaaauaaaaacuauacuuguaacucguuuaaauuuccauguucaguauuauguuuaaauguaguuugaugucauaguauuucuuucccuaagguucgauuaucauugauuauaucauacuacaaucauaauauuccucugccuauaagauugaacauuuaggggauauuaaaguuugugugcguguguuuuuuuuaccucagauauagaugaaugcucugagaacaugugugcucagcuuugugucaauuacccuggagguuacacuugcuauugugaugggaagaaaggauucaaacuugcccaagaucagaagaguugugagguaaacauuuuacaaugcuuaacuucucaccuguuuucuaaaaugagagauccuagauacuuauuuucacauagcuaagucaggaaaauacagacguucugcaauaauugcuguagcuuuaagcagguuaugagucaugauuauuuacuaauuauggucauguaagucauaaacauuggggauaauuaguggcuggguuuaaaaaaaagaggguagagucacaguuuagagaguacuuaucuguagucuguacauuuauaaaauacaacuuguauguuuacuuaagaaaucaagaaaagcugaguuuaauagcccucauugugaaaaaaaaucucucauagaaacuucagugaaaacauuuuccagugucuacuuuucuggauuccacucugacuaguuugaucaugccuuaggcguuauaggguuuauaaagugcucauaaaauuucagaggguacaagugcaguuuuaauguacccuuuuaaccauuucuaggauuuagugggguuuaaguauaucauaauucagagagguugauuucuuaaucugugucucucaaacuugcuuuuaauuacuuagauuuaaugcauaauugacccaggaauugaauauuggggguaggugcucauuuuuacuucauugaaauaaaugucaccaucugagcucuuuuuuuccugcaucuuuuuuugacaagugaagguaaaauuauauauuauuaugaggcagaccauaaaaaaugccuaaauaaugauuuaacuaaguauacauacauaccucuauagcuguugccaaaacaaagcuguauauguccagaaaaaugucacauucaauaauaugcaaccuacuugguaauaagcuaguuggcauuuguuguaauuuugguacguuacuacuuaauugaaaugccaugcugugugaacaucuauuuuguaauuuaguccuuuauuauuucuguauuugguguaguuacauaucaccgucugccuugaaauagauuuauuaaaguuuuaaggggaaauaaaauguuauuucugggccuauauuuaauauagugcuauguacguaauucuccucaaaauauccucauauguguucaauaauuuguauguuaaaagcuuuucauuuuaauguuuguuuucacucguagaaaaaaaauacuugauaccauaugugaugacuuuaaauaauguucuuguaaauuccuuggagacuaugagaucugaauuuauauuuauuuccuucauguuuuccaguauucccuuuacuaucuagauagcacauucuugcucagaaaacuuuugcuuaauaaaugaaugagugaaugaaugaggugcuguuuauugguacauuaauucuuacaccuauuucugacuucaaauaaaaauaauuuucagacauaauucaugggagauaauauaccugacuguuaauuaaagaaauauauauugguucuugaagaaagaguuuguguuuaggacgaaaauuugcaaaggaaguauuaaagacaaagaucgaaagccaugcacauugaacgaggcuuuaaaacacauguauucuuggagguuauacugauagauagacuauacaaggaaauggaagauauguauuuauuauuaccaaaaauauucuuaauuauuuuaguguauuacagaugauacauuaguaaccaaacaaaaaugcaugaccucacacaaacauuaagcaauaaccugugcauuuugauuuucuuguuguuuauuugguuucuuuuauuccagguuguuucagugugccuucccuugaaccuugacacaaaguaugaauuacuuuacuuggcggagcaguuugcagggguuguuuuauauuuaaaauuucguuugccagaaaucagcaggugaggaaccaauaccaaugauaauuucuagagguuaagcagauaagggcagaagaaaaguggccgaaaagguuugaagugugugaaauuguauuaccuaucagauaauguagucauauuaccaaucagaugacuuggggaaaccuaaaguuaauuuacuccuucacacauguaauuuucauccuaaaaccuuuuugagucauucuaggcugacuuuccccaaugaacauuuuacauuauuccauauuauuccuuuuguagaaaaugcauauuuacuaagaagcugggaaaguagauuuaauguacuugugaaauuuccauuauucuuuacacauguuaugaaaaccagguaauaaaaaauacucaguauugcuuuuagaauaucauuauauucaaaauuauuaaggaaaaaauuuaaacuugcuuaaguggcauuuuaaagacauauauuacauaauuuuaguuggcugucuaaauacuuuauccauuauuaucguacuuagauugaguucagaaaugaaguaaaugcuuauguuuuuuagucaugauuccacuuauuuuuauagcaauguuuaugauccaauuuuuauuuuauuauauuuauuuauuuuugagacagagucuugcuuuguuccccaggcuggagugcaguggcgcaaucucggcucacugcaaccuucgccucccaggucaagcaauucuccugcuucagccuucugaguagcuaggacuacaggugugagcugccacacccagcuaauuuuuguauuuuuaguagagacagaguuuuaccacguugcccaggguugucucaaacuccugaccucaggugaucaccucaggugaucugccauaauuguacuucaguuaucagauuuucucagaagcauacauugcuggaaguagaagaaagaaauuggauuuuuuuuggaauaaugagaaggcaaaauacuugagacagauuauacaguucaaauuuuaaaauauuuuaauuaaauaagcauguauguuuagaacuugauguuagauacaugaaugauuauucauuaaauaauucaacuaaauucauagacguuauuaaaaacauugaaaauuauucuaagaucaauaacuuacauaaauacuuaaguaacagugcuccuuccacacuuuauuucugccaauaugugguuuuuuccuuuaacaucacagagcaacuaauaucuucuaaugauagagauuggagaaaacucuucccugcuaugagaauaauaaugagagaaaaauauuaguucuaguaaauaacacuuuuaggaauacaauugauccuccaaauccuugaguuccucaucuguggauuuaaccaaccucggguagauaauauucagaaaaaaacacaaugacaauacaauacaaaauaauacaaaugagacacaauacaguaugacaacuauuuacauacauuugcauuguauugaguauuauacauaauguagagacgacuuaaaguacgugagaggaugugcauagguuauaugcaaauacuaugccauucuauauaagggacuugagcaucuguggauauugauaccauccagagguccuggagccaaucuccaggaguuuguucauuucucacugacgauucauaguaguuugaucucuaacaugggaucagaauuggacaaauuauuuuuuccagaauuuauuauuuauuuauuuuaaacuuuucauugaaauauaaaguauguaccgauauguacacauuagauuaaauguauagcuugaugaauuuuuauaaacugccccuugugugaucaacacaaagaauagcuagugcuuuuauuuauuuuugcaaauuucuugacgucuguugcucaugaucaaauacuuucccuccguaaaugucaacaaauucauucuauuuuccuguuuaccaugcuugugaaaaagaaugaauuguuccccauuguaaugaaucaauaugcugcugauauauuccagaaacaaaauaugcagaacaugacccuuugaaacuaugauuucagccugauuuuacaaagaaaaggaaauuaucuccauaauagaaucaacugcuggaagauccugagcauacacagauuuggauuuuggcaagauaauauugcuucacaucagcaaaaugcucagauaauuaugaaagagcauagaaguccuuauuccaagcaaaauuguucuuuuuuucauaaucugaguucaguaaauuccuacuacauuguuauccauccaacauacuuuacuccacauuuuaccucuuuuuaaauauuucuuuggaauucuaaagaugaaaacauucauuuugucaccuuuucuuuguuccauuugagggagauacgugccccauugcaaauggugccucuauuacuauuacuauuuuacuauauugcgguaagagugugggauucuguccugccuaauauagcaauuaucugaaguccagacucuuuaacuuaaauugccuuuauuuuaaguuaggugacuaauaguuauacaccuauuguuccuuuucccuguuugucuuucgucaaucauguggauuugcuagucccuuggaaacuucaaugcugauucucauugaaguguuuuaaggauacugaaucaacacauguuauuuuaaguccugcauccuaagacuuuucuccccuguaauagcuacauauaugucuagagucuuaauagcaacagauguugccagcacucagauaccccccaaacacauggguagacuaugucuuuuaaguuuuccuucuguguauucuacaacagugacuuaugcaacuggaguuuuaggaaagcuaauagauauauuuuaaguuuuuaaauuuuaccuuucuuaccacacaugaaggcuuaaugaugucugcagucauccaugugccaucuuguagaucuccacgagugauuccugacaugugaaauuauagggaaaauaugccuuuugaugaauaaaccaacgaugaaauuguaacacauuuuaugaucacuuauggauacagcaaaaacaaaaacaaacaaaaaagaacaacaacaaaaaaaacuaccacuucuuaaugucagauuauauaguguauaaaaggcuccaggagagauauaguaugccugauacuuauaccuguguauuaauuucagcauuuggaaggugcuaucaaaauauaugucaaagaaagaugacaaauuaccaaagcaucuguucccuggggaaaagauuccaagaauaagcaagaaaauauaauaacuuaauuuuaaacguacauggaaccagagauaauacaugagcagucuaauucugcccuucucuuuuauuaauuccagaaaaagaaauaaauaauugacucuuugucuguguuacuguuugucaguacaagaaaaaaagaauaaugcauugagcuuucuguauuucuuacucuuaaggaucucucuuuguccauuguuuagauuuucagcagaauuugauuuccggacauaugauucagaaggcgugauacuguacgcagaaucuaucgaucacucagcguggcuccugauugcacuucgugguggaaagauugaaguucagcuuaagaaugaacauacauccaaaaucacaacuggaggugauguuauuaauaauggucuauggaauaugguacguuugcagauuucaucaauaucuucccacuuugaugcagucuguauaaaaucauaauuuauuuuuauagugauaccaaaccaaaauggauuuggaguuaucugaugcuauaugagguauauucuacauacuguaaaucccugaagcauccugagaaauaauauucucacuuaauauauuagaaucauuguuuuuaguuauuugcuugaacuacucugucuuuaacuuuuuaccuuuuuuaguugcuguuuggugaacagugguguuagggacuauuaggaggccuaacauuuuuuuuuuuuuuugagacagaguuuugcucuuguugcccaggcuggagugcaguggcgugaucucagcucacugcaaccuccaccucccagguucaagugauucuccuguuuuggccucucgaguagcugggauuacaggcaugcgccaccaugcccggcuaauuuuguguuuuuaguagagacgggguuucuccguguugguccagcuggucucgaacuccagaccucaggugauccacuugccuuggccucccaaaguccugggauuacagaugugagccaccgcggcuagcauauuuuuuuuuuuugagacagucucacucugucugcccaggcuggagugccguggcauggucuugccucacugcaaccuccaccuacuagguucaagagauucuugugccucacccuccugaguagcugggauuacaggugugcaacagcauaccuggcuaauuuuuguaauuuuaguagagacagguuuucaccauguuggcaaggcuggucucaaacuccugggcucaagcuauucacccacuucggccucccaaagugcugggauuacaagagugagcaaccacacccggcuggcauaacaauuuaugcaaagacaacacugaucaaggaaaacuccucaauugccaacaauauuuuuuaaaguaaggagaaauaaacauaguaacaagucuaaaaagguaauucaaauucaaauauaagcagauagauaaguaauccuuaaaaaaaaauagacacagggucuugcuauguugcccaggcuggucuugaacucaaggaauccuccucccacuuuggcuucccaaagugcugggauuacaggcaugagccauuguaccggaccuaguugucaguuuuugugcaaaugauauacauuagcagguaccagugugcuuagaaaucagcauuuuaggcugggcgcaguggcucaugccuguaaucccagcucuuuaggaggccaaggcagguggaucaccugagaucaggaguucgagagcagccugaccaacauggcgaaaccccaucucuauuaaaaauacaaaaauuagucaggcuugguggcgcacgccugcaaucccagcaggagaaucauuuaaacccaggaggcggagguugcagugagccgagaucacgccacugcacuccagccugggugacaaagcaagacugucucaaaaauaaaaagaaagaaagaaagaaaagaaauuagcauuuuaauuuaauccuacauauagccuuuaaucuaaugaucaagaauagcacuuuaaucaacuggauuaaagugggacuuuucugaagggauuacugcuaguugauaguggggagaagucuuuucugaaguauagagucauugcugccaucagcagaggauagcugagagaagauuggcuucaccuuagaauguggugcacaaaagagacaucuuuuaugccuagaggagcuggcaagaaguuugugcugaucucaauuuauuuauuuauguuauuuauuuauuuaucaucacuauuauuacuauuauuuugagacggagucuugcucugucacccaggcuggagugcagugaucucugcucacugcaacuucuaccuccuggguucaggugauucucuugucucagccucucgaguagcugggacuaucagugccugacaccaugcccagguaguuuuuguauuuuuaguagagacagguuucaccauguuggccaggcugguccugaacuucagaccucaggugaucaauucuccucagccucccaaagugcagggauuacaggugugagccacugcacccagacaagaaguuuguauugagaagucaugugaggucaucacuaaauuauuuugguccuucauuuaugcagacaugcacucauuuauucaguaagcuuuuagugagugcuuuugaugcuaaguuccugaguucaaggcauuagaacuauagcauaucggggaaaccugcccccaauauuucauuguagggucuuucuauuuuccauaagugucggcuggcugagaaauaaagagaaagaguacaaagagagaaauuuuacagcugggccuccaggggugacaucacauaucgauaggacugugaugcccaccugagccacaaaaccagcaaguuuuuauuaaggauuucaaaaggggagaggguguaagaacagggaguaggucacaaagaucacaugcuucaaagugcaaaaaggagaccaaagaucacaugcuucugaggaaacaggacaagggcaaaaucagaaacuacugauaaagaguccaacaaagaccacaagccaaagggcaaaagcagaauuauugauaagggucuauguucagcggugcacguauugucuugauaaacaucuuaaacaacagaaaacagguuuugagagcagagaacuggucugaccucaaauuuaccagggugggguuuuuuccccacccuaauaagccugaggguacugcaggagacccgggcguauuucaguccuuaucccaacugcauaagacagacacugccagagcggccauuuauagaccuccucccaggaaugcauuccuuccccaggguauuaauuauuaauauucuuugcuaggaaaagaauuuagcaauaucuucccuacuugcagguccguuuguaggcucucugcaagaagaaaaauauggcucuauuuugcccgacccugcacgcagucagaccuuaugguugucuucccuuguucccuaaaaucgcuguuauucuguucuuuuucaaggugcacugauuucauauuguuaaacacacauguuuuacaaucaauuuguacaguuaacacaguugugauccugaggugauguagauccucagcuuaugaagauaacaggauuaagagauuaaaguaagacagguguaagaaauuaugaguauuauuugaaaacuaauaaauguccaugaaaucuucacaauuuauguuccucugcuguggcuccauccagucccuccauucggggucccugacuucccgcaacaauagcaagagauuuuccuugcucuagagcuuaguaccucacagauaaguagcugaugcuucuuugggaaauaauauaauguaacaugaaauacauuacauuagagguacaaacaaagcacacuugggcaaacguggugaauuuauaaaugauuacaucuuaucuuugauuaugagucuaauauuaauaggaauuuuaauuguaaauguaucauaauucauucagcaaaauauuuauuggcacuucuaugugcuaauccuuauucuaggugguaaagauacaacagcaaauaaaaaaaagucagugcucuuauggagcuugcguucuaauggugagacgcaaacaacaaaugcaugaaaaaauaaauaugccagauaguuauucauguuauaaggaaaaagaaaagccagacaaagacauagagaguaauggugguuaguaugcauauagaaucaggaaaggcaucucugaugagauuagaucugagcugagacuugagagcacaugucaugagaaauaaaugagggaauauaaaaagauucuguaccauguaaacagcaaguacagaauuucuuggaauaggauguguuugguauuugaggaauaacacagaguaguguagcagcaggggagaguaguuagaaaaugagguuagaaacguggucuagaauaagaucaucuagggccuuggaggccaugaugaggauguggauuuuaugcuaaauugaaaggcccuggaugguuuugagaagggacaugaucuaguuugcauuuuaaaagauaaucccaaucagaagcuaauggcuuuguggaaaccagaaguggagaaugaguguauaacaggauauggggauauggaguuaggagacuguuggaauaacccagcggagagaagaugacaguuugacuggugugcugaugguaagagugguaagaaguggucagauucuggauauauuuuugaaguuaagccuucaauuaaaauuuuugaauacucagcauaaagagggguuuuaaggccaugaaacuguuuguguugaccagugguuccaaacacuaucucauccaaugucugaaaauauauaaugcuccuuuacuauucuauaaugaaauguaucaguaauauaaacuaccuucacauauacccaaucaaaaccaaaauaauucugucauuauuauauuaauauggauaaauaaaaggaaaguaauuuauaagaaaauaauauguauuucaauauauacguagucaacuauaacuauaacacuugucaaagcuugcuucuaugcauaaaguaaaagcuacaaaugaagacuaaugcugggguguuaaauuagcaacucaaguaccauuaagggcauacaugguguugccauugguaauauuaauuuuccaaaguggugggaaguuccugguaaagauaugaacaaaacaaauaucaaucuauccuuaguugucaagauuauuacauucuugaaaaauguaaugaaugcuaaaauagugcagcaaauauuuugugucuauguaugcacaaacucagaugauuguaagcaugaauauucccuacaugaauaccuagcagugauguucaaaagauuuuaagaauacuugauauuuuauuauuaguucugcauuacuuauuauuauuaauucugcaugacuagccuauguacauaaugcagauugucuaucaucuugcagugccagcauggccccuacucauugugacaaauaaaaguguuccucaccuccaaauuuuccaaaugcccuggaguggagucauagugucucacuuaaaauacuugcauggcuacaggaaaaaggucuggggccugagcuguggggaggggaggauccagcaaaggagacugagaaguagugguuagaguguagaaagagaagcaaucagggucaaguguuguaggcuaaguuaagaaagucuguaaaggagagaauaguuguucacaugcugcuaauuggcuauauuaaagaaggaguguugaccaacuuuaaauuuguguaacuaaauuuauuuuauguuggaggauaguuuuucccuuccuaucaugguguuuuaauaugcuuauuguuuggcuuauauuauugguuagugagugaagaguuugcucuuugagugcuauaguuuuacuugaagugauugcagcagugguucuucaaauugccuuuguagaaggaauuuuuauuguuguuuacccuuacuugaaaccuuuuuuaaaaacccaaacaacucucaaaauuggaaaacuccaauuuaauuuuauguauuuuuuucuuauugccucaaucacuuuugaauuuuaaagaaaaaauaauuugugugcaauuaacagaauagugaacauauugauuuuucuuacuuuauauuaagaacuuaugggccgggcgcgguggcucacgccuguaaucccagcacuuugggaggccaaggcggguggaucaugaggucaggagaucgagaccauccuggcuaacaaggugaaaccccgucucuacuaaaaauacaaaaaauuagccgggcgcaguggcgggcgccuguagucccagcuacucgggaggcugaggcaggagaauggcgugaacccgggaagcggagcuugcagugagccgagauugcgccacugcaguccgcagucuggccugggcgacagagcgagacuccgucucaaaaaaaaaaaaaaaaaaagaacuuauuuacacuauugauuccaugugcguauuaucagacaauugcaaaauaaggccacuuaaauuuuuccuaagauagaauggcucacuuaauuguuaauuuucuagcagccuggaauugaaagauauauaacuggauguuuaagcuuaacagaauaguauuuuuuuuaacuuuaaaauaugguaugcuuuuaauuuuugaucgugcugccacccuaaaugccuuuuuaucacauuuaucauaauuugacauuccaaaugaguuguaacaaauuaauaauuacauuaaaaugauuacuuuacagaaguauuuuauuggaauaauaacauaaguuuuagaucccaguauuucaaaugacauguaguaauacuugguuauuugguaauuuuucuuuuuaauuguaggugucuguggaagaauuagaacauaguauuagcauuaaaauagcuaaagaagcugugauggauauaaauaaaccuggaccccuuuuuaagccggaaaauggauugcuggaaaccaaaguauacuuugcaggauucccucggaaaguggaaagugaacucauuaaaccgguaaugauccaagcuuguaucauucaucauggaugaguuccuuuugucuguaauagauuugaauauguguguuucugagaaucaauagaaguuguuuuguuaagcauacuaagugugacaacuugaaaugaucauggaaaaauaacauuaguaacccuugaaauuauauuaaugaaauaaaaaaaugacguagugguuuugugcccauuuaaauccccagcauaaaucaugaaguggauuucuaaaauucucaaguuaacacuugagaauguuaacacuaauguuaacauuaguaauguaauguucaguguuaacaucaugauaauccauacucaguuguuaaacauauaaauucauauauuuaaguccaaaauuacaccauuuuguaaaagccagucaaaggacuuucucaagucuauuuuuaggacuuaaaugcaagagcuaaagaauagcacauaaggugaaauuuauuguuaaauauuuacuaucuuacauccgucuuucauucucuggaaauucguaguuacuuuaacuuuuaaaagauuuccauuauaugauauuaagcuugaauuaauuaacccauguugacaugaguauaccuguuguuugaaacugagaaauuaauacacuuuaaaaguaaaauaaauuauucaaaaaguaucaaucauuuaugaaacgguuauuacaugucuugagccuggcaggauacuugauggaggcuaaagaaugcaaacacuuuugugucugaagagacuuagagucugauuggcaagacaaacccauauuauaaaugccacuaaagaaaaacaaggccaggcguggugguucacaccuguaaucccagcaauuugggaggccgaggcggguggaucaccugaggucaggaguucaagaccagccuggccaauguagcaaaaccccaucucuacuaaaaguacaaaaauuagccaggcgugguggugggcaccuguaaucccagcuacucaggaggcugaggcaggagaaucgcuugaaccagggaggcagagguugcagugagccaagauccugccacugcacuccagcaagacuccaucucaaucaaacaaacaaagaagauaaacaagacaacuuagagcccagggccacagcuagaagcaaauauagaacuugaaagcagaaaaguuaccacuggaugauguaggagaggcagguggggcuugaaguguuaaaaaccauuaagaucccacugagggcuugugauaguaugagcuugcuuguacugaaaaagacuguccaucugaagaauacuuugaaaagaaaaacuuaaauaaaauucaaaauauuuucaacuauuaucaaagaaaggauuuuuuuucucuuaaugaaaaccuauacucauaaucgagccacuguuuaaguuuaaaaugcacuccuugacuuguauuuuaauuuguuagauuaacccucgucuagauggauguauacgaagcuggaauuugaugaagcaaggagcuucuggaauaaaggaaauuauucaagaaaaacaaaauaagcauugccugguuacuguggagaagggcuccuacuauccugguucuggaauugcucaauuucacauagauuauaguaagugauuuuccauuuaucucuauuuucucauuaaugaguaaauuuauucauuaacaaacaguaauaauuuauuugugaaacauuauugaguaucuacugugugcccacucuagucuuaugcuuauucauacuauuauauaccuuuuacaaaaauuuuucaguguauugggaaaaauauaaaggcauuugaaugugcuuguguuguuauuucagguuuaucaguacauagccugauuccuuauggguaaauucaauugaccuauuuuaaaguucacugauuucucacuuguauggagucuaucaaugaaugcaucagaaagauucaucuucauuucuagcauuucuauuugaugcuuucuuaaaauuucuaccucccuguugaaauucccuaucuguucacacuugucuaguuuauguacugaguuuucaauguauucaucauaauuauuuuaaauucccugucucguaguuccaacugugucauaucugagucucgucauuuuguuugcuuugucccuugaccaaguguuguuuuucuugcaucuuuguguaccauguaauuuuugguuuagauuugggcaucuuacguauaacaguagagacugagauaaagaauauuugugucuggaaaugagcacauuucuuuugcuaggcucuuaguaaugggauugaaucaaucuagugaaaaguugagcuucuuaaguuuuguuggugccaggauuacccuuaaugcaccacagguuucagaucuuuuauuuuguuuuguuuuguuuuugagauggagucucacuuugucacccaggcuggggugcagugaugcaaucuuggcucacugcaaccucugccaccuggauucaagugauucuucugccucagccuccugaguagcuagaacuacaggcgcccgccaccacgcccggcuaauuuuuguauuuuuguguuuuuggccaggcugguuuugaacugcugaucucaugauccacccccuuggccucccaaagugcugggauuacaggugugagccaccgcacccagccucagauuuucaaaauacuaccuucugcuuagaauaagggaaugguuugguagcuaguuuuucuuuuucuuuucuuucuuuuuuucuuuuuuuuugagacugagucucacucugucacccaggcuggagcucagugccacaaucucggcucaccgcaaccuccaccuugcagguucaagugauucucaugccucagccuccugaguagcuggaauuacaagggugcgccaccaugcccugcuaauuuuuguauuuuugacgagguuuugccauguuggccaggcugguuucaaacuccugacuucaggugaucugcuugccuuagccucucuaagugcugggauuacaggcuugagccaccgugccuggccuagagaguuuuucaucauagcagcucaguuuuauguauucccuccauaauacgccucaagaaaaugucucucccacuugugucucucaagugucuugcccaccccuagcagagugcucuuguuaccugacauuugcuaacauggcagagaagaugcggagguuggggaagcauucuauguuguugucguacaaauucagucuuaggcagguguuguaucccugggucucaggaguguggaauuuucacuguuccucuucccugacucucaucaguaggggagaugucuagugaucaggacucaauauguuuucuugcuccuucugcaugauagauagcuuuuuuuguuuguucuuccuaaucuguaguugcaaugagucuucauauguguccuaaugacaagguuugcugccuuucuccuggcuugaaaacuuguguuguguagaggagaccgagaaggaucuagauggggcuuuguggcuucccuguagcuggugcugcuuucaggaccauauuaagagagaggcuuuuucggaucuccuucccugcacucuguuuucucuugagugcaugguaaggucuguggagaagagccugugaaugagcaugaauugucuuugugucuguaauuucuagggcuucuaaacucuuacgucagccccuacauggaguucagcaauuuguuuaaaucuuuaccuaaauuauuuuuaccaaauugcauggcauuuccugucugcccuggauuagaaaguguucucauucuggcuuuccuuggaaacaccugucuuucuuuagguuucugguuaguuuguugcucugcgaccucagcucuuugauaguuucaagaaaagucaugauuaugcagauaauuuggcuuuuguuguuguaagggugggaguggugcccuuuccacuuuucuacagccuaaguggagcagggaaucuugccauacugacccuagguuuuuaaccuuagaaguaauacuucugugaacauccuaaaucauacauccuucuaccuuuaugugauuaauucuauggaagaaaauuuuagaauuagguuaucucuaucaaagguuaugcaaauauauaauuauuagagguucaauuacauucuuuuccaaaaaucuuuuaucaauuaauauuucuaccaacagaaugagaaaguguaugcuuuaguuuuuuuccaaucugauaguucaaaaauuaaauuuuguagguuugaauauuaauauuauuucucuaauuucuacugaacuugaauauccucccauauguuuauuagcuauuuauaaauucuaauuauuuuauugaauucuuugucuuuuucuuuuuuaguaguucauuauuugagcuacuaacacuuugcauuauaaauuguuaacacuaaugugauaucucugcuuuaagaaaaaaauuacauuuuaauuguguuuauuuguaaccuaaaaagggcgagguaagguggcucacacuuauaaucccagcacuuuaggaggcugaggcgggcagaucccaaagagcuagagcccaagaguucaagaccagccuuggcaacauggugaaacccuaucuucacaaaaaauacaaaaauuagccaagccugauggcaugcaccuguagucccagcuacucaggaggcugaggugugaggauggcuugagcccaauauguugacacagcagagagccaggaucuuaucacugcacuccagccuggaugacagagugugagcaugucucacaaaaaaaaaaaaaaaaaaagugcuuacuacauuaaaauacauuuuuaaauuuuuauguaauuaggagguacaagugcagauuucuuacaugcauauauugugauauauuguguaguggugaaaucugggcuuuugguguacacaucacccaaauagugaacaugauacccaauugguaauuuuucaaccccuacccuccucccacccucccaucuuucguagucuauauuuacuacauuuguuuguuuguuuuugagacagggucucucucugucauccaggcuggagugcaguggugcaaucauggcucacuguaaccuagaccuucugggcucaagcaauccuccugccucagccucccaaguagcuaggacuacagccacaugccaccaugccuugcuaauuuuuauguuuugcagagacagggucuucccguguugcccaggucaguuuucaaauuccuuaacucaagugauacuccugccucagccucccagugcugguguuacaggcaugagccacugugcccagccuuuuuuacuguauuuuuaaggacaaauuuuacaaaaaugauuucccuuuuucuaacacaaauugauacaaugccuaguucuguucugccuaugaaagauuuuuuuaaaguuauaaauggggugaggauuaaauuaggauaaaacuaaauccauggugauuuggccaaaggaaaaaaauccugaaaagguaaugaaaauaagaguuauauuguaucuaaaaaaauuacuuuaauaaguaauuaaucauuucauggauaauuuguaagugaucuacuuuguaauuaauauuuaauguuacauuuuaacuucuauacauucguguguucauuuuaguuugaguuuaauauucuguguuaaauuuacuuauuucaagauaaauguuuaggugauagaaauuccaauuacccugauuugagcauuacacauuguaugcauuuaucaaaugacauauguaccccaaaauaugugcaauuaugauauaucaauuaaaaauuacuuauuucacaaugauuacauauaaacauucuuuuuuuuuuggagacagagucucacucuuuuucccaggcuggagugcaguggcgugaucucagcucacugcaaccucugccuccugaguucaagcgauucuccugaaucaagccucccgaguuguagcugggacuacagguauacaccaccaugcucggcuaauuuuuuguauuuuuuuuucaguagagauguuucaccauguugcccaggcuggucucgaacuccugagcucaggcaauuccaaagugcuaggauuacaggcaugugccaccguacccggucuauauauuuuuuuucuucuggaugggaguuacaggauuauaaugaaaaacagugacauuauauguggcuaaguggaagaacaucuugucaaaggaaaaugauuuuccuuauucacauuuacccuuucaagggcuccgugugguauuugggcuuugcuguauguuacaucauauuaaaugaggaagacuucauucagauuaugaacuaauauuuuuaguaauccaacuauucuggaaacauauuaauucaacaaauaucuauugagugagugcuggggaaaacaaagcaaugauagagauauauaccuccuagagcuugcauguuagugggauagacaauuaaccuaguaauuaagaaagagaaugugaaggauuaugacaagagauucacaaaacaaggguuccuauucugauuucaaaacuaacugcugaugucaguguauuucucuaguaucgaacuauccaacucuccuauguauauagaucauauuuauccuuuggagugaugauggcaacuguacccagauuuucccuaaauuauuacaguaaauuuguugaauuuucaaacgugugcuuggaaauaugaccacucugagauuugagcauuggugaaugugcaagggagaaggaagcacuguuaaagagcaaacugggaaaauccaugauaauccuuaacaccacaauccagaauucucuucuaggaagaacgggaagaugguacuccauuugcauguuucuugccugcauuacaaaaaaguuuguuuuguuuugccuagguuauauagaucauugagaaagggaauggaaauaguauuacacaagauaguuuugaauauuaccuggacuguguuaauaauaauuccuucugaugcacuuuaggagugcauugaucaugcuucuguuucauuauuuuaaauagauaauguauccagugcugaggguuggcauguaaaugugaccuugaauauucguccauccacgggcacugguguuaugcuugccuugguuucugguaacaacacagugcccuuugcuguguccuugguggacuccaccucugaaaaaucacagguaacuuaacucuaaaccuauauaagccuuguuuuucuuuucauuuuuuaaaauguauacauagcaguauuuaccucaaaggacuauuuugaagauuaaauaaaguaacuuauguaaaguguuuggcacaaucuccagcacaucauuaaggacucaaaaaaugucuauuauuguuacuuuuuuucuggcuuguuuccaaggucugaaugaagaaguaaggggagggaggaaugaaaaaccuacugcaucuauaccuaagauuaggcagacucucacacaggcugcuuggagccauccgaguacauagagauccacccuuauuaagaauacuuuauguguugugggaauuagucuguacugucaacauagaagugagucuaauuacagugcacugucagauauucagugcuuaauuauaauguuuuguucuuucuuacacucuuaaucuuuucucccaagaguaaguuaggaaaaaagagagaaaguuaaaacugguccacuugguuucuuacuggcaacucuuauuugaaauuaggaggaagaacacgaaaaagccuuagaugaaaggaaauaugaggguuaucagaaaaucuguauuauucagacuucuauuagagcauagucguucugucuaugugucauccacagugcauucuaacaaguuacagcaagaagcugauguuuaugccaaggcugacuuggaugcuuucaguagauuuuagaaagagaccugugguugaauaaugucuauuguaguaaaacaaguuaugcuguuugcaacuuaaaguaugauucagggaggaggaugggaaguuucuggugguuaaccauaaguaaccuaaaaauauccugaugaguuuuuuuuuguuuuuguuuuuguuuuaaucuccugccuuuaaggagcuuucuacauuuggauuucagggguuuuuuguuugcuaguuuguuuuucuuuuuaaacaaaauggaauucuuaucuuaaacacuacauucaugcaguggaggagguuaacgcaugccaugucuuugauauuuaauuuauccuuugaguguuugccuccgugguucuuucuuugcaugucagauuuccuucucaaggucuaugcaauauuucauaacauuauuccagauaucauugaucauuuuggagcauuuucuuuauugacaaucucuuuuaaugaguuuaaggauacggacauguacaacacaauaacagauuuccucaaguaaccuauauuugcaaaguuagucuuuucacuuaaaauagguaucuuggauuccuaaauaaacauuucugauuauguuuuuaucacuuuccucuaugccauauaagcuauaugaagagaucacacucaacacauugaguaauuuaggcauaacggcaguuugaaagguucagcagaaugaacacauuuucuuucuguagaaucuucugguaaauguucuauaacgugcugguggcaaucccugguuuuucuuucucagggccucuucauuuauuuuaucccaagucuguaggauugcuuguguggcacaaagaaaccuguuaguccugcuggcauaugcuuacuaaagcauuuuaaauuucccaagucuuuucucaacaaagagugauucaacuccuucccuuuucauauguaaacuuggaaauuaggaaggcucauaaacagaaagauauaagacacuccuauagguuccgguuguuuuacggaauuuucagaaaccaguauacauuuauauuuuagcuaaacuuugaguuuguaaaacuaauguguauuuuaaauuuuagucauaauuauuauaaauuagucuuauaauaauuagugauuuuucccuuaaauuuagaggcucuaucauacauuuucuuuccuuauugaaauuuaguuuuugacuuucaaaaacucaaaagucacucuuaagcagcauuacucuuacuccuugcuuauauugaaucuuugcucugcucuucaggauauucuguuaucuguugaaaauacuguaauauaucggauacaggcccuaagucuauguuccgaucaacaaucucaucuggaauuuagagucaacagaaacaaucuggaguugucgacaccacuuaaaauagaaaccaucucccaugaagaccuucaaagacaacuugccgucuuggacaaagcaaugaaagcaaaaguggccacauaccuggguggccuuccagguaucugcuuacuuuuucuucaguuuuaaaaaguauauuuuaaucaaaccgauaauauuuuaaauauauaauuauaguaaaaaagcaucagaagggaacauaaaauccaguauucauuauucuuuuucuaggggcuaguaccgacauuuuauuggcauauuuuuguuuuguuuuguuuaguuuaaaaauguugaacuaaggcugaucaaguuuugcuucauuuggcuaucccagccagaaaggauauguuauuuuauuucaucaucacaauagucuuauaaguucaauauuuguucuaauuuacccaauauuuauucaucuauuauucaguucaucuuaucauuuauccagcuuuuuuuuuuuuuuuuuuuuuuuuugagauggagucuggcucugucgcccaggcuggagugcaguggcacgaucucggcucacugcaagcuccgccuccuggguucacgccauucuccugccucaaccucccgaguagcugggacuacaggugcccgccaccacacccggcuaaucuuuuuguauuuuuaguagagaggggguuucaccguguuaaccaggauggucuugaucuccugaccuugcgauccgcucgccucggccucccaaagugcugggauuacaggcgugagcagugacaauaguuguaguaucuaacuaccaucaacuauugcaaaacaaacagucugggcacuguuuaacgugcuucaaauauauccacuuguuuaauuuucaaaauaguccagugagguaagugcuauuauuauccccauuuuacagaugaggaaacugaggaagcugcaggaccagggugauaacaaugaagaugauggacaguaaauagaucggagauauguguuagaaacaaaauuaauaggauuuaauaacugaaagacagguauaaggaugacuuuuagguaucuggcaugagcaguugcauggauggagauuccauuuaccaagauggggaaaacuggaggaaaaacagauucaucuuuaacugaauauuggaaaauaugaaauuggcaccaauauuucacuuuaaauggaaaauuagaggcagaaaguuauuuagaagcauuuucagaugacauuugcaauuuauucucauggggagaauucugaguuugaugucuggaccucugauaaccuucaauauacugcuuaaacugcucauggucuugauuucccauauauggaaauuguaucugggguuuugggaaauagaaguaaauaggcuuuaaaagcuauagaaagacagacagauagauagaugauagauagauagauagauagauagauagauagauagauagauagauagauagagguaaguagugagcaugccuaauuauuagggaguaaaauuauaguuuaaaugaauaaauucuauauugaaaucuaccuacuaccuuauccacaaguuaguugaaugcaauuuuaggaaaucaaaccaacaaagaguuuaaaagaaguagaauuaucaaaauuucagugguuucgggauuuuggcaacagcacugaggacuaacuucaggcaaaaugucuugagagaaagaguggggaagauuugagaggagcuaaauauugagauauuaagaguauaaacugugagauggguaaauuauuaauuacaugcaaaguaggcauguaaaauuccaugugaaguacuaaaacccaagagaaaugaaugauuuugaguaauuucuuuccucaaaaucgaaugaauuugaguaauuucuuuucucaaaaaaggaaaaguggcauaaucuaugauguuuagcccaacuugaaagggauucuuaacaaaugcuaugagcucacagucauaguaaaguaggaacuuuauucacuguguuggcaaguuagaaguugaaaauuuaaagguuuuuuuuuggcauaagguacugaagaugaagaauaagggcuaaagaauauccauugugaguuaagauuaauggagaggagaggccaaaaaagaggaaggaaaauuguuauuuuuaggaacucuaaauaguacaugaaagugaauccuguaucaugaccuauuguaugcucaacaaaaaaauuguuucuuuggaaaaauacagaaaucugcuuuuauuccaacaauaauaaaagagauauauugaucaugacauuuaaaagagauucccaaguagcuauaauuuggaguuaagaaaaugauuuaacaaugcuuaaacuguugcuuaaguuuaaagagaaaauaguauguuauuuguauaauaaaaauagaauaucacaagaauaugcuuguuucuacucucccucaaauguguuuaaguuuaaauggaacuaauuguguuuaugaaaucugaggaacucaugacaugcugaauucaaugaaguacaguaacauguauaucggcgucacuuaacauguauuuauggaauagaauuucacuauuaacuuuuccuuuaggauuagaauuugguuggaaacaggaagucugaaugacuucucucacuguaaacaaacaagaugcuaaaagucuuggacuaauauucuaauauuuuccuuuuacagauguuccauucagugccacaccagugaaugccuuuuauaauggcugcauggaagugaauauuaaugguguacaguuggaucuggaugaagccauuucuaaacauaaugauauuagagcucacucauguccaucaguuuggaaaaagacaaagaauucuuaaggcaucuuuucucugcuuauaauaccuuuuccuuguguguaauuauacuuauguuucaauaacagcugaaggguuuuauuuacaaugugcagucuuugauuauuuugugguccuuuccugggauuuuuaaaagguccuuugucaaggaaaaaaauucuguugugauauaaaucacaguaaagaaauucuuacuucucuugcuaucuaagaauagugaaaaauaacaauuuuaaauuugaauuuuuuuccuacaaaugacaguuucaauuuuuguuuguaaaacuaaauuuuaauuuuaucaucaugaacuagugucuaaauaccuauguuuuuuucagaaagcaaggaaguaaacucaaacaaaagugcguguaauuaaauacuauuaaucauaggcagauacuauuuuguuuauguuuuuguuuuuuuccugaugaaggcagaagagaugguggucuauuaaauaugaauugaauggaggguccuaaugccuuauuucaaaacaauuccucagggggaacagcuuuggcuucaucuuucucuuguguggcuucacauuuaaaccaguaucuuuauugaauuagaaaacaagugggacauauuuuccugagagcagcacaggaaucuucuucuuggcagcugcagucugucaggaugagauaucagauuagguuggauagguggggaaaucugaaguggguacauuuuuuaaauuuugcugugugggucacacaaggucuacauuacaaaagacagaauucagggauggaaaggagaaugaacaaaugugggaguucauaguuuuccuugaauccaacuuuuaauuaccagaguaaguugccaaaaugugauuguugaaguacaaaaggaacuaugaaaaccagaacaaauuuuaacaaaaggacaaccacagagggauauagugaauaucguaucauuguaaucaaagaaguaaggagguaagauugccacgugccugcugguacugugaugcauuucaaguggcaguuuuaucacguuugaaucuaccauucauagccagauguguaucagauguuucacugacaguuuuuaacaauaaauucuuuucacuguauuuuauaucacuuauaauaaaucgguguauaauuuuaaaaugcaugugaauaucuuuauuauaucaacuguuugaauaaaacaaaauuacauaauagacauuuaacucuuca

SEQ ID NO: 192641 - RNA, 8223 nt, Homo sapiens
uggaggagggacuucucuuucgguaaccagcucccuugcggauagucuauguucuccauauaaacccagcacuucccuuaauugagauacgugggacuucacuccguccccagcccggaaccacaagugagggcacugcguuuccugauugaccucuuuggcgauuacuuccgcccaggggccuggaauacuggaggcccuucgacggagaacaacaagaaaggcacuuccggugucuguugccaggcgcgggcccagugggccguaggggcgacauuguugccguugucuuucccccccagucccggggauggagaugucgggacucagcuuuucagagauggagggcugccguaaccuacuuggccuacuggacaacgacgagaucauggcccuaugcgacacugucaccaaccgccuggugcagccucaggaccgccaagguaagggcggacccuucaccuagaaggcugccgccccuuccccggccucacgccuaccccgcuuaggcagaauccucgggaauguuggccgcagccgcagauccacagcucuggaaccacuacgccgacuugggcugccgggucaaggcggggaggugguggcggugauaauggcacggcuuccagguuuuauccauugaauauuaugggcagcgcuuguugauucaaggauucggaauaagucauuuaaauuuuuaaaaauuuuaaaaaauuuucuggggagccagaauguuuugcauuuucaguuucgaucagcugaagagucagcugcugcucgggcuuuuuucuucaaguuugagugggaggaggauggcaaacauuuuguaugucucugguaaaaagcaacuacuguaauuaaauggcaggcaccuugaauccaugucuccuuuuggaggcaaaauuuuucugagaugauuuucguacuaggaauacacacaagcgagcuaaauacauauaccgguggauuuuuaagggguauuagugcuaagucugauugugacuaguccauauaaaaauguaaagcguuuguucauuuugugugucggguagcuaguuuuauuuuaaauuugcugaauuuuacuucaaaacgugaaaaauuccagauucccauauuaguauaugauuaucuuuaaaagauucugcccuuauaaaacuggguuuuucugcuuaagucggauuucauuuuuggcauugaagaaagucauuugucacuccgaaccauggacacuaaaagaggaaguuccaaagaauuaagaccgaaaauagcuuuagacuuauaugguucuucagcguuuauuuuacauggcuuucaccuucuuauaaucauggugagugugaauuuaaaauuauaauggauaaaaugcugcauuuaauuauaggguaucuaaaagcaaauaagaaaaaaauucccaguucaaaaacguuuaaaugacuugaagaaacauuccuggggcaggggguggggaaucacccuuaagcauaugaaaguauacucagcaucuuuggaaacuaaugaaaugaaaaccagaaacagaaguugucuuuucuguguaccagauuggaaaaaauauauauauauauauaaacuauaaacuucaaguguucaugaucaggugaagcaacucguugacaacuagugaaggaguuuaaguuaaaacugccacuuugaaaaaacaaauuugacaucuccuaaaauggcagauuagacacauacucgagaccuagucuucucaaacuugaauaugcuuuugaaucucucagggaucuuguuaaaaugcagguucugacucauuaguuuuaggggaggcccagaaauucugcuucuaacaagcuccagguugaugcucauacugcuugccccuuuuugagcacugggagauguguaugagaauguucaaaguaacagcguuuguaauuggacgcagaauagaagucuguaaacagaagaauaguuggauaccuugugugcagucauauaacuaauuaugauauagcagugaaaaugaguuagcuauguauaucaaauuaauccagaaaauauugaaugaaaagcugauuacagaaaacuauauacuguauauggauggauugaauuuauagcacaauuuaaaacauaccaaacuaaauauaguucagggauacauacuuaugcuguacaacuauaaaagaagggaaauuuuaaagcaacauuuaggauaguagcuacucugagguggaugcgaauaaagaggaauagcauuagggaagagacgaaaugggggccucaaagauaguaauuucuuauguccuaagcuaggggguaugcauaugggaguucguuuuauugccauucuguaugacucacacaugucagaaauauucuuuggucuuguauuuuaaaauacaagugggccaggugugguggcucacgccuguaaucccagcacuuugggaggccgaggcaagcggaucaucugaggucaggaguucaagaccagccuggccaacauggugaaaccccgucucuacuaaaaauagaaaaauuagcugggugugguggcacacaccuguaaccccuugggagacugagggaggagaaucccuugaacccaggagguggagguugcagucagcugagaucgcgccacugcacuccagccugggugacagagugagacucugucucaaaagaauaaaaauuaaaauauauaaagauacaagcccugguucugccacuuucuagaaauacaauaguugggccgggcuuggugacucacaccuguaaucccagcacuuugggaggccgaggcgggcggaucaugaggucaggagaucgagaccauccuggcuaacacggugaaacccugucuguacuaaaaaaauuagcugggcgucguggcaggcgccuguagucccagcuaccugggaggcugaggcaggagaauggcgugaaccugggaggcggagcuugcaguaaucccagaucgcaccccugugcuccagccugggcgacagagcaagacuccgucucaaaaaaaaaaaaaaaaaagaaauacaaucauugauaccuaauauggccucaacuuucauuaucuguagagugaggagauaugacuaaaauuccuugacaucuaaaauauuguuguaauugucccuauuuuuagagguugugcaugaauuuaggacuguuggccuuauuagaaaaaauauuuuuucucacuuaaauguuuucuuaaaauguaauucuuuaagaggaaaugcuaaacuuucacuaucacuuaugggaagugaacagaagagauuuuagguaagggaaguuuaaggcauaaagauguuaaaagaaaacugacaacggacuuccuauuuuuuaaaaaugaugacuaucauguaacagcaauaaugcugugacgagaguuuauaaacauauuugauagaguuucugcccaccuggcacaaauuuguaagugccucaugauuuuuuauuaaucuuugcaauuucuuucuagaugcuguucaugcaauauuagcauacagucaaagugcagaagaacuucugaggcguagaaaaguccaccgagaaguuauauuuaaguacuuggcaacacaggggauuguuauaccuccagcuacugaaaaacacaaucuuauucagcaugcaaaagauuacuggcaaaagcaaccacaacugaaauugaaggaaacgccagagccaguuacaaagacagaggacauccaccuauuucaacagguaaaauaaaucuuaugguuguauucugaaccuuuguucugucugaaacuuuguugauaauccuagauuguggggaacaugguuaauaauguuugugggguuuuuuuauuuuuauuuuuuaagagauucuugcucuguugcccaggcuggagugcagugguguaaucauagcucacugcagccuugaacuucuggacucaaguguucugcccaccucugucuccugaguagcuagggcuacaggcaugcaccaccaugccuggcuaauuuuuaaaauuuuuugguagggauagggucccaacuauguugcccaggcuggucuugaacuccugaccucaagugguccucccgccucagcuggaauuacaggcaugagccaccaugcccagccuauuuuuuuuauauuuuauaauuuuaacuuuauuucauauccuaucaauccugaaggaaggaagagaccaguaaagcaacuaagagcaaaaauauuucugacauauagugaugcauauauaaucaucuauugauaugugagaaaguauuuuucaauaucagcaucaucaaaugaggacuauuggauuuuuagagaguaaacugcaagguuaauuuuaacuuuagcuccguguaauuuuuuuucacuuuagaagaauuuuauugcaaauucuuucucacuuuuaagacguuuuugguauugcaaaaaugucaugaaaggaacuuaaaauuuuacuuuaaaaaaaauuuucuuuuaaguuccaggguacgugugcagguuuguuagauagguaaacaugugccauggugguuugcugcgccuaucaaccuaucaccuagguaugaagcccagcaugcguuagcuauuuuucuugaugcccccgcccccacauuggaaccuaaauauuuuuuauacuuuuuuuuuuuuaacuagaaaaaguccuauuguagaaauauucuccagcggacauuggcuguuucuguucuuuauauuaucuccacuguacauuuuagauacugcacaaauauuuaaguguugcuugaauuaaccucuauguaauuugcagauuuuuaaacuacauaccacauuuuuugaauuaaugagguuucacagugagaaagcuuugccuucacacuaggaaagaaucuuuaagagcuuucuuacuuuauguacugauaagagcauugacuuugaaaucauacaaauacgacuucaaauuagggucugcaauauacuagguguguuaaauuaggcaaauaaccagugccacgcacagugcccaguguauuaaauagcaggugcucaguaaaccuaagaucucauacaucucaguaaaguacuguguuguggaacacauggaugaaugagaucuaguguaucagguagauuuuuacaguaacuuuuuuuuuuuuuuuuugagacaaagucugcccugucacccaggcuggaguacaguuggcaugaucucagcucacugcagccuccacccucuggguucaagcacuucuccugccucagccucccaaguagcuggaauuacaggcaugcgccacuacacucagcuaauuuuuguguuuuuaguagagacgggguuucaccauguugucaagacuggucuugaacuccuaaccucaagugaucugccugccucagccucccaaagugccgggauuacaggcaugaaccaccacgcccagcuuacaguaacauuuucugugaaaaaagagaaauaauagaauaaaauuaaucccaguuauagaaaauaaccuguuucaaucaccguaagaguaucuauuuaaagacaaugaaaaugcuugcuuauauuaacuuuaugucauuuauaugcaaaaugcauccauuuaaagugaacguuuugaagguuuucacauauauaccugugauauacauauauaccugugaaaacacugccacaaucugaggaaacacuuacauaaaucaucauauaauuuauauauuuuuauauaugacuguucauacugauuuuuuuuuuuuuuucacacggagucucgcucuguugcgcgggcuggagugcagugaugcuaucuuggcucacugcaaccuccaccucccaaguucaagugauucuccugccucagccuccugaguagcugggaauacagguacacgccaccaugcccggcuaauuuuuguauuuuuaguagagacgggguuucacuauauuggccaggcuggucucaaacuccugaccucaccauccgccugccuccuccucccaaagugcugggauuacaggcgugagccaccacgcccgccaaguucauacugauuuuuaaauuggccuuacuaaaccuuacucucuuagcugaauuuucagcaauuuaagcuggaaauuucuaaaaugauuuuucuccucuugaaaaaagauuuuuacuaugcauaauggguucagcaaguucacauaugguucauuucucucugguguaauggguucauucaaacuuaauaggcuagauagaaaaauagauaugaaaguuaaaccuuaguguuauuuuguauuuauuuuauuuguuucaaucagcaggugaaagaagauaaaaaagcugaaaaaguugauuuucgucgccuaggagaagaauucugucauugguucuuuggacuucuuaauucucagaauccuuuucuaggaccaccucaagaugaauggggaccacagcacuucuggcaugaugugaagcuuagguuuuauuacaacacaucagaacaaaauguuauggacuaccauggagcagaaaucgugagccuucguuugcugucacuaguaaaagaagaauuucuuuuucucagccccaaccuagauucacauggacugaaaugugcaucuucuccucaugggcugguuaugguuggaguugcugggacuguccaucgaggaaacacuuguuugggcauuuuugaacaaauuuuuggacucauccgcugcccuuuuguggagaauacuuggaaaaucaaauuuaucaaccugaaaauuaugggagagaguucccuugcuccuggaacauuaccgaaaccaucuguuaaauuugaacaaagugaucuagaggccuuuuauaauguaaucacuguaugugguaccaaugaaguacgacauaauguaaagcaggcuucggauaguggaacuggggaccaaguuugagguaguggaaaugagacauugcugaacaaaagagaacuggguuuaccugacccucuaaagcgcuaaguacugucagccugaaaaaaaucuucuauacagaaacucuuccaaauacuauaucaguaaugucugaaugauuucagaugugaaaauugacauauuuuaguugaaauaccuuucuggacuacagacuuacauaucaugugaauacuuaccuauuucuacccgaguugcagcaaguauucugaaagcuuaaugcaaauaaaucccacuuuagaucuuacagcuaacugugugccuuagaaaccagguaauauuuuccuuuuacuuagugaauauucugcuaauaucugcacuuuucaugugggaaaggauuaauaaugguccaggcuuccccucuuuaaguuucauguuuacuuuugucuaacucuggauaauuguauuuuacaaaugcaucucacuguaguauauuuuuaaaacuauuaaauauuuuagagauguuuaacguaaacucaaaguucucauuuuagaaaauuuaaauaacauucuuuuugcaaaaaaguccaauaauuuaacaguugaagaaaaacuuacuaccucuuuaaagauuugagaaacauuuuucaaaguuaucagcuguaguccaagcuaaauaucuuuuguaaucugcaacauuuuccuuacuguuuuugggcagugauaaaugcuguucucgaaauagacuuuauucuuaccuaggcuucagacaacaguuuuauagagcaguuacuguaauacaauauaaaggaaauaugcuguugaaauuuuaaagguaugcccaguuccuaacuuuuaaacgaauuaccguucuuccucuuggcugaucuuggcagagaugacaaaaaaaaccccaaaacaacccaugcauguauaauguguguauacacauauacauaaguauacauauacucccacauuauaacuuagaauauuuaguuuuuuaccuguuacuagguuugaguuacaugguugaguugccaaauuauuuacaugcuuuguuuaaauucuucaucaccuagcaacuguuugcugaucauggauuuacuuaguuacuuuaauuuauaaaauuaccauuuggaaaagaacucaauugggaaaugugaugacguauuguacauguuacuuuuuccuuugcuauaaucaucuagggagacugauaagaauuuuggaaaugggagccuggaaacucaucuuuguuuuuuuaaugcuaugccucuuacgaggaauacgaauugguauguccuaaaauaagaacuuaauaaaggagggaaaucccuuuugucugcuauaa

SEQ ID NO: 192642 - RNA, 30420 nt, Homo sapiens
gcggccgccucugcugcggccggaaacaauaguggaggaacccgagccgcacggaacggcggugguggcccgcggagccggacgguaaagaccccgcagcccugcucccaucccaccugagccccgacccccagucccaucguuccgccuccuucgaguuccgagccccguggccccucgcgcugcugcgcgccaggcgccccgacggacagaccgacggaaagacggacuuggguccgcgacucccugggggcggccgcgcgcccccaacgccgaaggccgggccaggacccggcuccccgagacgcugaggcugggcggaccggccgccguggcccucggacgcuuucuucccucugggaggaaucccggagcgaugggacgaggcucucccgcccgccgggcuccaggaugccgcggcucucccagcuccggcuugggccccuccggcggugcccggccgguaccgugaagccgccgcucggccuucgguguaguugccccggacacggcgggacgcccuccccggguauucgguacccacgugcauuuugcugccgccgaucuccguucgaugcgaagcuucgcaacuccgaguucgcgaggcgcaucugagguucccccaaugaaguuagcaaagcagugucccgugcaggucguuuuuccuguuucucacagcguuaacuagguugacagaaccugguagcugaaaaggccucgcugcuaagcccucugauuauucgagguugggggacgaaggaggaggacuagaaugccggcaaaucucuuuccuucaggugccacuaacccaaucaacuauaggacaaaaaagacacggacauagugucaccuauggccuggcuuuaaguuuuacuagcuuugugucuuuccacaggaaaagugcaauguuggagugcaaguauggcgaugcuuguuugauggagcuuuugcuuuaaaugagcugaacagcauccuuauuuccuagaaguucccaguaaagggaacuaccccaaaggcagguucaugaaauuguguaacuuuccuuuucuguuucuuaauaggggcacuaugaacgaagaggagcaguuuguaaacauugauuugaaugaugacaacauuugcaguguuuguaaacugggaacagacaaagaaacacucuccuucugccacauuuguuuugagcuaaauauugaggguaaggacacaguauaguuuugaucuuauggaaugaauuuaacacagcugcuuuguacugauuguaagguaaaacuaaaaugucuucaaugauuggaaauugugcuaaguaugaauaguguagagauuuguuaaagauaagguuucuggaaaugaaggugcaguuaacagaguuacgaauuuaagagaaaucuuuuuuuuuuaaagaccccugcaacaaccccauuuuuccuaauacagaaauaaguaugaguguugacugggaaacguguuuucugguuugagagcuuauugaauugucagauuuuaacagaccuguguguuuuuuauauuaagaaguaacauaacaauuuuuuuauucuuucgagccuauuaugcaaguauuugagugagaugagcccgaacucuuuucucaccaguaugaucuuauuaucuggaaaaauacuuuaaaauuuuuagauuaaccucuuuucagugaucacacacacuguugguaauuuuuaaaaccugaaaagguuuuuaaaauuuuuuuaauaaugucccuaagauauaugaagaaaaauucuccaaauccaaaaagaaaccccaaaaaaaagcccuauuggaaggauuuauuuggguuggugcaguuaguguugucauauuacaauugauuuuugguuuagauauuuaugagucauacuaaaaaaaaccuuaauauuccugcaaaaaaaauuuggccuguaauuugaguuuugaguuguaacauaucaguagagagacuuuauuaaaccucuagauuuuggacaguuucaaaauaguucuuuccuuuuuucuguauuauauauuugaaauuuuucaugaucuuuauuuucuguuuacuaaguaugggguaugaaauguucuuauuguuuaaaaaaauauagugggggauuauauaccuugaaauuccuguuaggacuuguuauucagaaauuauuauggucaccaaacaguaugugauggaagauuauggauuucuuguggauuacauagaauaucuauaacuucagcuuuaauaaauguagugauuauagcuaauuucaaaagaugacauaacaggaacagugguguguuccuacaaucucagcuacuccagagguuaaggugagaggauugcuugagccuaggaguucaaguccaguuugggcaacauagcaagaccccaucucuaaaaaauuaaauaaaaauaaaaggauaucuuaaaaauaaguuucuuuuacaguacuuaaaucaugcuggggugaaaauccaaauuuauguucuuuggaaauagaguuggcuuguauauuguugauacauuguagaauuuuaauuuuagaugaguaaagacauuagaaauuaucuaguccaaacccuguauuuuacauuuaaggaaacagccaaaaaguuggacugcccaggguugcuguaguggugauggcaagcuguuguuaugugccaggcacugugcuaaaccccuuauguggauuaucuuauuuaacucaagauagcuuuggaaugacuacugucauuuucuauuuuaaaugugauagaacugaaccuuggcgaccuaagaaauacaguuugaagucacacagcucauaacuguugguccuggacuuuaaagccuggcagucugguucuaguauaugugaucuuaauaccauugaucuacugucaauaguuauuuuauagcaauagggcugauguucuaauccuaauugguuauccuugcuauucucucagccagcuuuuucuaaccaguguuugcuggcaaaucaucauuaauggaguucaugccaugaucgaauuuuuccacagaacccuaaauuuucguaauugcuuuucuagcuuuuuaaaauaagccuuuuaacugguucucagucauuauauagagaauauacaaauauuaccuuagguaccaucucuuaacauuucagcucugauaauaucucagcauguaagcauggaauaaguccuuuguuuuugaaaucauaguucccuucaguguaaaagacaauucucaauuugaauuagaacuauuucguuuaauauucuauguauauucaagguuuuauauauuaaaaucccaauuuaaucuuuguaagaaaaauuagagucaaauaauuucuucucuaucuggugucauuucucagcucucacaaauacgcauuuucauuuucacuacagugaucagcuaguguauuacaacuuuuuuguuuaagauuuuuguaggccggcacaguagcucaugccuguaaucccaacauuuugggaggccaaggcaggcggaucaccugagguugggaguucgguaccagccugaccaacauggagaaaccccgucucuacuaaaaauacaaaauuaaccaggcaugguggcacaugccuguaaucucagcuacucaggaggcugaggcaagagaaucgcuugaacccaggagguggagguugcagugagcugagauugugccaucgcacuccauccugggcaucaagagcaaaacucugucucaaaaaaaaaaaaauuauuuuagaaaagaggagggaaaugaggaucuugaauugcacaaaauuuuaguuuuuauaucaguauacgggucuuuagaaaucagugggggaaaaaagucauaauaauaauuacauacuagaaaaauaacaagguauauuuguugucgguaaaucuuuuaaaauauuuuugaaguuuucuuuccucuaccaaguucccaacacaaugccugucaauagacuagaauguaagaggggcuuuuuaaaaaugacauuuaacuuuacuaguuuaguguaaauuuuuuguaguuugguaguauugcaguugccugauuucuuagcuuuauaauugcuagcuuuggucuaaagcacucuucuccgagaagaggcugaguaaaaauaaauucucuugaggaauaauaacaguuaagcuaguuuugaguccauacauuuguaguaaacaauaauaauauuuucuacuuuuuggauuguugcuuacaucaaaucaacacugguuuccuaaucaauuagccucuuguuuaaaagcugugugcaugcauacguuuauaaaaugaagacaaaggaaggaagaaauaacaaaagacaaucuaaucuuguugaacagauuuuguacugugggcauggcucuaaguuggcuuuuucucugacuuuacaauaaugaaaaagaaagaggagccuacauuuuauguacuuccaagccacaggugauaugcuuuaaggaccugagaaacacacuuugaggacucagauauuuuuuaauguucacaagguugauuuuuuuuuaaccuaugcuucaccauuugauaugguuuggaucuguguccccaccuaaaucucauguugaaauguaauccccaguguucuaggcagagacugguauuaggugaucggaucauggaggcggaauucacaugaauggguuagcaccauccccucagugcuguucucaugauagucagugagugaguuaucaugagaucugguuguuuaaaaguguguagcaccucccccccucacucucuuccuccuacucuagucaguugaggugcuggcucccucuuugccuucugcccugauugugaguucccugaggccuccgcagaggcugaugcuaccaugcuucuuguacagccugcggaauugugagccaguuaaaccccuuuucuuuauaaauuacccugucucagguauuucuuuauagcagugcaagaauggacuaauucaccauuaaaauaaauugucugcuucucagauuagaagacaggugcauaaacuuccuaaauacuuacagccuugacccuaagacacuaugaacuuuuucauacauauuagugaucaaauacucuaauaugcaucauaguucaaacugcuaaaaucucuaaagauauuuaaugaccaacucacuaccauucccuaaggaauggcaaagaggaaggcagcccaggguggucaggagcuaguaaugaaacucaacuguaagguaacaaagcccaaagugagaccuaagcaggaagagauccaggguuucaauacuguugguucauacuaucaguuuucaucuugugccaaaauaguguacaaauaauucuuagagcauuucucucuuccuauaauuggcuugcuuucuuuuccauagaggaaaaaaaaccuuuuuuuuuuaagcuagcuuagcuuuguuuagcuuuuuuuccuuucuucauuuuauuaaaauaaggguuucacuauguugcuuaggcugaccuugagcaauucucccaccucagucucccaggaagcugagauuacagguguguaucaccuuacaccuagcuaaaacuuuuuuauaagauuggaccaauuccuguuacacagguugagcauucaaaaucaaaaaucuaaaacuuuuugaacaccuacaugaugcucaaaggagaugcucauuggagcauuucagauuucagauuuuuguuauuuggaaugcucaaccaguaaguauaauacaaauauuccaaaaucugaaauuugaaacaguucuggucucaaguauuucagauaagagacauucagucuguaccaaacaaaguuuucaguguaaguugaccuugcuaguugaugaguaaguauguaucuggcugcucucuguguagagccucuuggauuacuuucaguuaguucuuucuagaaccauucuagaaggagacccaaagucagcuccuuagcaaucuuuccaacaagaaaaaucuguaaucuugguuaagucguagaugaauuagugucuauguuuaaucuuacuguuccuugauucuccgugucuuuaccauauacuguuuguggucaguagucagggaccaauuugaaucucaauaugaaauucuugauuugguuuggaaguuagaacugguuguuuauuacucgaagggaacauaaacuguuccucuauguccugcuucugacacuaacuuuuuuccacuuaaguaaggggccccaccacuugugaucaggaagcuguaaagagcuaauucaaucuggcauuagccucuuucucauuucccauccuguaauggcaaacaucauguauuaacuaaaaguugcacuuugaaguauaaagccuaaugggaauucugaacuuuagcuuggugaucuuuaauauacuuaucuuagucuauuuugagcugcuauaacagaauagcugagacuggguaauuuauaaagaacacagauuuauuucuuaguucuggcgguugagggcccugcauuugggcaagggucuucaugcugcaucaucccauggcagaaggcaggaagucaagagagagcuaaacucacuuuuauaacaaaaguggauuuuuuuuguuuguuuuuuuuuguuuuuuuccaagauggagucucgcucugucacccaggcuggaguacaguggugcagucucggcucacugcaagcuccgccucccagguucacaccauucuccugcuucagccuccugaguagcugggacuacaggcgcccaccaccaugccuggcuaauuuuuuguaguuuuaguagagacgggguuucaccguguuagccaggauggucucgaucuccugagcucgugaugcacccaccucggccucccgaagugcugggauuacaggcgugagccaccgcgcccggccaacagugguuucuuacaaaaguuaucugaagauaacuaacccacuccuacaauaaugacauugcuucauucauuuggucagagcccucauuaccuaaucaccuauuagaccccaccucccaacacuguugcuuuaaggauuguuuccaaaacaugaacuuugagggacacauucacaccauagcaacuugaaaauaaaagcucaagguuauuuuuuuuucuuaacuuccuuuuaauaucauuuaguuugaacacuuuaaaaauggcucugguaguaauacuuuauuugaacaggaguagggaugggugagagugaaaguaggcuuaauuggugauaaguuuaaauaauagaauauuuuuaaagaaaaaucauugaaacuaggcuaacaauaucugguaaagacuugugauuuaacuaacaacccauauaugaggagcugguuuccagacuuuuauaccuguccuauugaugguagccucauuuuuuuuuccuccugccuaacuuuauuagggugucuagggugcguuuaaaauuuagaucacacauaaauuuugguugugaggauauuuccucugcaacagaggaguauauauauguucauaaugaugaucuugagugcuuuuuaagucauugauaaaaauguguucuuuuaaaucagugauuuaaaguugaaaacaagcagaguauauaacccagaauauccuguuaauaagaauaucauaauuauaaauuaaaaugauuuauuagaauacauagaaaugacuuucuguuucagagucauaguucauuuaucccaauagucuaacagagaugaaaagaaauguuuuaucagcuauaugaaaacagcuuaaaucuagauugaaagucucuacuacuuggaucaaaaauauucucaaagauacaguuuuuauguugaaauaacuuacaguaacuguuacuggaaaacugauaaagagacaucaccucuccagaaacgauuauuugccuuuaugaaguauaauagacgcuaaaaguguaauuuuucuuauuacaugcaaauaauaauggccugugaagaaagaagacaaagauagauuuaucucuacuuuagaggaagugaagugucacccucuaguuggaagaaacuaguccaccuuaugcucaguaaauauuuagggaauuuauacuuuuagguaagucucuuaucuaaauaauaguuggauauuauuuaccagguauuguacacuuuacauacaguuuuuaauuuuauucuuaauacaacuauaugaaguagguucuguguuaucccaguuugaugaauaaggaaagugaguagagagucuggguaacuauuccaaaaaucacaaagguuagagaccaagggucucugauuccaaaauguccaggugccuaaauuuaugcuuccaaagaaaaugacauggacucuuaggaauuuaggagcuauuaaguaacuuuuaggcaagauuggaaaugaauuacacaaaugugaauauucaagcaaggacuaaaguuuagguccuaagacaugcuuaauuuuuaaauaauuucuacucacgauauuuaaugaauacacauucuguggaauagccaaaaauacucauuucugaugaccuaagagaguggggugaugcaauuuccauauagauuguaaucuaaacaaacaauaauaugccaacauaauauaguuuugagaaauuuuuauuggauugguguuaaucagagagaugggaggagcuaggaagaaaaaggacacacacaagacagucuuguugcugguccuuacccagaagaaccaugcagaugucagcugguaaugaaacagugauucuaacacugcucucuguucuuccaccauccaaguaaggcagacuagcauauuuauccuaauuagccuuucuuucaagagagagaacaggauuaugagugaguggaagcagacagugugagcacaggugaagaugucggcaccaauccugaaauugcauagcagcucccuuuugcuuaucagccucaauagcugaugcugggacaaccugagagaaaagaaaguguucauuaauguugaacuuccuaguuucugaauuuuagaagauaaggagcauuaaacuaacuaugucaauagaacauuuuagaaauauuuagaacauauuuagaaauacuguuccucuguuuacaguucaaaauuaaaacuuaagaaaaauuuuuccauguuuauuaccgaauauaaauuaaaaacuauaauuauauuuguauagcacuuagagguuggaaggugauuuugcuguuacauuuaaucacuauauuaugggaaaugagcauuaaaugugaauuuuaaauaaggcaagacaugaaaaauguaugagugauugaaaucaaaguagcuaaguaaaguugcagaguuaucaaaauguuaaccacaguucugguuggagugaauuuacauuauucuaauucaauuugucauaccaucuguuaggaauuugauaaggagaauaaacccauuaaacucugagcuuuggauuuaucguuuuaacaaggggacagugucugcuguuuauaaauaauuuucaauuaauguaucuuauuucugguagcucuuugcuguuacugucugaguuguacaacaguaaggcaaaauaaugauuuguguguacccauaaaucugaaucucaaaaugaaagcgcugugguugauuucaccauaauuuuaaacauauuccuucaauaaauacuaacugagcaacuacuaagugucagaaauucucuaguagcuagagauaauggaguuagcaaaaauaaacaaauccccaaaaucaugaggcuuacaugagaggaggaaaaagacaauagaauaaauaaauuauauagcauauuggaauguaauaaaggauuauuugccacuaugaaguauaauagacacuaaaagcaccuuccaguuucugaagugcuauacaaauauacuuaaugacauuuuuaauaucuguccuaaacguauacugguggaauaauaucuaccaugaacuuaaugaaugauaauugcuacucuguuuugaaaauuagagcccauacauugaggaaaucugguuguguuauuugggaggaguguuucaagauuaacauggaauacuccuucauucauacuucuauacugcuaucuucaaauauuaaagaggaucuucaguaucuuuaaguauuuuagacaguagaaaauacuuuaaaguuuuuauauuacuguuuacuuugagaacauuucuuuuacuuaauauccuucauaauuuugaccauguuaauuuggcugaacaaauuauuuuccauuuauccugauaaaucaacauuuucauuauuguguuaguucucacacugcuauaaagaacuaccugagacuggguaauuuaugaagaaagagguuuaaucuucucacagcucugcaggcuguacaggaagcguggcuggggaggccgcagaaaacuuaacaauuauaccagaaggugaaggaaugucuuaauggccaaagaaggaggaagagagagagaagaagaaggugcuacauacuuuuaaacaaccauaucuugugagaagucacuaucaugagaacugcaagggagaugucugcccccgugaucuaaucaccucccaccaagccccuccuccaauauuagggauuacaauuuaaccugagauuuggguggagacacaaauccaaaccauaucauucugucccuggccccucccaaaucucauguccuccucacauugcaaaauacaaucacccuuaugaacagucccucauagacuuaauucauuuuagcauuaacucaaaaguccacaguccaaagucucaucugagagacagcaaguccuuucugucuauaagccucuaaaaaacaaguuaguuacuuccaagauacagugagguuacaucacaaacugggguuaugugccugcagcuuuuccaggugcacagugaaagcugucagugaaucuagccuagcauucuggagucuggaggacggugacccucuucccacagcuccacuaggcagugccacaauggggacucuuugugggggcuccaaccccacauuucccaucugcacugccuuaguagauggucuccaugagggcuccaccccugcagcagacuucugccuggacauccaggcauuuccauacauccucugaaaucuagguagaggcucccaagccucaacucuugcccucugcacaccugcaggguuaacaccacguggaagcccccaaggcuuacagcuugcacucucuggagcagaggccugagacauauccugggcccuuuuagccauggcuggagcugaaguggcugggacaugagcagugucucaagguugcgcagggcagcagggcccugggcccaggccaugaaaccauucuuuccuccuaggccucugggccugugaugggaagggcugcaacaaaggucucugaaaugccuucaaggcauuuuccccauuguuuuggcuauuuagcuccucuuuacugcagcuggcuugaauuccuccccagaaaaugagcuuuucuuuucuaccacacggucaggcugcaaauuuucugaagucuuauacccuuuuaaauauaaguuccaguuucagaucaucucuuuguucacauauaugaccauacucuguuggaagcagccaggccacaucuugaacacuuuacugcuuagaaauuucuuccaccagauagccuaaaucaucacucucaaguucaaagguccacagaucccuugaccgggguauaaugccaccagucucuuugguaaagcauagcaagagugaccuuuaccccaguucccaauaaauuuaucaucuccaucugagacuaccuacuacuggacuucauuguccauaucacugucagcauuuuaggcacaacaauuuaacaagugucuaggaaguuccgaaguuucccuuaucauccuaucuucuucugagcccuccaaacuguuccaaccucugcgcauuauccuguuacaaagucgcuuccacauuuucagguaucuuuauagcaaugccccauucccaguacugauuuucuguauugguucuugcauugcuauaaagaacuaccugagauugggucacaguuccacaggcuguauaggaagcauagcuggggaggccucagaaaacuuacaaucaugacagaaggugaagggggagcaggcacaucuuacauggugagagaagggggagguguuacacacuuuuaaacaaccagauuuugugagauucacuaucaugagaacagcaaggggggaaguuugcucccaugauccaguuaccuccuaccagcgcccuccuccaacauugcguauuacaauuugacaugauacuugggugggaacacaaaucgaaaccauaucaauuuuauuucuacuacacaguagaauaaauacaguauagauaaaauauaauuccuacauauuagaaaguucuccagaaaagucaguuuuagauuaccagguuauuuauuaacaaaguguauuggauaaauaucagucauagauauucugggagaucucaauucucaguugagagugaauauagaccagcuuaauuucuuucacacuucuuacagccucugucuuuucuaccucccacucuucuuuuuuuuuuggauggagugcccaggcuuuguugccugggcuggagugcagugucgcuuuguugcccaggcuggagugcagugacaggaucuugacucacugcaaccucugccucccagguucaagugauucuucugccucagccucccgaguagcugggauuacagguaccugccaccaugcccagcuaauuuuuguauuuuuaguagagaugagauuucaccauguuggccaggcugaacucaaacuccugaccucagggugauccaccugccuuggccucccaaaguguugggauuacaggcaugagccacugugcccagccucccccucuuaauucaucuauuuacccucuccuccauuuuuuuuuuacuaacucaucagcuuggcaaccuacaguuauuuucuauguaaccuggcagauuggccaaaagaaugauuagcauaucagaaauguucaugucucccauuuuaaaagaaaaagucaaggaaaaaaacuuuucccuuuuuuccuuaagccauaguucuuuaaagagcaguucauuuagggucucuuauuucuccucccaacuauucuucgugcccucuaauuugccacccucuuuugcucucaccagcgaucaccuagcuaucuaggcaguaagcagguucguguuaugguaauuuucaaagucugaugucuuguuuguaagaacauagaucacuuucucagaacuuaaguggagcaggcggcaguugaggagaugaaaggcagagagacagaguuaucacauuucuugcuuucaaaccuuaaauuugcuuugucauaauagugugcccucauucaucugguuauuauuaugaaggcauuuuuaaggcuaucuuuuguuuaaguaacaucuuuuuacccuugucuaucauaggaaacuuuguuguguuuuuguuuugcuguaaguuggugucuccauaugccccauguaaguggauauuuaaaacuaguaauucaauuacaguuaauuugaauagcuuuuuagaugucuuaugacaauuuuaugcagaaaaauuuuuuuagaauaaaugucaguacauucacuuaaauccuuuaggggaauauggaacaaguagaggguuacuuggguccauuggauuauuggcuuaaaauuuuuuguaacauaauguuaauuaaaccuuauaguccaaauuugauuuacuuuaccagaaaaacaaauuuaccuuucuauaucguacuguugugaguguaauaucccauauuaauauaucaguacgcuagcugggugugguggcucacgccuguaaucccagcacuuugggaggccgaggugagugggucaccugauaucaggaguuugagaccagccuggccaacauggugaaacccugucuuuacuaaaaauacaaaaacuacccagguguggugguaggcgccuguaauccuggcuacccgggaggcugaggcaggagaaucgcuugaaccugggaggcagagguugcagugagccaagauugcaccauuguacuccagccugggugacaaaagcaaaacuccaucuaaaaucaaucaaucagucagucauuacgguuuuaaaagaaauggugauagcuucuauccauguucucuuuccaaguacccuuuugcuuaguuaccuauggacaagcugccuuguccaauucaguagccuagccacauugaauucauuuaaauuaaaauuaaaacuuuaguucuucagucagacuagcuacauuucagaugcuaaauagccauuuguggcuacuggcuaccuuauugcauagcucaguuauacauacaacuuguccaucaucacagaaaguucuguugggcguugcuguuaaaaaacagguagcuacauuaaggaguagaauugaguuuggauuaguuuugugccuuuuuaguaauaaacaguuguuauguagguguguuuccccaacuuuccaacuguuagaaugaaaaaguagaauucacugagagagguuuuauuuuugacaagucauuugcaauguauacaucuaucaguaaaagaucucaguucugcucuggccuccuagguugagggugagguuuaucauugucucucugaacucuuagcucauugaaauuuuccuuuacaauucauuuauuagauuaagcugcuuugauuaacuguuuuaauccuuagcacacacaggaacuuuaaaauggcaugcacaucucuaagcugaaaucugccaucuaaaggccaccuguugauaaaucuuucuuuagggcaguaauucucaaaaugugcggaagcaaguuucugaacccaucuguauguuggcuucaugugguugccaauauucuaucugcuaccaaggcagagauaagcaguuaccuuuuacuuuuaaacgguauguuggguacuugaauauggcagacuauuuagucauuuaaguggcuccugauuuagcuaaaggcaugagggugaggaaaugagguacucuuuaucacaguacuuucuaagacaccuaggacaacugauaaaaauuuuaagaggcagaagccuguccuuuugugggaaguagauacuccaacuauucauccuugccuucccacuuuuagucuaaucuucugccuuggucacaugacaggauagacaaacugagcauccucccacucaguggcagugcuuggcaauagauaauaaugguaauaacuuccugaauuauggcuuggcuacugcuugcucaucaaaugcaugguagucuagucgaauugagcacaaaaucaucacuggggcaaguaguauuuacacugcagcaauccagccuagucucaguacaguacaggugaccggacauggauuuggagccugcagggucacagguacaagugcuuucauuaaggaaauaauaagaacuauuuggaauugaagagcacauacccaguucagcagccaguuccugucagauccucucauuuuguuuuuaauuuuucucuuuaaaauauuugugggcuaaacaaaacuuaccuguaguguggauccagcuuucaguccgugggagugccacuucuacccacagggcuuuuccuuuauuccuuuuaucaggaaugguugucugcgccucagaaacaaguaacauuuucauccauugucuuuccuaauaacauggaauuuggcuacccucccauuuuuacagugaacacuugcuugaagcacaagauuacuguuucuuaauauggacaacacauacauauucaaguaccuguaccccguuucuuagcauccaagauaagaucaucacaaaaagaaaaacaccuuuacucuuggaaaauuacuuaggcugugccaaaugugagccuccauaaaaaacuuuuuuuucuuuuuuuuaagacacagggucucacucuguugcccaggcuagauagaguguagaggcgcagucguggcucaucgcagccugugccucucuggcccaagcgauccucccaccuaaguagcugggacuacaggugcaugcaccaugcugggcuaauuuuuguauuuuuucuagagaccagguuucacaauguugcccagacgacucucaaauuccuggggucaggcaguccaccuggcuuggccucccaaagugcugggauuauaggcaugagccaccacaccuggccaaaaaauauuuugaagcaauacugcauguauuguugcacaaauacauuuaucauguuuuaaggcagugugcuuaaaauuuuuucacagcauguuaacaacuggacacuuaauuuuuuugccuuauuuaaacaucaagaaagaacacauaagcccaccauuuagcaaacccauacucccaguucccuaauucugcucuaaguuugagguaaagguuggagugcuugcuuucuuagugcuuuccaaucuccuacugaugugauaaugcauauuacaacuucacauccacugaugguuguauuauauuugcucucccuguggagcaccaaguuauguaaagccaguccuuugguugggaaauggaauauguaauccaauucaacauauagucuaauugaccacaaaaagugugagggagucagaugacaugauucaagaaugugugaaguauaaaggcauucagcaucagcauagacagcugagagacagugcuauuugacaggaccagcuggugaaucaucaggaaaagauugccuagcuuacuuauuacuaccaaguuauaaaucaagucuuccucaagaggcuagggguaaaagcagaggaucaugggacaugugguagaacuuuaagcauuuugauauucgugggguuuuuuagugccauuuggaguauuauuuuuguuacgaaaaaaaauuguuccuacaauuggugaauuaaacacaaucuaaucauucuuuuaaaaggguaacagugggccaggcacaguggcucacgccacugugaucccaggauuacacgccacauguaaucccagcacuuugcuaggcugaggcaggugggucaccugagguggggaguuugagaccagccuggcugacauggugaaacuccaucucuacuaaaaacacaaaaauuaaccacgugugguggugcgugccuauagucccagcuacuuggggggcugggguaugaugauagcuugaacccaggaggcagagguugcagugagcugagauuguaccacugcacuucagcccgggcaacaaggcgagacuccgucucaaaaaaauaagaguaaugauggcaacuagagcuaaacaucuaaacauuugaguagucuuugcacuuuuaggauggauuuaaccaaguuuucuuaaagcaauuuauuuuaaagaggaacuuaaaggauagagauggggauagcaugccagauggguuagagggaggguuucaaaguacagaauaauaguauaaaaacucagauaaaaugggaaaagauaaaagaaaaauaaaauuauugaauaggaacagcuuuuuaaaauacuacuauucauacagaaauacagccuauauacauuucuaaauagccucuagugagaagaaacccuuuuuuuuuuuuaauacuuuaaguucugggauauacaugcagaacaugcagguuuguuacauagguauacacaugccguggugguuugcugcaccuaucaacccgucaccuacauuagguauuucuccuaauguuaucccuccccuagccccccacccccaacaggccccaguuugugauguuucuagcccccuacuuccugacaggccccaguguguuauguuccuuuccauguguccauguguucucauuguucaacucccacuuaugaauaagaacauacgggccgggcacgguggcucaagccuguaaucccagcacuuuaggaggccgaggcgggcggaucacaaggucaggagaucgagaccauccuggcuaacacggugaaaccccgucucuacuaaaaauacaaaaacuuagccaggcgugguggcgggcaccuguagucccagcuacucgggaggcugaggcaggagaaugacaugaaccugggaggcggagcuugcaguaagccgagaucgcaccacugcacuccagccugggugacagagcgagacuccgucuaaaaaaaaaaaaaaacauacgguguuugguuuucuguuccuguguuagacaugaacucauccuuuuuuauggcugcauaauauuccaugguguauaugugccacauuuucuuuauccaaucuaucuuucaugggcauuuguguugguuccaugucuuugcuauugugacuagugcugcaguaaacauacauaugcaugugucuuuauaguagaaugauuuuuaauccuuuggguauauacccaguaaugagauugcugggucaaaugguauuucugguucuagauccuugaggagucacaacacugucuuccacaaugguuaaacuaauuuacaaucccaccaacaguguaaaagcauuccuauuucuccacauccucuccagcaucuguuaagaaacccauacuuuaaaaaaaaauaagauuaagacuuuugguugccaauuaaggucuugguucucuaauaaugacuuuaugauuuaaaaaaaagugacauggauaucuuugaaguaucuuaaagauguuuuuauaauaggaagucaauuacguuggccuucaaaacuuguauuagcaagcaaguuguaguacaaucuugguuggacugguuuggaaauuauuauaacucagcuccucaaaaguaucaccugauuguguugcauuuagauuuauucccuuucaaaagcugcuuaggaaacaaauuagugcucagagcuguuuacgcuuguaaaugcauuuaaaauugauaagucaguugggaaacucacugggaucucuugaaauagcaaugguuguuucugcuauaauaauuugaacugaugagguagaaacaacaaaucacuucaagaauuuauaaaaugauauguguauuacugaugcaaauuaagugagcuacucacauuauuuucuagauuaaaaaguaauuuuuuucaaguauaugaaguagucaguguuuuauagaaguuuuuguuuccuaugcuacugcugcacaggauauuuuuaaauauguuuauaaaacaaauguuucuaauugaacuuuaaaacucagucagguuuuuaaauuuuaguacgacugauguaacuaaagaaauuagagguauauaucuagaugaaugagcuacaguuaacauaaaaccaucuucuuguauauuuucuguauguaaauuucuauuuaaaaauauauauuugaguagaaauucauuauuuucuuugacagauugaaugaugccacaggaaugccauuucuguaucagugccacugauauguucuuuagacuaauagcccauuagacuaaauauaggaguaacuucacugaaagacaccuuuaauuacccgcugaguagccuggcagaacugcaaauucuaguucccuugcuaggagggaccuugcaagggaccuugagugauaauugauuuguuuuugguguuuuaaaauauauuuuuaauuuucuuuuaugcauuuaacuacuuuugaguacccacuaugugcccggcauuuugacacugagaauauaugaguaagauagacaugguccauauuuuucacagaaccuacauuuugucaggagauacaggccgcgaaagaggcaauuguaaaaucuagugugauaaacuaacccagacauuuggguuagacaaggcuucuuaggggaaaugagaacuagacaggaggugaugaugaucaugacccacauuuguagugggaguggugcuugagugaagcagaaggauuucagauguuguaggugcuagauuuuaugggggagaaaucuguuaagacggucagcaaaaccucugggauugcggggagugaagagcuuucaaggaggacacccagguuucuuccuugagcaguuaguuggugaugccagauucaguaaggggaucaguuuuggaguuguguggugagagagauaaaggaguuaaguguucaguaaggugaguucgaggagccaauagguacaucuaaguggaaauuauauuauaugaaucauuaagaagaaacaguagauaaacauuacaaguccucauuauucuucaaauagauaucuauuauauugaccuauuguugaagcucuagaguacaucagaaaauuaguuauuuaauguacuuuuuuaucggaguuucuguauaaauacuaaaaaacccacaaaauauaacaauaaauauuaauuacuuuccauagccuaguucacaaccuuuuuuauaugcuaaagaauuucauugcuacauagagcugaggcagugcacugagaaugagaccauuuacgguuuugagggauuagcuaaccaucuguuggcaacaagaccuaaaagaguuugcagaggguaggggagcucuuuaauaaauguuucaguuaguaauaggcaagcuucagguucucucugcauaccaguguuucccagaaaacuaagcauuggaaucagauagcagaauggaaccauuuuuccuuugguguauaacuugugauaacuacuguuuugucuuauuaucuaaaaugcguaauaauaaaacuuaauaaagcagagcucgugagcuuccuuuuuaugucaguuucccauuuuuaaagauguauacucuauuaucaaauaaagcuuugagauuuauaauucacauauucuaauguugcuggaaauuugaccuaaucagauaauaacugguagaaauguauacgugcucacaauugcaguacaaggagcaaagugauaaauaagauguauauuaaauucuguuuaaguuuccagcaauuuuuguacucauuggaaaaaacaaggcucagauauuugaguuuaccucaugagagcaguuguuuacaugugcuuacaauauuaauguuuuagagguguguucacauagcuuacaguaacuguugagggaacugauaaccaauuuaacacuugguuuugacagucucaucaagucccaccauuggcugauacuauauauauuuuuaaaaacauuaauauucacaaguaugcuaauacuuuauuucauaccauuaaaguacaaaugcuucauuaucuuucuuuuagccagacuuuggaguucaaauaaaauaacuaugaguucaauuuuuaaaggaaaggaggaauuacaaaauguauuuuuuucugaugaaucagcuaaaacuuuuuuuuaaacuagcuccugaguggcucuccgcuuacuccauuugaaaagcuaagcagauuuaaacugguuaauucuggcagacauaaauuuucagguccacauuccuaauucaccuucagcauaaaaguagcgcuguuuaacuuuaauaacauggcuugaacuuauaaaaaugugugaauauauucuguauuuugaaauguauuagauauuugaaaauguuuuauauuuuuauaauuuuuauauuuuuaaaaaacaauugagguagcauacuuauacucuacuaaguugagagauauaaaaguaauauuucuguuauuuaugguauauaaugaacauuugugaguugaggaauuacuggcuguuggaucuuggcagauugaauuuacugcuguauggaaaaugauugaguauaaugcauuucuucuagaaaauaaaauuaucuugauaagguuuuaguaacuauaaaauggaaaugugaaaaauguuagaugcuuugauuuucuuuaaaaauaaaucuaaauaguuuauugaauuuuugacuuuuauuugcauuuuucugguucugguuuuuuuuuuuucaauaaacauaauuuaagaacaugauuuacuguguuuuagggaggaaaacuuguucaguauuucuguuauugaaccucauaauauuauagauauuuuugcaaguguguacuucagaagguuucaugaagaaagcacuauaauguaaaggccaagaaucuguaaagguaaauugcuggguucaguaguauuuuuuuauaucgugcaguaacaucucuagacuaggauuaaaauugaauaauuaaguucuuagaaagauuuugcuauccauaagaauuuaauauuacugaauauugaagcagaaauuauuaggccacauuguauauuaauacuaauauucuuuagcauuuuuccucuaauucacagacuaucagggacucugauuuuacuaagauuuguauguucuuaaagugacuuauagaaaacaaaauuucucaagucuuuuguuucucuuuuuuuuccauagggguaccaaagucugaucucuugcacaccaaaucauuaaggggccauaaagacugcuuugaaaaauaccauuuaauugcaaaccaggguuguccucgaucuaagcuuucaaaaaguacuuaugaagaaguuaaaaccauuuugaguaagaagauaaacuggauugugcaguaugcacaaaauaaggaucuggauucagauucugaauguucuaaaaacccccagcaucaucuguuuaauuucaggcauaagccagaagaaaaauuacucccacaguuugacucccaaguaccaaaauauucugcaaaauggauagauggaagugcagguggcaucucuaacuguacacaaagaauuuuggagcagagggaaaauacagacuuuggacuuucuauguuacaagauucaggugccacuuuaugucguaacaguguauuguggccucauagucacaaccaggcacagaaaaaagaagagacaaucucuaguccagaggcuaauguccagacccagcauccacauuacagcagagaggaauguaaguaaaauggggagaaaaguaaaaguugggugguuugggauuuuuguacauuuguauagauguguaaugggucaagaauuuugcuguggaaucauagauuugggaaacauuguauuuaacagguucaccuuagcaaaaaugagacaucuuaaaauuuuucauucacugggauucugucuucuaagcauugaaguuaagcaauuuccauguuuguuuugccauuuaaaaugauuacacuaaauggaaucaacaaacugugaauuggaacaucuaggacucguauaguuuagaaguacagcuucaucuguuggcuaauacacauugucauguugcugaucccuguaagacuaauugacuggugguggcauuucagaagcaaaaaugugacauuuuacuaaaggccaaagguaaugugugcacuuauuguaaaguuagaaagggugacucauucucucuacaucuauuucuacaaaaauuuacagaagcugaggugauuuuaauugucuugaaaucauguuuucagagccagaagggaccucugcuaucuuguuauacaacuucuugauucuaaaugugaauuauuuaagauucuacaucuagacagacaaauuuauuuuucaaacugcagguuauaaacuaucuaaugcuuaaucaaaauaagcuuaauggguagugacuaacacuuuuuaaaaacugaaaccgaauaggagauaccagaauucauuggaccuacuacuauuuuuuggugaaacuuuuauuucauuggaggguggugauguacugggagugauaaaaaauauguuucuggccaggcacaguggcucacaccuauaaucccagcacuuugggaggccaaggugggaggaucacuggagcccaggaguucaagaccagccuagacaacacagggagaccccaucucuacaaaaaauaaaaaaauuaggugugguggcacacgccuaugauuccagcuccuagggaggcugaggugggaggaaucacuugagcccaggagguugaggcaacagugagccauugaucgcaccacugcacugccaccugggugacaaagugagacccugucucaaaaaagaauaaaaauaaaauuuucuuaccauggguuguggucaggguuugaaaacuucuacuccacacuuacgagcguuaaugguugaauacuggaguacugcugaauguuguguuggcaguuaagugcugauuuuuaaaaauaggauauuguguuggugauguaagcagcauguuuuccuagguuguugugguaauagugaauacauuuucauguuucagugaauucgaugacucuuggugagguagagcaacugaaugcaaagcuccuacagcaaauccaggguaagaaucacugucaguacuuuuuugugugugacaaauuuugacauagaaaaucaucuaugauaggacaccacuggcuuuaucuacauuuaaauuuggaaaugagauauucaaaccuguuagaguuuccagagcaaaaagaauaagaaagaaacaacuuucaacugcagaggaaauacauuuuuccuuuuuuuuuuuuuuuugcgacagaaucuugcuucaucacccuagcugcagugcaguggugauccucccgaguagcugggacuuacugucauuacacccagcuaauuuucuauuuuuuauagggaggggguuucaucauguugcccaggcugaucucgagcuccugggcucaaacaguccuccugccucagccucccaaagagcuggcauuacaggugugagccacugcgcccagccacauuuuucuuuucuaagugaaaauggaaacuaccaccucuuacuaacauuuuauugacuacccacuauugcaccaggcacuaugugggaguccucccaaacaguucuuuaaggcaugugauauuagucuuuuuuguuaaauuauaaacaauuucaaacauauauaaaaguagugagacuaguauagugaacccuuuaagccauuuucaccagcuucaacuguuagcaaaggcauaauaaucaguaucucuacuugcauccauucccauugcacuaccaguagcauggauuauuuucaaacaaauccuagcuaacacacuguuuuuuguccauaaauaguuuaggauuuccucuaaaagagauaacuuuuuaaaaaacagucacagucucauuaucacaccauuuaaaguuaauaauuccuuaacgucaucaaguauaaugcuaacacuaacaaguaauguucagauuccgcaguugucuccuuuucaauuuauuuccuuuuagaugagaaaauuguacuucagagauguuaaguugcuuacagagaucaugcauccaaucaguagcagaucaaggauuuaaacuccaaagcuuaaccacacagccucucagaauaauaaaaauaaucacaauaauaguuguaguagaaauuuaugaguacuuuacaaauaugaucucauuuaauuuuuacaguagccuggugaagugcuuacuaucauuauuaauguuacacagaaaaggaaauugaaaccaaaaguugcuugccugaggcacguaagaguaggaacaaggauucaaaacucuuaguagucugauuccaaagccucuuagaggggguuccagaccugaauacuaacaggcacuucuuguccauaaaucacauuauguacuaauugaaucuguuuauagauucuaauugagaaaaguagcucagcuacaguagcaaccaccauuuuugcuguguaucucuguagucacuugauggagaagagccaaauuccauuuggcuauguaaaguauacagaugccuaggaugaucagaacugauaugcuuuguagagaacagaacuguuuccuugguaucaaaucaguuucauugugacacuuugcccaaugcauagauuucaguuagaguucuugaaauauaaaucauagcaccggcuuucugcauacuaaaaaugaaaguuuuuaaaucuuuuacagaaguuuuugaagaguuaacucaccaagugcaagaaaaagauucuuuggccucacagcuccauguccgccacguugccaucgaacagcuucugaagaacuguucuaaguuaccaugucugcaaguagggcgaacaggaaugaagucgcaccuacccauaaacaacugaccuaaacagacuuacuucguaugcccugcccuuuauuggucucccagacaugcaaacuuugaagaaguuugaagaaaguugugguccguuuuuuuauggucauuaaauuugccaaacauaaggcaguauuuaacaucuuugucaaauaaagcagaucauuauacucuagucuucuagggcuaaucauuuuggcucauuuggggacucuuuuuucccagaauuacuaaacaaauuuuaucacaugugacuacuuaaauauacuguuacagugucauuuuauuaaacauuuuaauucaccugucaaaacaacagauuaacuccuuaguguaaacuacuagagauaauuuuuaagagggaaauggaauucauaucaccucuuauuuauuaugagcaauauuuuaauauaaaaauuuuauaugugaaaaugcuauuuuagguacuuugccauucucuuuauaaauguguauuugagugguucuguauauuuauuuacauuaucaugugugaauauguucacccauauuucaggucacugcauuuuauucucuuaauacaauguuuucacaacgguuaccuugcuuuccaaagauaaauauauuuuggauuagaaaucugaguuguuuuaauuucuaauaccucuuguaaaagaagaauuaauaacuuuuuaaagcaguauucagguaaauacaauacauuauuuuguuuucuaacaaaagcaguucuuaguucaggaagaaaagacuaaucuggcuucuaugucaauuugucuccauagaaaugaaagccuccucuugcuucuuucauuauuagcuucacaccagugacugugaugcauuagaauuuggacagaguaagucaagccucacuuccaauucaaauauaaugucuaucuucaaauugagugugcugugaaauuguucugucuuugaaaaaaaaaaguaagauuauuuugugugccacuuuggguaaaguuucaagaauacuuaaacuguccaaauuguauuaucaccaucauugaacuuagugcucaaagaaagcauugugagguauuuuucuaaacuuuagacucuauagagaaauauaggauuguucuacagaagaaaagcaaaacuccuaauuaaaaaaaaauaaaccuauguauuaagagaauguucucguaaguugccuaugaugcuuccaaagaguuuuuaucuaacagauugugccaaacagcuagauaaauuuuaauaauguauuacaguaaaggcuauaaccaaugcagaauuaaaaugggcucuaaauucuguuuuuaacucauguuuagaauguacuuaugagguagauccuugcuugaaaguaucugcugaaaagcccaguaacguggcagcuucaugcauaaagauauaaaugacauuugccuuaaauuuggcagccuacccuggcuugggucagauuuuguuguugaacacaagaaaguauuuaagcaaagaaacacuucaguuuaauugaaaacaacuuuuuguaaugcugacguguuaaauuggccugaggguauuaauugauaucuguugauuuuguuuuucuuugaaguauaacauuacuuuuuggagggaauuuuugaaagaugcuuucgauuucucucaauucuuuaagucaugcaaaaugaauuuaaaauccagggaguauggaugcauugccuuaguuuugaugagcuuuaaauuaaaugugugcaauaucaaaauauucaaacuuacaagcuggguaaauacauuuccugauuaauaucuuagugcuuaauuguucccacauuuucaaauuugacuuuacucuuuuuuggcguaauucaguaagauuguuaccagccaguguguuugcacacauuuggguuuguguuuagaugaguuagggacagucauaaaaguuggggauauguugcauuugauaucaauaguagcauauuuccagaauaugagccauaaguugcaguccugaauacaacaguguuauccaaagaaaggaguuuucugacaaauauacauagcuuugcuaaugaguacggaacaaguggaugaacgugugcaugugcuaaggucuuaagugggacucugauuuauuccauuuagauauuucuacuuaagcucuaaaaaggagaggugcucuuaaaaaaaacuuuguggugcugguacucacacuacuuuauuuggaugaguuccuaguaaaaaaaacuuuuuguugaaguauuuugcacagcaguuuauccaaauguuugguaaacuuauaauuuaguccuauguuaguuuucuuaaucaaauaugcaauuacuguguaugcaaauauaaguaucagguacagaguugaguucuaacaagagaacaugaaauaucacaaauauuguuuuccacacuuggcuauucucuacaguuguuaguaauuuuugagaauguuuugaagcauaucucauguacuacuguuuaaaaaguggcaaaacagacugccagucauccauuacuaaauuuucagagcuuauaugauuaaggggagugagauaagacaaaucuuuuucacguucaguuuuauaauuugacacguuaaauugaguuuuaaaaauuagaaaaguguuuuugaccacacagguuguucucuuuaaaguucagccuuauaaugaagcuaaaaaucaauuauguuuuacuuugagauuaucaucuuauccuuugauccucauauuaauaucuaaauuagucuuuuuuaaaaggcaugcacuugagacuccaguaauagaugauucaggcagcagaauaguguuuuguugugucguugacuaugcacaaugguggagcaaagacacauucuuaguuuuucaaaacacauguucauuuuaccacaaagugcccauuuuuauauacauuuaaggauuauuuuuucaaugucaaguucauguuagugauuucagaaauauagucaaaauauauagucaaauauaucuugacaggcaucuugagauuugguuuuucauuuuacuauauuuaugacugaaaaugguuuuguguuuucuuuauguuguuuauauauuuuuuaccuuaguguuuacacugguaaggcuuguuaguccauuuuuguaguuuuuuuaaaguaagcuuuuagaucuauuuguguuuuaauguuucccaguuuggguuuuguuuuguuuuggaagaaucugcuuucauuauuaaauuauaaaauguaaaugcucuaaaguaggaauuuuuaaagaguaaauuauuuguguagcuuauuaggagguucagguuagugaccauaaaguggguuacuuguacaugaaaauuugaaaugguaccauguaaaauucuucuauugucaacuuuuucugauguaugccaguucauuuacugacaaauguuguuacuaagugcuuauuaagaaguguaauacgcuauaaaaaaguuaauacuuuuuguucagauguaaggcaaagauaauugaugccguuucaguguaugauuguauuuuuaacuuuuacguuggugggaguaacuauuugaggaaauuuguggugagaauuaguaagagauaaaacccccaacaguuuauucuuaccaaguaaaguuuuguggucauggggcagggaagaguuuauuuaccagaauacuagagcccucacacaaaauaaagguaacuuggaggagggcuauaaugcuugcaucucaguauuuucauuucacuucauccuuucauaauugccuugauuauggugcagucuaaccuauuaagcaacuucuggcuaugguaacauugauaugaaccauauuauaucaagucuccaaaacaucuaguuuguuaacauacacuuucccuguucuuuuuaguuugaguccacauuacuaauacauuuuaauaauauuuaauuauuucacaauuuuaaguuuaccaaaguaaacaaaaauucaugaagaugaguauugcccucucccaaaaaagguuuaaagauuaguugaacuucccucaacuacaccuaaagcaaaggggaauuuuaguaaguguguguaccuuguuucuuucagacgcaucuagaauguuuuucuuucaccguaccuccaaaagaggcaauuuagaaaguauuaaguagugacuuuuguucaguuccauuuugugugugugugugugugugugugugugugugugaaccuugcuuuaaaacaguagcguauacuauggucauugaacuuaaucucucugguguuagaaauuuacuuuacaaaauuguguuaagacuuuuggaaaaagaaaaugaaacugcugugguaaaaaccaaguuuguuucaaaaaaguaggcaauuauuuggcuguuauauuuucuuugaaaacugcaauaauuuauauauuuguauugcucugcuugggaacuguauauaugcuugucuacuauuuuuaauuuuacaacaauaaaauaaguauuuuguuaucugcua

SEQ ID NO: 192643 - RNA, 290278 nt, Homo sapiens
ugcuccuccaagaauguauuuauuuacaugaaaacaccauuuuauacaaauugaagacacaucuuaaaagaaggguuuguccaggcaugccuuccucauccccuuauauugccacuuccauuuucaucuucuuuuguaucauaaaugaaacuucagacugguuaaagaaaauugaaucugccucuucuccccacccaaaauuacuucgauuauuuaaugucuguagucauccuucaaagaaaagucuugcccgggguuauuuuauuuaauuuauuuauguaauacaguguagaaagcgaucaugucauaagcaaugauucuguacaaucauccugcagaaaauuguuuuggagaauucuugguaauugaagaccagcagagcaccccuccccacccgccccguaaaagugcuuacaaugaacagggauucuuuucuuuaucaaagacccaaagauacguggacaaaaaaagaaaagcuugaagucucaaugccuaaugugugcacauaaaacaggcacgaagaaacaaacguguguauccucuuaauuccuauaucacaaauauagcagaagcagcaaucuguacaguaaaaugcagucauggaaaaaaaaucucucuaaagcaucugaaauacuuaaaaauguuuaacuuuaaaaugcauagugaucaggaaaggaauacuuaggcaagagaagcagcugaacucccacguucacaugaagcaucccccaucgauucuuaaagcauauguaaaguaggacuuaauugggucacaaaccacaagaauaauauacaacuggcuaaggggcuaugugauaaauaaucaggagagaaucuauucaugcacuaguuugauacagcuaaauucuuuacaguacacaaaacccauuaauaauguaguauagagaccaaaauguaaagagagauagaauacauuacugauguguggauuaauucaaguucaggcaucuacuuguguuacagcacagcugucaaaaggcgauaaugaguaaaucauaaaacggguuuguuucuucccacauuauucuauaaauggacaccgauggguagugaagcaaugguuuugcuguccaacuucagaggcugcuguggcgggggucuaguucugcaucugcucaaagaacuuguagguuggauuuucguagccguucugcugcaucuuggacagguggcgcuccucuggggugacagcggcgucaaccugaaaaacaagaggagagcugaguaaaaaauaaaaaucaaucuuuuaagggugaacauggagaagcaguaaaaagauaaggaguacaguacucuucuuuugccaagauugcagaacacccauaauuuucucccccacuuugacaucuuggagcagaacgccuuugcccaccaguuacacagaugcugugcuccaucuagccaccagguggcgguggaaaccuugacgcgcuugcaacguguccagugguuguuucugguuccccaacuccacaguaaguggauaaacccagugcaaugguauuuuuuccuccccuguuggguccauaaaggacaaacagagucaacggaagccuguuuuacguggaaguguuuugguaaaauagauaaaaccacaagaguaucauggagggagauucagcaaaguauacuguaucuugggugacacucaaaucuguguagaaaaauacucgauuuccuggacugcugaauuuagucuagcccauuucuaucaaauuuuauguuuguuaaaauguuaaggagagguuugagaaucaauuaaaacaauaacauauaccaaagggggcuauuauuuggcacaagaaaaaaggaagagcaaggacgacgccauucuagaugauguaauuuuuuaaaaacugagaauuaagauacuauagaaguauguucagcucaaaguuuaaaaucagacccucucuguuaauauguugcuuuaccucuaaggucaggccaguaacugaagacguuuuucucccccugucacuguuagagcuguguguggcauuuacugucugcagguugggcaggguacuuaccccuacaacgugggcaguggcuguucuuguuuuacuauauuuguuauaccucuccccguucgcagaagagaggagguccuuaacucugcugaaugaguauguuaaaauuccucuuuuguaaaaccaugguaagaugaagagaauaaauagaaagucaucagaaugaagaggcauguuuuccagagaaaaguuuggauguaccauagagaagauauuccuucaaagggauauuuccuagaaugggcugcucauucaucucugggagaauacugcaggcccauucccccuuguugaguguugccaagugacauuccucccuuaugcagcuuuucccccuacacaccccaucuggcauggaucugagccuacacagcaaugccccugaagccaaggaagaaaaaguaccagcgaggauguagugucagcaguaagacaugaggucucgagauggagcuagauaugucaugacuagaccacacuggcugauaacaauucagacuaaaagaucugucaauauggccgggugcaguggcucacuccuguaaucccagcacuuugggagccugaggugggugcgucacuugaggucaggaguuugagaccagccuggccaacauggugaaaccuugucucuacuaaaaauacaaaaauuagccaggcgugguggugcacgccuguaaucccagcugcuccacaggcggaggcaggagaauggcuugaacuugggggguggaguuugcagugagccaagauugugccacugcacuccagccugggagacagagugagacuccaucuccaagaaaaaaaaggccaggugagguggcucaaaaucccagcccuuuugggaggccaaggcggguggaucacgaggucgggaguuugagacacgccuggccaacauagugaaaccccaucuuuaacaaaaauacaaaaaaauuuagccaggcacaguagcacgugccuguagucccagcuacuccagaggcugaggcagaagaacugcuugaacccaggaggcugaggcugcagugagccaagaucgugccacugcacuccggccugggcaacagagggagacucugucucaaaaaaaguaaauaaauaaaaauaaaucugucaguauaaucagguccccuguggucccuucggauagccccacuucaugaagugauugacucuuuucagucugggagugagguggaaugacuaccaguggcuaaucccaaggcagcuggaauagguagauauacagcucccucaucccuugggacagaauguuccauccauuaugugcccauuuuuuuugaguuggagucuugcucuuguugcccaggcaaucucggcucacugcaaccucugccucccagguucaagugauucuccugccucagccucccgaguagcugggauuacaggcacccgccacuacgccuggcuaauuuuuguauuuuuaguagagaugggguuucaccauguuggccaugcuggucucaaacugaccucaggugauccgccuaccucggccuccuaaaguagcacuaggacuacaggcaugagccgccauggccaugugccccgauucuuacguuuccauuuauggaagagacugugcgccacugugaaucccucccaucuaccacccuguggcucagagcugccugaguuccccugcauccaaacccucagcuuacuccaaugacagaccuaggcaucuccccuuagcacacucccaccaacaagcucugaccaaggccaguacucagaggacucugcucaaauggaugcucagcuucacuguccuucugggagcaaaucacagauauuuuccuuauccucuccucuuuccuuugcugugcacuguugucaacaaaugaggucaccuggcuuuaacugguaacuguguaauuagccuccaacuuguaaguuaaaaaccaugguuaaagauuagcaccaaugaaugagagauuucauucacucuguaaaucugugugccaggagacagccuaucugcagcaguacgccauuugaacuugggcaucauuuuugcuccccaucaccucgaaacugagaacucaaagaaugcccagguuaaaaaaaauuaucuugcuuaggagaucaagcacaaagcugcuauguuucugauuguagaaaaaagccacaaugcugcuugauuguuggaauauuauacuuuuauuucuuccaggaggcacaucuaccaucacacuggcugucaacaaucauuugcaugcaucaagggcaggggaacaccuggcaauuugauagguuuaucuccucuucaaacuccaaagccuaacgcuuaagagugcccugcuagagaugcgaggcuccaaggcuggugcacaauccagaccucuaacucuccugucuuuucuuggcuucuguuuugcuacuugauaauccuauuaccuuuugccacugagaggacagcuacauuuugccauuccugccauggggcagcuuggcccucagaccuuagagggcuuaggagcuacagaagaagggauuaucuugacaaaagggcauccaaggaguauggauuggaucuuuaaucuccagccccuugaaagcuagaugcgaaaaucugaguacucaugucuauggauaaaggaggagcaccaaguaaggguagccuuccucuccagcaggcucaccaaucucuuccucauggcuaagcuacagcaguggcaugggccaccaugugaaggccagcccuaccacgacccugugcagacagggccucugcacagacacaauauuauuucccuuaaagcagagccagggaggguuugagcccauggugcuuguucuggaaggaaugauaagacaaugaagucagaauuuccauuuuccaacugggcaggaacaucugucacuugcugggaugaagacacacauacauacaaccacugaauauucauucucuucccagacugccuggauuacacagcagcaggaaaugaucugaggucuucaugugacucucgguacgcugcaccuuccugagaccuggaccccugcacugcaugguggcauggcuucaacuggcugcugccuaugacacacgcugaaaagagcugagcccaaauagccugaccagccuuguucuaaaauagcuuugaggagaacguuugacacucuuuggcuaaccuccauacccccugacccuuuucucccugaacuugauucauuggaaccauuuaguccuucacuguauccagaguaauuuagagcucagcuauccgccugcagggacaagauucuauuugggugaccuuaguuucuaggucuccuccuauugccccuagaguauuuacaugcgggugugugagcuuggaggagaggcaggaaacaccacguuuacauuuuauuauguacaguaaccagcaggauguggauuaauagauguccuuuuauacaagggacugagucaggccaaacgacagaauccugucauugagauggaccagacgaguaaaggaggguaagggaacuaaggcgaacaauacaacaauagugugacacaucaaaggagccacaagucugcggaaaaaaaaaauaaaagcaaagaaaauaggaaguuuucaagcuagugacuuaucccucguaaccucccaguaacugccugcuaccuaguuguauagaugcuuguuuuccuaauuuugaugccaucucucuauaguuauauauaacuagaaggcaguugacuauguuuauggccaacaucaagcaauucuucaggcagguucaggaacuccuuugcuaucccuucauaauuuuuuuuuuuuuuaagacagucuugcucugucacccaggcuggagugcaguggcgugauuuuggcucacugcagccuccaucuccuggguucaagcgauucuccugccucagccuccugaguagcugcgacuacaggcgcaugccaccacgccuggcuaauuuuuuguauuuuuauuagagacagggucucaccauguuggccaggcuggacucgaacuccuagccucaagugauccaccugccuuggccuccccaaaugcugggauuacaggugugagccaccacgccuggccugugaucauuuuugaugcuuuccuuugaucuuccaauuucucuuccugcugcucacuguaagccacuccuagguucugcacccccccucacuuuuccuuaucguggcuuuccauucaaccugaccacucucuccaacuacucuacaaugccaacgucagugcgucuguauccuggugggucagcuucuggccgggaagaaaggaccucuaaggacaucuuuuuauacagucaccagugugacagcauauuacuuagaaaaagucauaugccauaccuccauaaaagccaaauaaaaggaacucucuucuuauuuagaucauuaaugagauaaccaggaggugggggcggggagacuucugguguucaagugaucagaucugugagaggaaaacuuuuucacauccuauaauaaagagaagcugugcccccaacuucuccuuauuaaaggugacaugucuggggagaguagcagaaagagcuacaauacguauuuuuaaauauccagugucuauguaugugaauguagaaaaguaccgcuugcuacuaaacagauccugggauuagugggcuuugcaggaacguccuaaaacaggagcaaggugguuaauucagcuagugcugagauuuccagccaccagagggcuauucugacauggagggcacauuuggggagugguaauaauaaagggcuauugcuucacugcuugaagcaccaauaaggcacaguuaccuccuugggaaagcguggccaauggcucacagagugacucucuggccuuauggcuaaguaaauucaguaagucaauauuuccugcuuauuugaaaaaaaaaaaaaaaaaaaaaaacaacaacuagcaagugcucauuuccaaaugcuaacaacucuaccaauaaaaauacaguuaugggccacauaaugacauuuuaguccacgacagaccaaacauaugaugguggccccauaauaccguauuuuuuacuguaccuuuucuaguuuguuuagauacgcaaaucccugccaguguguuacaacugucuauaguauucagugcagcaauaugcugcacagguguggagccuaggagcaauaguuguagguguguagcccagguguguagcaggcuauaccaucuagauuuauguacauguacuuuaugauguuugcacagcgaucaaaccgccccaugccacauuucucagaacguucucuccagugugaagugguaugugacuguucuaggcuuguuucauuuauacauuuguucucaggaguuuuuuuccuaggguuccuaucucugugaucuucugcgggcauuuuucacucuaaaaacaaaaaaucuccuggaaaccaaagcuuucaucaugacuucuucaggcacgaugguauguaaguacaaugguauucuguccugagugacugaggugaguccaacuggaaauauugauguacucauuuuuguucuuacugaaguaggguuacugauuaaugaagguuagccagagccggaaauaaagguauuuccauguacuugagggugagagugccuguuaagguaggaagaggauguugcagaagcaucacuucugugggugcagacgcuggaaugcuaagaaaaauggugcucugaaagcccaccgugcucucucaccugggaacaucccuaggcuggguugcaacucccuguguucagguucuaccaucccagcuaaacuacaucuuuuuugaggacagaaaagcggaauguggucuauuucaacauugcuguacagacacacuauggggcugcacagagggcugcuuucaggaaggacagucacaaaggucuugaggggaaggagcugagaggaaauaaacaaaacaaacacgaaugagguggagccccucaucuagaaaggcuuccaguugcucuccaguagacagcaaaaugaggagagaagagcugaacagccauccuucccgauuuugcuccugcaaggauaccuccuggcuuaaaaauuaaugucagaaucugggucaaagugucaacuucuccucugacauuuuaaguccaaugagacacugcuugguaaacugacuaaaaaaagagcguuuuaauucaggcagcuggaagagcacuuaaaaggcaaccgguuaucugggaggugagagauaccauuuuccacucccugaggcuugcgcggagaacuaaaaggaaggaguguuaaaaugaugugucagggauucucaaauccgacugcacaucucauucauuuggggaaauuuucaacacucagauucgcagccuccuauuuggggauucuuuuuccuuaggucugagguaggaccuggucucacgcacagccaggggaaggagcuccagguggaggccuugcuuuuaugcucagcaucacuggggucuguuacgggcuaaaacgugucccccuagaauucauauguugaaguccuaagcugccaguaccuccaccugugacuguauuugcagauagggucgaagagguuauuaaaguuaaacaaggucaucaggguugauccuaauccacuaugacugguguccuuguaggaagagguuaggacacagcagaaaaacagagugaaggucaugugaagauacagggagcagacaggcaucugcaaaccaaggagagaugccuggggaggaaccaaccuggcugauaccuugaucuuacacuccagaaaugugagaggguaaauuucuguugcuuaauccacccaucuguguuacuuuguuauggaagcccgaggaagccaagucuuuggccucuggcaucaaagaaggcaacuucaacggacagaccggcaacaaagagaauuauauuaaauaaacuaaaaagugcucuugaaggccaggcaugguggcucaugccuguaaucccagcaccuugggagguuggggagggcggaucacuugaggccaggaauucaagaccagccuggccaacauggcaaaacccugucucuacuaaaaauacaaaaauuagccaggcguggugguaugccccuguaaucccaguuacucaggaggcugagagugagguaggagaaucgcuugaaccugggagguggagguugcagugagcggagaucaugccacugcacuccagccugggugaaagagcaagacuccaucucaaaaaacaaagaaacaacaacaacaaaagaaaacaacaaaaccaugaaaaaaaccaaaacaacaacagcagcaaaaaaggggucuugaauuacucaaguaugaagacaucuuuauuugcucaaauauggaauuaaauuuuuuuaaaaauuaauuugagcagaaaugaaauaagcugauacuaaugaaaaccuaucuuacacuguuuugagggacauaagcuuagauacuaucacaaaaggugcaauggccaaacaugacaguggggucauugcuuuuaugugcucacacucugaucuaugggucaguccguuccuuuccacccugcugccugcuguucucuugguuuccuuccucacacugcucauccacgucaguaugaauggggaaaugaggcuccaccccaauuuccaucagcagcuucuguuguagucugcagagguuuuaauugcugagcaaaaugaaauuucuggcuucaccacaaauuucauuuauuuaaacucugccuguccucuucuaaucaagaaugguuuagagcccauuuccuuggggauaguggaaucuucaacucccuagaaacaccuggacuuuucucugauggaaaaagcaaugggggccagacgcgguggcucacgccuguaaucccagcacuuugggaagccaaggcggguggaucaccugaggucaggaguucgagaccagccugaccaauauggugaaacccugucucuacuaaaaacaaaaauuagccgggcaugguggcgugugcccauagucccagcuacucaggaagcugagacaagagaauugcuugaacccaggaggcagagguugcagugagccaagauccagccugggcaacagcgcgagacugucucaaaaaaaaaaaaaaaaagcaauggggaauaugaggggaaaucuggacucugagcuugaccuugcauaauuugaacccuucugucucggccucaguucccucaucuacaagaugagaagaucaauuugauuggucaucaucaauaaaucuuucagcucuaaaaauuccauaacucuuaaaauaucgcaauuaaaugucacacaaauuuuucaguuucccugugcauauaaaaguuauguuuacacuauacucucugcaagacaguuuccuaaaaaguugcauauacugugagauuuuaacacuuuuucccccauccaaauggcauuucaaaugcauaaaaauaacuuauucguaaauuuucuuucucucuuucuuguuuuaguauagcaccuugaaacuaagauauuucagguggaagugcaggguaauagguugcagaacucucaaauaacaaucauguauguuuuggugggccauuugguauagugugauuuccugagaaacuuuaaagguaagagucugcacugaaaagucacauuauuuacuauuaccugguuguauugagaggccagacuauuuaagacaaaagaaauccaagaauaaacauguuuaguuuuuuuggaaaaagcaacuuccuacuucuauuuuuauuuuuaacuucuuguacugguuuuuguugcuuguguuugaaaaaaaaaagucuaagaguaaucaugcuuuuuuaaagucaugcauuaucauuuguauuauuuugauaacuucaacacaaauuguaaguugagauaacaacacacacucucaauaccuugagcagaauauucacgguaaguugcaaugaaugaaaaccaaaacaagaaagaacaacuguaacccaagcaucauggaagcacacugauucguuuuuuaaaagagauacuuagcuaguucuuagcaaaaagcuaagccuaauucucucauagucuuaauucccacuuggaaacaugcagucaaguuuaccuaccuccaccacaccaugaugaauggauguguacuguuucuucuucagcaucaccaaggugaugacgaucacugucgcuaugacaacaccgcccaccaugaguccaaugauugcaccuuuguuugaacccacaucuucugcaaagaacaccuugaaaacaaauuaagaaaaagaauuuuaauuucuaaaugcaauauaauuuacaauuuauaaacgcaauuagaagaauuucauuucuuaaaugcaggggacauuuggaugagguuauauaaaaaguuucaguauauucucugcccaacugguuggucaaauauuugaugcuuacuuuaaaaaaaaaaaaaaaaaaagaaaucacauauuuuccuacuaagaaugauaaucauaguuuauagaaggauguacaacauguggcuuccccaguucgaggaagucuacuuuccccacaggucaaaaccgaagucugcagggaccugaaacccuuugacagguggaacauuuggugaguggugggaagauagcgcuuggaucuaucaaaagcuggaaaggcacgaucauacuaaugaaaggaggucagcauuuuccuagucauagcacucugagcccugaugugugacucuaagugacugagacuuagguguuuuucaacucugcagauguccuaauuuccuuggagggacacuuuuaaugcacaggaauaggcauucugaaacaaaggaguuaaacaauagaaaaaaagauaucuuguuaccuacuuuuagcuauaguaauucugcagaauucuaauuaaccuuuagcaguguaaugcuuuuuaaagcauaauguuauuucaaagugaaguacaggcaacaagaauuuuaagucacucauaacucaugcuuucuaacuauugucuccagaaaccaaaaucugaaauguugcuuuauucuugcucuuuauuuggauuaaacauaaaaauaauuuugagaacauuguaaagaaggaauaaaauuucauuuacugcacuacauugcuucauacuguuuauaaaagcaagucauuauuuuucaacuuuaucuacuugaaugaaauuauagaagcacaccacaacuuuuaucaucuuguuauauaaggaguugaucuuaugccagaugaaguaaaacuaaagcuaaauauuaccacguuugcucugcaacuuaaugaaaauacaggcauacauagcuuuauuguacaguagugcuuacagauaguauuuaaaaaaaaaaaacaaaaagguuucugguaacccugcaucgaacaagucuauuggugccauuuuuccaacagugaacacagguucacuucaugucugugucacauuuugguaauuauuuaaauauucaaacauuaaaaauuauuauaucuguuuggugaucugugaucaguggccuuugauguuacuauuuuaauuguuuuggagugucaugaaacaugcccauaaagacagcaaacuaaaucaauaaauguuguguguguucugucugccccccaaacuggccacuccacccccucaacucccaggcucccuaucccuugagagacaacaauauugaaagugggccaguaaauaacccuacaguggccucuuaaguauucaagugaaaggaagagucacaggucucucacuuuaaagcaaaagcuagaaauaauuaagcuuagugggcaaggcauauugaaagccaagauucuugugccaguuagccaaguugugaaugcaaagaaaagcucuugaaggagauuaaaagugcuacuccagugagcacacaaaugauaaagcaaaacagccuuauugcugauacggagaaaacuuuuaguugucuggauggaagaucaaaccaaccacaacauucucuuaggccaaagccuaaucaagaacaaggcccacaacugucuucaauucuaugaaggaugagagaggugaagaagcugcagaagaaaaaaaaguugggagagguugauuucaugagguuuaagggaagaagccaucuccauaacacagaagugcaaggugaagcagcaagugcugauguagaagcugcaauaaguuauccagaagaucuagauaagacuccugaugaagguggcuacacuaaauaacagauuuucaguggagaugaaacagacuuauuuggaagaaaaugccaucuaggacuuucaucacuagagagaaguccugccuucaaagcuucaaagaacaagcugacucucuuguuaggggcuaaugcagcuggcgacuuuguuuuugaagccaagacugaccauuguaaaaguccuagggcgcuuaagaauuauucuaaaucuacugugcccaugcucuauaaauggaacaaaacugggaugacagcacaucucuuaacagcaugguuuacugaauauuuuaaacccacuguugagaccuacugcucagaaaagacucauuucaaaauauuacugcucacuaacaaagcaccuagucacccaagagcucugaaggacagguacagggagauuacuguuguuuucaugccugcuaacacaacauccauucugcagccuguggaucaacuuucaagucuuauuauuucagccucuuauuauuucaaaauauauuucaaauauauuuuguagggcuauucacugccauagauagcgauuccucuaauggaucugggcaaaguaaacugcaaaccuucuaaaaaggauucaccauuccagaugccauuaagaacaucugugauccaugggagaucaaaacaucagcaauaacgggaguuuggaagacaaugauuccaacucucaugggugacuuugaggaguucaagacuucaguaaaggaugucacagcagaugugguggaaauaacaagagaacuagaauuagaaguggagccuaaagacaugacugaacugcuaccaucucaugaucaaacuugaauggaugaggaguuaccucuuauggaugagcaaagaaagugguuucuugcaauggaaucuacucuuggugaagaugcuaugaacacuguugaaaugacaacaaaggauuuaggauaucacauaaacucgaugaagcaguggcuagauuugcgaagacugacuccaauuuugaaagcuguucuacugugagcaaaaugcuaucaaacagcaucacaugcuacagagacaucuuuuugugaaaggaagagucaaucgaugcagcaaacuucauuauugucuuauuuuaggaaauugccacagccaccacaaaccucagcagccaccaccuggauuagccugcagcagugaacaucaaggcaagauucuccacgagcaaaaagauuaggacuugcugaagacucagaugaucauuagcauuuuuaguaauaaaauauuuuacuaauaaaaguaaaguauauacauggcuuuuuuuuuuuuuagacauaaugcuauugcacauguaacagacuagaguauaguguaaauacaaacuuuuuuuuuuuuuugagacagagucuugcucuuguugcccaggcuggagugcgaucucggcucacugcaaccucugccuccugggaucaagagauucucuugccucagccucccgaguagcugggacuacaggcacaugccaccauaugcagcuaauuuuuguauuuuuaguagagauggcauuucaccauguuggccaggaugcucucgaccuccugaccuugugauccaccugccuuggccucccaaagugcugggauuacaggcaugagccaccgugccuggccaacauaacuuuuauauguacugggaagccaaaaaauuugugugacauuuuguugcaaaauuuguuuuauugugguguucugaaauuuccaagguaugccuguaccucccuaaaaaauucuuucaauuuagccucaagguagucaaaugacugauuuuucuaagcugaaacuaacauacuagcaaucuggaaaggcaauauaaaauauagcaaaugaagcaacuucuaaaaguguuuuacucgugguuuauaacaaaaugagaaauuguucauaauuauucccuuuacuaaacaaauaugcuagcucaacauuuuuaugaaaagcaaaucauuaauuagcuaauauacuagugugagguaaucaggaauaaauacaagucuggacauaugccugugccuuuaagaaaauacuguaauuuuguaauauucauugcacuaauuauaauacauuaucuuaacuaguccaguagagggagcugauucuccuaauugcugccgcugccauuagucacugucgcauuauaggcguuaguguaauuguggggaugggcuuauaugacacaggccccaggccccgacaaaugcaaaucuguacauuaaucgucagcuuucuaccccaccaacucuucaacucuuuagugguuccccaguuuuuauuaaccucuucagcaacagccucaucaagagaaacccugaucuuauaacaacugauacuagauuaucuugccaaugaaaaccaugcuucaaaaagcuaaaugucuuucuacaaaaaaagaacuaugggaguuaagaaugcaaauccaaaucccaagucaguuuuuuauuugcuacaauuauuuggagucaaguaaggcauaaauaauaauuuggagguguuucuuuuagagauuaauacuaggauuuaucaacuuuaugaauauugaaaagacauuuucugcuuggaaaaaaguaacacucacacacacacacacacaaaacaaaacaaaagaagugccugagauaacuuuaaguauuauugcuauggaaauuuucuuaccauuuuucuguccaccacugaaugugauaaaauugucgucuucauuaauuuaacccucuuacugcaccuacugauaagauggaacccuaacauaauccacgauuugauuuaucuccauuucuaagcuuuugguaaaggauuuuauauaacuacuagagcugaccacaaaggagauguggcuuuuugauuuacuccaauucuaacauuaggggggaaaagugauuucaucugaaaaggaagcugcugucuucuuugcacaaaccuuuugaugaauaacacuaucgggaacaucaugggguccugcucacuccaugaucuuacucuugcaagagaaguuaaaucaugggagguaggggagggaaugaaaagaaagagcugggggagaaaugaauggguaaaggaagacaguuccggaugugaauuuaagccacauaaaguguucuguaaaaccaagcaguguaugcauguguuugauccuucaaauaaaccuauuguaaaccuauuuucccagaaaacacaguggaagucaaaguggcugcuauauugaaauuaauuccacuuuaagucccgagucaugcacgaacuuugcugccuuguagucugaaagaacuauacauacagccucuuucuuuucuuuuuuuuuuuugggauggagucucgcucugucgccuaggcacgaucucagcucacugcaaccuccaccuccuggguucaagcaagucuccugcgucagccuccccagcagcugggacuacagguguuugccaccacacccagcuaaucuuuuuuguauuuuuaguagagaugggguuucaccauauuggccaggcuggucucgaauuucugaccucgugauccacccgccuuggccucccaaagugcugggauuacaggcuugagccacugcgcucagccuagccuauuuauuuucuucauguuuucaugguaauccuauaggcaagcauuguauuuuuaucuuuuccuuaauuugauuucuagcacaggaugaaccagaguuaauaggucauuuggcaagacaaacaguaguggaaagagguaaauuauuuuacguaccaauuuuugaugaugaacuucauauccugagucaugucggaauucugcauccaucuucacuucagagaucuccuccgucuugauauuugucaacccagaaccuguauuacaucauaauuaaaguaugcaggacaaccaauuaguuuuacucauaaauaauaacacuguaagacaaagccuacccaaaacuucuuucuaggccugaaguuagaagaaaauugauaaaugacucuuaaagaaaaaugauacccuauauuuaaaacuucaauuacuaccuauuuugaacaaaaagaaaugaaaggguaagggaaaccugaaaguaaggcuucugcugccuuuaaauacaugcuauaauuuuugaaaaugggggaaaagcagaaguuaaauccugguugagagguuggcaaggauuuguuccuggaauauguuggcuuggcuuacgggcuuauuguuuagccuauuaugugucuuuuuccaugugcacucauuacuucagaaauaauaauaaaaggcuuuaaaaaugagcauuaauuaccugguagaacaaaacugcuacuuuggggcuuuguuccaauuacaaauaaauuauguucauguaucuaugcagugaagcguuguaaaaauuauauaauuuuagucaaguguucuaguuacacagauuguaauugguucgucugcugaauaaagagcuauaguacauaauuuuaaaaaugcuucuuagcaacuaacagaauuuauaaccuacgaacucuuccuuuucuauaaauugcuauaugauucuuaacacuaauuguucugaugaauuucauuauucaaauaauaauuugaagcuuaaaacaaaaugcagagucauuuaaaaaccaaaaacauaaguaaaaaauguaaaugucaguguccaugcuauaacauuuaauuaucaaacaucagaauuuuaggaugaaaagggcuuuugaagucaucuucucuaccguguucccacccaggggcagauugucaguuccuguuugaacauagaggaauguaucaauuucccuccauuuuuugauagauuugccugcccaaacuguccuuuuuuuacaugaagccagaaucagcuucccuguaacuuccauccuuugagccugauucaacacagagcaagccuaauccucccuuccacauuaaaaccuugaacagguaucacgacccuaaggagaggcauguuccugcugguucuugucuuacuugggcuacacauucccaauuccuuuggcucccaggggaauucacuuccugcucuuggccuaaucacucuuucaaucuugucuacgagauucugggaaacuugugacacaucuugcugacacugaaaagcacaauguccacagcauaugaugugccagucuaagagcacagccuauacaaggagaagguaaggauaaucugacaaaaccuaggaaauccacgcugguugugaccuagcaccauuuccucauccaauuguucaaaaagcuuccacuugauaaccuauuugaaaagagacccacaaucaaugucacucuauaccuggcuuacagauugugaagcuaucuucucuccuuuuugcuauucagaacuucauuuuccuaucccuaccuucccagcuuuccacaaagaccacaggcaauggugcuacuuccccuucaaguucucuuagccugcaguuggucugggucauaagaacuuggacuuggguagcaagaugucauaguuuaaaauauauccacaaauuugcugauacuccuuccuucaagagggagaacuugauucccuuccuucgaauguggucgggauguagugacuugcucuagugaacagagcaugauagaagugaugguguaugacuucugagacugggccaaaaaaggcacuaaaacuuccuuaaucucuuuccuggaccucuuggugcaggggugcgagaugccauguuguagggacgcucaagcagcauuacagaguucacaugguaagauacugaggucucuuaguaacagugacgugagugagccacguuggaaacagacccaccagguccaaucaaaccuucagaugacuuuagcucaggcagugucuuaacugcaaccacaugacggacacugugccagaaccauccagcuaaaccacaucccaaauccugaccuauaaaaacuguaagaaacuaaugcuuguuguuuuaagcugcuaaauucucgcguuauuugcuacguagcaauagguaacuaaugggcuagggcuuucuuuucucauguugaucuaucucgggcuuuaauuuccuuucaucagaaguucauucucuuuaauauagacauaaaaggcacaauggaagugggacaguuucccuuucucauucuuuaacucugguccucucaaugaccuaacccucaacccccaacuucuugcuacgagacccacagaguucucuauucuuauuuauuuucuuacuuuaauauuguuaaguauuuuuugguuaaguuucaacucauucugcugaaacgaaccuuucugacacuuauuuuuauaggguagugaugcuaaaacucucuuaauucucacuggcuguauauuuuaaucuuucuauagcccuuuuaaaucugagauccuuauauaaccagugauuucuuuagagcucacuccuuuucuguuauuaagaucuggcaacgugccaagcacgguggcucacgccuguaaucccagcacuuugggaggccaagcuggguggaucacuugaggucaggaguuugagaccagccuggucaacauggugaaacccugucucuacuaaaaauacaaaaaaaaaaaaaaaaaaaaaaaaaaaaaaauuagccaggugugguggcgggugccuguaaucccagcuacuccagaaggcugaggcauaagaaucgcuugaacccggcagguggagguugcagugagcugagauugugccacugcacuccagccugggugacagaaugagacucugucuccaaaaauaaauaaauaaauaaaagaucuagcaacacaauagguuagaacuauauuucugagauuuuuaagaaaacuuucuugaacaguuugaagagucuucccuuuuagauuuuggagccaaauauuuauacugaaaaauaaaaguaaagaaugagcucuggccgggcacaguggcucacaccuguaaucccagcacuuugggaggccgaggcgggaggaucacgaggucaagagaucaagaccauggugaaaccccgucucuacuaaaaauacaaaaaauuagccggacgugguggcaggcaccuguagucccagcuacuagaggcuuaggcaggagaauggugugaacccaggaggcagagcuugcagugagccgagauucgugccacugcacuccagccugggcgacagagugagacuccaucucaaaaaaaaaaaaaaaaagaaugagcucucggccaggugcagugacucaugccuguaaucccagccuuugggaggcugaggcgggcaaacaguuugaacucaggaguucgagaccagccuagccaauauggcaaaacucugucucuacuaaaaauacaaaaaugagccaggugugguggcacaucccuguaaucccagcugcaugggaaacuuaggugggaggauagcuuuagcccaggaaauggggguugcagugagcugguaucaugccacuguucuccagccuggaaacagagacaaauccuguuuuaaaaaaaaaaaaaaaaaaaaaacaaaaccaagagcucuccacuaaaaacuuuacaagcccacacuacuuuugaaaugauacugugaauacuuuuggugguccaaaaaaaaaaauucauauuaucaagucagcaugacagauaaauucauguuuacagcucaauaguuugagaagcucuuggcagaagagcucuugcuauaauaguucauguuuguuuagcaugaauagucaucuagggaagacuuuuuacauuaagcaaaucuuacuaaaagacaaaaucaguaagcuggcacauagggaaauauucauaauaaggugauaaugcauguaauaaaaugugaugaguaguuucaaauaaauggcagggaccuugguuugcaggcuuacuuagaggucuuucuugaguugugcugauuucacccuaagcccuggugacuccagcucucucuuccuguaagucaugaugaguggacagagccuuuuguucaugugggggcuaagggagguauguccuucaugacaccucuugcauggcucgggucaaggaccugguuucccuuuauuuggacugcagaaggguggugaugaauuguaacagaaaggguagcuuucuacccuaugugaagagcucgcuaauguguuuuucuuuuuuauucuggucaaacuguauaauuaguccuucagagucuauuuuuucuuuggaaguaagccaggaggaggagcuauaauggccacuaugcccccaaaucaccacuguuauuacaauggucccuacuugacacugcaugcuggaagcuaccauauucuguuuuuuuagauaugagaguuaaggagaagccauuuuccucagucaugauuauaaagcacugggugggggaaaaacaaaaaccuuuuuuuaacuuguuucugaggacaacagugauuauucaaaaacaaugccaucacuugaacggcaugacaaucuugggaaggcuuucuaaguuuggaaaggcuaaagauauaauucggcacauuagacucaaguggguggucucuaaaaugugaagaagaaccaaagcuaugcuacaaaacacggggaaauuagcccaaauguuugauaaacuuacuacaagcacaaaaacagaacacacgcauggcuuaauacaugugcaguaaauacugcuauucauagacaaaccuuaacuagaaucuuccucacuucauaucugagcauucuuucucaacuuuagccaucuuacugggcaacccaagccuacgcuguguaugaaaggaagcuuggcuuaggccacccucucuucugaauagaauuguucccuucuucuuugccaauccaggugccucaaaucuuucauaaccucucuggaagcccaucuccaguaaguucucuacuuaacaugccccuggguuaguacuccaucuccucccaucacagaacauucuuguuagcacuuaauguugcuuuguauuuccuugucuuccaaauuccaucucauguuuccaaauaugcaaaauuccuucuauuauaccucaagcuccugagagcagggacccuaccguuuaauuucuuucaaaccuagaaagaauuuaguggauugaucuuugugaaauccccaagugacaucauauucuuacuguuaugagaaagguuuuggaugguuuucucccaccaguguaauaccauuaacuauucucuagcucuuccuuuaaaacacacuguuuuuguuugacagcguuuggagguguccuuuuuguuagauuuagauuaaaaaaaauuuuuuuuaaaagaauaggccgggcauggugcuuaugccuguaaucccagcacuuugggaugccgagguggguggaucaccugaggucaguaguucgagaccagccuggccaacauggugaaaucccgucucuacugaaaauacaaaaaaauuagcugggcaugguggggcgcaucuguagucccagcuacuugagaggcuggggcacaagaauugcuugaacccccgaggcagagguugcagugaguugagaucgugccacuccacuccagccugggggacacagcgagacuccaucucaaaaaaaaaaaaaaaaaaucaaaaaacaauuuuuuuaaaaaagaaaaaaacauugacugguagugucaccugguccuggauguuucaauaguaacauauaggcucuccuggcccaauguagaaauuugauaaaauugaaugagucgaaugagcgcuuucuaaguuacauuuuaugcuuguagaugaagagcaugucuuuuaaagagaagcaccaugaaaaaagucccaaggcaaaugaccaaccugagcuggcugugguugcaauuagaacugaacugacccucagcccgaggccuuacaaguuggcugagcagaacaggaaugucaacuccuggcuccuugagauucccuuacaugacauugacaauaaggaggacauuagaagaacugaaacugucucugacucacuauaauuuaaguuccccuuaaaagccuacagacagaaauucauaaaucaacgagaccagcugucaagacgugucacacuacugucucugcugccacuguuaaucacagcauaaaggcaugaagaugccacaggcagacucucagucuucaucagugaccgugcuuggaggcagucauggcucgagccugugguggaagugugagggacagggugggucuccuggucugcugcugacuguaucugaaccaggcagcaaagguugaccucuguguauuaauaucuucaaagaaaguuaauucccuguucuuugacuaucgccuggggacauuaugaggauaaagaagaaaauaaauauggaaaaguauguguuauuugggauuaaaaucucccuggaauacacaaauuugucaauucaauaacuuucuuccucuuuuugauucacugaaagcacuggcuacuaucaguugggugagguuguucauagaguagacaccaggcacauauaugcuucugcugugcuaugacauuauucauaaaauaaaaauguguuucuucuuaauguuugugaaacuguaaaaaaagaagugucuauuucaguguuaaugggauuuuuaaguaauacauaaaaaaagggcuuaugugcaaaauuaugcauccacaucuguuguguuacuuuagccacucauugagaauaaguacauacaacccacaaaacagaagauguauuuugggcucuggaaagaaaccaauucugguauuuucaggaaaucaugucuacuucaguaacugauugaaguuugagcccaguucaguuagaaaauuacccaucuggacaccaaacaagaaaggagagauguucacacugguauccaagucaucaccugagagucuacaucuaucugggcuucuguuuuuaaggacaggcuguauauaaucgucucuguuuuuguuuuguuuuguuuguuuuaaagaaaaaagaaaaaaaaaaacccaaauuuggaagggcucucuuuuagguuucaaagggaaagcucagaaacaaaaaaaaucauuucacucggaacuugggaaaugaagaguaaggaauagucaaggggaauuuuuaaaaguuugguuucuaaggucacuucaaauucuacucugcaguaaguacaauugagagaggcuuaaaaugcagaaaggagacaacgucugcucgagcuuaggcccaagaugcggagaggcacaagucaagcgguucugauaccuggucgaguggucaguccucggucggcagcagggcgggcaucaacaggcucaacugggcacaggaagcaagggacacagaaagcaaacaagacaaaucaagaugguaagucguggcucccaaacauagucgagcagggaaaaaagcauaugcaauaaacaaguuacaaaaaaggagcagccagaaaagaaccacagugaguuaaucccgagcaucgaggaccaggaggggcaccacuuuaaauggcuuaucgcuauugaugugccaguccugcuccuuaguuuucuaauaaaagcccucaccaggauacgcagcaacaucaaagaagagggguggggaggguggauuucccucugagcuaguuuagagauaguuucuuggcuuuugauuagaaauaaaauauucccagccuagcagaaaaccuuaaagauacuuccuuuuacaacugcccaaucuuaucuuauuuuacaguuaauuaacuacaaaaggacucuguuaaauuuccaggggaagugcaaauaugaauuuaucaggagagcaaaguuuuacuauauaaucugccauuuagugagugaaucaaauuuguccuuaguaugagggcagaagagggaaaccgcagucuuuuucucacuuuuucaaaaaggcuggcuuccauuugacagaugacauacagcugaaacgugugaaaugaggauauuucauuuuauauuugccauuguucacaauuuucccuuuuuauguguucuggguccgacccaaagaaagcaguguggacagcaugauauuccucaccaucaucugaccuuuccaaagcacuucugaugcucagaaaauacuuccuuguuuuacgcuggcguuugaagaaacaaggaauggggacaaaagugaaguuuuuaggauuaauaauggucauaggguaaaugaagccacggagguaggugcagggggaagcugcuuugguaagguggcaaguguaaagggaaaaagguaagacaaagugagcacaggugcugaaggagacacggugugcucgaugaaauggcuucuaacaauuucagcaaaaccauccagcuuacugaugcacacaggccaggcauucaaaggugggauucucaguccaaaucgauuuuggaugccacauguuaauagaaacagugagggagaaaaaaaguggcaguaagccaagucuccaaaauauaagaaaauauuuccgggagcacuaggauauuuggaugaaauaaaaauuugguccuuucucauguagagacuggcagcaugguggagucaaaaggagggugaggcaucuaaucccaggccugggcccaacauuuacaaugucuguggccuugggaugcgccacuucuguggcuguuucuccauauggaaacagaaauguuaacaucugcaucuucuaauuauggugaggaacaaauaaguaaccuuuaaagccuguuugagacccuaccagauacuacagaacugcacugauuaaauauccuaugauuaaauauuccauaguaacuacugaugcgagagugacuauucucuaguauuucacuagugcauuagaggaagacauaguucacuuccuucugcaacucccaaauacauuucgacaaugagguuugguuuuucuauacuucauuuuuuuuccuauuugcagcaaccuguaaugaguaacuguauuacuccuuguaaaaugcaguuaguugaaaggucauuguacuuugugagaauuuccugaugaugagggacccaauagugcuucaacugcaguuaagaacacaacagaccacaugcacgagggcaaacgcguaccuugaagugguggugagcacauacaucaauaguuacguuauuagaaaauguauaugcaacucggggcaguaaguuaaguguaccugugguuuaaaugcaggcugaggagcugguagucccacgggccacugcuaaugucaccacuuacuuucucugugaucuggggcuaaucacauucuuucugaacuucaguugugucacaaaguaaaugguuuuuccaggguucaaaugcguauacuuaugugaaagaaacuuacaaaugauauuguccuauaaguuucucugccucuccccgcucuucuucuucuucuucuauuuuuuuaaauaggcauguauuauuuaaaaacaauaauaaaacccuaacccuauuuuuuaggaagauuaaacaaaacuaguuucagugacauaaacccuaaucugcuuuaaaagauugaagcugauuuaguauaaauuaaugcucaaaaaauaaguagcucagggagcagacauuaaaaguuuuuuaaaaggcaauuaugauaucauugccgaaaaaaaagaauacacaccaacaaaacaaaguaguguguuauuucccaauccacugcaaauacuuuccaauuuuuccaauugaccuuuacuuaaccagacaguaacuucaucaaugaagugcuaaaaaacaucuuacauuggcuguuuaguaauuuaaaaacaagaaauacauuaucuuagcuuuaacuuuuaauagaguuaaaauaaaauguaagcagaaaugaguuauucucuugcucucaguagcuuugaaucaaauccuuugcuguaagaggagagaaacagaauggucagaccucugggauuuuugagucuguuacuucugguauucuuuguaauaaaccucaacuauuaaccgugcugccuuguacaaacucucuaccaggccaaagguaaugaggaaucagcaguacaccaguuuuacauauagauaagaggcugacaagaacugguuuguaaguuuaaugaaauauuuauuuaaucuaaauuucaacauuuaaauuggcuuccucauugccucuauaaagcuaguuaaaaauauacuagaaggcagcuucacauuuugcaaauacauccauacaagucuuauaagaccugcuuugucucuuuaaaaauauuauuuuaucuacauauuauaucuagguauuaucuacaaagaggcagacuguuggccacaaagacuugcuggcagucacugcaugcuaugcugcucuuuguggcugcccuucucaggcagucaggaaaaaguagaacaaacacaaaugucaucaacgcuaaugcuuccagccagaucauuucacgaucugugagcacaauucuguaacaacagcuucauuucagccuagccauucauuuagguuuuguggaugugaaaaccaaagaauaaaaaauuguuaaggcaaaucacagcacauuggaaaacucugauaugcuuauuuucuucaauguaaauuuaaaaaaugggcaucagaaccuccucuggauuucacugauuguucuuaagaaaaacaacaaauuuuugguaagcauuugaaacuaugauaaugaggacugcaugaagaacaaaaggaaauccuuugagaauuuuagauauuuucaguaguuggguguaugugugugugugugcacaugucuguacaaagaaagacuaacaaguuucuggggagaggugggagacgguguuagaagagagacggcuuuaggacuguaucucauuauauggcuuauuauauucauuauuuuaaggauacauuguugaggccauaaggugauucaucuugagacaggcugauaaagucucucuaauaagauccuggcuccauuaaaaaaaaaaaaagcuaccacugacauuuacuacguuccaggaauuuugcuaagagcuuuuuuaugccuucuuauuuaaugcucauacuauaccucugaguuaggaauuauugucaaccuuauuuuacagacgaggaagcagccagagaggcuaaguaacuugcucagaagcacauagcagggcuggaauuuaaacucgggucuguaucauucaggaguucagggguaugggguaguauuuaauauccuaugagaugauggccgucuauuuuauuuaaaaaccaauuggggccgggcgccguggcucaugccuguaaucccagcacuuugggaggcugaggcgggcggaucacgaggucaggagaucgagaccauccuggcuaacacggugaaacccuaucucuaguaaaaauacaaaaaauuagccgggcgugguggcggguaccuauagucccagcuacucgggaggcugaagcaagaaaauggcaugaaccugggaggcagaguuugcagugagcugagaucgcgccacugcacuccagccagccugggcgacagagcgagacuccgucucaaaaaaaaaaaaaaaaaaaaaaauugcuuaaguggcuuuuuaaauuguuugcuauaaucaauauauauaugucaauguugggacugauaaugaagaguacugcaacucaagacucugacacugcaaguucuauugccucccaaaauuguuauaccagauucuacuguucaaacagaaucauccaacaagaauaucagcucuuuucaugagaccuaggcaauguaauagcugcguguuugucaaguauccagaaguacuuaaucaagggcuuugcucaaauggacauccuggcaauuaccaaggguucacaguguauguguguguguguacauucacacgugugcacgcagauuuucuccuaaggcugaugcaacaagguaugcuguuaguaaaagagcaaauuuagcgugcauucaauuuacaaaaugagaucggacauuuuucacuaaaaauucucauuagagacugaaugaagaggaccuucaaugaccaaaaucuaucuaccuguaaagaaacaaaacaaucugcacucaauacauuuaacaggacaguuuuccaggucuuugauaaugaacugucccuaaaauuguuuucuucuaugugauuaagaauuauuuucauaaaugguaaaguuuuaauuauuuuuacauugucaguaacaugcuguuugcuauuacuguaaggugcccuuuuucaaauuaaggaaacaaauuuggggugaugauucacauugugaaaauagucuauauauuuucugcaaugguucuuuagaaaaaacuuguccaguacacuuaaggucuaauauuauauuuagauuuaguacuaauugcauguuauaagguauauauauuuuuuacuuuauuuauuuauuuuuuuuaaauuuaaagucucgcucugucacccaggcuggagugcaguggugugaucucagcucacuggccacguccgccucccggguucaugccauucuccugccucagccucccgaguagcugggacuacaggugcccgccaccacgcccggcuaacuuuuuuuuguauuuuuaguacagacgggguuucaccauguuagccaggauggucucgaucuccugaccuugcgaucugcccaccucagccucccuaaguccugcgauuacaggcgugacccacgaugccuggccuauaagguauauuauaaauaugaaaucuccaucaacauuugcugcuuugauaaagaaaaucagguaaagugcuguuguguucuuaaaaaacauguuauuuguaucuagaaaucaagguguuuguguguaauuguauacuucugaacauguagaaaaagauaaaagaagcugaaagauauucuugccugaacagguguuucugcuaagaaaucccugugaaaaaggaugccaucuacugcucaaauuuguugauagagaagaaucuuacuucucugagguaccaaaggaaaaaacauuuagagcaaugugcuccuuaauuuuggcagcugccuuaaauuuaauuuucuaaacacaaauuaagucuuaagcaaaauuaaauuuuauuuauauguaguucucuaucuuugccuuuaacauuuaauucaaucugaaauuucauguaagaauaaguagccagugaagacuacuuuggugccugucaaaucugcaucucugcaggcccucaaaacuccucucuguugguaaacuguaauuuuuccuuauuucacuaucuaucugcuuuuuuggaagguggcauucuaggucauuacgucauaaacacaaguugaauuuugugcuuccauuccagagggaacaauauaccucacaguuaaaaaacauuucuaaaaaauuccuaccaaaagucaucacuuaagaacuuagucuccuggugccuccauuuccucauuugaaaaagucauaaacauaauaauaugauauacaguacaugcucuuuauguauccacuuuuguuauauaauguaccauuuuauauuaagaagaggaacuggaaaauaaaaauuagaagaauguuauugccacacauuuuccuugugaagaacugccucuucaauaauacacuguggcuccccuucguccgggaguguucacucgaaggauaauauucccuagaaugcaaaccuggacaugugcgaaacaagaggcccuuuaccugcaaauguuauguaaaucauuaccauuuuguuuugccaccuauacaauggaguuguugucuuuuccaacaauuggcaguuuacaugcuuugcagcauaaaaaauauaaagaauaauuuacacagauauauuauuuuaaugacauaguaacuccuaguauuuacuuuuuaaaguaaaauuauaaugaaaauauuuaugacuacaucaaaaaaaauucaccacucaagaacauacaaaagauaacucucucucuugcacacacguuauguauguguauauauaccucccagaacgcccuugcuggcucaggggacucuuaccuucguuuucuguguuggcuggcacagagucagccccaaaagaaugccacggcuggagaucguccaggcugaacucuccauucacgggaaggagcuccacggugguuuucguuucggucaaagauggcaugagagcaucguuuccguaacugauccuugguucacuaaucauguuggccaagacgucaucugaauaguuuugcucuuucugaagcagcucaucuaaaccaaacaaaaccaucucuuuggugaguaacaacaaucacaacagcagcagcagcagcagccaccauuuacuucugccaggcaagacuucaacugcuuucacgugcaugaucgcguuuagagccaugacauagguaccauuaucaucucccuuuuacagaugugaaaacugaggcacauggcauucaagcuacuuaugcaaagucgcagcucacaagagcugcuggcaggacugcaggcaggagcauggcagccggccaaugugcugcagcguggcacugcuagaggugaaaggccacaggggcucagcugccauuuccuccugacacaguuagacgucccuaguauacaaugaucgcacaggaauaaacgccaggcuuugguguggcggcaguaagugaggcacaaucucauucaagcugaaagacaacagacaaucuccugucuugccuugcacacuugcaaggauaagaaaagcauuaaagggccaguaguuugcuaccuucuugaauaguuuucacugucuugccuugaaaaaaaaucugcauuuccuaaaugcuccucuugugcugcaugaccuaugcucugaggcaacaaggaaacuguucccuugcccuuccagauguagcccugcagacagacauccagccuucucuggacuuaaccaccccuggcuccccguauuucccaaugugagcagacaccaaauauccugccuuucuccucuguugcuucccuuuccaaagaaugcugucagugccgccuacccccccacuuuaaaaauugauuaaacaagaaucagcuuuauggaacaucauugacuuaucuuuucuuacuggaaaaagagagcuuagaauauaaucuuguaucauguguaauuacugcuuuaaaaacugaccccaggauaugaagauuugugagucuucucuuaugucaccaaagauucaccauguuuuucucugauuuuuacaaauuagagaccgacagacagcacugcacuauuaacaauaauauuugauuaaccaaaaugucucauuuuccaaucauagcugugucaagaguuugcuguaguauauauuucagacacaucacugguuaguuuuauugcuagagaaaaugaaaauaagaucaggauuuaaauuugauuuguaacauuuuacaaucaucuuucaaauucucuuuucuauugacaaaaaauguaucugaaaaauuaaaauucuguucaaauauacccauuaaaauaauuugauggaauagcauuaaagcuugugauuaauaucuuuucauguagucaguuuuauugcaagugauuuuaaaugauggaagucccaagcaaauuaguccuuuugaagucuaaucugaguuauaauauaucccuauucacuguggcaccguuucuaaaauucaauacuugaugcccaugaugaccuuucccuuacagauaaaagacccucauuagauuuccuccaacuuuuucauguuuuacaaagccauagguagcggcuaauaacuuagccaaugucugauuaaauaaauuaaaugagcauuucuuuuauauaaaucuuuugcuugugacuguuaagcacuuacuaugcuaaagagaggauauucuggaauacuaauaauuauuggugcauacacauucaucuugacaggaaauaaccuuugccagcgagaaagcucuugaacuccccaggggcuacgcuguucuugggucugugguaucuacuaucacuuaccauguccuuuauuuggaaauguucucacuguuucgcauacacaguacuuaucuucuucccugugacaucucugaauaacucuuuuuacucuuuuuuucuccucucuucaucccugucauuuucuucuuguaucucuuuccaucucuuucuacaauucuccccuuuggaaaucccaucgacucuugaaacucuaaagaucuccuaccuuugggugaaucugaaauguacuuccccagcuuugacuucucccucccacucaaauuuguauauuuccaacaguuugcuggagauaccaacuuagggcucccuccugauccaugcacuugguagguacacaacuguacucaaggucccuggcuuucccuuccaccuuuccuguuuucuaaucauggcagaaccauucucccucccagucacaggcuugaauccuucagagccauccaggacucccuguauuucuucguguccaguacucacacuaccgacaaauccuuuugcauucuauuucugaauucucucagccauuuccugcuugcuuuuccacaccacccucaccgccccuaggaauaugauuacuuuucgccuggauaauuacgauagucuccucacugcuugcuauggucugaaugucccccaaagucauguguugaaacuuaaaucuccacugugguaguagugagagauggggucuucuggaaaucaagucaugacaguuccaccccgugcccccgaauggacuacugccuucuaaaagggcuagaggaaaccagcacaggccccuuuaugugcaucugccaugugagaacaguuuuugcugccucuggaggaugcagccacaaggcgccuuuuuuuuuuuuuuuuuuuuuugagacggagucuugcucugucgcccaggcuggagugcaguggcgcaaucucggcucacugcaagcuccgccucccggguugacgccauucuccugccucagccucccgaguagcugggacuacaggcgcccgccaccacgcccggcuaauuuuuuguaguuuuaguagagacgggguuucaccguguuagccaggauggucuccaucuccugacuucgugauccgcccgccucggcuucccaaagugcugggauuacaggcgugagccacugcacccggcuugauccugggcuucucagccuccagaauuguaguauuucuauuguuuguuuauaaauuacccagucucugguaucaugauaacagcacaaaccgacugagacaauggucucccugcugguuuuuauuuuacguuugguuccugaaaucuuaguuccugacacacaagaauggcucccucuuuguuucagugggucuucauuuucuaccgaauuaauuccaacuccuuugccagaugcugaaggcccucuguggucugggcccaccccguauuucuagccauggaacucacagcuccagcugucuacaccacaccucucucucaggcuaaauagcuugggguauucccacaaaagaccaugcauacccauucugacacuuuuguuuucuauuccugcuaucuuggaagcccaucucugcucaucuacguuauuugaacucuuuagagcccagcucaaaugcccucuccuguaugacucuccucucccaaggcaggcauuauuaaucugaugggacaaggagacugaggcugggagaaaggaaccaaucucuucaagacccaauggccaguaagcaccagugcugaaauccaaguccugggcuucauaacaccagccuucccauguucagccccuaucuauuucagccucucguauuaucacaaaaguagcuguagaaauuaggcauuauuaagcaugucuguuccaauaucuuuagcagucucuuccacccuuguggauuuguaagcugacuuaaucaccguuaguccuauggaaugguuauugcuuuuggucaucaaauaagcauuucucaggcaggggcagcuggaaagggcccugugcccaucuuagcccuuggcaguaaaaaggcagaggagcaaaagaucacagugagaaaucuuacacuuguacuucacagaacagucaggggagguugagguacgcuguaguacccuuuucucuuuucucuguuacacuguugguagaaaaguuccuccaaauggccaccagcaugcugagccccauggugguuaauuauauucauuuucagaaaauguaagugaaaaagugacagauucaagaaaagguacauuuuuagcagagugaaacacacuuagccuucguuuuuuuuuuuuggucguuguucaaaauaggaagaaauccacauuccuaucuuaauucaacacagaaaauuuagaaauaaccaccccuggcuaugucauucagaacaacgaaccucugccuccuggguucaagcgauucuccugccucagucccgaguacugugauuacaggcacacacuaccaugaccggauaguuuuuauguuuuuaguagagacagaguuucuccauguuggccaggcuggucucaaacuccugaccucaggcgaucugccugccuuggccucccaaagugcugggaugaggcgggagccacugcgccuggccgucaguguaguuuuaagagaaaaaaagagguagacaugauggauuaccauuaucagaaguggaauucaauuucgucaucauaaaaugucuaaggcagccagcuaccuguagacaugacuaagggcucaggauuuuaccaguggcuuacacacuggcacugggcaauugagccuaugacaaaauacccagagacaaauaugauucuuucauuguucauucugagugggacuuucuuugacuuccauggugagacuaaucacaccgaaaccacacuuccacuacauuaguggcccugauggauuauccuuuuaucugaauuaauuuaauacuuaauuacaacacucugauggccugcaauggggauuuucagaacuuuuaagcaucuauauuugccaaccgcuauauuaaacuaagagacugcuuauuuuccucccaagacuuauuuuuuccccuucuaaaagcuauuuguuaugacccaaaauuguagcguuuaucuuugaagucaaauaucuucuauaauauccaagcauuugaaccuuguaguuaacaguggaaauauuuaacugaguuuaguggugauaauauuuaaaauauggcuucaucaauaacagagguauuuaauuucaaauaccaaacaccuaaugaaccccaucaccuugcucuuuuacaaaugcuucgagguggccaggcgugguggcucacgucuguaaucuagcacuuugggaggccgagguggguggaucacgaggucaggaguucaagagcagccuggcuaacuuggugaaaccccgucucuacuaaaaauacaaaaauuagccgugcaugguggcggacgccuguaaucccaccuacuugggaggcuaaggcgggagaauugcuuaaaccugggagacagagguugcagugagcugagaucaugccacugcacuccagccuaggcaaccgaguaagacucugucuccaaaaaaaaaaaaaaaaaaaaugcuuugaggauguauacgaggcauacuuagaguaacagagggaagaagcccuaccacuuaguuaucauuguaaacacuuuaaagaaaacaacaucaaaagauaauaauuucaucuucaaacagcuaaauauuuuguuuuuucuuagauauucaugaucauucauuuugagaaaaauagccuuauaaauaaaagaacugcugaauaggaagcagaugaauucauccaauauucuuuuaauuauuaauccacuagccaaaugucuucuaagaauuuaacggucacaucuuacgauuaaagaaaauaaaauuuaugggcauuaaaucaaucaguuauguguuacaagugucaguuauaauuacugaacagcuucuuccauccacugaacacaaguggguuggagaagaacauuuucuucauauaaaggaggugccacucagccuuuucccuguaaagucuggcuguuaaagcucugaucugaaucuauccaucugacaaaggucuaauauccagaaucuacaaggaacuuaaacaaauuuaccagaaaaaaaagaaaaacaaccccaucaaaaagugggcaaaggauaugaacagacacuucucaaaacaagacauguauguggccaacaaacauaugaaaaaaaaaaaaaaagcucaucaucacuggucauuagagaaaugcaaaucaaaaccacaaugagauaccaucucacaccaguugggauggugaucauuaaaaagucuggcaacaacagaugcuggcgaggaugcggagaaauaggcacgcuuuuacacuguuggugagaguguuaguucaaccguuguggaagacagugaggagauucugcaaggauauagaacuagaaauaccauuugacccagcaaucccauuacugggaauauacccaaaggauuauaaaucauucuacuguaaagacacaugcacacauauguuuacuguagcacuauuuacaauagcaaagacuuggaaccaaccaaaauguccaucaacgauagacuggauaaagaaaauguggcacauauacaccauggaauacuaugcagccauaaaaaaggaugaguucgggaggugggagccaagauggccgaauaggaacagcuccggucuacagcucccagcgugagcgacgcagaagacgggugauuuccgcauuuccaucugagauaccggguucaucucacuagggagugccagacagugggcgcaggccagugggugcgugcaccgugcgcgagccgaagcagggcgaggcauugccucaccugggaagcgcaaggggucagggaguucccuuucugagucaaagaaaggggugacagacgcaccuggaaaaucgggucacucccacccgaauauugcgcuuuucagaccggcuuaagaaacggcgcaccacgagacuauaucccacaccuggcucggaggguccuacgcccacggaaucgcgcugauugcuagcacagcagucugagaucaaacugcaaggcggcagcgaggcugggggaggggagcccgccauugcccaggcuugcuuagguaaacaaagcagccgggaagcucgaacuggguggagcccaccacagcucaaggaggccugcuugccucuguaggcuccaccucugggggcagggcacagacaaacaaaaagacagcaguaaccucugcagacuuaaaugucccugucugacagcuuugaagagagcagugguucucccagcacgcagcuggagaucugagaacggcagacugccuccucaaguggucccugaccccugacccccgagcagccuaacugggaggcacccccagcaggggcacacugacaccucacacugcaggguauuccaacagaccugcagcugaggguccugucuguuagaaggaaaacuaacaaacagaaaggacauccacaccgaaaacccaucuguacaucaccaucaucaaagaccaaaaguagauaaaaccacaaagauggggaaaaaacagaacagaaaaacuggaaacucuaaaacgcagagugccucuccuccuccaaagaacgcaguuccucaccagcaacggaacaaagcuggauggagaaugauuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagaaaaacgaauaaaaagaaaugagcaaagccuccaagaaauaugggacuaugugaaaagaccaaaucuacgucugauugguguaccugaaagugaugcggagaauggaaccaaguuggaaaacacucugcaggauauuauccaggagaacuuccccaaucuagcaaggcaggccaacguucagauucaggaaauacagagaacgccacaaagauacuccucgagaagagcaacuccaagacacguaauugucagauucaccaaaguugaaaugaaggaaaaaauguuaagggcagccagagagaaaggucggguuacccucaaagggaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaccaggccugcccuaaaagagcuccugaaggaagcacuaaacaugcaaaggaacaaccgguaccagccgcugcaaaaucaugccaaaauguaaagaccaucaagacuaggaagaaacugcaucaacuaaugagcaaaaucaccagcuaacaucauaaugacaggaucaaauucacacauaacaguauuaacuuuaaauguaaauggacuaaauucugcaauuaaaagacacagacuggcaaguuggauaaagagucaagacccaucagugugcuguauucaggaaacccaucucaugugcagagacacacacaggcucaaaauaaaaggauggaggaagaucuaccaagcaaauggaaaacaaaaaaaggcagggguugcaauccuagucucugauaaaacagacguuaaaccaacaaagaucaaaagagacaaagaaggccauuacauaaugguaaagggaucaauucaacaagaggagcuaacuauccuaaacauauaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauaguuggaaguaaaacucuccucagcaaauguaaaagaacagaaauuauaacaaacuaucucuccgaccacagugcaaucaaacuagaacucaggauuaauaaucucacucaaagccgcucaacuacauggaaacugaacaaccugcuccugaaugacuacuggguacauaacgaaaugaaggcagaaauaaagauguucuuugaaaccaacgagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaaucaaugaauccaggagcugguuuuuugaaaggaucaacaaaauugauagaccgcuagcaagacuaauaaagaaaaagaggagaaucaaauagacacgauaaaaaaugauaaaggggauaucaccaccgaucccacagaaauacaaacuaccaucagagaauacuacaaaaaccucuacacaaauaaacuagaaaaucuagaagaaauggauacauuccucgacacauacacucucccaagacuaaaccaggaagaaguugaaucucugaauagaccaauaacaggagcugaaauuguggcaauaaucaauaguuuaccaaccaaaaagaguccaggaccagaugguucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcuugguucaauauacgcaaaucaauaaagguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaggcaggagaaggaaauaaaagguauucaauuaggaaaagaggaagucaaauugucccuguuugcagacgacaugauuguuuaucuagaaaaccccauugucucagcccaaaaucuccuuaagcugauacgcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuuaaaggagaacuacaaaccaacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacgaagcuggaggcaucacacuaccugacuucaaacuauacuacaaggcuacaguaaccgaaacagcaugguacugguaccaaaacagagauauagaucaauggaacagaacagagcccucagaaauaacgccgcauaccuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucacguccaaaacaccaaaagcaauggcaacaaaagccaaaauggacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcaaaggacaugaacagacacuucucaaaagaagacauuuaugcagccaaaaaacacaugaaaaaaugcucaccaucacuggccaucagagaaaugcaaaucaaaaccacuaugagauaucaucucacaccaguuagaauggcgaucauuaaaaagucaggaaacaacaggugcuggagaggauguggagaaauaggaacacuuuuacacuguuggugggacuguaaacuaguucaaccauuguggaagucagugucgcaauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaacuggaaaccaucauucucaguaaacuaucgcaagaacaaaaaaccaaacaccgcauauucucacucauaggugggaauugaacaauggagaucacauggacacaggaaggggaauaucacacucuggggacuguggugggguggggggaggggggagggauagcauugggagauauaccuaaugcuagaugacgaguuagugggugcagcgccagcauggcacauguauacauauguaacuaagcugcacaaugucacauguacccuaaaacuuaaaguauaauaaaaaaaaaaaaagauuugaauuugcaaauacaaaaaaaaaaaaaaaaggaaaaaaaaaaagguugaguucauguccuuugcagggccauggaugaagcuggaggccaucauccucagcaaacuaacauaggaccagaaacccaaacacucauguucucacucauaagugggagcugaacaaugagaacacauggacacagggagggggacaucauacaccagggccuguccagggguggggugaaaggggagggagagcauuaggacaaauaccuaaugcaugcggaguuaaaaccuagaugacggguugaugggugcagcaaaccaccaaggcacauguauaccuauguaacaaaccugcaugcucagcacauguaucccagaacuuaaaguaaacaaagaaaaaaaaaaaaagcucugauuuggacaccagugagaauaugaagucccucggcuugcuggauuuucuucugucuaggaucgaaccuccacugcuauuacuauuuucuuuccuuuuugauucuuuuggaucccauggaaaaauauuuaucugcaacuucuccacaaaauggaaauuuguuuuuaaucuuaucuaacaggagauucgcauaugaccaauucuuaucuuuuaaauaaaaauuuacuuaugugccugccugaaaggacugaagaucauaccucuacgcucucuuccauguccuuucuucucucuccccugacacagcugcauuggaaguagcuguaaaugggauggacuaauuuucccuacccaggaggcccacuguaaaucaagcggucacccacuuccagcuaggcauuuugccacaccagggcuaugagaaacagauuuaauuuuccaaucagcaguucugugcaugucugauucuuggcucaacauacaacugcuaugcuguuuauuauacuucaucucuccauggccucugaaacuccccaaggcucggguucgucauccgcaaaaucgugggaggcugguuccaugguucuugcagucccuucgcuuugaauccuuuugucuguacucuugcuacauggguguucucugggaguuuguuagacaugcagaaccucaggucccacccagauccagggaaucagaaucugcauguuaaugugauccccaggugacucucaugcauguuaccaucugagaagaccuacccuccaccacacugaccacagccacgagcuguaccaagacaccaccacacaacagccucgguuaucccuucaugaaagaaaaacaaacauaauggcugggcgugguggcucacgccuguaaccccagcacuuugggaggccgaggugggugguucacuugaggucaggaguucaagaccagccuggccaacauggugaaacccgucucuacuaaaaaaauacaaaaauuagccaggcacgguggugugugccuguaauccccauuauucaggaggcugaggcaggagaauugcuugaacccgggagguggaggcugcagugagccgagauugugccaacugcacgccauccugggcaacagagcaaggcucugucucacaagccaaaaccaaaaacaaacaacaaacaaaaaaacaauucucaaaaacaaagcaaacaaagcaaggcaugagaugagugugagccaagaaacaauacugccaggggaauauugccaaaacaccagagucaugccuugaaguuucuuaucaucagggucacauuucugaaccagaaagccacaggaaaggaaagacuggucacagacuuccuucuucccuggaccauuuguuacgggaaguucucaggaaacaggucaguaaguguagagggcaucacaggacaaacuucauugcuggguuucccagaaaagagcagcucuccccuacugaagacacuuuuagcagacgggccuucacuagugaguaaauauacuaaagaagcauggacuuacuuguaggucgguggagcagcugauuugggagagaacccaugagaucuuuaaggacgguagggauguucugauuagcauauaugcuacagccaucugcgaugccaaagccauacugugaugggacuaugccaguuaugacaccuucauaaccaugagaacugcacucauggccuuuucauacccaucugcugauuugauaaccacaauaaucuuccuuagugggaucacuacucccacugacaguugaacaaacugacauccauccugagaaguauacuuaaaacuagcaaguggcagaacugaaaucugaacccaaguaucccaauuccuaaugcaaccuucucacuguuccaugaaaaguuccauuuuauagaggacauggcuauauuacuuggauuagaaacuaauauuaaagaagcauaucacgccuguaaucccagcacuuuggaaucaugaggucaggagaucgagagcauccuggcuaacauggugaaaccccaucuuuacugaaaauacaaaaaaaauuagccagauguggugguggcacuguagucccagcuacucgggaggcugaggcaggagaauggugugaaccccggaggcggagcuugcagugagccgagaucgcgccacugcacuccagucugggcaacagagugagacuccgucucaaaaaaaaaaaaaaaaaaaaaaaaaaggaagcauaaacccaucuaucaucacaagcacccucuuuuucauacauuucaaauuuuugauagguuugaaaaagaaugaauucgacgguaucuuuuagaagccaggauaaaagagauuaaagcaguaguccaaggucacggagauuccugaugguggagcagggcugaaaagcucccucuucuagcuaagugaggccugccugucacuuugcuuggacagcccauucucaauagcacuuuccucccagaacacucucccaagucuuuagguuucccuuucucaggaugaauacgauggcuacgugaauggccagaaguuucaccaacucuaagucaaauuguaguguagcgaccuaggcacuucaauggucaagagagauacagcccuguaugacgcggccacauuuuccaacuuggggaagaauuuauacacauauuaucacaaaguaaaugcuguaccauaaauccaguuuuuaucuugaccuccagaaaauuaggucaguuauuuuuagcuacacuaucaaucuugaaaaucucccagaguuaaaacucagacuacaugucuaaaucgggguuuauuuuuguuuaaaaauaacaguuuccuggccacacauguuuaaaugaagcaugcuuuguccccuuaugguaacaaacugcccuggaagggacacaaacaaagcuucacaucauuugugaaaauauuccuuauugcuagggacauuuuccugaaauaucacuugucuggcuuagacugaggguacagaagaagucccuuuuccuuuaaaacacauuuccuuuuggcuuucaaacaucauagaucaaagaacuuagaccuaccaguggcaucagucaguaaucaagauaaagaccagccaggcucccuggcaucuaaaagcagauuguagggcuccuuuuucccguuuaccuguagaacuugugccaaugugcugaucugauuuccaacuacauuagggagucuugguccugccuggguugucaggaacuuaaaguagagacuaaaaaacaacuuuauggccaggcgcgguggcucacgccuguaaucccagcauuuugggaggcugaggugggcgguucacgaggucaggagaucgacaccauccuggcuaacgaggugaaaucgcgucucuacuaaaaauacaaaaauuagccgggcauggugcaggcgccuguagucccagcuacucaggaggcugaggcaggagaauggugugaaccugggaggcggagcuugcagcgagccaagauugugccacugcacuccagccugggcgacagagcgagacuccaucucaaaacaaacaaacaaacaaacaaacaaacaaaaaaaccaaguuuauauacuacagaaauaaucucugaaagaugcuguauuaagauuacaacacacacacacaaacacacacacacauaucuucuuguuuugaggaaacguacagugaaguauuuagguguaaagggccauuaugucugcaacuuccuuuaaaaauuuuuaaauauauuuuuagaacuuuucuaagucuccaauuauacuaaaacaaaaaguuuaguacuguaggcauugucagcuuuaauuuauacauauuuggaugucuuccucugguucgauuuauagugaaauuacaucauaugcccauuaaugugauacaaacugcaugucuucuacaaacaaaaauaaaaauagaagugaauguaauuuugaugccuuuuuuuuuuuuuuaacuggagacagagucuugcucugucaccagguuggacugcagaggcguaaucucggcucauggcaaccucggccuccugaguagcugggauuacaggcgcgcaucacuacgcccggcuaguuuuuguauuuuuaguagagacaggguuucaccauguuggccgggauggucucgaucuucuaaccuugugauccacccgccucggccucccaaagugcugggauuacaggcaugagccacugcacccggccugaucccucauaucuuuuaaacauaagucaauuauuucauauggucuuuaagccaagaaacagcuaucucuucacucuucacaugcuggaggaaaaacuggcugccuggcugguugagagauguguacuuugauggcugaccugaagacauuucaaggugauuguuacgugaaauucucucuucaaaucugacuugaagagucuaaccucugcagcauauguuaugacuucacugugagucuucuuuuauuaauaaaauauaauguuuuuacuaauuauaagaguaacauaaauuucaugccaaaaauguagaaaaaaggaaugagaauucauuuacaauucuaacagcagaaauaaucaagaguagugguuuuuuuuuaaugguuuuauucuuacagcauuauuuucgucucuuuaucacuuuacuaugcaauuuuuaugacuaugcuuaaggagaguaaauuuuucgaaguuauugaggcaauggagagucuuuggaaugaggauaauuaggccugaggacacagaggaaucaugaggaagaauucuccaguuucauuccuuuuucuggguacaguuuguuucuccuucuaaguaaguuccuagauauagaaugaauuggaaaaaaugaaacgugagguuugcuacgucuauaacaguaucacauuucauuuuuuaaaacugccaaugcuuucagugaggaccagaaaguacagugagaaaaaaaaauuccucaaauauuaguuuucaugcucuugcacgcauuuuuauaaaggcaaaagucauucuggugccuguauacaaucuaaaggcauaaucuccuggagccuucagugcugguuuugggguuuucuggagaucaauccacagugucccauuuuuucugcuggagcucugaacccacuaagagagagcaagaagagauguaaaccucuccuuugcuucugauaaagccaagcccuuacuaguccacaugaugcuuucucuggggagugagucacauacaggagacauggcuuguccagcugcgugcuggacugaauuucagcuccaaccugaaccuuccaacaggacaagggagggaggagaaugggccguagcaagacuugcccacagcauugccauaacagcugugcaggcuguggguacaacucuaagagcagcacucauuuuguaguuucagugagucgugucccuaaagccguguccugugugaccagccccgucucucaagcucaugagagaagucuaucugaccgggauaagaaggauccuggggcgggcccaagcaaaugaaugaauugggaaacagugccgcucccggcagccagcaaaaacuccgccaugcugugaagaaagugcauucuaauugauucauguugauacaugcugaauugauggaauuuuauacuucaaaggaugcaaagaauugguuagcaagucugaugagcucaugguagaaaggaugauuuucaacauccauacauagugaauuucauucaaagagccuaaaaagacuuaugcagauaauuauaaggggaucaggcaaguguguaauagcacaaauuauauauauauauauauguaaaaucacaacacaggauuggguccuuuucccacagacagcacaucauccuuguauauaugauagcucauuugaaauguuuauuuaugcagauuuuaaaaagcacacaaacccuguaagcacuucugcacaguggccuacucguguuuucuuuaacacaaaacuugcuuucuggugaacaauucuagauauagcaaugguucuuucuccucugcuuuagcuuauucacaagcuucuuuaacuucuuuaacaacguguggggaaaccaagccuggcaacagaaagcacuucacauggggggcuuggaaaugaauggaaagcgucugucuucaggagagcauucacgaugcacaggagugagagaagcugaaaagagucacuuuaaaagaaauaaucugcaaccaagaaaaucaaaccacuuuaucauaaacuagugagccccucccucccugccugccuuccuuuuuccaggggagugcuagaaauaacuucaucaauuucuuuucacuugaagggcucaugguucagaagaaaagaugggcauaaaaauaauuacuauuacaaguguuaugguagggauaccgacagaaugacaaagaaacaagccugggcuuuagggaugugacuagugauauuacaguggggccccagggaaagagaucauuguccuagcagauacaagugcauguaccgaggcacagaggacaagcugcccaggaucugugacucuucuggcugcugugguacaagggaagugaaaagggaagcagcuuagccaagaggcuuucaguuugugggauacagagggcagaggaauacacugaccuauaccaugaguaugcaauuagcaaaaucccagccuaugggaauucuacgggucaagugaccugcgcuucaugaacagguaaacuguaaaaaaaggauggaggagaagccuggagauuauaaaagacuaaccagacaaagucagcaguaaaaaauggccaaaagcauagccgauaaggaugcacacaagagugauacagccagaaagauauuucaggaacuggcccaaggaaaaacagugggcauuuugguggcgguauuugggauagggcgagaugcuaucgggguggaggauaaacuucuaauucuugaccugaguuuaaucuacgaaaagagaaaauaugggggagaaagguucuguuuacacauguugaguugcaaucuuucagaauauuggguggagccaauggaaacauggacccagagagcucacuucuaugcugaaacagcccacagggaagcaucagaaugaaaauggaaacguucccaauacuagcagaacuccacaggcgcuuugaaaaaaacauccacauuagauuccccaaaagggauuuaucugguaauaaauucugcuagacaaugaacaguuccacccaugauaaaauaacauguuguugcugcaaauucuuuguauugucuaauugcagugcuuaacguaauaaaaucaggcugguguuauuguuaagaacuagagagugaagcauuuuuuauccaaauaaagugcaauggguuuuaaaucaaaucauuuuagaauaagaauccuaugagauaauaauaaaaugcaacuucaucuuuuccugccgagaacaaagaagaaaauaguguaggagaugaaaaguaaaguagacccaaccuuuuugcuaauuuguuuuuagauacguacuccaugcagacaauggugaagugaagugaagugaaggggugucaucuuauucaccuagagaaccacaaaucuuggugcuggaaaguacgauccauucgacaugauggacuauuucccacccggccacucacucgagaauggauaaccuguuuucccgccugggguaacugcuuuccauggauguacagcuucaggccucauacgagaggaucucacaacaaucucuucaaacuuuuucuaauccccacacuuuccagucuuggcacaagaccucauccaggcuucugagucuuuguugaaaauuuacacaaaauucuagaaauguauuuucuuuaagauaguuacuuuaaaaauguuauuuucaucucagcacaguuagccuuuccuuaucuguucuuaaaauguuucaacuugaaacuaaaaaagaaaaaaaaaaacacauuucaucucaaauuaugauauacuaaauaauuauugacuuggccccaaacauuucuacucuuuucuucuuacacaaucagauuuaaaaauguaacuaccuuuucuaaacauacaauauuaaagcauacucaacuucaguaacagguaaugaauguaccucaaaagucagagccucuacguuaaguaccauagugcuccaacaucguuuuuuacauuuuuaaaauuuuauuuuuuauugauacauaauagaugugcauauuuucagauuauaugagaaaacuuaauauauucauauaauuuggaaagaucaaaucaguauaaugggauauccaucacuuaaauguuuuucuuuucuuuuugcuuugaggaagggucucucucugucacucaggcuggagugcagugaugugaucauagcucacuugaaccuugaacugcugggcucaagugaucuucucaccucagccuccagagcagcugggucuacaggcaugcaccaucacaccuggcuaauuuuuaaauauuuguuuuguagagauggggucucacuaugaugcccuggcuagucuugaauugcuggggucaagugauuuucccaccucggccuucccaagugcugggacuauagguguaagccaucgugcccagccugucuucuuuacgcuagaaacuuucaaauuagguucuccuagcuauuuuuaaauauacaguagauuacuguaaauuagucaccuugcugauaauuaaauacuaggucuugcuucuucuaucaaacuguguauuuguauccauuaaugaaccucccuuuguaaguaugauguaagcaauccuuacuuggcuacacuauaagcuucaacaacaaauuaaaaaaugauucacauuauagagcauuuauacaugccuuuucaucuuccaagugugguaaacauuaauuaacccuggcuaauuaaaacagccacaguugacacauuuacucauuaaucagccucaagcaaaugcaaagcauuaaacucuuucacguuuugguaccaauuaaauguuauuauuuuuuuuuuaaugaagaggucauaaauuuaagacauguaguucuuagauuuaaauuugauagugguugaaaaaauuugacaauaguucacauucuuaaaagucaaggaaaauaaaaacauaaccgcauuauggguugaauuuucccccaaaauauauguugaaguccuaaugccuacaccuaagaauacagccuuacuuggaaacagggucuuugcagauauaagauugaggucacaauggagaagggugggcccuuaaucauauuagagaagacacagaaacagagacauggggaguaacaccaugugaagacagagguggagauuggaggggugcauguaccaaccaaaggaauaucaagggcuggcagcagcacuagagcaagcgaaaggcaugaaacagauucuccccuagagcuguaagaggcaguguggcccuggcaacaccuugcuuuaggacuucuaaccucuagaauaaugagauaaugagaguauauuucuguugguuucggccaugcgguuugugguaacugguuccagcagcccuaggaaucuaauacacugcccauguaagugaauauuagcuauuugcugauaagacaagaauuucugguuauaauaaauauacuggaauagaaugugguuucuuuuuuuuugagauggagucucgcuccagucaccaggcuggaaugcaguagcgugaucucggcucacuguaaccucuuccucccagguucaagcaauucuccugccucagccucccgaguagcugagacuacaggcgcccgcaaccauccccgacuaauuuuuguauuuuuaguugagacgggguuucaccauauuggccaggcuggucuugaacuccugaccuugugauccaucugccucggucucccaaaguguugggauuacaggcgugagccacaacacccggccgaaugugguuucuuagugaguccuuuacucaaggcuggaauuaaacaaaggagaugaaucacgagcucuaugauaauagucuaauagucuaaucuagcccucuuaagugcagagauguuuucccucugaacacccguguguuucagcucuguuccucuuccaaugcccuuccacagggaacaaauccuuucuugaccaccaauggcugcaugacuuauccugagaagaucauggggauuuuggaugccaggucaacccuuacacucagcaaggaaguggaagggccucaguuucaaacacuuuguaaacacagagguuaggucauuuccucuccaauaagccagaagcugagcugucccuggcagcaaacugugugucaaaugccuggcggguuucagguuuuacuaacuccagagugacgaaacaucaccaccucuaaugccagaaagaagucagcuguuguaccugugucacaacuaaauuuacugaagucagggcagcugaaguaaucuauaaaacuuagcaugucaauuucaauuuagcguucacauucaacaaauuguguauuuaaaaaaaaaucuccaguagucuaaaaguuuucauuuuauucuuguguaaaaucuggaagacuggaauagaauguuuuaugguaugaguguuuaguagcaacauuagguuaacugugaccuuuuggcucaagacaugagaaaauauagcuaacaaugcuugguuauggguuugucacacuauacuuuguuauacuauccagcaguauccaccugcuuuaacaguguggauacacuaaaaacuaauuuaaaaaaaucugggcugggcgcgguggcucacaccuguaaucccaacacuuugcgaggccgaggcgaguggauuacaaggucaggaauucgagaccagcccgaucaacauacugaaaccccgucucuacuaaaaauacaaaaauuagcugggugugguggugcgcgccuauaaucccagcuacucaggaggcugaggcaggagaaucauuugaaaccgggaggcggaggcuguagugagccgagaucgugccacugcauuccagccugggcaacagagugagacucugucucaaaaaaaaaaaaaaaaaaaaaaccugucaaaucccuccauacaaguguaugcacuucacauaccaaggaggucuaggauuugaaguucaucaaggccgaguuuaggcugccagaccacaaccucguuuuaaugccuuaggugcagaaacaggagaaauaauaccuuccaugccuccccugacuagcuuuaggauaaagaagcugugcacuaaauagacaguagcugaggaacgaugaagaggaucuacccaaaguaugaauaagccaacugcuauggaucgaacugugugccccugaaaauucauguaucaaagcccuaacccucaagggaccuuuggagaucagaccuuuaaagagauaauuaagguuaaaugaggucaugggggugugacucugauccaauaggacagguguccuuauaagaaaaggaggaggccgggugcggggcucacgccuguaaucccagaacuuugggagggcaaggcagguggaucaccugaggucgagaguucgagaccagccugaccaacauggagaaacccugucucuacuaaaaauacaaaauuagccaggcaugccuguaaucucagcuacucgggaggcugaggcacgagaaucgcuugaacccaggagguggagguugcagugagccaagaucgugccauugcacuccagccugggcaacaagagcgaaacucugucucaacaaaacaaaagaagaagaggaagagacaccucucuuucucucugagaaagaccaugugaggacaugaugcguagguggccauuuguaaaucaaggaagagaggccuccucagaaaccgaccugcugguaccuugaucuuggacuuccagccuccagaagcaugagaaaaauaauuucuguuguugaaggauucagucugugguauuuugguauuuuguuauggcagcccuagcagacuaaugcauuuaucuagucacacucagacaaaagaaagagcacaggucagaauagcuuuuucuagaggauucuguuuucuuucuuucuucggcuucuuuuucuuuuuuuccugaaggcaauagcugaaucugagaguaacaaggggcucaccagggaugugcaaggaauuucuuguacugccccuuucauggaaaugacaaggaagugauuuauuucagaugugacucaguucaggauuugaaagcacaugugacaaauggucaaguaaagaaaaagcuuuucuuuuucuuuacuugaccauuugccacgcaaguucccaaguucuuccucccuaucuugcuucauuacaggcagugggaaaaauccaaacagcuucccccugugucugggacaucuccagcucugugguguauuuacuuugaaggaacaaaaaaggggauaguauaugacuuccaucccaagucacuauaggauauacuuuaagaaacaagggaguuuaaauugcucugcuguauaaccugcaaaauucaucuccuacugcagaauagagugaguugcuucucaggauucgcaccuggaguugguauucagcacauguuuucuuuguaacauuucugucaauucucuaaaaagaccacacuuuuugagcuggcacuaggcucucugacaaucuuccaagacgaagcuuuuacaguccaucauuuacaaugcugacaacuccaggcacauuuugucaauuuucccuuucaucucuuauuaaaauaaaauaauaucacuuuggauuugaagagagccuaaauggauaauucuuuaagcagaaugucaguaucaaugauagaaagggaagaaucuaagagggagguaaauguucuauaaguagagaaguagguucacaauuucugaaacagcaaaucaaacagcaaaugggggaaaguuaugaaaggcagaauuuugugacucaagcccaucuuaugcuuauacaguuuuuuguuuuuguuuguuuugagauaaggucgucccucugucacccagccuggaguguaguggugccgccaggccucacugcaaccuccaacuccugggcucaagugauccuccaaccacagccuccugacuagcugggauuacagguguguaccccuaaacccagcuuauuauuuuuuugacuuuuuguagaaacagggucuccccauguugcccaggcuggucuuaaacuccugggcucaaaugauccuccugccucagccucccauagggcuaggauuacaggugugagccaccaugccuggccuuuuauacuguuuauucccuuuagauacaguuaauggacauuaauaagcaguuuaugccaaucccuuuucauagcuaauaagaagucuuaucuuggauaaauaaaaccuagccacuaaugcugccacacccaaauaaacucucuaugcaucugaacuucuugagguuaauaaugcuucauuguaauauuuuauaaaaucaccacuuuggaagugaacaccacuagaaauucacauggccaguuuauagauggggacugggggaagcagggaggaucucugcaauccaguaguuaggcucugccagaauguauuuagaguugucucuaaauacauucugagucucugcuucauuuuuuuuuucaaugaaaaugacaaugucugucaucccauguucaagacaaauauaacaaguuucuaagaauccuuauauuuuuguuauugcauauaagcaugaguuuuaaaaaccucugaauguuuaaaggaucaccugggggaauaagaaaaaugcagaucucuguaggucugagguagagcccaagaaucuguauuuuuaacuagaauuccucuaaauuacugugcuucacuuggccccaauuacacauuaggagacaaugauuucaggaugacaaucagccuuuuccauccaaggacuuaaagcagcuaaaccgaagacaccgacaaauaccagauacuuuucucagucuacuggcugauggcacaaaagugcagaagucacguagggcaguauggaaagcucgagcuaggacuggagucagcgagagacgcuagcuuccccuguucguggauuccgaagccucaagcccacauuaacaaggccuuagacgacaguaaacacccagacucaggcuccuacagagggcccccaguucugcucuaauauaccuauuuuucuuuaaauaaaaaacaucugauuuuugcaccccagguauuuaaagacacacuuugauuucugaaaggcuuuugaccacacaugaggaacuccuugggccuugaccauuuuuagcacuuucacaguuucugauuuugaucaagccacuuaaucacccaggauucugaaucugaaaaccaggaggguuuaauuccacuuucauguucccuugaggagcuguuggcagcaggaugaaggcagguccauacagaacaugggaaggaagccaggaagccagcuuuuccuuucacaucaaagagaucuagaaagcaaaaccugucucacauuugcauacaauauuagacuuacauauggaugccaugucugucaaaagacaggcuaauuagggcauuaguuucuuuaaugguugcgauuuaguaauucacaaauagucccacuuaauuuuucauccuauaccuaaaggaucuacuucacacuugaaguuuaagaaggcuucucccuuaagauagaaagaaggcauucaaguaucaaaauacugguuuccugccaaaaaauaagggaugagaaaaagcagacacuuagcuuaucaaucaaaaugcuggcagggaaagacuacuggauuaccaaguucauuccccuagccugcacugauuccucuuuuucucuaaaguuucuuauuuuuucaguuuuucucaugauacugacauugccaaccagcagucuggaaacuguucagguugauucuuagcagaaaaucgaggggcucuccuguuacuguuaauauccuuaaaacacuuaaauuugguuaguuugcuucaagcauucucaguauauuacaaaaaaaaaaaguacucaagaauuucuagacuuuauuuugacugacaucagcuacccuaaugaacaggaggggacaacagcaagguauauuaggagcaucuccuuccuuuuuaaucagaauuauauaggaauuaagaacucuaaggccacaguagaguauaguaucuuggaagaagaaagcggagaaugucugacauuuucacugaucguuuaggcugauggcuuaaaccauuuccacccaaguuucuuacaaguuagcauuuccagccaacauuaccuacugcaauuucucuauaaucuuaaggguauugagcccccaaaugagagagagaaaagagauguaaacuaaacaggagucagagaaggggaaacugagucuguugcacaucauuuacccuuuaacaugauuuuaaagguaauaaugcuuauaaaaauauuaguaguaguaagggauaucaggugacaagcagaagugccccucuccacagauaugccaguguaucuguagaaauacggugcuaaaauuagaaaagacugaacauuuuaauuuauuagguagacccaaauagucuaaaagguuucacccauauacuuagcaauaguuuaugaaaguuccuuuucaccuauccuuaucaugacaaggcauaacagauuuuuaaaaaacuaccaauuggccauaauuuuuaaaaaauuacauuuucauuggguauuaauaauaagaaguuguucaccuuuuaaucuacaacuaauuaucagauaugcaugcauuuuuuuucuaugaauugcagcuguuaaauuuuugugaauuaauccaaugcaucaauuccuuuggguuuucaccuuaaacauuuuuguggcauacaauuuguauaaugugaauuuagaagauaauagcauaggugacuggggugcuacaauggauucucaccuauuuauuaacuuuuuaaugaguugauuagucucuaaaucaguaauucgcaaaguuuagcauuuaucaaugucaccuggacagcuugauaaaauacagauugcucagccccaucccuagcuuugcugauucaggaggucaggggugggaucauggaaugugcuuuuccaacaaguucccaggugaugccaggcgaugcugauguugcuagacuaaggaccacacuuggagaaccacagcucugaaauauucccugggcaugguauuugcaauacauacuuuauaccuaauaauuuguuucaggacacacaaaugcacaugagauuugauacauacucucaaaaagcuaacaaucaguuaagugguaauucacugacauguacacaucaaaguaauguuagacacauguaauaggccaagauuggggaugggcauuauaggcagauggaauaacauaaauaaaugcauccagggcuauggauauaagaucagccuggcuggcaaagucagacucaugaaggagauuaaugggaaaaccuaucuguuuugucugucucagguuauuuugaggaucaagugaaacuuagaaacaauaacaacaaaaaaagcaaagucugugaucaagaagaauuacucuguugcaacaauauaaacuaagaaaaaaauacgcaaaauucucugcugccuugggagaugaucucaugauguguaucauuuacuuuuaauauuuuuauuuauuuauuuuugagacggagucucgcucugucgcccaggcuggagugcaguggcgugaucucggcucacugcaaccuucgccucccgggcucaagugauucuccugcuucagccuccugaguagcugggauuauaggcaugugccgccaugccugccuaguuuuuuauuuuuaguagagaugggguuucaccauguuggucaggcugcucucaaacuccugaccuugugaucugugcgccucagccucccaaagugcugggauuacuggugugaccgaccgugccuggccaauguguaugauuuaauagccagcagcaacaggccacuaacaugccaucugcuaacaggggcucuagcuauuaacaucaacagagcuaaaaacucuuaugucugaucccuugcaaauggcgaagaccuggcugagaauuauuaucucaugcuuucagagaaaacuuugcuuguccugcacugaaaaaucuggcugcaauaaucacauggaagaagguauguuuguuggcaugguucaugggcuggcuuaugacuucuaagcagaagauacaaaauaauauaaaauuccugcaacaugcacaauguagcugauauucauguucucuuuaaauaucuuaacacugacuuacauauuuaaggguguggagucuuugagcuugggaagcaucuuauuacugagguacaaaugcuaaaagagggacauuucuucuaucuaccgcauuuucaaugaaaagaugcugaaggugaauaaacagcucugcaaacccaguuuuguuuaacuuggcaacagcaguaaguaaguaucacuggacacagagacacuggaauagauucagucuuuagucuuauucaucacgucugaccuugggcauauuacaugguuuuccugagccuaugaaaucaugcggcugaacgagcugaaaacuaagauucuuuccuuugcuaauaaauuucagcaaacgauaggaguaagaacggcugucuaacgagacuaccaaaugcuacgagacgcagcaagcaaugucccuuuaccuaauggauacagcuucuuaacuguuuauccaaagucuccccaagcaaauucuaaauuauucuaaauuauuugaguaacaaagauugggcccuuauaccugugacgugucuggcaaugacaaagaauguggaacaugggaagcauuuaauacauauuuauugaagauccuguguccuuauuucuucaaucuccuugcuauucacaauggcgaaugauaugaauauacauauauauauccuaucaugguaaauauauauaacauaaaucuuacuguuuuaaccauuuuaaguguaacgcucaggguauuaaguauauuucacgaugcugugcaaugugauggacgaugcaucacggccauccaucuuccccacugaacuauuuucaauauugccaaauugaaccucugugcccuuuaaacacuaacuccacagucccucauccucucagccccuggcaaucagcauucuacuuucuguaucuaugaauuuacuacccuagguaccucauguaaguaaaguuccauauaaaacacuuuacaaaauuugcaugucauccuugugcaggggccagguuaaucucuuuaaucauucuaauuuuaguauaugugcugcuaaagcaagcaucauauauauacuucuuuuuuuuugagauggaguuucgcucuuguugcccaggcuggacugcaauggcgcgaucucagcucaccacaaccucugccucccagguucaagcaauucuccugccucagccuccuaaguagcugggauuacaggcaugcaccaccacgccuggauaauuuuguauuuuuaguagagacgggguuucuccauguugaggcugaucucgaacuccugaccucaggugaucugcccaccucggccucccaaagugcugggauuacaggcgugagcaccgcacccagcuuuuuuuuuuuuuucucuuuugagauggagucucguucuguugcccuggcuagggugaaguggcaggaucucagcucacuacagccucugccuccuagguucaauucuccaaccucagccucccgaguagcugggauuacaggcaugugccaccaugcccggcuaauuuuuuuauuuuuaguagagacaggguuuugccauguuggccaggcuggucucgaacuccugccugacucggccucccaaagugcugggauuacaggcgugagccacugugcccagucuaucacauauacacuugugaaaacuucuaagacuuccuuacaaauaaaaguggugacugagaacuaagccauauaccuagugauaucucaguggugaugauaaaguuaguuuuuauuugacaaaaucuauuugcuaucagaauacuauacuuaaaaaucauaagcuuuaacaauuaaaucgcauguauaaaaauuuuagagaacaugcagcuauagcaacuucaaugcuauacaggaagcugaagacauagguccacaccucaguaucugcccucaggggaugggcagacaaauuucaaugcccccccccaaccaaaagcaaagacacaaaaggcauguacaagacaauacaaguuguugccaagcacuguuucaaagaaauaagauuuaacucaugcuuuuaggagcauauguaaauacauaauaauuaucaaaagacaaacacauuaaacaggcuuuuuuaaacgcacuaucugaagucaaugaauccaucaacaggagcugaaauuaaguaacgcccuggccuugacccucugaccccguuucaugcucgaaguccaaagccucuucacaaauaguguuuaggugcacaccaagucaacauuccuuuggacacgucucauaacuuggaaccgguuaauagauggauccacuauuuuugaugagauauuauaacuaaccuucuaugauuuacuuucuaaagcagcccauagugcauacggcaggaaaacuguuaacuaauaauggcacuuacucagaaaauacaugcaaaauuuguuucugaguugaacaccaacaagcaaauuaacaugucuuccaaacuccgucucacaugaaacaaacucaugucauucccaguuaguguuuguggaaacauauuucaaaauuaaucucaaaauucgggaaacauauuucaaaauuaaucucaauuuggauucaucuccauacucaggguggcaaacaucacugauuuuuuuccccuccucuuuuaaaaaaugaaccuugaaggcagaugcuugugaaaaacagaauaaccagcccuuguuccagucuaaaaucauugguuguucccaagacucuacaaaaaaagcaggacacaucugcucuaguguuccaugccaggaaguaguuccacagccaccacuguggucugacuucacuucccaaucauuuuaauuuggauuucuuuuuagauuuuguuucaaauuacagggccauacaaacgagcuggugaguugagaaaauagcuuuggaacugcauuggaucaucaaaagaaacggcagacuuuggcgugggagaccaugccucaggcuccauccauuugguugaggugcccacacaugcacaaaaauaaaagaauggcauaaaaacagacaaaaacuacugacaugucagucaucauggcuuaaggaaaagcucacaaauaauuucucuggaaucucaccaaaauuuggaguaaaagaugauagcaugcuaaaucaguucucuugcuacuucuaaaauacuaacguuccugaauggggcucaagguggaaucauuucgaggcaaauaucaguucuaguagauaaaaguguuguuuaaaaccucauuaacauuauauauaaauauuccccaaaaugaucuacagauccaaugcaauccgcacuuuuuuuuuuuuuuuuuuuuuugcagaaaugguagugggggcagggggugaggaagaucuuaaaauucauguuguaaugcaagagacuccggauacucaaaguaauauugaaaaagaagaacaaagauaacggacucacacuugcugauuucaaaauuuacuacaaagcuacaauaaucaaaacagugugguacuacaguaagcacaggcacacagaucaaagaaaagaacuaagaauuaagaaauaaacccauauuaucuauggacaauugauuuuguguaauagugccaagaccauucaaugggggaaauaauagucuuuuucuuccuuuuuuugagacagggucuugcucuauugcccagguggcgugaucaaggcucacugcagccucagccaccccaggcucaggagauccucccaccacagccuccugaguagcugggacuacaaauagauguuaucaugccuggauaauuuuuuuguagaaauguggucuugccauguuucccauucuggucuugaacuucugggcucaagucaucugcccaccuuggccucccaaaaugcuggaauuacaggcaugagccacugcaccuggcaagaauagucuuuuucaacaaauggugcugggacacuggauauuuauaugcaaaagaauaaagucaaaccucuaccucacaccauauaugaaaauuaaaaugaaucaaagauuuaacuguaagagcuaaaacuacaaaacucuuagaagguaacagguauaaaucguuguaaccuuguuucggacaaugguuuccuagauaccauaccauaguaacugccacaaaagaaaaaacugauaaaauagacuucuaaauugaaaauuuuugugugucaaaaggauccuauuaaggaagugaaaauacaaccuacagaauggguaaaauauuuccaaauaauguauuugauaagaauuuaauaguauccagaauauauaaaaauucuuacaacucaauaauaacagcaggccgagugcaguggcucacgccuguaauccuagcacuuuggaaggccgaggugggcagguugccugagcucaggaguuugagaccagccugggaaacaugguaaaacccugucucuacuaaaaauacaaaaauuagcuggaugugguggcaugugccuguaaucccaacuacuggggaggcugaggcacgagaaucgcuugaauccguaaggcggagguugcagugaacugagaucaugccgcuucacuucagcccgggugacagagcgggacucugucuccaaaaauaaaaauaaaaauaaaaauaaaaauaaaauuaagaaaguaagguaaacaacccaauuaaaaaauugggcaaagaaucugaacguacaucauuuauuugaacugaacaaaauaauccauaacaaaccauugcaaucgcaugaagaaaacacugugguugauauuuaauuccucaaauuucugccagcguccauuuggagcacaauaaacaagaucaauauacugcacugaauuauacauauuaaggucaacaauuugucugccagaaugguagagagcgcaauauuuuuuuaaaaaaggaaacuuuuuuuacauucauuauuccuagaaaguguauucuuuuuaauguagcuaaaaggauuuacuuuuuccuaaaauuauggaguagaaauacauaaaagaaaguaucuguuugccaaugguaaaacuauaaaaaucauucaggaaaacggaugcuguauuacaugugaauuuuuaaaggucauuaucaaugacuuccacagaucaucuggaugacauaugcacuauauuuacagauuccauaauuaagcuccaaagcaagaaaaagagagcuuaccuaauaucacaaccaaaaaaggcauagagagcuaaacguauacaaagcacucuacuaaccaccacuauggggugaguucgacaccugcaggucuguaaccucaagucugcagacagaccaguuggggaccuaagguaugaaguguacuggcauucacacauuuguaucuugcuguguggagacauuucaacauggcaguccaaaugucagaaaacuaggaggcugucuuaauaguauaccguacuuugccauucauuugacaaagcauuuucauuuauaaaugagugguucuauuuugaaagagaaauugucuugggucaaagauauacauuuagacacaggcagcuaaacuuacaggccucaugucuguuacuuaauaacacuagggaaaauaugaauaaggagcucugagacuauuaugaaaccaaugggggaacaaggcuuugguuguugauaauauguauaaauguucuuggccagaugugggggcucacgccuguauucccagcauuuuggggggccaagaugggcagaccaccugagaucaggaguucgagaccagcuuggccaacauggugaaacccugucucuacuaaaaauacaaaaaaauuagccaggugugguggcacacgucuguagucucagcuacuugggaggcugaggcaggagaaucacuugaacccgggaggcggagguugcagugagccgagaucacgccacugcacuccagccugggugacugagcaagacuccaucucaaaaaaaaaaaaaaaaaaaaaguucuuauguccaaauacuuaagucagcuguaaaccauuaaaucuauauacauuuaaaagucauuucuuaugaaaaacaaagucacaccuauguucuuauaagaacaaagugacagcucucuauuugcuguuaugauuuuuuuuuuuugauguucauccuugacuaacaauuacacauaaggauacuugaaauucucaauaacauuaaauuucuauuuuguugggcugggaagugcuauaaauauucuauuuuaaaccuagucuacuuuggacccacuaaacccccaaaucaacaggcuuauuagaaacagaauauggaaacacugucuuugaaauaaccaugcugcauuuuuccugaagaguggaacauuuuaucaagaggccacaguaaaauuguaauaaaaaauaagcauccuuucauuauugcgaauuucuugauuccccgccauaucuuucaauccugccccauucacuauggauuuauucagccagagaucuuucccgcaucugguuuauaauaauucauguuuuuauuaauuuugaaugcuagaagaaaaaaaauggguaugaaacaauuaugccuuuguucccucuuuauuuccuacugccuuucucauaaauugguuauuauagcauucuguaaaacagccaucucugaaaagagcuacauuuuuagccuugagguagcugcaaagagaagcacacuuugauaaauaaccucagugccaauacaaagaguagaauagaauccuuuuagcagagauuuaaggaagauuacaaaggacaaagaaaacaccaucauuuuuaaguaacaauuugacaaagcaaagguugaaaggaugaagggauucugcccuuuugaaggauuaauaaauaauuaaagcagaauaugaacacugaagaggagccauaguuucacugaaauaaugauuccaucguuuguugaaugaaaaaauauuaaugaagaccuacauagugauuuaaaagaggagauuuuaucucuauacaaacaaugccugaggccauucuuugcaagaaaucuucauaaucugccugaaaauaacuuuuuaaaaaauaaaaacauuaauaaaugacugagccugggaacuugcacauaauaauuaaaauugaaugaaaaaaauaugaaauuauaaaauaaaacacgggccuuuuauaacacaacaggacacuugaaaauucacacuuauuugucaugggaauagcuucagacugugguuggcggucaaacaggacagcacaauuaaaucaaguagaugaccaaauagcagagggucaugguacaaagaaggaccauguuguaaaauuuuauuaauaaagguccucagaacccugauuuaugcuuuguuaucuuggccaaccacauccauuuaguuagcuugaucaaucacagcuuuagaggaugcuguggccuaggaaagaaauuuguuuuguguggugcuuacgcuagaugucaaggaaggaguuuuggucaggucuuuaggguuacggaggagcccacuucaucaguccaaguuaaggagcaucugccuuuuuauccuggggacuggcuucaaccuuauauuuauaauuacuaauaucuaaaaaguaccaggguccuugcuggaucuugaggaggcaaggaugaccaacauauaucuggaagaguucacaggauggaggguuaguagagauauaaacaaauaauuuacuccaaguuagaguaugguauuggagguggauacccagugcuuucacauugagguuaaguaggggaaaauuccacuucagagaggaaaauaggcagcagaaagaacacagauuuuggacuucuggcaggucuuggcuuccaccccacuuucaucacuuuacuaucugggcugggcaaguuggcaaacucucuuagguucaaaguucaauuucuucaacuguaaacuggggaugcuaucacugaauuuccgaguaucuucacuagcccauaugcugccuuugugugaaaugcaagaacagcccacuuccagugggugugcacaaugccagagggcuuggcuccuugagugggauguagaauaaaauuaucagucuccacucuuacccuaaaccaccugccacugccacaucucuauauggcgguccuguaccucaacggggaacauucauaaagaaagaaugugaccaucagcauuaucacaaagaggcacucauuaguugguuacaugguugucacucaaaugccagcucuuuucuccguucucuaugcaaauuagaaaggguuuauaggacuugggcauuuuacuugaaucuugaaaggugcaacuuuucaagcaaggaaaaaccacaagcagcuuuuuuuuuuucuuuuuuuuuuuuuuuggagacggaguuuugcucuugacgcccaggcuggagugcaauagugcaaucuuggcucacugcaaccucugccucccgaguucaagugauucuccugccucagccuccugaguaacugggaauuacaggugccugccaccaugccuggcuaaucuuucuauuuuuaguagagaugggguuucaccauguuggccacgcuggucuugaacuccugaccucaggugauccacugccgccggccugcagcuguuuuuuuuguuuugucuuuuguuuuuaagggaacuugcauaguuccgaaaaggaggaauugaagugggagggggccaaugugagauaagagguagggugacuggcugggagucuaaugacacugaugagaggacaggaucucagguaaguaggggaugugcagagauuucacaugaacacagaaggccaaauauacagaacuugcaacuaauaagaaauaaugggugagggagaggaaggcaucauggauaguuuaggccaaccaagagaacucagaauagaguguguaaaacaaguaaauuuccagaaggacaugaguguuauacacauugauugcagguucagaggcacaugggauauuuggggucuggaauauggcacugggauucaguacgcuggcuguggcuagacccaugaauuugggauucacugaaguuagugggaaaguagcaugaacagacaggaugccucagggaagcacaauggaagauacaaggccagggccagaacucacaagcaugaugaacccuaugcucuggucacaguuuacugcucacaaauuuaaugucaauuuuccccuucaccgauagcauuccuucuucucagcaugacuccauucuuccucauuuucacccauaaaagagaauucuaauuggaagcauaauuuacugaagcagauauaccucucccacuaaagauacuggcaguuccccagacuggugaaaaccucuuauccauaaagcaacuguuaccauuauuuaauuaaaccauuguaucucucuacagauguuugacugcauuaagcacauccuaauugcuuguauuuauaagcacaaacuucuauacaaaaggcaugcauuuuuagggacuuuaaaauuuucuccuuuugccagugucucugaauuuuaguaugcuauuuguacugaacugacuccaaaucuaaaauuugauuauauacagaaauagcaaauaaaugcaacucagacuaaugacaaagcauuuaaucagagaauauuagaacgacuacaagacauaaccuggaaaaaaaaucuaugaagaaccuauuuagaaaguaagcuaaaagcaacacuuuuuauuaugagaaauuuuaaacacauacaaaaguaaaaagaauaacaugaggaaccucuaauaacauuuggcuuaagcaauuagcaccccuggccaaucuugaaguuucaacuauauuccuacuaaaaagggacguauuguuuuaaauguuccuucaaaugaaaaaggacuauagaugacaacuagguucaacccagaaaagcuauucuccccagcaaaccacuucuguagcuuugacacuagcagcucagauaguguacaggguucguuauugcaaacuucucuuucuauagagaacagucauuuaaaaauggaagcacccaggauuccaaaugaaagguuuuuaaaaaagauuaucuuucagaauguggcaucugguauauuuagaaugauauauaugucauuacuuaaaaaaacccaacuaauggguggauugagagcauauuacauacauacacacacacacacacacacacacacacacacacauuaagagcacauacguaauauguucuuuauuuuuauuauacuuuaaguuugaggguacaugugcacaacgugcaggucuguuacauauguauacaugugccauguuggugugcugcacccccuaauauguucuuaauccaaccuaauggcuguuuuuuuuuuucuuuuuacagaaaaagauuccaugauacuaguuaucuaaauauccucccugguacugagauuugaaguuuauugugcugcccuauucuugggcauuucguaauauucaagauaucugaaccaccaucuguucuguggaagugugacuaauuaguggcuaauguuuucaguaguauagugccaaauaaaaaguucuaauaauuuaauuauaaagagucaacaauaauugcugggugaggguggaauauuggucaucaacuuuuuaguccuuuguaauggcuuauuucccuauaguuauuaccuaugccacuucaacugaagucacaugugaaaacaggcuuaagauagcuguaaaaaacaaacaaacaaacaaacaaaccauguuuucuagaagauuuuagcuucaguucauuaagacugauaaauuauuucauuuuguaccuucuacaacuuuuuggagaacuucuuuacacuuauuuaauacauaguauuuuaaagguuccuuacugaugucuauucuccaaguauaccugaaaaguauauuuguuugcuaaagaaacuugauacagugaaaaauuaauuggagaucucuguucucaauucaugguguagacuaaaaacuccaccuccacuaucuucauaaauucuugcucaacacugaguugcuccuucugaacaaaagcuuggcacacuaugaaguugcuuuuuuucucuucuuuuuuaaauuagagaggggguuucaccauguuggccaggcugguuucgaacuccuggccucaggugaucugcucaccuuggccucccaaaguucugggacacugcaccucccugacauaugaaguuucuucugcaaguuauguagcucaaaguauaauuucagauuccguccauuaaugugcaguacugaacagaacaucaucacuugacacaugccaaauauuucacagcaauacaaacaauauuuacaaggccacauaaaucaggaaagaaugagcagaauaacacuggcauaaaaugggaaaaagugagggccagcuguucccuugagcgguguuucaggcacuucaaagucggacuuacuguaauggguacauccaucuacaacauccugggugcucugauuccagaugauaaccuguaucuauuuccaacccaauuaacaaaggguaggauucuuuauggggaaggauaugccagauacauauugcuuauauguugguagacuacacacuaaaucuccaguauagguacauaugcuuauauugaaagaugcaccaacauaaucgucaucuauguaccuuugugaaguaaguuaaacaguuaugggcauuuuggcagcugacagagacucaugugguauuugauucucuuuccaagagaaacagaaaugagagaucuuaaaugaaaucauuagucauuaggaaaacuagggacauaaaagacagugggcacacaaggucaguuuccugguuuugauaauggacuauaguuacguaagaugucacuggugaggcaugugggugauggaugcaugagaccucucuguacuauuuuuccaaguucuugugagaguacaauuauuucagaauauaaguuuaauagcccacuaucuuuuaaguuuaaacaaugaugugguucagagaacacucauggcuucccugcucagccaucaaagagaauugugacuuacugaauauaacaauaaccucaaagucacaagucacaguuauguguuuuggcugugcuacuuauaaugcaugugacacaggccaguaaguuacucaaauuuuaaguuugagcuuuuucauuuguaagauggaacaaucgugacacucaaaagaugaagaaugaguuuuuuuccccauuaauuguaaaguaccaaagcaucauaauuugagagccauaacaagauugggcaaauuagaaaaaaugcugccacguauaauucaauaacaaguguccaauuauuacaaaacuauacccuaagucaggcgacauuccuccagucuuacaaguauggagagguaagaacugauucaauugcuaaggcuaguaagcuaguuccagccugacaguuucaucguaaaaggcaagcuguucuauuaacuuccauauuccucaaacagauaacucacuuccucaauuuuccucugggggaaaauacauguccaugugcagcaucaaaagaacagcuuacuuaccaacuucauccugaaucuccucggccacugcaggcacguuguagagcagggagagagacugauucaugcgcucauaaaucacacggaggugugucauaaccugcaucaaaggaugacaacuccaggucaacaaugucuggggguaggaaugguucuuuuucuuucuuuuuuucuuuuuuuuuugagacggagucucgcucugucgcccagguuauuuuucuuaccaagcacugcagguagauacaaacuuccaaaagaaaacugacaaaacacugcuacuguuaaaaagguugaacugaaagggcaacuuuauuuuucuuguucuccuauuucuguucucuaacuuuuugagcucagguuuaagacuugaucuugaaacuuaccauuaucuuguaugcuuauaacagccaauuaaaaaggcuaccucugccaccucugauuccuaauacugaggcucucuuaacaggacccucaugccuaaauacauuucuuugcaaauuucccccuagaaaacaacguauuucaauuugauuggcuauuucaugcuauauauauuuaacucuuucauucaagaaaauguaaaauuucacauuuccuaagguagaucccaguuuucagccuuugggaaccggggaguauaaaauacauuauuacugggcuucauuuaggcucacaugaaaucucaacauuccaguagguuuaugauugccugccauacuucaguugaaccaguuuucaagauuuuaguuuauacaacuuuuguuuuucucauuuuagucauugguuuuaaucaguuccuuagcaaucaguuagcaguagacuaagauuuuuacauuuguuauuuucauaacucagaaaaugccaaaccacauauugcucuaagacaagcuuuuagaauuuaccagaaguuaaagagcucuugccauagggaaaacaccuauaggugcucggagaaugcgugggauccugucaccaacccaagaagcaagaauccuggauugucaaagcugcagaagaugauuauaccccacgcuuaccugggaccggaucugagcggcuuucuugggauccaccaugcgcacaugcucgaaaugcuuuagggugugcugucuguccuucuguucugcgcggacauacuucuuuagcauauugaacacgugacgaggcugugggaggaaaaugaaaaacucuuuuucaaguuugugcaaaacacugcuucuuccauuggcgauggguuagagguuccacuaaugcauccggucaugugaacguacugugagucaccuuuuugcaggucugccuucuaaacauuucuccuacuccuuucuuaauggguaauuacuuagaucggcugcuuuucacuuccacaagagcauuuaacauucucgacauauaugaugacuguccuccuuacucaacauuuucuuuuuaaauaggaguacucugcuauagaaagagaacagauuugaggucugucagguuaaguuagguccuucucuuuucgcacccaaggggcauaugugagacuacauugcuacguguacauuuugaagaccagagguaaugucacacagauaaucccaucaccaguaacauguaacauacgaaaucaaaaugagaaaaacaggaaauuuaaccacuauuuuguaagccaaggaguaacugaacuguaagagacauuauauuuuucuaggagaaaggccauugcuaaacuguauuuauuuuacucugaaauuuaauuaaguucuuucuaagcuaucagauucuaauucuuucagcaacaauuacauuucgucuuaagugcuccuauuuucuuucuaauugguuccauuucauuuuuauuuuaguuuuaccugaaaacauccauccuaauaaaaacuaaggacaaagauucccuggucuucaacaauuucaucacuauaugcauuccacuacaugauuuuguaagaugauuuccaaaaacacaacauuucuucuucauuaaaacaaacaaacaaaaaaaccaguugugaaaauucauguugggaauagaauuuuggucauuugggcaaaccuagcuauuauuaacccaugugucaugaguacccugaaaaccaguuggaagguacaaaauuuauuccagagaugguguguguggugguggggcgggugguaauggagcuuuuguuguguuauccauauccuaugggaugugccucuccuuccccuuuugcuuaguuaacuuaggagccaucucccugccaucucagguggaacgagguacccuuuuucugugcuccuaugaaauacugugcaaauccccauuaauguaccuaacucauuaaauuaucuaugauucuuacuccccucuuuaaugugagauccacagggcuggauuuggucuuuuuucuuuauuuggaaccccaauaacacagugcuugacccagagggugcucuguauuugcuuggugaaugccugccacagaggccaugcuacuguacuugagaaaacaaauacauauacacaauaaaaauaaaacaacuugggcucaucugccuucuuuuuuccuaaaagaaaugugcuucucuauaauccccagaaagacagccaucacagcuugcaacaguucuuggcaacuuauuacaacucucaucugaacugugaaaucugguugaauuuacaaaucagaggaugaccuuuuaaaucucagaagaaaaguaguaaaagagguaaugacugauaagcuauaucucuauauauugaaaagaggauagguuauacaugugaauuaaaaaaaaagaacauuugaaaacaucagagauuaaaggcugacucuuguugauugugaaggauauuugauaugcagaguugugugaucaggaucuugcacaaccacccucgaugcuugcuuguuauuaagcaccaaggucuuagaaaucucucuaguucuguuaccauuauucauccaagacuggagacagaaggggcugugacuaaucgcauuuaaccaugauguuccuuccuggccuucauggaugcuuucuuaguugcucuauuucauuuuucucccuuguaaaggauuuauuguuuugaagaaaaugggaugaauuuuuaagaguuuaaauaagaaaaaaaaaaagcacuucaauuaaaaaaguaaggauugcuuugggagucugaggcaggaggaucacuugcagccaagaguuugagaccagccuggacaacauuacaagaaccugucucuacaagaaaauuuuaaaaauuagcuaggugcagugacacaugccugcaguuccagcuacuugggaagcuuggucaggaggauuauuugaacccaggagguugaggcuguagugagcccugauugcacgacuguacucaagccugggaaagagaauaacugccugucuuuuaauuaaaaaaaacaaaaaacaaaaaacaaaaacaguaagaauugcuuuucaucauaacuucuuuuuuuccaguuagucaucuaugaauguuuuuguaagauauuuuguccuaaaaggacugucaccaacaagcagguacaccaggaugccauggccccaggcuggccuuggcauuacuacuucaagcuaaauuucaauuuagagaagaugcaggucauuucugaugaccaacaucuggaucuccccuuuucuucuccuaucacaacaaacagcauauauucccacuaauuauuauuauuauuauucuuugagauggaaucucgcccugucucccaggcuggagugcaguggcgugaucuuggcucacugcaaccuccgccuccuggguucaagugauucuccugccucagucuccugaguagcugggacuacaggcacgugccaccaugcucagcuaauuuuuuuguauuuuuaguagagacgggguuucgccauguuagccaggauggucuccaucuccugaccucgugaucugcccgccuuggccucccaaagugcuaggauuacaggcgugcgaccagugcacggccaauuaauuauucauguuaacauacauuuaaaaauaagcacaaaagccuugacuuuucccaccuaugcaauucagauggcaguaucuuucagauaguauuugcagauuaaauguguucagugauaguuacccagaaugaugcguaguccauugcugauacucaauacacauuuauuucuuucacucaggccuuaucuauaaaucaucgaccccuuucuuuccucuaaguaauaagaguucaauguguauugacugcuucugaaugagacaguauauuaaaugcuuuuugcugguaacucaucaaaucuucgucucagcccuaugacagagucauagcagcucuccccaccuuauuggugaggcaugaagcacaaaggagauugugguuacauaggcuacaucccuggcccaaugguuacacagcuaguuaguguuagauuugaagaauggguuagucucacugucuuggcuccagagccuccuucuccuaaucacuuugugaucuggcccuucaaggagaaucuaaaauagaccaaguuuaagauaguucuacaaagcaacuuacgaaguuaaaaacaggccaggcgccguggcucacgccuguaaucccagcacuuugggaggccgaggcgggcaggucacgaggucaggaguuccagaccagccuggccaacauggugaaaccccaucucuacuaaaaauacaaaaauuagcaaggcaugguggugggcgccuguagucccagcuacucgggaggcugaggcaggagaauuguuugaaccugggaggcggagcuugcagugaccugagauuccaccacugcacuacagccugggcgacaggacgagacuccgucucaaaaacaaacaaacaaaaacaaaguuaaaaacaaagaaauaagugcaugguuagaaaagacagucuguuccaggaguacuugccugacuuucuaguuuuuacaagugcagguaauauucugugggccaugcuaacaucagcuccuuuaauugugcagaagguucagauuuagcuuguucagucucucaauuacuguccuagguuucuggaguuccauuauuccuuagcuaaugcaugaaauuauuuagcuaauuauuaagcuaauguguggggagaagaaagagcaagauaggaauguccucuauccauguggauaaaggauuaggauuacuggaaagugauucaagguauuaaaguuaggcuuuugugacauucaugguuucuagugcuaaauucauccuuaucuucuauugagauggguaauuaaauggugaauguauucacauguuuucaauugcugaucucauuuaauacugccauucuccuucaaaauauauuccuaacuuauccugaaaauccccagaguuugauaauaauguucccggacugaacugaggguugggcuacuauaccucacagcccaauaacgagaugcagaugaacugggaggaagagaguuuuuauuuuuguaaccuuuuacagggagauggccuggaaauuagugccagaccaacucaaaauuacaaaguuuccagaacuuauaugccuucuaagcuguaugucuacguguaagugugcauucaucucaugacagaagugauuaacuucuuuaauccauaacuaaggucugaguccugaagaccuuccucuggagucucaguaaauuuacuuaaucuaaaugggucuaggugcuggggugauuacucuuaucuugucuccugcuaaaucagggagguuugaggaguuccugcagaccuccaguaaacuuguucuuggaggccuguagaguuucuucagacucccaguaaaacuuguuaauccuaaauggguccuguuaagaauuccuugguuuugccaggaaaggccuaggcaaaacucuuggugggcuuuuguuacauuccagccucuguauaagggcgcuggcuuuuuuuuagcuuuuaguauuuaacugaaccacucagucaguacggaaacagcuguuacggaggccugcauuagugagauuuggccugccacaauaacagaguagcaaaggaggcucugaggacuccccaggccucagcuccuccagggauaaugagaccugggaaaccccuucacuguuuauguaagcugagaugcgcauuuugugugcaucuacauaaacacaagccuuuucuuccuaaugccuauuggauaagcaaagccugggaacaucagauaauucaggaagaccuuaggauaucucccaauaaaugaauuugcaggguucugcuucauugauuuggccaccuaaacacaucucuaggaaucaugcuuggaaaugaaaacaaaaucagauuaccuucuuuguuggacgguaggcaaauaaaucauaccaaauaaaaugguaguuaucucuaucccucagaaacaaauacuauuuuuaguuaagaaagaaaaaacacagguguaaaaagaaaauaauucuuggggcccccaaaucacuaagcuaaagggaaaagucuagcugggaacugcuuagagccaaucacccugauugucuacccuggagaggcuaaucagaaacucaaaagaaugcaacuguucaucucaccuaucucugaccuagaaggccccuccccacuucgagucuuccugcuuuuuguuucaagcugucucgccuuuccagaccaaaccaauguacuucuuauauguauugacugaugccucaugucucccuaaaaaugcauaacacuaagcugugccccaaccacuuugggcacaugucaucaggacuuccugaggccgugucacaggugcauccucaaccagggcaaaauaaacuuucuaaauuaacugagaccugucucagauuugcuggguucacauagauaacaguucccuauacuuuuauauuuuuguugagguuaaaaaaaagaccucccuccuuuugauauaugauuccugcauauuucacucaaauaaauaaauaauugcccucacaacuuuuggccaaaauacaaauccuccaggcuuaacauuuguuauuucuugagcuauaauaauguaucuaagaauaacaagguguccugauugucuagugagguuuauuuuauuaugcuaagacaaagaugaauuucuuaaaauuuuaauuaaaaacacagaaaccuucauacaggaaugguagggaaaaaccccucuguuaucucuauagaaacauauucucuuaaaguaauugcuauuacuauugucacaauauucauacuuaagacggguuauucauaugaucagaaaaacaaaagaauucaguggcucacgaaaaggauauugauaaagagaguuuaagaaacauuuuuuuuuuuuaaccugcaggcauauaauccggaucacccucaugucuuuaaaucuucuguuacuagcaauaauuuuucuguguauuaauacuacagucugguuauauuggcauuagauggcuaaucucauuauuaaaauauauggcaaagaacagaggaagagaucugucccaggaggacuaauuauaccgaauccuauuuauugucacuacuguuucugaaacaguguuuagcucauaauuaugugcugucuguuugcaacugaugugacauuuuuuaauuuguacuaaacucaccucacaaucacacugccuuuuaaaaaaucauucaaaauaauuuauuaaaggauuaagaacaggcaccaccgaaauggcuuagacaucauuuacagcaagaggaaagagaaacauaagauuuacauuuuagaacauuacucauuuuccucucuggaaacaagagcguaauguauuucuaccucuaggcacaguuccugccacaauuugguugcuaauaaauauuuguuaauuaaauuaaugaguaacuugcagcuagauacaauuucagaaauaggcccaguagugcagaauauccuucauagucuucaaguagaaaacaaacaccucucuacucagaauaguggccuucccaauuuucaccgaaauacugacauuaauaaaccuacuugauguaucuauauagugugcuuggguacuuuagaaaguaguuuuaacugggaacucuucccagaaaauauuuaauggacuucauagcgugcacaaacucgucucaaagagaagauucauuucauuaauuucaaaacaucucacauauuguguucuuauaguuugaugucaaauugauguagguaauauugaagaaaauuuaauggccuuuccugauaaaagcuaacacgguuuuggagauggagucucacucugucgcccaggcuggagugcaguggugcaccuccaccucaacucacugcaaccuccaccuccuggguucaagcaauucucuugccccagccucuugaguucagcugggauuacaggcgugcacccucacaccgaccuaauuuuuguauuuuuaguagagaaggguuucacuauguuggauaggcuggucucaaacuccugaccucaggugauccaccugccucggccucccaaagugcugggauuacaggcgugagccaccgccccuggugcuaguacauuuuuuauugauuuccccauuucuuagacguauuuacuuuuucauuuuucuuuuauacgauuucucaaauuugguguugcugggacuugggaaaagucucauacauuugacuaauggcaggaugacucaaugccagucacgucugaauauguagcuuauuacuugacaguucacgugggaaguguauuaaaauuauuaaguccuauugucccacuccacagcuuuaugcuugaucuagaaaucuggcaucuuaucauaauagacacuugugcccuaaacccguuucuuauggaaggcagugaagugucaagagcguuuaaaagcccugggcauaauccugccaagaaggaaguaaaugacucacuguacgggaaucaccccaaccuuuccaggucacagaaaacccucuccuggagcauuaaauugcacccuggugguuuccaaaacugaacaaagcaauucucuccugcuuucauaaauagguucagaacuauuauuuucacaguuuuacacccuggauuucaagaaaucuugagcauauaaaauguagaaaauuuccgugugcagguuuaaaaaucacacuuuagagaguuaagucucucugugcuugagaugaucuuaguuaaacguaauauuuggggaaacugccauggggaccucugaaucaccaccuuuauugucuuuaaugccaggaguugagcugaauuuuuaaagucuccugcaaaauuuauccaccuuccuuucuucagaaaggcaaacaaaugaucuuuguaguuuaaggugaguauaaaagggcaaaugauaaucccaugccaagguggacacagaagucuugaaugaagcaauggagaaaauggcaguagauucucacacucucccccuuugguguuucuuaaguuuuaacaauauggauccauuagauggaaggauauugaacaacuaaucucuauuaauccacuuagucauaaggccagagcaaaacuuuuguuuauggccaaggaguuaucccaauguuccuucccaggguauccgguuugcugaugcggcucugauuuuguacugaacaugacgcaggagcaucuaggagucaucuaucaucuguucucuccuucccguggaagcagaucacuuccucauagggaugugucaccaaagccuccauguacuuccucuaacaaucuuucuccucuuacggaggaagacaucuuccuacuucacaauuuugucucaacuuucaaugaauccuuuugauuuucuaauuauggcuaacaaaagcuaaaacaacagaaauugcagaaagaggagaaaaauuaacuccaauuugcagacggaauaggaggaaucccuuuauuaaaucacuugcuccuaguuacagguuauaaagauggcaaaccugggaaguaaagacaagaguuuauguuauaaaagguagaaaauaggagugguuuuaauucucucaucacuuagugaccuuuuuucuuuucuuuuuuuuuuuuuuuuuucugagacggaguuucacucuuguuauacaggcuggaguacaauggggugaucuccccucacugcaacccggguucaagcgauucuccugccucagccucccgaguagcugggauuacaggcaugcgccaccaugcccagcuaauuuuguauuuuuaguagagacaggguuucuccauguugguccggcuggucuugaacucccgaccucaggugauccacccgccuuggccucccaaagugcugggauuacaggcaugagccaccacgccuggcugaccuuuuuacaaaucugguagguuucauaaauuuuuuccaggguauuuugcuaguucucagaaauaauuuauuuugguuguucagaccacagucauaaauuagugaaggcagcauauagaacugaaauuuagcacccaacacaaccccaugauucaugcuuucagacaaacucuagcacagaauggauaaagagcuaagaucuucugaccugggaauacagaaaggacagaaaauguuuggacuuguaugucuucaagcuuuguuuagucaaacagugaaacauguguacacuuaaugaugaacagaauuaguaauacaacccagaaggcaaagcgcacaguguugcugaaaucauaagcaaaagauauguucgacuaacucggacccuugcagagauuugucaaacggucugaucauccgaaaaaugccaacugugacauauucuugacuuuuuaagagagauuuacagcaaucugcuuuaauuuugcauauucauacuuggacuauggugguccugcuucauacauccucuaacugguuagccuauucaaagaaaaguacauuugcauuucuuuuaauuuuacccucuccucuucccauaccuaggcaguguuaugaccuauuagaaauucugaguuuuuuguugauauuaaaacauuuauauaaggaaacucaaggugaugauacuuaaaagccaaacaucaccuggcaucuuuaaacugguauccauggucaaccuucacaaaaugaaugaaccccuuaaagcuuaugcgagauuguguuugcguguguaugcguacauguuuccagggugaggauucuuugcuacccaucuguucucuaucagucauaccaggcaggugaauaacuacuggaucuuuaaaugugcuauuugucuacaaaaacuaaauauuuauauuuucauaauacauuuucauucucaaagauaaaaugaacauauauauuaacauuaaaauacguagguuugcuggaagaaagcagagcguaaaaccauacggugcuauggguuuuaauagcauccugugaagaccuauuugcauucugaaggcagugacugagcagugcuccacuguggagggaaucugggugaugaauauggccucaguggcaaaagacagcuuuuaagcuaaugccuucccaacauacuucuuaauguucuauguaacuuaauuaaacccagaaaccacuaguaucucuuguuacauacuucccauuuguauguagcaagauuuuaucgaacuugguaaacauucagaagguagggaaguaauaguacugaguggcuuuacugaaagagcauguauaccauucagcauaguuuauaagauuuuguucacuaaaugcuaauucucucauuuuccuucccauucacuaucuguuauuggguuugcccuuaggagugcccaagcuaaugagucccccuuugcucaccaauguauacagaacucaacuaaaaauaaacggauggugaacaaauaaauaauaaauauguaaguauagagcaauuauuuacuuuucugaaagaugaucuuuuuggccuggcagucuuucaacuuuuaauuccauucugauuagcuucauaaaauuuugguuaaauucaaaaccugcugguggaaugccuuaaacauuauaauauucaucuguccacauaccaagaacucagcaaauaauuuuuaacuuacuaucaguuacauugagguacagaugucccauauuugcuuuggagauauaugcuauauacauauauuuuauaagauaauuucuuuugcaacgaaaagugauggguagaaauaauugguuuguugggugaagggcaauuagcgguaucauauaaaagcucaaguuuaguaccacaauuucuuuuuugcuuuagaaaagaaagguacaccaacacccacauugguuaaaguuugguuuaguuguaauccacaucauauaguggcgaaaaauuuauuuaugaggugguuuaaaccuucucaugccaucaccuguuuaccugugacaaaccucccauuaaugucuacccuuguuaucuccaaugacggcuguuucuuguugaacauuuauugcucuucugcuggaauuuaccaaauagccuugagcaaaaucucaacuuagugaugaaaccgugcucuuuaaugaagagucucacagaauucauguucuaucaaagaauuaugugaagaaguuuccagagaucucagcaaaauuuaacauguggcugaaccauucaaaaaugagaaaccaaagaaggaugccgaugcuauagaaacugccaacauuuuuuuuuugcucaauuaaacugauagccugaaugugaagcagcagauagaagcaugaaaugaauuucaguauggauaagaugguuucaaucguuaagacacugaaaaaauccaaacaacacaacugggauagauaaacagauguacaggaaaauguuuccuaauucucacuucccuuuagaaaaugcaguuguugaagucagaauaauaaucaugauaacugucugaugaaagauuuagacuaaguaucuguaaaaacaccaaaaaucucagaauuacaaagaaagcuuuggcuguguaucccuuaucuuuaaaacaguucaagucuuacaaauuagggggugcuaagguuuuccaaaccuaggccuacaauagaaaguugauugaaauaaaaaaucccuaucuggccuuugguuuaacuguacaggaucacauuaagucuaauuucucuucaacagucaggacauaucaucaucuucugucuaugaaggauaagcagaacgcugagaguuacaaggggaaaggcucagacagcauuuaguuccuguuucaugaagcuaugaauaguuugaguacgagcccugacaaaguaaaaagcaggaagugcaugacuguagagggcagguuaagaaaugaugaaugcuuagcuuuaaguauuuaaucugguagcuugcaggccuccaaaggugguagaaguuaaccuccugugcugcaguucuggagaggcauuuaauucuuccagggggaaaaagugcuaacuccuugauuuuccaaagaaagucuaaggaaaguaaaaaggugaagggguugguguuuagaagagucacuagccuucaacagaguaagaguuuuuucugagugcaaagacacagcucugcucaacuuuuuuuucccauggggaaaacaacuauuuuaauaauuguaauauuucaaguauuuaucucauuuuuuaacuuuuaauuuuggaacagcgucuugcuuugucauccaggcuggagugcaguggcaccaucacagcucacugcagccuugacuuccugguucacacucacaccucagccuccagaguagcugcgacuacaggcgcgcaccaucaugccuggcuaauuaaaaaaaucuuuuuuuuuuuuuuuuuuuguagagauagggccuuucuauguugccuaggguggucucaaauuccugggcucaagggauccucccaccucagccucccaaaaugcugggauuacagcugugagccaccacaucuagccuaaaguauuuauuuuaaauacaugugccuauauauguaugacucuaaauaugagucaaacaaugcauuuuuagguugaccauucaguguauuugccuauagguacauaacuaaaucagaaauuugaaacauacaguauacucagacacagggacucaggaaaugaaauucauuaguagaacaaggaauucuagcugcacaaaaacaacaucucauaacacuuccacguuuagguuuaaaaacugaguaaaaguaugauuuaaaucugagcuucaaagaaacugaaaacaauccacauuguuuuggaaucccguguuugcaaagucugagaauauacgguagaauuuguuaaggguuagacagguaauuauucuaagugguaacaucuacagaaucuauggaaacgacacuuuugauuuacuuauauucaaauaccauuuacugaauacaguugucugcauuuuccaggcacggugguuaaguaugagggagaucucagaaauauuuauguaugacuccuauuacaagaugugaucuuuuucagacaaccaccaguaagcucuggauuuaugucuucaagaggaagguauaaaaguccucaagaaggcauuuaauuacgccugcaaucucagcacuuugggaggcggaggcuggcggaucacgaggucaggagauccagaccaaccuggcuaacacggugaaagcccgucucuacuaaaaauacaaaaaaaaaaaaacauuagccaggcaugguggcgggugccuguagucccagcuacuugagaggcugaggcuggagaauggugugaacccagaaggcggagcuugcagugagccaagaucacgccacugcacuccagccugggcgacaaagcaagacucugucucaaaaaaaaaaaaaaaaaaaaaaaaaagaagguauuuacaauuuucuugugccugccaaagugcagaccuaagugccaggucaagccauacaacauuaaaacuuaaaugaacaccuaaagaugguaacuuaacaaaaauggcaaguaaugcccccuagacuccaggccugugaccacccagccacauuuuauuacaaaggaaagauuuaaaggugagucaugguggcucaugccuguaauaucagcacuuuaaaaagccgaggugaaaggaucgcuugaggccagaaguucaagacuagccuggguaacacagcgagacccugucuuuacaaaaauuuuuuaaaaauuagccacacaugguggagcuucuguagacccaacucucaugaggcugaggcaaaaggauugcuugagcccaggagguuggggcugcagugagcuacgacuggaccacugcaugccagccugggugaaagagcaagacccugaaaagaaaagaaaagaaaacaaaagaaaagaaaagaaaagagaaaagaaaagagaagauuagagaagagaagaggggaggggaagagaaaaggaaaggaaaggaaaggaagggaagaaggaaggagggagggagggaaggaaggaaggcaggagagaaagagaaacagagaaagagagagagagagagaaaauaaauaaauaaauaaauaaauccgaguuaagaauuuaacaggaauccuuagaucaaucaacaacagugaucugauuuuugacaguaaaauauuucuuccuaauccaguuuuuaauuuuuuuuucaaaugaacauguugccuaauuccauaugaagcaaugcggaggcccacaauaagcacgauuacaaccacucuaaaauuauccccuuugauaaaagaugacacuucggcaaacauucuugccacugccuuuccugugauggcugaugagacuaaacugagaguuuaaauguacauuuguuaaagccuccauucagcccucagcuuauuuuuagucccaucaauguccauuuagcaaagaucuuacuuuagagauuggacuuucagcuggaacgcuucacaaguuucugcuauaaagauucuggucucagcacccaccagccuauccuucucuggcaaaugaucacacggcuccucuccugaaagcguguucuccaaaaaagagaggaaccaaggaacuuuuguucugcagagauauaaaaaaaaauuuccugacaagugccuugcuaagauagagaauuuuggcaaauagaaaaugaaaacgcuaauaugaauauucuuuuucaaaagcucuuuguuuagagaggaagcucguucuagugagaaggcaccacagugacucgcggcucuacccucucccuucccagcagugucacccugaaccagccgcuccaucucccgagguugcagugauaucaucgguagaacaggguaaauaguaucuuacgucuuggaagaaugccacgagcucuuuaacggcuccucauggcuuucugugcacuguaacuuuauccauagaaagaaaaaucaaaauggugaggaaaaucggugcaaaugggugacuuucugguuaaguugcauaaaaugcacaaacaauuccagccaagauugagugagaagaacuggauuuacccuccugccugaaccaccaauaacuggacaauauauucauauacaaacagcguuucuuuuuuuuuuuugagauggagucuugcucugucaccacacuggagugcaguggcacaaucucggcucacugcaaccucugccucccagguucaggugauucuccugccucagccuccugaguagcugggacuacaggugugcgccaccacaccuggcuaauuuuuuguauuuuuaguagagacgggguucaccauguuggccaggauggucuugaucucuugaccucgugauccgcccgccuuggccucccaaagugcugggauuacaggcgugagccaccacaccuggcauaaacaacauuucugcaagacauuagacaucaggugaaggacacugauuccugaaaaggggaaacaaaugaggacuuacagcugccaaacucauggcccugaauuuccaggucaugguuucagguggggaaacccacacagagccuagaggacucguggaguggaggacaugaaguguguggagagaucaagguaguuguaauucacaggacaggguauuggugaggagagaguugcuccaaaagagaauccagagaugugcagagugaucccugagaauauagcugaguaaugauggguacaugcaugugaaagaaacugaagccagggggaaaaucaccaaaaagaauuagcauuaacagugcuugguguucacacagggacaggaauaaugccucuucccacgagucaggugagaaaacuuaacauucaugguagaugacugagaagggucuugccucacuaguaaggaauaacuaguccuaggcugauaacugcuucuaucccaccuaacaaaucuaaaaaugcaaagcucaaaaggaucaaacuguuuccaaguaacucaacuaugugacagaaaaaagcucaagaauauuacaaaaacaccuagcauucaacagguuuaaauucagcguccgacauuuaauaaaaaauuaugaggcauaaaaugauacagggaaaugccacauguaauaauaagcaaucaaaauugauucaaaguugacagagauguuagaauuagcaaacauggauauuuaaacaguuuucauauaauaacuguauuccauagguucaaaaguuaagauacagacgauauuauggguguuggggguagcccagguuaaauuucuauauacaacaacuacaguaugugaggugauaagaugaaaaacggccagauggaauuaagggcagacugaaugauaccauggcauaucaaaauuaaauuguuaaaaaccagugauauagagaaaacuguaaaaacagaaaaaaaagacauguuauuuuuagagaaauaaagauaaagauaucaacacaaauaagacagcagaguaucaucuuucaggcagugaaagagaaaccucaauccaguauuuuuuacccagcaaaaauauuuuucaaaaccaaagguauaaaagggacauuuuuggucaaagccaaacaaagauuucaucaccaacuuaugugcacucaaacuuuuuuuuuuaaagagacaggaugcccuuugucacccagaugggaguacagucaugcaaucacagcucacugcagucucgaacuccuggguucaagugaucuccuaucucaaccuccugaguugcugggauugcagguacaagccaccaagcccagucucuaagacauuuuaaaggaaaucucucaggcagaaggaaaaugauaccagcuggaucugcgcaaagaguuuacagcacccaaaaugaugacuucauggguaaacauguuguuuuuuuuuuaaauuuacaacucauuaaaaaauaacuguuuaaagaaaaacaucaacaauguaguaaggaaaaaguaugacaacaaccgcuuacagagagagagagagaugaaaaauggaaguacuuuuguaaaguacugucuguggagugguauaauaucauuugaacugacauaacaucaucgugacaaguuuagaauguuuucuauaagccuaaagcaaccaguaaaauaacaaacuaguuauaacuuauaaacccacaaaggagauaaaccaguaaaauaacaaacuaguuguaacuuacaaaccaacaaaagagauaaaauagaaucauaaaaaauuucuaauuaauccaaaaaaaaaagaggaaaaaagaagaacaaggaacagacuggacaaauagcaaacaaauaucaagaugacagauucagugacaaccauauccauaaccucauucaguguacauggucuucccaauccaaaggaaaacgcaagacccaauuacaugcugccuacaaaaaauacacuucaaauauaaagacaaacaaggucaauaagaguauaaggauggaaaaaugcaccacauuaauauuaaucaaaagaaagcuggaauagcuuuauuaauauuaaaguagauuuuggagcaaaacauuacaaaggauaaaaagaucauuucauaagaagaggcucaaggagggccuaacagccuggaacauuuacacgccuaaaaacacagccucaaacuauacaaaauaaaaacugauagcacuguuuagaaaaauggcccgguccacaaucacaggcagagcuuucaauaucccuugcucaaugacaaacagaaagaacaaauggcugggcauggugguucacgccuguaaucccagcacugugggaggccgagguggguggaucaccugaggucaggaguucgagaucagccuggccaacauguugaaacccugucucuacuaaaauacaaaaauuagcugggugucguggcucaccuguaauccuagguacuugggaggcugaggcaugagaauugcuuaaacccaggagacagaaguugcagugagcugagauugcaccacugcacuccagccugggugacagagugagacuccaucucauuuaaaaaaaaaaaaaaaaaaaaagaacaaguggacauaaguuacacacucaugcucagaaaguuccuuccauuccaaguaagcucucccacagaaugccggugaacacaucuaugccuguaccacucaacaugccuuuuuggggcaaugaucacugaaaaccaugaauaagucucaucauugcuaaugucaugacugacaaaugcuuccccacagagaauauggccacugcucugagauggaaauuugaguucuaauucuuucugguccacuaaaaauucuuacaacucagccaaaucucaacuuuccuugaccuuaguuauauuauuauacuuacaugaugagggggcugggcaagguuacuucuaaaauccuuugccauggucugaauguuugugucucucccacccccaauucauauguugaaaccuaagccacagugugaugcuauuugagggugaaagcuuugggagacaauuaggcaugagggcagagccuucaagauugacauuaguacccuuauaaaagagggcccagagagcucucuugcccauuccaccauaugaggauacagcaaaauacaaacaaaaacaaaaauaaaauaaauaaaagauaaacaaaauuuaaguucuaugaaccaggaagcaaacuuucaccagacaaccaaguaugcugaugucuugaucuuggacuucucagccucugcaacugugagaaauaaacuucuguugcugauaagguacccagucuaugguauucuguuacagcagccugaagggacuggaagacauccuuccagcuuuuguguucgaacuugaacuaugccaucaauugucaccaccucaggaauauuaaaucaagucagggcuugcaaugugagucccugggaguccugucuggcugcucuguggggaagugugaguaccugcuguguagagaugaccuuguggagguagcugcccugugacccuuugaccuucaagauggaauggacagggguugaaccucugaauaacagugcucaaggcauuucuccucauucuuuuuguauggcuuccaguucccagugccccacccuuacugucugugcugugaccugaagugugaacucggcugcagcgagaccuacccgaggaggaacagccugcagagcggugauguaguucuccagggccaggcggcggcggucauugagcauggcuuccacucuggccaugugugucuccaccagcugcugucucucguuggcugcuuccuguuccaaagauuccacuuucuccuggaaaugcugccaucauaaacacauauguccauggggacugaauaaguaggaugaagcagcaauuucaagucuucuaaaaaagacauccuauuccauuuucuucuagugcuaaaaaguauccuaaagacugcauagucauuccaacauugacuaauucuacguuuuauagcuuacuucacuuucuugcacucuccaacccucaucaaaccuacuuucucauugaaaaucaguauuucauaggcucucugaaggcugauuugacuaauaacuuuggauaaauauaugcacucuugaaacucuuauauuacauauuaaaaaaaaaucccucucuuacuaacaguaccucaaguaauugaccauaauaaacuguugguuuacuuaagguaauuuugagacugguuuccaucaaaaauucaaauucucauaauuuuugcuggagggagaagcagcagaagauuguggugacugaaaagauguauuauuaauaaaaaguagauugcaaguuacaaugugaguuuuauggcaaugaauuauaacuugaaauaauugggagcaaauauaaggcaggauuuaaacaacucaauuacuagacaaugauuaagaacagcugaaguucaugggacuaugaacaaucacacgugaggugcuggcagauaaagguaaaccugcagacacucauuaaaaagacugcuggcaugugauguuugguaggaaauggguucagguuuuaccuggauaacugccuucuuaucagcuuuaggcaaguucuuugcuugacguucugccucuucccauucucucaugaccuauaaauuaaggaaacauuugaauuuaaaaucaucaguucauccuuugaauacagacuuaauaggauggaugauuauguuuuuccucuauuuuugucauuuuagauauuuaaaaaauuuauuacauaccccuuccuaucugaagaauauuugaccucccacuaggauauaaauaauuaaucacagcaguauauuaaacauaaauguucauauuuauugcaggaauauagcuuuuugagucaagguuggucuuuuuuuaccccgagaacugacagucauuugauuugaugugaacaaauaccaacuauucauggaaggcacacauuaacugaacaaggucuuccaauauuaaacugaacaccuaaguuuuacucucuuaugaaagcaacugaaaccauuuuaaacuguauauuuugacuuuaaagaaaauaugacauuuuaugugugugugugucaugaauacaaugccaaaaagcaguacauaaugggggaagaaaaagaagacuucugcugucuaauauccuaagaccuaucccccuuuaaagaacugauggggaauuaaggcccuuugagcuugccaaccuaagucaugaacagcaaggauuacgcuaaguccuuccaaaaacuccaagaaaacauguaauauucugaaugcagcaaacauguauuuuuuuacaaguagcacuaauuuaguaaccaacugcuaugguuugaauguaaccccuaaaaagcauguguuggaaacuuaauccccagugcaacaauguugagggguaaguccuguaagaggugauucagucucuguccucaugaguaaauuaguaucauuauggggggaguggguuuguuauugugagaaguggguuguuauaaaacucaguuuugcccuccucuugcccuucuuccuuccaccauauaugauacagcaaggaaguccucaacagaugccagcaccauguucuuggacuuccccaccugcaaaacugagagccgaauuuuaaacuucuuuuucuuuacagauuauccaggcugggguauucuauuauagcaacacaaacugacuaagauaucaggugaauguguuuuguaggaaaucaaugcuuccugcucucaacuuugauguucaccuggauuucccugagagaaguucacucauuaaccugauacaaaaaguaaaagucugcaccucuguauguuguucaaagaaaauauuaacuuccuaccaccuacagcugccuuuucaaguguaugacaaguagaauuuguuugaagugcaacucugaacuagguaaaaugaagaaagaucaaggaaacaaaauauugguuuggugccagauguguacuugcauacucuguguacucccaaagcaugagaaaacuugauuacuguauuauaagagccuguuuuuuguagguacuuagccuuaaggaauagacucuucuaacauacuucaagaugggaaagaaaaagaggcuuggaauaaauaacuauagauagaagacuucuaugagacaauacuauaucaaaucaccauguggguuccuaauuacagauuuuauuguccauuggcauucauucuuuguauaugauaggcaauuagcuucuucuuguuguuuuuguaaaaccauggaggaaacaagauggaauaaauauuucauuacacuugaaaagcauaucaaaaauaaucucaagguucacagcaaaauugggacaaaugcccugcugcaaugaacaagaauagaacauggaagaaaagaaacauauugucccaucugcuuuggugcuucuaccacguuaauaaagggaaccugugggcaagggggaaauggaagaccaucuuugcuuuauagaugagauaagccuugcaauauaaauauuucaauuuccugcuuugggaauguucacaguggugguacucuaccaacaauucuucaagcaaggaaucucaaaauuaguuugagauagaaguucaauguucuacugcaaugugagaacugauuucccauauuacauuuacauuuuuuccauuuuaccucauacacuuuaagaaacuggacuuuaagcuuuaagcugggggaauccaugaaauaauuaaagagauuuauuuagcuaaugaguugcaaauaagcauuacuauagaaauuaacucacauuuugauuuucagaacaauuuaacaauauccuauacccccacaaauaaacaaaucaccugcaccaucccacuaagacucuacugcaaaugaauacacacuauauguaggcugaccaucucccugugaacagugaauuucacugugggacugauaacaaguagcauuacugcugacccuguauuaagagcuuuacaaaaucuaucuaauuuaauugauuccucacaacagcuugugagauuagccagggccaucccauuuuacgaaccagguuaagguaccagcucgaggcuaugcagguaaaaaagggagagggaagaauauaaaccaagaucucuguggcucuaaagaucauguuuuuguacccugugguacccaauuuuuuauuauaaaauaaaaaauucauuaggugagcuaaguuuauuuauauuuagugacaggagaaaggggcgcucuuaaaauguugcugcuuaucuuaaaaauaaaaaccuaggccaggcacaguggcucaugccuauaaucccagcacuuugggaggcccaggcggguggaucacaaggucaggagaucgagaccauccuggccaacauggugaaacccugucucuacuaaaaauacaaaaauuagcucggcgugguggcacgugccuguaaucccaguuacuggggaggcugaggcaggagaaucgcuugaaccagggaguuggagguugcagugagucuagauugugccacugcacuccagcugggugacagagcaagacuccaucuccaaaaaagauaagaaauaaaaaccuaugaguugggucagcuuucaauuugaaggacuucauuuuaagcauauacuaaaaguaguaaguuuauaaguaauaaaagugcucacacaugguucagcuguagauuucuauuugacuagaugcuagucacgacauauagcaacaaaaaucuacagguuuagcaacaaaaaucuacagguuuagaguuauacuccacaauggcaacaacaaaccaaaauaugaaaaaauuccaaaauccucuguauuuguaagaaaacauauaacaaaaacuacaauaaaacuuaauuuaaaaaaccgcacaauuuuuaaaauuuaaaauucucaggaccuggcccuugcaguggcucuauggauucuuauaaagcaauuuuccacugcaggcacaaagguaucaauuucauuuggauuuaucaaucuucaaagacuuggcuguuucaugcagagaaaaugacuacuacuaaguagagauuuaagaggcaggcaaguuuaaaguugaaaagucccuagauuucagcaccacagacuaugaagauacauauugauuucaggugucucacauuccuaugaccacuggaaucuaguagacaacauucucugcucugggacaacaucucuuagguuauaucagauauaucugaugacuaaaagaugaacaaaaucuacaaaaucaugaacuaagucacaaguuacacagaugugcuaaaaguuaaauuauuauuuuaaagaagaccugucacaucuaaaacuaacagagaauuugaaauaaguuuucuuaauaaggucaaaaaugaacaagauauacuaggagaaaaaauccaggauuaaaaaaacacacauuaaaaaaaaugcuacaguggguccacgaugaaugcagguagcaggcuucaugacuugaggucucaagguuucuauccagcuuggaaagauaaugcagguguguccagaaaucacuaacaaaaccggggagcaaauauuuagaauuaaaugaaagguaagagcaaugacugccugucucauucugaguaugaagugggguguaaggaaugggugagaugugucagcgugaagaagagugggagggcauuuccagaagaacucaaugccaagggcaaagggaagcccaagaugagaugaacagacgaugagcagaguggccugaucagaacagcagcuuaacgcuguacagaaagcaaggguagcaguugagaaggaagaggugguaggaagaccagagucaggguacagugguaggcgcugaaaaugacaagcugagcauucgguguuuauuuuugucauuguucuuuuuuuacgacuucaugugcccagaaguggauuugugagggcacaggaagccucugaaagcuucauaaagaagggagauaggauguaaauucaaaugaggacauuucaguggcaauaaguaugauucauaguccuccaaugcuuuccgaacagugccugugucuuuccuaaggaaagaucugauuuucuuggcaucaggugaaaacuuaauaauucccuguggcuagcuuucuaguucaauuagcuguuagguuuucaucgugggcagccacuagaacugcacauuauauuccagagccaaaaguacugugauuauaaggcuuuuuuccucuuuauguuauuauaccaaaguagauccaaguauuguuauucaucuuaaggcaaaacaaacaaacaaaaaacaaaacaaacaaacaaaaaacaguaccuguguuguaccuuucuagauaaacuauuaguuuuauguuuucaaggguagauuuucuuauuauucaggugaggccaagaggucaggagaugauuaucauggaaaagacaguuuguuacucagcucccaagaagccgguacaugccacuacaugcagggucauaugggaagcaccaggguuggucaggaggggaaaacaugagcaagagccuuuuauugugguuuucauggaaagaaugagcgaagcaggguaggcggguuuaggacugauuaguucaaauaauggugauggggcaugagguugucccuaguggucugguaccugguccuggggugauuagagcaggugaauaguggcccagaguauaagaaggugguugggaguaaggagcuuuugauugacugguuugcaugggaaagacaugcucaggggccauucauuuggcccugggagggaggaaucuuccuggggucagcagggacccagaucagaaauuacaggaaagauuaauugucuacuaaagacugacugugaucuuagaaaauacgcagcagucuaauucauaaauugcauuuaaugucucucaagagauuaagcaucugugcuaagacaaaaauuucuccuaucuucugauauuugccacagaauauuaacacuaaaaaugaauggcuuacuuuaaccugagaucuuuauucauucacuuuuauguccuacuucuuuuccccccacauucacuccuagguuuguagacuacaaaucagaaaagugacuggaaaauaauaaguccauauuuguugauugaaugaaugaaugaaugaggaaucugagcaagggcuaaaauccuccauauuaucaaacuccaauacaacauccagugccugguagcagacauagcuucaauuguaguugauaguauauauggauuagccauguuuuagacauaaguuauuuuuuaauuugcuuaauuaaggaccugcuaaaaaaaaacaaaccaaaccaaaacagguuuuuuuuuuuuuuuuuuuuuucagcaaaguauaaugaaaggaguacuguacuaggagcaagaaaggccuggauucuaaauguugucucuggcucacugauuuugcuuugugcuaaaaugggaagccacucucucgaaccucuauuccacuauguaucacuuaggagacuagaugaaauaaucacuaugguucagcucaguuuuaagucucuaugauuuuacagacuguaaacaaucguagguucacaauuauaacagucugggauuuaauacaaaaccucaucuuuacuaaagagcauuuugauggauuuuaauuuacaacauguugauuacagguacuacauauacacagaauaauaaugccaaguaccuuucuucgccagagagaauguuacagacaucauuuaauuugugcuuacaaaauccaacuauaccuggauccuuccuaggcagcauguucacggaggaugcaaaaaacccacaaacugugcccacacaguaaacauuuaaaauuagaacuuuacaucuuuaaagaucuugauaaagccagcaggccuguggggagacugaggcagaggcaagcucagguuucccaauaucguagggcugaaugauggaagagccagacuuaccugggacauucucucucggugcuuggccucaagccucucuuuggcuuucuggaaaugggcauguucauucucauccccaggugucucgagauacuugucaacggcaucagggguacuggcugcuguuguaggaacuauaaaguagaagagaaggagguuugagaaaaaaaagccaacaacaacagaauaauccacucguuuaauagaaagccguauuuucaguuauuucucagaacagagaauuuaguaaagcagcgcauacaagacguuaaugcuguuuaagagaacaccaugagacacugugcagcacaguaaggaugucuuucaccacucccaaguacagaaugaaggaaaaaucuuuaaaaugguccauuuugcaauuauagcauuagaguucuuuacgaaacaagcaugcaaagagcaaaaacaguuggugcugaagacauguuuuuccaaauccccaugcuuuccuaaauuacuauuuugcaauuuugaaaguaaaugaugauaucaucaauaucauacacuaagacuccugcagaaaccacagauaucuguaauuagccuguuguagaauaacggcaccccagggaaaagguaaauguaugauguauuuagauaacugaauuacgaagacaaccuucaugagacaguauggaaacacgacaaaagauauauaaacaucaauaaacacauuuuugaaucacaaaaggacuuuucugucuucauaaauuugacaauagucaaugaauucauuaugcuaguugucaaaaagaaagugauuucuauuuugaauucaacuaauacugcuaagcaauauuugaauugcaacauauacugcuauauuauguaacucaugagccaagugaauuauaauaccuauacaagcaauuuuccaaaagauuagugagaauucagaguauuuaugagcuuaaaagcaaaaagaaaaaagaauuuugacuuaagaggaagcauauuuaacauaaaaaacaaaaugagacguuuucacuaucuuuugagaucaaaucaauuguuucauucaaaagguuauucaaauaucaccaauguuccaaguauuccuauugaauuauuaccuguguauuacauuugggauauaauaucucaaagaggacuucaaugagaagaauugauagcuaagucauuuugaaacuaaacuugaaguuaaauacguuuucuacauccuucaagaaaaugucuggaaucuuaauccaaagucuucaaagauauuaacuaaaaccggaaggcuguuaaauaauuaaacaguaucuuucauuuuaaaaagaaacauucguuuugauuuuuucccuccacuucaauccugauuaauaaucauuuuucaaaaaauaaaagcaguugagugucuauccagauguugcuuucaaguggaaggaaggaggcagggcauauuccuggugccuuuacacagcugccccugucuucucuguagcaaaugagggagugguguuccuucuuacauuggcagcaacgggggaaggaaggaaggaaggaaagagucauguggggauuugcaauuaagcacauuuggauuugaaucccauuucuuuuucagaucagcugugaccuggggcaggaaacuuaagcacuccauguuucaauuuuuuuaucaaguggugauaacaugccgcaggacaugauaggagagcugggaaaaugagauaccauaccacauguaagucauccggcagagagggugacacacaguggagcucauacauguuaguggccuucccuccuccucugcuuaauacauccuguucaaaucucagagcuaaugcuaaccacgggaaaguucugauacuuuuauucaaagccacugaaaauguuuugguagaagagugcaauaauaaagaaaaaaaagaaaaggacaaguuuuaaaauuuuaaaaauugagaaaaagaaacaaaagaaaauacaaacuaacaaaaaauaaauaaaauagaaccacugaaaaugaauuacacacaggaucacaaagugcaaccuacaggaaaagcaguauguauuuuucaaaaaauguuagguguagcccacauaaaaaaggccgaaaguaucaaaaauaaguaaauuguuaauuuguaagauugaaacaauaauuuugaauauuaagaccuuuuuggaaaaaagguaaauguuuuucuccauagcuucaagcaaaccaauaugcaaguauuuuuaacuuaaucauuaaguuaaaaugaauaaaugcuaaauaccacguucuuacugacuuuaacuuaaugauuaaguuaaaaauacuugcauuucaaguucccaacuugaaaugaacaugguauuuagcauuuaaaaugugcuucccuagcuuuagucaucuucucaucuuaacugguagagcucaaaugagaacaaguuaaaguaaaagcagaaaauaaaacaguaacauucuuuugcauaguccaaucuggcagaaugacauguuuaggcaaaccauauuuuauguuugaaacaaaugaaaauguauaaauauuugggguuauaccugcugaugaagauagucaucuggcuguaacuguuauaaccauaacauaagcaccccuuuggaaaacuggaaucauaaaacuuacuauauaagaaggaaauuuuuucagcuccuaugguuugcgaacacugucuacuguauaaaggaaagaagauaaacacuauaaucugaaucacuauaaucagauuggccuaaguagaaaugcacuuagcaacauaauaagagaauaaccauggaacaugaaugugagguauguuuaauaggacugaggauauuaaaaaggauaaaaaccuucuuuuuaggcacguggaaaugaauaugaauacuauauuaccaacuuaauccauugaauccagaaauauuucugugguaauuaauuuucugugccaacuugauugggccgcaaggugcccagauuaaacauuguuucugagugucuuugugagggugcuucuggaugagauuagcaucggaauuggugcacucaguaaaguaaaucacccuccucaacaugggcaggaaucacccgaucugcugagggucugaaaacaaaagggcagaggauggagcaguucacccuuuuuauuuccuggcugccugagucaggauauuggucuucucuucucccuggacugaaauuuacaccauugucuucccugguucucaggccuuuagauuuggacuaaaucauaccaccagcucuccugggucuccaacuugcagacaacagauugugggacuuagccuccauaauuguugugugagucaauucugcagaaucaaucucuuccuauacauauauauccuauugguccuguuucucuggagaacccugagcaauacaauuucucuucaaguaaaucuuuguuaacagucccaguuauuucccauaguugaggaagcugugucucuuuuuaucuuuaacucaaauuuuucagccauucauacaaacuccccaucucaauuagugugagugaaauuauccuauauucauaccaaccagcaagccagauuacugucuagucaagcagagaaggauagcauaugcugauauuguuaaaugaauuuaauaguucauuacuacugcucugcagcuggugaggaucccggaaggagagagcaauuuuaagguggaguauguccagagagcucaacuucuauuucgugaauauccuuauauccuaaagagauuaaauucauaggacugacuaccauuuugugauuauguccacagaaggccagagacacgugugcccuauguccucacccaucaagguacuuccuuuugggaagggaguggggcucaaggaaugucaggauaugucacaggacacagaggaaacaggaagcuguauaucagcaggucacugauauauuuaagguacuuaaaacacaggucacuguaaccacuuagaaaguggaaacaaacuggcuuuaggaggguuuauuucugguuuugcauuuuaaacuaccauaaagcaguuuauccugcucacagaccucugagauuccacggaaccucugauaaaggcuaggauuucggccggaugggguggcucacaccuguaaucccagcacuuugggaggccgagguggacggaaguuugagaccagccugaucaacauggagaaaccccgucucuacuaaaauaaaauaaaauaaaaaaauuagcagggugugguggcgcaugccuguaaucccagcuacuugggaggcugaggcaggagaaucgcuugaaccugggaggcggagguugcggugagccgagaucaugccagugcaccccagucugggcuacaagagcgaaacuccgucucaaacaaacaaacaaacaaauaaauaaaggcuaggauuuccauguuggcacuccgucucaaauaaauaaauaaauaaaggcuaggauuuccauguuggccaaaugauaacagccucuuuucaucagagcccaccaugcuaggcauguucuguguucucguuuaauacaugggaagaaaaaauuacccuauuuuauugcguagaggcaaaacacuaucauuuaacauacccauuugcaucccuaaacacacacaaauaaagucuguuaagauuggguaagccauaaaaaggcuguaaagcuaauuuuuagaguaguaaagggccaauccauccacaugcuggggcacuguaaaggguuuuuguuguuuuguuuuguuaaugagcagcacaacuuggcaaaacaaccauaugcuuuguuaugauguccguuggcuuguuuucuaugaaacagcuguuccugccccaaacacuaucuggcaaauccuucaacagaaguugggucauaaagcagggaucaagugaaagagcccauggagcuagaauauggaggacguucuggccuugggucccuccuucagccugcucacucaugccuucugcaagcaagcuggcuagguauguuccccccuccacaaaaaccuagacuuaaaacgagacaaaacacaggguucaauauccuuagcucuagguuuugaccucuagaugccuagucauuagcagcaauaccaacaucacaugcauaagcuuuuaacuuuuuaaaugaccuuuguauuuuagucuccuaacagagccuugaggggcaugguaggauauauaggcuauuaccucccuuccuuuuaauagugaucauguguaucuaaacacucauaacaaaugaaaaaauguaacagaaaagcaguucuaauuccuaguacaucacugcuucaaggugaauauuugcuuccaaauauacaguggcauuuuggaugacuaacgccuucuacauaagccacauccuuauucuuugccacccugggaagucagagguaucaaagcagcugagacagcagcucugacauggacaaacuauccugccuuuagugcgccuguucauucuuuuauuccuccagcccaccaacauugcagcccuuauuauaugugaggcacaugggagaaaccaaugagaaaaacaugaaggcccugauccugguggaauuauauucuagggaaagaaacaauuaccacaagaauuuuuuaaaagccaguaagucauauuguuaauaugugauuuguauuauggagaaaaagaggaaaaagaaaaacagagcagaguucagaaggaucgggagagcugaggggagaggggaaagguagaccgcaguaagugagcgaccaggcagagucuuaagugaggaggugacauucagaucuucccagcuggcugcuggaaggacauggcaggcagaugacaaaacuagcacggaagcccuaagaguugaagcuggcuggcaaauuccacgagacccgcauggccagagcuaaagaagcaagagaggaaguagugggagaggcagggaagaaaugggggacaucauguacagccuuaaagccacaguaaggauucugagggaccagcgugggcuguuugagggggaguauaugugauggggcguuuuguugaaggaucacucuggcugcuaugggacaaaaguagaaggaagaucuuuuaagaggaaaagacaggcugggugcaguggcucacgccuguaaucccagcacuuugggagucugaggcgggcagaucaccugaggucaggaguuugagaccagccugaccaacauggagaaacucugucucuacuaaaaauacuaaaauuagcugggcgugguggcaggcgccuguaaucccagcuacucgggaggcugaggcaggagaauugcuugaacccgggaggcggaaguuguggugagccaagauugugccauugcaccccagccugggugauaacagcgaaacucugucucaaaaaaaaaaaaaaaaaaaaaggagacaaagaugaagguggcuuggaccaggguggcugucacaggagguuguugcccucagcccccuucccacacgagaagggucagauucccuucuuucucucacaccaaaaugcuguauuaccucagggaacugaauaugaaaacgggagaaacugcuuucacaugugcgugagggcucauuucaauuuuaauacugauacacgcaugcuugucacaauacugccacuucacacugugaucuauucucaauaccugccagagcucuguuuucuggggugaaguaacacagguuagcuuucaguuuauucauaaauggcgaugcugcacccaacguuccuaucacaaaaugcuccuccaucacuggggccaagacaccaacgaaacauuuuccauaccuguguuuccucugagaaaacuguuagcauuugaagggaaguuacuuuaaaacaggggaaaaccugcuaauaucuucaggaugaggcagacgucacucuccuagccugucugaagacuccuuagaggauaauccauuaaguugaacuguacaugcacugauuucccucauuuuaguucugauuuuguaaucauugcggagcacuccauuucauauucauacuaaugugguacuucacauucauauaagaauguggggucaaaauuaaaggcacugugaaagauugccccuaucauuuugauaugcauuuguuuccucaggcuucuggggugacccauaauuuuacagucacaauggacucaggacacaaaagaagaaaugacccaccuucaaacagcaaugaccguggccaucuccaacaggccagaaggcugaauguuucccuaaaccaaggcuuaugaauggcauucagucgauauauuaauauuagauucuaacaagaaaauuggguuagucuccuuucaucagcagaaaagcaauuuaucucuacagccuugguaacagaagauuaaaacaaauuaagaccuauauaaaucauugccuuaucauugaaaaugcuauuugauaccgacccagcaauguugucauuugagauggcuauaauuuaggaaaggagacaaggaggaucauuuauauaugagugaaauauaaacuuguuagcguucaugugaaacuuuaaucuugaaacauggcagagcuuuccgagugccaugcuuauuauaacuuaaaaaaaaagugucucuaaaaaaaaaaaaagugucucuccauuuuccuaauuucaaaaauaguuaaaacuccuaacgcauucuacauucaaauauuuauccuaaccauuaaguccaagauagaggagccauuuauaacaagaaaauacaguuugugauccuccaguguaauaccagacucucuuaaaaacaaaauaacaacaaaagaaaaaacaaaggcauucucccccuaauaugcccuuguauuacaauuuuauagucagugcaaucauaguugguggagaacacuaucaaugcaucacauggacauaagguaauaaaaauauaaucuaugauguguuuacucuagucaagcuacauuucuuuuuuauguccauggacacauacugacaugggaauuuuuucaaauauaugaacugaaugugaaggaacgaaugcuggcauuauuuuuuuauuaacaucuauucucuauucagcacaucacacuaaaacuuaaaagcaaccucaaguuugaaucuaaaaaauauaugugaagcaauagcaauaacuggcguccagaauggguuaaccuuagguuauuguuuuuugucaauuugucagaagcuauucuugacuucguuaauggaggcacauaaagaaauaaccugucauagcugcucaacacucaauagaugaguucgaaaagucaaaaucuucaauauuguccaguuucauauaaacuguagcaguaaaaggagaugguacaguuaaccucuauggaggucuuaaggauaaagcugauuucauuuuaccccagccuuccagagcaaucuucuccuacacuucuauauuuccuuuauaugguuauuuaccucuacggcauaucugggucucaacucauuaauaaaauuaucagguauugauagccaguacucagauuccuuugcuggugucucucaaaauaccuggccucgcacauccuggggucaaaaauaacugcugcacaguucacaacugcaaagauacggaaccaaccuaagugcccaucaaccaaugagggauaaagaaaaugugguguauauauaccacggaauacuaguaggccagaaaaaccacaaaauaaaagucuuuugcagcaacuuggauggagguggaggccauuauucuaagugaaguaaucaggaauggaaauacaguauguauucccuuauaaauugggagcuaagcuaugauuaugcaaaggcauagaguggcauaauggacauuggagacucagaaugaggaagagugggaaggaggagagggauaaaaaacuacguauuggguacaauguacacuacucagugaaauggggacacuaaacucucagacaucaccacuauacacuucauccccguaacuaaaaccacuuguauccccaaagcuauuggaaaaaaaauaaaaauaaaaauaaaaaaaccugcuguauuaaaccaaggaucagcuugcuggcuaccuuuuuuuucccccuugagaugaagucucgcucuugucccccaggcuggagugcgauggugugaucucagcucacugcaaccucugccucccggguucaagugauucuccugccucagccuccugaguaggugggauuacaggcgcccaucaccacgcccagcuaguuuuuguguuuuuagcagagaugggguuucgccauguuggccaggcuggucucgaauuccugaccucaggugaucugcccgccucggccucccaaagugcugggauuacaggcgugagccacugcacccagcugcuggcuacuuuuauaaaaguaguauuaucggaacacagccuugucuauuuguuuacuuauugucuauuguugcuuucaugcuaccacugcauaguuaaguaguuaugacaaacugcaugaucuacaaagccuaaaauaucuauaaucuggccuuguaugaaaaauauuugcugaccacuuuauuaaacgauccacuuacccucuuuuggcaaauagcuaaacaacagagcagagacauaaugaacauucuuuuaccacagguagaacaucucuaaucugagaaucugaaaugcuccaaaaucugauaauuuuugagcacugacaugacaucaugguggcugggauagcaacaccuuuguucucucacagugcaacguacagaaacuuuguuucaugaacaaaauuaucaaaaauacuguauaggccaagcgugguggcucacacguguaaucgaaguacuucgggaggccgaagcugguggaucacuucaggucaggaguucaagaccagccuggccaacauggugaaacccuaucucuacuaaaaaacacaaaaauuagcugugugugguggcaggcgccugucauucauuccagcuacuugggaggcugagacagggggaucucuugaacccaggaggcagagguugcagugagccgagaucacgccacugcacuccagccugggcaacagagcgagacuccaucucaaaaaaaaaaaaaaauuguauaaaauuaucuucagacuuuuguauaagguguacaugaaacauaaaugaauuucauguuauuucaucaugaauacaucaauauuccgaaauccaaaaucugaagcacuucuggucccauuuuagagaagagauauuuaaccuguauucaaaguagauggcccuucuuuuuaaaaaaugcugaguugcuaagcaauccaguuccuuucaauuuuagggucaucucuaauuauuauggcuuugaagaaaaagccauucuuccuaucuaagcauuuccagauaccaaagauuuagcuuuucacacuuguuaaucugauagaauauacuggcacugacgugacagguaguuuaauucaccaucacaucuuuuaaugcuuuaaaauuguucucccucccuagguugguuggggagcaaaguguaaucccagguugccuaaucuaauuuggcaguuuuaguuccaaugguauugcagaaugugcuaaugggaacuaacauuugcuacugcacagugaaaagaacaagaauagugugauuaagaacaauaguucaaauuuggccaaagauuaaauggccuaggcauucagacuucugucuuauggcuccugucuuuacaacgacccugggguuaagguggcauauuccauugaaaggcugcguggugugaguuuucuacgauuugaaaauuaugagcuucugcggcaacaaacuuggaaccuggggauggaacuuggggccugacuuguuaaguuccaauucuuuucauauucucuguaaguguaccagucuguuucaugucaucuggaccauucugaugugccuagaaaucaaucuuuuucccucccucaauccugcauggggucaggccuacaccucugcacaaacuauaaggccaucaaacauaauccuaaaguacaaauaaccuguguagcaagacuauaggacaucucuacagaugguuguccuccagcauauccugggauucuaggaaacuaagaugaaacagagaggagaaagggguggugcauaggugaaccaaugacuucaaacuaagggauuugcugguuucucuucugcugccacaguagcuuacauuagagcaggaaaacuacgagaccuucaauacuauagucaggacagcaacagcaacuuccacuuuaccuugcaaauauugagagcuuggacaauagucuaacaaauucaauuucaaacaucugucgagaauuggaugaugcugacauucuaacauuucaacaugcccccaaauuuguggaaaguacacguguuuacaccaggagaguucuaucucugagucagauguggggaaacuacuacucuagaacaggauucucaaccagaaugugacccccugggcacauuuagcaaugucuagagacauuuuuaguuaucacagcuggaguuguguuaauggcauuuaguggguaggggucagggguacugcuaaacacccauaugccuaggacagacuccuaaaaauuaauuauuugaaucaaaauguuaauagugcugagguugagaaaccuugguuuaguuguuuguaccacaugucagcgcaaaugaaggagccugagaugggacacacuuuggccagaucacauggugcaaucugcugacuaaaaauuggcaugaugcucuuugagagauuaaaugccauuaaggaguuggucuguuugccuuuugggaugcagucugauggagacagcaccaggaaaaaauggucacacucucauauuuaaaauauaaaugaauccacaaauauuuauauaauuuuauugucuacaaauacuauauuuugaagauuaaaugugaaaccuuuugcacuguccuaaacccaaaugggcaggugcaaaacuaaugucagaaauuaacucagcucucguaagauucuuuaucccaaaugagaaaggguuuuuuuuuaaugauuugaauuccuauguucacgaauaaaaugaaagcucucagccuuauauuugugguuuagauuuuuauuuaaaauaacaacaauaaaauaugucccuaaaauugcaaugcucaaaauugguuuuuaugacaaaaguuugaaaccuagaaaugccugauuuauggcaaauuauuguuuuuauaaugcaaaccaucauacauuuucucccuaaguguaaucuuuuaucaguucaacugaagagcuuuuucuaucuccuuucacauuuguuauuugacuagaagcagcuuagacugagcaaccuguaaaaccaaccaccuuugugcagaaauaucauccaacuggcucuagauuguugaaggagcaaagucaaguccaaguugcccagucuaacaggcuugcuuaccuucuaguucagcuccuuuucucugaauugagucugccaucugaauuugaccuccagaugaccaugacuuuuucaaaucaaaugugcaguuugcuauaaauaagaccacauagcugcacaggcuauaaauaacuagaaauuauauguuuuuuuccuugucuguuuguacuagcacugcaaaacccuucacuugcugugauugaauagucucuguaggcagacaagaaaauauagcugcccaaagcacuucauccuccuagaauggaaaggugucaggaucccaaauacacugcaaguagauggagaaaauuacugggaaggagaaaauuacaaaagagacuuucaguaucuguuuggaacaguggaugaugaaagugguaguuacguguacagcaugaaaauaaauuuaucagacaaugaugcuuguuuccaucaguuauuaaaaauggaaaaauagaauucuuauaaaugcuaaaaugaaacaagagaaaaauaaucacuguuuuauaaaagaaugggaaagacauuuaauuuacugaugcgugcucuauucauggcauuuaggaaaaaauguuaacauucuucauccucuuuucacuguuuucuguauucuuaaaaugugcuucugaaucgcaaaugugauuucacuaaccggcaaaacaaugucagaaccaaugcuuagccauuugguguggagugcggccaaaacgucauuuuggguuucaaagccugguccugccauguucgauggcuugggacaagucacuaagcucuugaagccucauuuuuucucguauguacaaaaggaaugaggaaaaugcccacaaaguguucugaagaaaaauuaaaugaucugugaaaaugcucgguacaaugcaacucaacaugcguaccuaugucaacacuauaguggaauagcuagagcuuuuuccuagucugucaacccacuugcuguacuuacaguguuuuuagagaaaaaugcuuuuuucacaacagcaaaagaaacguuuauguugcagcaguacaaaccacauccuucaaaaguuauacauaaugugaauuauucugaauauuuuauggaggccauuaaaaaacuuuauaguuuaggaugcagucuuuuuuaaaauaccuaauccuucaucuauaauuuaucaucuuuaaaaaagauaacuggcuucaucaguuuugagaugaggguuuuuuuuuuucaggauaauguacacaaaugcuaauuauaaaauaucuaaguuacaacugaaauugugccucuucuuccagcaaucauaagcauaaauggcauauaucaucccuaaccuaacacuggauaaaucuauuucuggauggaauccaaauucaaauaugaguacuaaaaccacauuuuaaaacuaaacucgucugauauuacaacugaaauaaaaacaaaacauaagacacuguaaguaaggccugcaguggcuggacaaugcauuucuuuauaggaggcucuuucucuacuuccuagucaaaaggugagcaccucuaaccuaccauuaugccuucugggagaggagaaagagggguuccuaaugucuaaaagugacccuucaugucuaaaguugaaaccgggucuuauaacacacauaaauugaaaucugcguguacgaauuaguccauguacuacaauaccaugaauauuaaguacuuuuucugaggaaacaaguuacuuauguauuauagucucuuguuaaaucauggcaucuugauguaaccgaguacucuauuuuaaagaucuuucuuccuuucuuuuccuuccaguuuuaguaaugaaaugguaaccuuugcucucuuucuucccaccaggcacucccugcacagcgcuuccauuaucuaauuacgcuuauaauuauuauuaaaauuauuaaugcuugcuuagaaguuccacugacugacuuaggcaccuucagaauucucccucaucaggagaucaccucaaggcugcaguuaauuuacaacccgauugugcgggaugcgccagcccacuuaccgaacuggauaauaacucaagucuuuggaacaaguccuguauagcagcaccuccucaccccuccuucaugcccugcauuccaagcuccccuuuuuaagccuuuguuuuuuaauccaaaauuugagaugguugcuuugaggcaggagccuggaccauuuccccauugcuagcuuugcuaaguaaagucacuuuccuuccacugcaccuagcccuuguucuucaguucugcaaaagcagugagaggcuaagccugcucucaguuacacugauagcuuuuaggaaauaaaauaguaauggcaaauacaauacaaugauguuguccauauaauauucaauaaaaccagacuaaauaaaaaggaaauuggucagaaauagaagaaacuuagucaaugaugcucuuagcccaacaucucaagcugucuggcaaaaucagauguaauuacaagcaagguaaugggaagaaacauuuuacuaagacagguguucaagaaacacaaaaccaugcaaagaaggugaugaugcuggaguuaugugaaccaagcagcauccuccuccccucuucccuucccucaggugaaugacaacguacguuuaacaggaucucgggcaagagguuccuggguagucuugaguaaacuuugggacacuauggaaaaaauaagagaacauaacuaaaaacaaaaagagaaacaugggaaugauggcugaaaugcacgaguccacugacaaaaaaacaaccuaacaaacaaaaucacucacuuagguuuggucccuccaacaaaaccaaaaugaacauauaaacauaagaucuauuuucguaagaaguuaacauuugagaaugcuggauauuuugucucugauaguauauccgaguaacaacagguuucuuaacagaagaggauuucuugcuccuuuugugccaaauauccccaauucccuucgaugcauuuuuucacaaaaacuccauuuauuucacucauucauaggacagcauguggcucucggcucuggcuguuugcugaggcuuauacucucuacuuauucuuguccacccaucuaacugaucuucagccuuugccuucuucauacauuauucugucaccuuuccccucuaaaaucaggcauagcuagccucaucuaauacaucucuguugggagcaucgaccuuuugcaaaacccucagcaaacugugugccacccaggacaccuggacaggugcccacuggucacucccagcccaaacugaucaaagggagagaguguuaggugaagggauggcaguacuggggugagguggagagaauuuuaaucucuugaagcaaauucaucacugcuaauaauuaaaaccaaauaaaucucuuauuaccaaaaacuauacaugauauuucagaaaaugaauccacccagggaaagggagaaaaaaguugcaaaucugccaggaaaccucucccaccggcuaaaccagugagaaucacuguaacaaaaggccuuuguuccaaaggcugcaggcaacagaauucuccauuguguucgcaauaccugaccuaauugacugcuuuguuugaaacugaagaagggaguccuuugauccagaagcugcaaucauccaaucagagccagaaaaaaaaaaaaaaaaagcccuugagguuaucaguuccuacaccuguucacacaugggacugaagcagucaucucauucacuggcgauggcaggagaccaacaggagcuuuuccauuacauuccucuuagauccugggcuccuuuacaguggggguauuaauggugcaggcccuucuguuguuuugcuuaauccuaagaucuugcugcaaaacaauuuauauaaucccuaggaaucucaggcaggaaauguggcugccacccuugcaacacagcggagaauuaggcaggagucucucaaaaaaguaauacacaguuauugaguuucauuuuuaguuaucaagcugagcugaauaauuacuucuugaguaguucauacuuccuacucaugaacaacaacaacaaauaaauaaauaaauaaauaaauaagcacaauugggaauuucacuuggaagucuguuaacgacauggaagucucacaucugguacuggaccuccugagaauuaccucuuuggggaaaauuucaucaugcacuuaagucaucaugacuucauauuuuuaucccccggaauuaugaaaagcuuaauguucaagagaaagacuuugaaaauuauguucuggcggggugcaguggcucacgccuguaaucccagcacuuuggauggccaaggcagguggaucacuugaggucaggaguucgagaccagccuggucaacauggugaagccuugucucuaccaaaaauacaaaaaauuagccgggcgcaguggcaugugccugugauccuagcugcuggggaggcugaggcaggagaaucacuugaacccgggaggcggagguugcagugagccaagaucacgccauugcacuccagccugugagacagaaugagacccugucuuuaaaaaaacaaaaaaaauaaaauuauguuccucgagccuuaugucauugaaaguuucucacguuaagucaaaaguuuucuucuacuuucaagagaagaagcagaaguuugaccuggcaaaugucugugugcugagcucggagggggcaagacgggcacuucuacccuccggcauuugagaugcaugagcucaauucaaucacauucccucaucagcacaauaaaagacauguuaugaaccaacuuaaagguauucaucacagccauacaccuuaucaaugcaacucaagcugcaucagccaggcuuccagugguagacaguaucugcacagguagugcacaugcauaaacaugaacacauauguacacggacaaacacauaaguaugcauuugcagaaacggcuggcugcagaagacaaaacagccacuccagcuuuguuuaaaagagaagcacucaaaagucccucuggauugcaagacauaugugcuacagcuaggaagagaacacauccauggccaugcuuuaucagggaaagacggagaggugugcucaugauugaacauacugcggagacucugagcaauuagagaaguggacagaaaugugguuagugguagcaacaggcccauucccaagaaccaggaaaaucaaucuguuacaaaaagcagagucaguggcgagagagacgaaagguggccaggcucgaagaaggguccacuuacuggcgcugccacacacggccaugcaguacucuucugugucaaaguuguuccgguugccgccacauccgccguaaaagaauggggcacacuucccuucagucacaucaaaguaccagcgggagaucauugcucggcacggccccgucucggcuuguucagagcacaccucuaaucagaggagauguggggaaccacauuuagcaugaaaaggcacugucucucuguucauguauacacguuuacuucuuuuaauccucccaguggcaaccuggacugguuuauuaggcagcaucuaccaaacauuuacugaggaauuuaacuggccaccaggacuagagauuuacaccucucagagcaugcacugucaucugguuuaaugagugcaggacucgguagcaauaaaaggauuccggccaaaggugaaaagaucauuuggcugcuuuuagaugaguaugaaaugacggaagguaucugcacaucacaacaauccuccaucauaaaaaauaaacuucucuuuuuaagaagucaacuuucauguaaggaaacugcuuugguuaugaagcgaaaguuuaagcccucacaaacaucugauugcuuuccuuaauaaaugauugccuuaacucaaauauaaaauuaauugcauauauuuugaauguuuuccaguguuggaagcugucuguccauugacuuuaucuggaaacacaugucauaucuguaaaugugacuuauacucaaugacauuaacuuaagaccauucauuuguauauuaagauauguacuaauauaaacggucuuaaauuaacucugauuuaagaccauuuuauuuguauauuaaaauauguauuuauauauuauacauuaauaauuuaauuacauaugcaugaaguacaucuauaacaacguauuauuaauucugcuauuuaauugauauuuauauauuaaaaaucuguauuauuuguauauauuuacauacacauuaaguacaacuauaacaauguauuauuuaauuaugcuacuuaauugauauuuauguauuaaaaaucuguauuauuuguauauuuuguauauuuaccugacccuugggcaggaauguuccaaacaauaaaacgcagucaaucaacuccaacugauuaauacacaccacgcacuguuauacauuaaaacacaucuuaccugucaacaugucuugccacccuccccaagaucaguuucacucaucccugauugccucaaagucaaucagugacccauccaauugcauguauaaagucaauccugaguagaauuauaacucuaccucccauguauaucccauuuuuauuggaagugaaacaacagcccaauucucucucuggguuugugcccugcccuugcuagacugacgccuuagcacacacagaugucuucuuaguuuuacugacagaggaaaaaacaccuuucuaaaagaugaaagccacgcaucacccauuacuuccaaguuaggaauauucaacagauucuuuuuuucuuuuuaugagacagggucuugcacugccgcccaguggcacaaucuuggcucacugcaaccucuaccuccugaguucaagugauucuugcgccucagccucccaaguagcugggauuacccuuguaccagcacgccuggcuaauuuuuugguauuuuuaguagagaugggguuucaccagguaggccaggcuggucuugaacuccuggccucaagugauacaccugccucagccucucuaagugcugggauuacaggcgugagccacugccacugguccuucaacagauugauucuaauuagccaaucaaagacaaggauccaucacaucuaggcauggcuuugagcuucacaggccagaagcugcucugucaguaacucagaggggauauggucccuagacccaauucacuuuuaauaaaucagggugccaguccuuuaauuuuggaagauaaauaaaauugcgaaguagaugggauacuuacgucaacaaguugguuggguuucauccuguaagaguauuguguacagaaauccaauuugcuuugggagcguggacuuugaaagcagcaguacugagugagauggccuuaaugauggaugauaaugagguugaugcuuucguagccacguuuccaucugaaaaccacgugaagagugucagaucaucuucauguccguugcauggcgcauuucuccugcggaguguuugacaccuucugggcuuagugcugacugucccuccuguugacaucaucgugaugguagccaccucugguuuuaccaguacuuuauugcaucuacugaaagagcaacguguauagggaaguaaaacaauaguuaguccccauuuguauugacauuguggaucccaucaacuauagccagcaguggucucugcucccagagcuuaccuucaguuguaacaaacaucuacagcuucacuuugcuuuccuucucuguaucuccuucaccaauguguacauauucaugucacaugcucuuuaacguuucuaagacacaacaauacccauuauuaaucucuuacucaggcaguguuaauuccaauaagacugcaaggcagcagugccuccagagccugcacugugccgggaauuggcacugggauugcaagcaccguggucauugcuaccaagggaggcacagaaucccuucaccccauagucacgggagcauuggcaacaaaauuuaccaugccuuggcaauuuaugcugacccucacauuuuggcauuaaaaaaaaguaucaucuuagaguaccaaauaugugucuucuuauagaugugugccacgggccucgcagugaacaucacagcucugcagaugcacaaaccuugucuuuaugagucuauauauuaaauaaaagugguagaauuuuggaugggugcaagucaaguaaugggauaaaagaaugaugaucgaaggagaugauucaugauaacuaugugcccuuaugugaaaccuagcaacaauuucuuacuuaugauaaaggcacaaucuccccaguccagaaucuaaauggcauuauauuaacauuuuccuauaccacuaauuaaacauaaugcuacauucauuuuauuuucuucugccucauucuauaacagcuaugaaaccauuuguuauagcuaauucguagaagccaggcuaaaugagcccuaaucaacuagaacaagcauucagaacucaaaauccauuuacauguuaauuaaguaaauaguauaagcuacacguugagccuacaacucuugcuggagucuccagcuguaagagccuuaacuccuuccuuucauaaaggccaagaaaagagugaguuagucccuauucggggaguguugguugguucucccaauccuguuaggggcaguuggcacucuugacuuugaacggcccccaagaguuucacugccuugguggaguccaagugggcaucaugggcaauagcaacagaucccacaauacucaaauacaaaaggcuaccugagauaaugcggucaggaauggguguaacaguguauguuaauuuaaugucaaauacauaauguauggagaagauguacgugaggcuggaagaacaggacugacagugugcuuuuguuacuucucaaucucuaagagacagcuaccuuguccaacugguucucaucugcugacauggaggaugagcagauaggccuucucuuaacaugcaaccccucuccuggugaaaaagagcuucucguuauaauucccccaauugucagcaacccugauuccccaucaccucaacucucacuucccaacacuuucccucagggaaauaaugagaacagcaacuuccuacagcagugaagcugacuucggagaggacugggaaaggaauggaacguauccucuaucacucauaauuauauuccuacucuacuacagggaaagggaaugcaacuguuuguuuucucugacuuuuuugcuaacccuuuauuauuccagaacaauuuuccauguaguagaaaagagaaucuuagccuacucugggagaagcugggacugaggguagggucagcaccagcgauguaugaugcuaaugcuuuuacacaaaguaugaauaagcacacaagaaauggccagugccucucagaagugaacacggagaagcagcagcauagacuuggguuaaagcaguguuaagggauuaaugucaauuuaauaguugugauacuguacugagugaagacuaugcagggucucuuuguauuaauucuuuuuuuuuuuuuuuuuuuuuuuuugagacagagucucgcucuguugcccaggcuggaaugcaguggcacuaucuccacucacugcaggcuucgccaagcuccgccucccagguucacgccauucuccugccucagccuccugaguagcugggauuacaagcacccgccacacaccggcuaauuuuuuucgauuuuuuaguagacacgggguuucucuguguuagccaggauggucucgaucuccugaccucaugauccgccugccuuggccucccaaagugcugggauuacaggcgugaggcaccgcgcccggccucuauuaaaucuuucaacugcauguaaaucuacaauugucucaaagaaaagauuuuuaauuuuuuuucuuuuuuauuauacuuuaaguucuaggguacaugugcacaacgugcagguuuguuacauagguauacaugugccauguuguuugcugcacccauaaacucgucauuuacauuagguauuucuccugaugcuuucccucccccaaccccccacccccccaacaggcccuggugugugauguuccccgcccuguguccaaguguucucauuguucaauuuccaccuaugagugagaacaugcagaguuugguuuucuguccuugugauagucugcugagaaugaugguuuccagcuucauccaugucccuacaaaggacgugaacucauccuuuuuuauggcugcauaguauuucaugguguauaugugccacauuuucuuaauccagucuaucauugauggacauuuggguuggugucaagucuuugcuauugaaaagauuuuaaaaagcccacauaaaaaaaugaauauaggaagccaggcaugguggcucaagccuguaaucccagcacuuugggaggccgaggugggcagaucaccugaggucaggaguucaagaccaacguagucaacauggcgaaacccugucucuacuaaaaauacaaaaauuagcugggcaugguggcgugcacauauaaucucaccuacucgcgaggccgaagcacuggaaucacuugaaccugggaagcguacauugcagugagccaaaauagugccacugcacuccagccugggcgacagagugagacuuggugucaaaaaaagaaaaaaauaaugauaauauaggaauauugauuuuucaguuugccuaagaguucuaaccuugucucuuuacuugacucagagauuggaagauuuggaaaucucaguuugagaaaauuuccuuuacaucccucucuagcaaugggauauuaguaagagaucuaaccaaucaagaugcucaccaaguagaagaguuuuagagcacugagaccugaaacacaucuucaauaagccgcaucuaguuucauggaagauaaaaauaucucaagagagaguucaaaugcuuauguuuacauuuucuauuuuucucaauagcauaauuucuuccuuccuaaucuacugaaacuucuaaaaacaucagcaaaaaaccuguuucacauuaauuacuauuaucacucaguggaaauuuauaaaucagccacuaaauguagaggaugcaaaauuagaccuuauauaacuaaacccaaauaagauuccugugaaaauuaaaaccguaucuucaaaauguauacuauauguaauuauuaugucaauuaaaaauaaaguugaaaagaaaacaaauuuaagaaaaaacaaaaaacucuucaucugccuucuuuguucucuucucaaaauguaaaauacugagaaaacuaacauuuugaaaucauuuuugaaaucaaacuuauuuuuugauuuccaauccaccuuucuguucaaaguaaauaucagagauaauaauggagaaaauuuguucagaaaaauaaaagcaagaauauuuccuaaagagaaauguuagaaacauaggcaaagacuuacauggcuaucuaaggaaccacaauccuuuauugauguugaauuucuuacacuuucaagaucacaaauagcuuuucugauauucacuuaucugaauucugcuggcaaggaagcauuaugccuucuuuuguaacaacucugcucacucuucaagacaaaaugccauuuacuacacugaaaugcugguguauacgaaacacaaagcaaaaucaugugcuucuaauaaaacuccacgcauuuuaucuuuguaagguaggcccuugcugagauuugugcucgugucaacgcuacauuccauuuucuaaaaaucaguauaacacaaaauaauacagaaucuaagccagagcucccuggauuauacaaaaugauuaugcaauucauuguucaaaaaauaaugcucaaccacaaaaaauuaguucugaauagauauuucaaauuggagugaaauucuuuguggacaaccaagguuagaaagcugauuuuacauauuuuaauaaauuuagaaugaacacaguugugaaacuggcaaccagaauggggagaaaaucuccacuuucaaauguacgauaauuauaaugccuucuuaugaagcaaaguuaacagauuagcaaauaauucgcuguaaauaaagugguaaauaaagaauaaagcugguuuuagaauaaagcaaagcugguuauuauuauuucauuuuuaaucauugaauuucaaguauucucagccuacuggaauguaugugaaauaaaacuauauuccaugugauguauaaauuuuaaauuuacaaauuuugggaaagcagucacaaucaaacuagucauuuagagagagcuaggaacuauauuuucugaacuuuuuuuuaaaaggcaacauuuuauagcauuauuuucuccauacucuacaagaauaucuacuuaaacuucacauaauacaacuauuucuccuuucugacagaaauucccuaucuugaacucuuuuucuccaauuuuaaguagaguaaaaagggcaaauguaagacaaauauaauuuauuuuuguaauaaguuacuuccuuaauguaacaguggaauaaaaugaaaacgacauaaauauuaaaauccacuaaguauacaaaacuucaauauuucaaauaaacguuauaauuuauaaauauaauuauaauauauuagauuauaauauauuauauaaaaacuuuauaauuuauaaauauaauuuauguauuauauuuauaaauuauauauuauauacuauauauuacaauauauaauuauauaauacaauauacaauuuauauacauuuuauauaaauguuuacauaauacauauaucugucugagcucaauguaguucauaacaacuuuauuuuuuuagccuaaguuauugcuguaauucuaaguauuacuacguggugacauuucaugagccuaaguuauuaaaaucaaacuuguauucuguugaaaaauaagcagacaauauuugcauuugauucuacugaugaaaaaauuuuaaaagccaacacaauagaaaacugguuauuuuuuaagaacgugauuuucccaauucuggaaccauguacuuuuaauagaaaagaacauuuuucaagugcuuguacguaguggcaagcagucgucaaaaaacauguuuagaaaauuacucuaauaaggcaauaaauuaucaaauauuuaugaccuaguaaucauauuuuacuaaauagaagcauguaaaauuaggcaagcaagcuugaacugaagucuuaugacaaaucucacuuaagcuccaaauauggauugaaauacaaacaaagaugaugcaaacagcugugcaugcuaaugaaagcacugcuucaguacaagaggauggugcuaauuugucacggaaguaacuagaagauauccgcaguuggcuagccuuuuuacugaauugcguuaauucucucaggcuagccaauacaucugucauucuaauuauaccugacccaauucucaucucuccaugaugaaagauuguuuauaaaaugccaccugaaggagauuuacuuguaaaguauuuagacuaaucaggacucccgugacgguguuagggaacacucacaaaaggguaccacugugguuuuuccucaaccuuuguuuccuguuuguuaugggaauaaacuugcucuucacugagcugcgugguuagcgugcaacaggcuauuaacaagaagcucaaaacucgggauaucauguccuguauuggaaaauaaggggaagugcuuugucuuacugaaugagagacaggaguaugcugggaaacuggcacugucuagaaaaacaaacaaauagaacacucuugaguuacaguguaugccaacugccaugguauaaauacucccaccauugguauuucaagcuacuaauggcuauggcuuacaaaauuccucuauacuguaauaauuagcuuuuacaggcuagcaggaguuggcuacacuaccauguuaaugacaggaaauaggggcacaagugaacacauguagggagacuguaagaguuuuucgguuuccuuggucuugaggugugaauuuaaggaaagaaaagcucaguagguagaugucucaggauugccucauacuuguugguaucuguaauauaccaagaacaauaacaccaaagguaagaaugguuuuccuuuucaguuucuuacuuccugucucaaugcugcaaaucugcaccauauggaaggcaggagacgcuacuagagucuacuacucaaaauaggaucauggaccagcagagucaacaccaccugggacucaggccccccauacagacucaacaacgauuguuuuccaagggccuuggauaacucgaauggauaucucaguuugagaagcagcaugaucaaccuuaucuuuuaaaugcaauagauaugucaaaacgugagacauaagauuuaaucauuuuccaaaagaaguaguuagggaagaauuaguaaaaguugcauagguuuuggcuuauuaaaagaaguacacauauauuugggaaaagacagauacaacaaaauuaguagucuuaagauucaaauauacagcucaacaacuuaauuugaacagauugaacagauugucuauacacauuuauuuuacucugaaguucuguccuaucucaagcaacauuaaaacagcuucgauaccucugccuuagauccaguaccaagaucauaauuuucuuacucauauuaagacuauugaaauaccagacuucuuagaaagcugaauucaagugguaucauuccuauaauaucccagaacaucagaaauaucaaaguuuuuauuuuuacuuguaaaaauaaugaagaaagccaagaucaauucaagggcuuagaauauacuuccuuuuucuuuucuuuucuuuuuuuuuuuuugagacgaaucucgcucugucacccaggcuagaguacaauggagugaacucggcuuacugcaaccuccgucucccggguucaagcgauucuccugcuucagccucccgaguagcugggaccacaggugugugccaccacgcccggcuaauuuuuguauuuuuaguagcgagggguuucaccauguuggccaggcuggucucaaacuccugaccucaggugaugcacccaccucggccucccaaagugcugggauuacagcaugagccaucgugccuggccagaauguacuuccuuauaccacuucucuguaaagaaagaauuagaugauauuucuguuccgguuuaaaaaaaaaaaaagaaaaaaagaaugccucuagauguaggucauggguuggaaggaugguccuacuguuucauguccuuuucuggggaagacugacauguacaccucuccauguuaacuggcuucuugucacaaucucuagcaggcaaacaaccuacagauuccagcugggaacagcagugucucugguuacagcacagaugcuaaucaccauuugcuauuuuauaacaguggacaaggggagagugaauuccuuuugaacaaaaaaaaaaaaaaacaaaacaaaacuaggaaagcaguuuaccuccauaucucacugucuacauggcaaauaugcauacgcaauguuucaagucaacauuuuauguuguuuucuguuucuaaauaaagcuacuagacuacauuacacauuuuaucaaauacuugcuuuuaccuuacuaaauguguauuuaucauauuugcuuuggcauauuuuuguuuauuuuacuuuuucuuauacaauaaaaaauguucacugguuaucuacaaugugcaaagcagugauacagaaguuagagcuuacauuaaaaugagaccagccgggcuugguggcucaugccuguaaacccagcacuuugggaggccgagauggauggaucacuugaggucagcaguucaagaucagccuggcuaacauggugaaacccugucucuacuaaaacuacaaaaaaaaaaaauauauuagccgggcgcaguggcaggugccuguaaucccagcuacuugggaggcugaggcaagagaaucgcuugaaccugggcagcagagguugcagugagccaagacugugccacugccuuccagccugggugacagagugagacuucgucucaaaaaaaaaaaaaaaaaaaaaagcaaaaaacaacaaaacaaaaaaaacacacaaaacuuagcuggucuuggugaggcacaccuguaaucccagguacucggagacagaggcaggugaaucgcuugaaccauggaggcagagauugcagugaacugagaucgugucacugcacuccagccugggcgacagcaagacuccgucuuugggggaugagacacaguauugcacggguauuucucuguucacuuuuuuauuuuuauuuauuuauuuuugagacggcaucucagucugucugccgagacuggagugcaauggcacgaucucagcucacugcaaccucaaccucccagguucaagugauuucuuugccucagccucccaaguagcugggauuauaggcacccaucaucaugcccggcuaauuuuuauauuuuuaguagagacgggguuucaccauguuggccagguuggccucaaacuccugaucucaaguaauccgcccaccucagccucccaaagugcugggguuacaagugugagccaccacgccugggcuucuguucacauaucuaaagcugcucaucacugcagaucucaacaccauagcccaguguuuugcaaccagagagagucuauccccuacuccucccaggggacauuuuugauugucaucacuugggggugcugcuggcaucgaguagaggcuagugaugcagcuaaacauccuacaaugcacaggacaaucauccgcaacaauuaucuggcccaaaacaucaauaguacuaagguccagaaacccugccauagcccaagcaaacaccagaaggauucgugaugcauuuuaguaacuuugcccaccaagacuacugggcagcagucaccagcacuucagaaauccuggguaacaaaugcuaguaaauuuccagaacagaugcaaucauaagaauuggcaagcaagacuuuucuuugcuccuaucaugaaacauaagaaccuaaagucacgugcaagcaacauaaaauugccauccauauucugugauacuugcauauucugucuagaaauuauacccaauaagaacauauauaaauuuaagaaagaggcaacccuacucucauaguuaaaacaccugaacagucuuaccauuauuaucaacuaaauauagcguaaccuuuaacauuuccucugccuuaaucuuuuuuuuuuuuggacagggucucacugucaccaaggcuggagugugguggugugaucacggcucacugcaggcuugaccucaccugggcuccagcgacccucccaccucagccuccugaguagcugggacuauaagccugugacacuacagccaaaacaacaauuuuuuuuuuuggucucccuauggggcccaggcugcuugcaaacuccuggggucaggcgaucauccugccucagcuucccaaagugcugggauaacaggugugagauaccaugccuggccuguaaacacuuuuuuuuuuuuaacacuguaaaagucucaauguuuacaauuugggcugcugucuugaaaauuaagggauucucuugagcaucauuuuuauaugagauucauucauucuugccuccccuugacuuuuuacucuucuacuaacagaaucacaaaaagucaggcauauuggaagaggugguuggaaaccaaagaugaauuuucaggagggcaaaaugguuaaaggcugagagaagcagcugguuaggcuguaagccacucugcuuuuggaaacucauuguucugcaagggaacuaaagaucuccauucaaauccacagcuuuguaaccugcucaaggaaucugacuguacuuaaucagaccuauggcuuggcuaaaaacgugugcccgguugggugugguggcucaaaccaguaacccagcacuuugggaggccaaggugggugaaucaccugaggucagaaguucgagaccagucuggccaacguggugaaacccaucucuaccaaaaauacaaaaauuagccaggugugguugcacacaccuguagucccagcuacuugggaagcugaggcaggagaauugagaauugcuugaaccugggagacggagguugcagugagccaagaucgugccacugaaucccagccugggugacugagacuccaugucaacaaaacaaaacaaaacaaaacaaaacaaaacaaaacaaacaaacaaaaaggugcacccagcuggugcaguggcucacaccuguaaugcuagcacuuuaggaggccaaggcagguggaucaccugaggucaggaguucaagaccagccuggccaacauggugaaaaccugucucuacuaaaaauacaacaguuagccaggcgcgguugugugcgccuguaaucccagcuacucaggaggcugagagaggagacucacuugaacccgggaggcagagguugcagugagccgagaucgcgccauugcacuccagccugggcgacaaacaaaaacuccaucuuaaaaacaaaacaaaacaaaaaaagugugcccauguaaauguaugcauguuuaaaugaaccugaaccucugaguugcuggauuucuucuuugagguuugauuuuuuuuuuucuuaauugcaaauucuugaguugaguacaguuauugugccugaggcaucugcacacuuuuuuuuuuuuaaagcaacugauuuggggaaaauaugagaaagacuaauauucuuuaaaaaucuaguuucuggccuuuaauuaaauuggacuaaaauuuuauuuuuaauaaaucuagauauaauuguauuaaaaugccuuucacugauuacuucugcuauucuauuuuuuuuuaauugguaaagccagguucucacuauguugcccaggcuggugucaaauguguaucuuugugaauauacuaaaccacugaauucucucucacacacacuucuauauggcucuauucccuagucucaucacauuuuaagcaaccuaauuaucugagugggcuuucuagauugagaccauuaaacuacacggaaagaugcuuguccauguccugcuucacucugccucuaucaaaguguguaucaaacaccucggaaucaauggcugccaugacauggggcacaaaauaacaggcuguuaccugucacaucuauggucagugcugacacuaguucucuugacaucauuagcaagcaugcuacaacccgggcgagaguagaagugcauccucuccaucuucaaaacacaaagguaaaggccugaggcuugcucuauaaggaggagccauuacccuuuugcccuguucccaaauacucccuggagcuuuaguuucauuuuuguacagcaugcuacuacugaggccuccaacugaaguaugugaguucauguucggguucacagcaaguuaaguucacaguuuaccccaagcuuuguggagaguuaaauauuaaucauaaguaaaaaucccguuagugaauuauaggauaccuuguaagugucauguccauuacaaacaaguaacaacagaggcaugagaauuaagcuaagcuuuguuucuucuccccuugagaucaauacaagcuacucugauuuacuucaaguauguauugcauucauucuauuuggugcucuaucacccaguaaaucccuauucuuccuuuauaauuacugauacgccaacuucucugcaacauaguaggugaaaacuuuuguuccgggcugagcacuuucucuucuccaugcugccaaaauuccuuccuaggcaggccugagagacucaucccucucaaggacaaugcagauauggcuagaagcaaccugagcaagccacuuuguuccuaucucugugcccccagcaaccaaugccaugucugguaccuacaagugccuuguggauauuggugaaauguauagcaauaaaucaaaugguacuucucccagauuaauugucaccagaagaagaaaaauaauuuaauucugccaaggucaaucacuuagcccaauauaagcaauauucggaucaaaccuuuuagcuuuuaucaucacaugagacggugaaagagccaucuguaucagugucucuaucuguucacuuaacagaagaacucccacaaggcuuaaaauaccugcaagaaauaaaacucuaucuugaaaugcaguggcaucuaauacuaucuuauccaauuuucagcuggauuuaaaauuuaagugcagauauuucaauauacaguguauauucacacaaaaaaaauuuaagcaagaaauguuucuuuuaaucauaacauaauguucucucuaaauaucagcuuuauuauaccaauagauauggauagguuacauuuaugccuuuuauaauuaaaagucaacuuauugguuuaccuuuaacauuccucauuaguaguaaacauuaguuugcuaauguuucaaaugcaauggaggaucggaaugaugauauaaccauaacuaagagagcaacuaagguuaauugagcaguuacuguauaccaggaauuaugcaaaguguuuccuauaaauuaauuaauuuaauccucacaaaauaguuaaauauuggauaggucuuauuaaucccuauuuuacaaaaagaagcaaugaggauucaagguuauuugauuuauacaaauuuacacaguuaguagcuuguaaggcaaagauuugaaucuggacagcuugaguuuguaaauugaacacuuacugggcaugaugguaagcguuuaacauaaguuaccuaaagucauucuuacaagaaacaugcaagauaacauuaccaucuacacuacacacauaaaaaacagguuacuuaacuggcccaaggucauaaaaauucucucaaacacuauacuagucuaucucuaaccaaaaaaaaacaaacccuaccucaaaagaaaucaacuugauauggcaguaugugaaauagaaagaacuucacagucaccgucuuauagugagaaucagggguuagcaaaugguuuacugaaaaggccagauaguaaauguuuucaguuuugcaggcaaaacaaucucuuuugcgauccucaacucuacuuccaaaacaugaaaacauccauagacaauuuuuaaacaaaugggaugggcugugccuaauaaaacuuuuguguagaaaacaggaaaacaggcuauuuuuggccccaauuugcugacccuugaucauuacucuuauuuguggacccccgaucauuuuucuauuuuuuuuuuuugagacggagucucgcucuugucgccaggcuggagugcaguggcgcaaucucagcucacugcaaccuccgcaucccagguccaagcaauuccccugccuuggccaccugaguagcugggauuaugggcacgcgccaccaugccuagcuaauuuuuuuguauuuuuagugaagacgggguuucaccauguuggccaggcuggucucuaacuccugaccucaggugaucugcucaccucagccucccaaagugcugggauuacaggcgugagccacagcgccagccugaucacuucaaguaaaaauucuaaaaauucagaaaugcacaguguaaaauaauagaugaauauaugccuauaucaaagguauaugcauuuacaagggaacacagguugaaaugaauuuguguguauuuauaaagaaaauaaaaaguguaauuuugacaugaguguagcagaaauauccuggccuaucuagguccaaauucugauuucaucacuuaaccaguuaugugacccaggacaauuuauuuuauucuuuuuuugagacgaaguuucgcucuguugcccaggcuggagugcaguggcacaaucucagcucacugcaaccuccgccuccuagguucaagcgauucuccugccucagccuccuguguagcuaggauuacaggcgcaugccaccacaccuggcuaauuuuuguaucuuuaguacagaugggguuucaccguguuagccaggauggccuuaaucuccugaccucguuauccgccugccucggccucccaaggugcugggauuauaggcaugagccauugcgcccagcccaggccaauuaaaaaaauuuuuuucggccacgcaugguggccuguauucccagcacuuuguggggggcggggggcggggggcggggggugccgccaaggugggcagaucaugaggucaggaaaucgagaccauccuggcuaacauggugaaacccugacucuacuaaaaauacaaaaaaauuagccgggcaucguggcaggcaccuguagucccagcuacucgggaggcugaagcgggagaauggugugaacccgggaggccgagcuugcagugagccaagaucgcaccacuacacuccagccugggugacagagcgagacuguaucucaaaaaaaaaaaaaaaaaaaauucuuggccuuagagaucuuggcuuuaaacggggaaguaaaauuuccaccacacagcauaguuacaagguuuaaagacagagaaucacugcuuuaaagcacaagaggccuguuuucccggcuacuugggaggcugagguuugaacucaggaguuugaauccagccuaggaaacauagcaaaaucccgugucaaaaaaaaaaaaaaaaaaauuuaaauuacauuaaagggcaagaguggugaccgugaaaaucuauaucugcaacaaaggcuucaaaaaucugccagucucccaggagguaaaaugcugucugcucugccccaacgaugccuuccacaguagcaaagagccuagccaucagcagggguacaacgaauaguugcugaauaaauggaacauaaggaagaaauguccaguuccucuggacagggcacaauuggcuagauuaaauaaaagauuaugccauuuauuacaauacccauuucaaucagaauuuagaauuuauggcucaaucaaaacuacccugauaucucugguuucugaaguacaaucccuucuugaagaacagaaaauuaggagcaaguaucuaaauacaccacuguuguacucaaaucgguaauggcuuauuccacuagaccaauaaccaauaauauccaaguauuuuuuuaacaaccaaagaugacaauaagcccccaaaaccagauagaucuugcaaucgugugcucacuuuuauuuuuauuuuuuugagacagggucccacucuguugcccaggcuggagugcagcgaaugugcuuacuuuuaaacaauaauuuuauucuacuggaaucagugacagagaacagacaucuucucauuuggguaucaucgauucuaacacaauauggcagagaagauuaugacuacgcuaaaagugucuuauuuuucuucccuccauuucuuuccgguuuuaacggguuaugaaauuauugaguuuuuuaugaagcacauuaaggacugguaucaguagcaauauguugguaaugaugacaauuuucuuagaaaggauggcuguaaaucacauuuuguuccagguacugaaacacuaacacugaaaacaagauuguaagccucccugcaguaucucaucuuugcaagucacuucuaauuuuuauguugaacacagaagcaaccuacuuguaauuagaguuuuacaaaaugaguaaucaccuauggcguugccauugcucucaauuagggaagaaccacaagucaccuuuuguaacagugaggaggaggaaaaggacucuuugcagcugaccccuuuaacguuacccucuaaaacaucuacuucuuuacuggaauuagcuacaagcacaaaaaaauuaucucgcaugggcacaacugaccauaacauguuucuguuaggcccccuuucccaggaagacuugccucaauuagagcuuuuguucaggaguuugagguggaaugaauggaccugcauuaaagauuccucuauuucuggggcauuaacaguugcuaucucucaaugaccagguaucuugcuuucagaagguugcuuuuguugcucuucuugccaacaaaauuauuaacuuguuauuuuuuaagguucauuucuuuuuugccuuuagccuggaguguuuuguuuaugaaauucuuuuaacugccuucgucuuucuacaggaaauaaaacaauacaacaucucuguguuccgucuuaauaucaaauaauacuaccugcaaaacucaagcaaaaagaacuggacuaaugcagacgauaaugagaccaauuuaucucaagcaaauugucuuguucuagaauaugggccuaaguuuauguggcauccucucauuguacugcauaacugaugucacuccuuguucaccuguuaccucaacaguacuagcaucaaaacaaaaucucuuuauugucuccuggaaaaaucugcagcgcacaguagcuucugaauuaauauuuguuaauuaaucaccugcaguuaaugcccaucuuugccagccuggcauugaaggucucuauauuuuggucccaaccuaaaagacaucugcucuagcuuaaauuggaccaauccugucuccuaaauaugccuuuccauggcaccacauuuguuuugcuaguccugaugacucuacagcaaaauccacugguagacacaccacccacccacacuuuuggcucuaguucaaaugucaugcucuccauggaaccuucucugaucaauccagaaguucccucuuacucucggaggcagguucuguguucacauuucuuacaacacagauggcuuuguacuucuuugacuucuauuuccuaagagauuuuaacauccacuaggguuagcuggucugugugugcucaucauccauuccacauggccuagcaaaauggcuuguaccaagcaggugcucaaaaucuaauguuucaaguaaaaugggacacuaaacugguucuauuaaacagcccagcuugauggagauucaccaaggacuuucagucccacugcaggcugcuagcugcuguaauuuguauucacacuucauuuagguuucgagaagagaagcccugaaaagcuguccuucccugcuacaggcaucaggcuaacaaguucauuugaccagaucugccauaguugguccuaacaguuguaugaaaaacacccugagaaagcaugucucaguauuugaaaaauggugguuuaaacaaaaugcgcauuuacuagcacauuuacuuaugugcuaaagugaguaagaaacugucauuaaguagggaaugauaaacuuaauccaucuugcacucuguucuuuuuuuucaaagaacauguaaaacuuucaauaaauuuuaagcuaacgcugaguguuuaauucagaauaaucucaauuuuaaaagcucaaguuaaagaaauguagaaccucaaaaauacuguguuaagugaaagaagucggacacaaaagaccauguauuauaugaucccacuuauaauaacaguccaaaaaagggcaaaucuauagagacagaaaguagauuaguuguugcuuggggcuagaggugaguagagggcuuaacugggagugaguaugugugaucuuacuggagugacgaaaauguucuaagauuagauuauggugauaguugcacagcuuggcaaauuucuuaaagccgcugaauuauauacuuaaaagcaaaugaaacuuauauguaaauuacaccuuaauaagguaaaaaaugcaacaaagggaagaaaauacuauagugacaacuaugaauauaguugagggagacaaaauagcccauguuaagcucuaauagaacaauaaaucugaaaucauuaaacuuuagcaaaaagugagagaaagccacuuuuuguaaaugcuguaacauuugugguugaccuuuauaaguauuugcaguacauuaaaauucagucaaguacauauucauucaaucuagcucuagaagcaucuuuuacuaucugccaagcagauggcagauaugaaaugcagaacucuuuaaggaacaaaugcauacucuuuaaggaacucaauccaacaguuuacucguuucuguaacauuuggucauuuaauaucaacugaauguuuguuuuuauuucauggagacaaguaugaccuuuaguucuuuuaguucacaauauuugcaacacaaacauuaauucaauagagaaagucuaagacauuaauacuauauuuacuucuugaagaaagcacugccguacuucccaauaaaacaauguaaacucaacauaaaucaccucuguuaaaauucauagcauaaaauaaugcgauacucaccaaaucuuuuuuuuuuuuuuuuuuuuugagacaaucuugcucugucacccaggcuggagugcaauggugugaucucagcucacugcaaccuccgccuccuggguucaagcaauucuccugucucagccucccaaauagcugggauuacaggugcgugccaccacgccuggcucauuuuuguauuuuuaguagagauggguuuucaccauguuggccagacuggucuugaacuccuggccucaggugauccgccugccucggccucccaaagugcugggauuacaggugugaggcacugugccuggcccaaaucuccuucuuuaaugaaaucuaaucacaacuacucacucaacuaagauuuaucgaaacuacaagccaggcacucugugcaauacugaauaaaaucaaguccuuacccucaaggagcucaucgucuaggugguaacagacaauauuauauaacaaacacucacugccaaaggaauaccaaggagucaccuaacucaguguuugucaaauuagaugacuaccugguugggcggagucuuguagaauuaacuugggauuugccaagcagcauauacaagguacaaaacaaacuguauaauaaagauuucacauuauuugaaauuguuugcuuguuaaaccaaaaaaauuucacaagcauaagaagccuuuuggaaaaaaaaacauguuuuugauuggggaaggcaguggugcuaggguggauauuuccaacucugguauuacgcuuucuuuuccuuggggguggggggaauccaagcaaaugguggauuaccucgaaccaccucuuccacagacucuguggugguggugguggugguggcaaugcuggugguucucucuguggcuucuucguaggguuccucagccucuuccucuaccucaucaccauccucaucguccucgucaucaucggcuucuucuucuuccaccucagccacuucuuccuccucugcuacuucuacuacuuugucuucacugugaaggcaaacacaaauaacagaaaaagucaauuaaacacauuucagggaaggaaaagaaaagucguccauauggaauuuuggcaauuugagaagaaacacacccaaaacuucaauucagcaggucuaaguauaaaucccagcucagugggucugcaaaaauuuuuauccuuggggacaguucuuaguuucugcaguugcuaaaaggggaugccaugagucuaaccacaggacauucuggaaaagggaaaauuacggagacaauaaaaagaucagcgguugccagugguucagggggaguggggaagggaugaauagguggaguagagaggauuuuuagaaacuacucugcacgauacugucauaaguaauaauagauacacagcauuaagcauuugucaaaaccaagagacuauacuacacaaaaagucgccucucauguuaaaacaggaauacugguuaauaauaguguaucgauauugguucaaacguaccauacuaaggcaaaauguuaauccaggggaaacuguuggggaguggggaagugagagguagagggaacuuuuuguaguuucugcuugaauucuuuguaaaccuaaaacugcucugaaaaauguaguccauuauaaaaaguggggugguggauaucaaaacugaguuugccguauuaugggaauuacuucucauagugcacauacaagagccgcaacgcauugcacgguagcggauacucaguauaugcugguggaaauugguuuaaaaacugcaacugagagcuuaaacuggacacacagguggaagaugaagcugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaccugcaaugcccuguggucagggaugccugcuggaacucacacagguggaagaugaaacugacuuaaguaaaucugcaaugcccuguggucagggaugccugcuggaacuauuuaguugcguacccuaugguuacuaacugcuuauguuuuguagaaaaccaaauauuucagugguucucaaauuucagugagcaucagaaucaccuggaaggcuuauugaaacacagaucaccuaccugcuaaaugugguggcucaugccuguaaucccagcacuguggaaggcugaggugggaaaaaaccuagaggccaggaguuugagaccagccugggccacacggugagacccugucuccaaaaaaauuaaaaaaaaaaaaaaaaaaaagccaggcaugguggugugcaccuguaguuccagcuacucagaaggcuggggcgggaggauugcuugagcccaggaguucgaggcugcugugagcuaugacugcaucacugcauuccagcuagggagacaaagacacugccuccuuaaaaacaaacaaaaaccagccaggcaugguggugugcaccuguaguuccagcuacucagaaggcuggggcgggaggauugcuugagcccaggaguucgaggcugcugugagcuaugacugcaucacugcauuccagccagggagacaaagacacugucuccuuaaaaacaaacaaaaaccaacacagaucaccaggugccuguggcaguuucuaaugcagcuccagaguuucugaaucaugaggccuugguggggccugagaaugugcauuucaaauucccagguaauacugaugcugguggucaggggaaaauauucugagauccacugcaauaugcugagaauaauggcaagagauaaccaguaacucagugaaauugggaagaggaucagaaauauuuaugguauuaaacauuuacaugcugaugcaucauaguuuguaaaaaauaagcaaauuuggauggcaaaagaagggcaugucuagaacaaaauuaaaaaggccuauuaggaaauccuuguggaaaucauguaccugucaaggcaggcaugguugacagcauuugaauaucuaauaguaaaagccuaucguauaccaccuagcaggacuagaggaauagauguccuugaucagaucacaaaaccaauacaggagaaagaccuagauguggcaggggguuucaaccuuucuggggcaacuaccacaggucuauucgagaaguaccauaguaauagaauuaaaagcugcuaugcugacauuauaauguacccagaaggaaaaaaaaaagcgagagggagaaagcagaagggaauuauuaccacagagcugauucuggccaacaaggagaagcucaucauugggaaaagugauaggaacccgggauuuguagccacaggaagccuuggacucguagugagagcacagcauuauguaggaaaucagauuccaaacacgugagacaagcgaacacuaugauuccaugaucuacgacaauagaaaggaagacuccuccauaaaccugaaaggcuuucaaagucuaacaggaccgccauaaguaguuuugcugagagugaaagggaaagauauguaaagagauuaauccaucaauggcaggaauucucugauuaccucaggauuuaaagcauguguuacacaaguuguauaaagauguguaugauccccauggaacaccugacucugauuacguaggauacaagaauaguauaaagggcguuuauaaaaguuucaaaaaaauguguaugacccccaaguggaacgccuuucuaacucugauuaaauaugauguaaggauauuaagugaagacauccgaagaaguuuagcauguggcuaaagaauaaaaagaaacugauuaagcagaauaauuuauuaauagcaacuuacucauauguuaauaaaugaaguguuaauacagagaaaauccuaaucaguuauuguaacauuuccacaagacuaggacgaaauaggugaaaagagaaacagaaaacacuggcacugaaaaucagauguuggaagccuuuaucuccucguagaaauaaaugaggugaaauaacugacuuuuuuuuuugacugcccaaauuauugcacgaaaguuuacuacguggggcuacauuucaaaagaauccuuaacaguugcucagcugcccugagcuucugccuuugcauuuuucuguaggaucucacuguuguauuacuggugaaucaaagaaagaugaccugaugcaugucaucaguuaauuuaccguguuugagaucucuuacuuauucaaucaaaucaugggcacuaacuagcgcuguuuuccaauuuaaguggaaaauucagggaaagucaggaagaaaaaucaaaccaguauucucuuuaaaucaugauguauacacgugaucuugaaccaugacuggaaugacgauguccaaguguaccauccaggguuuggacagcaccguguuuccaggugggauggugaaaacaugacccuggguauccccagguuccuucuccaggcuucuuuguuauuacuuggauguggcccuuaaagcucugaauagaaaccauguuuguaaaaacagcuguuuagugugaucugcauucugguaugugucuagccgugaaaaagagugaauuauaugcccaucauccaucccugcaucugccugagcaauuuacuggcauaauaaccaggaacggagacacguaauaaauaguucaaccggcuaaggaauuaaauuacuuggccuaagagaacucagguccaaguucuuauuaccauagcuuugauuucuggaauuaaauuuagauguccaugaauucaauuauucauuuggacacuauuuaaaacaagagcacacgguuuuguuugaauaaugcugcaucuucccaaagaaugccaaacacaacaacauuacaacuuuuaacugcaguuuucaugaacagcuagaaacacugaaaggaaaaaaaugacuuuuccaccacuucuucaaaugcuggacagacuguuguccuguggacuuguuuugaaaagcucaucacaguuuaaggaguugcaagggaggaacaguuuauggaaauauaaagcugagcaucauaaaacaauuuccuuacaaacaaucaaauaacaacucacaauaaaauaaacgcuuggcaacauaguggaacauucauaccacauucgcagacuuuaguggcuaucaauuuauaguggguggcuuuuacagcuuuuaaacaccaauaacaaacauuuuuacagaacaagggaaccaucugaaaaugcugaccauccccagaguaucugaauuuaauaaggucaaagggacauuccuacgaggaaauaaaucacugaugauaaaauuuuaugugucagcaugcgagauuuuacuuggaugaaggagaaaugacaucacaaaggugacucuccuucuguuucuaacuaaagcugaccuugauauaauuccacaugcaggugccgccugauaagucccuuuacagagugaaagauuuugauucacacaccaauuuucauuucuguuuauuaaagucaugccaaaaaagucaccauuuguauuuucuaagaaagccauaugacauucuagaaauggcaaaauuauagacaguaacagaucaguggcuuggaaagguuaaaggcaagagagggucgaacaggaggaacacagaggauuugggggauaguaaaaguacucaguaugacacuacaaugguggguacaugucauuagacaguuuuccaaacucacagaauaaacaaugcugagagaaugcuaauguaaacuauggacuuugggugauaauaauggugucaguguagguucacugauuguaacaaaucgcucuaagggggacgcugauaaugggagaggcugugcaaguguaugaacagggaguauaugggagaaucucaguaccuucugccuaauuuugcugugaaccuaaaacugcucuaaaacaauaaagucuauauuuauucuuucacagucucuguuaagacggacuuuuuucuucuugcuacagauaaacagggaggaaaugacagagagaaagcucugauucucaugguuaugugaauauggacuaucaugagauccaaccuacuugcacugaugagggaagagggaagacaaccaaugucaguuccugaaaugcaaccaaccaggggaaagcucagcaggaagagguucagacucuuccucuguggauaugaaaaugggaaaaaagagucuagaggcucccagagucagaagagagagaaaauacaguaguuuuuuucaagaagauaaacagacgguucuccuucucucugucucaacucuccaaacugccagagucuaaacuggaagguacaauggcuggauaagucaguuuguccgaaaggaaagcaguuuuugaaauuacugcuacuaaauuaggaaaauguuuccggggagggagggcaaaguaagaaauagccaguacuucucccgcauaaaggcacuguuagaagcgaaacacaaggggacacaucaccuaauucuauuugaauuaaauaugaaaacaagcaaacugcaggcaaauagaacucaggggaaaggccaguaacuggcaggggccaggagagaggauucuaggggccagcaagucucuguguucugguccggaugcuggcuaucuaguuguguggucuuaaaaaacuuugcuuacuugcauuaccucuuauguguacuucucucuaaauaaaucaguaaaaagguugaaaaggguuucuuguuacuugcagcuaaaggcauaagcccaccuggggcccuagguuuaaggccuccagcuuuaggaagauaaccacaugacuggacuaccaaaaauucaugacucaggccugaggagguggcucaugccuguaaucccagcacguugcggggccgaggcaggcagaucacuuggggccaggaguucgagaccagccuggccaacauagugaaauuccgucucuacuaaaaauacaaaaaauuagcuggacgugggggugcacgccuguaaucccagcuacuugggaggcugaggcaugagaaucacuugaacucaggaggcagaagcugcauugcacuccagccugggugacagagugagacucugucucaaaaaaaaaaaaaaaaggaauaaauaaauaaagucaugacacagcugauuaagaaugagcuauaaaucacaaucuugaucugaaauuaggcuauaucaucauucuuacacauuuaaugaauacuuauucugagugagacaauucacacuaacugcuguaugaguaacagacauacugcagauuaaacgcuucagaaauucaacagagaagugauuguugcgaccagaggcaucugaguuggccggaagugauagguggcuguggggaugaggcaggaauauccacauaaugcacaaguggaauaagaaguaaauaaaauauaaugaaauuuuacacaggcacugaguuuuaacagugaggaaggguaaacugcagagacacggggauucagguauuuuuuuucuuuagccaauggauaaauauuugaguugaaaggcauauguacaaauugaugauaaugagcaaaaaaguggcaaugcauucauucauucauccauugaaucauuccauuaaguaccucucuaagccaaccccuaguaauucaaucaacaauauucgcugugcuuuaccaagugccaguacuauuccagguagugaagauaaagcacucaauuucuuggaaucuaucuauuaguuggggagguguaauaugagcaagaaaaaaaauuauggaaaaguacuauagggaaaggagauggggcuaauugcuaaugaaugacuaugauagaugugugccagggauggguagcauuucaaacaggguggucagggaagggccccacggaagagccaugugaacuaaaaaugcugaagucgggcacggcaaaaccaagagagugcauggauggcugaggcagggguaagagcaagugcaaaggcccaggugugaggaagagauuagcacguucagcaaaaacaacaaagggccagugagcuuagggaguagcagaugagggaggaaguauaagaucuggugguggagacagacaggcauaguguuacccaguacgguuacauuucuuacagcaacuggaacgacucaaugagauuuaaguugcaaugaugucucuggcugcugggcacagaauggucuccagggaaaacaugaauggaugcugggaagcuggacacugggccaggagcuagggguacacuggaaagcaaagguggcucacaaggcaaguagccaaaggccagacacugaccucagcaccuguauaaaugcaaaauuacugcccugauaacaauuacauacagccagaagacccaaaagagugagugcuagugugucuagugaggcagagauuccaggugucuagugaggcaugacugaaaugugacccaaagaagguccgaagugaaugaaguccaggggccaaagauagcucuccacuaggcaggguggguagagcaugugcaaaggcccggugacaggagggagggaaaccugagcaccugaaagggaauuggcugacaagaacagaaagugggcuccaagaauggcaagucagcaguggcacagagcaggucuuggcaaacugcaacccgcaacuuguucuuguacauccugugagcuaagggugggcuuugcauuuuuuaaaggauuauaaaaagaaaagaaaggggguaaaaaugacagcaauaugugacagagauuguaugcgaccuguaaggccuaaauacggauuguaaaaaugaccauuuaaagucaaaccaacuucucucaacacaugcuccuguaaacccugccccacuuacguuagugaauuagugaauuucuaaaaaaaaauuacugaaacaagcaaagagauccgagaagcacuaaagcccagcuuuuguguaaaccagcaguuccugggcagaaccuuuaaaagacaaucucucuuuacucugcuaucucaguacacacuuaggguaacaugaauauccuagcaauagagcaacaaucuaaacaauaccccugggacaugauauaagacaaauccaaggaguggacaguuuauaggaaaacugguacagcuucuucagcaagucagugucaggauauaaaaagugcuauucugaauccuaagaauuaaggauguaagaugcuggcccuggugccggauaggaugugaaaugcauaaccugugaaggaccuuucuggaacucagggagaaucugaauauggacaugguauccaaugguacuaaaaauuuauguuaauuuugugggugagaugguaucaucuggacucuguagaaaaauguucuuagauuuuagagacauauacugacaucuuaaauaugcuuccuaucugaacuuuucuuuaaaauaucuuggcaucauaaaaaguauguuuaaagggggaaaaugauauucuggcaagacuuaaauuuggaauauaauuacaguaaaaggcuaaauugcuuuuuuaaaggcuaucuuggaggcaagaaaagucauauauuaucaaaagcagauuauuguucugacagcuuuaugaaccaacuagaauuaaggagaagcaccuaaggucauaaaaaguuuuggagucauuuuaaauucuugauaugugaaaaaguuugguuaaucagaugcuaggccagaaaacugugaacgagcaaauuccucauguccaaagguuuagcugcuacuaaggaugggugauccauauauauuuuggguggagaguuggaaguauaugaccuuuggcugucuaacaaauauuugaguuccagggucugcucuggagucuagggaugcugcagagaauaaagcagacaaaauucccugccuuccugguauuuacauucuacagggaaggaaagauauaagaaaacuaaaacaacgauguuacacuagcacauuacaaggugacaaguguuacagagaaaaugaaagcagcaaagcuaggggugggcuggggcugguaguuggccgggcuguugcaguuucuacagaagaugguaaaagaagaugcccugaaaaggugucaaugcagcaagaacuaugugccuggcaucuccuuccacuguguccauacacaugagaacuacuacacagcuauagguggucuguguccaaaauggcuacaaagcaaccuaggaaagucacaaaguaagagaaaagccugguccuuuucuuuugggggcacuuugugaagaccuauuccuuagaaagaagagagaagcugcaugcuucugggcuucucccccucuuuuuugggaaaaaauaauugguucuguuaaggaaguguaucagucuguuuucaugcugcugauaaagacauacccaagauuggggagaaaaagagguuuaaugggacuuacaguuccacauggcuggggaggccucagaaucauggcgggaggugaaaggcauuucuuacaugguggcggcaagagaaaaaugaggaaaaggcaagagaaaaaugaggaagaagcaaaagcagaaaccccugauaaacccaugagaucuugugagacuuauucauuaucgcaagaauaguacagagaagaucagcccccaugaaucaauuaccuccccugggucccuccacaacaugugggaauucugggagauauaauugaaguugauauuugaauggagacacagccaguccauaucaggaagcaaaaacaacaaacucugcuccuccuuccagcacgcuccccaaaaugcagcaauaccuuguccugccccagauucguaaguggagccccauuccuaggagaaaacagauacaucugcaccacugauccucaguggcagaauaugccagguaucuguccaggagaagaagccauguggcucaggcuacaggguuuauagcccaaggccucccuugccucugugcucugagggcuugaaguaaguagaaaaguacuuuaaauuguaucauaaagguaaagaugauguagcuucuuggguuagccacaacauuuaggaaaagcauguucuggagagguaagacuuuuaguugauuuuccauuagugagcuaacauuuuuccucuuccaacaagcccacuuucuugcauugguaaguauuaaguaucuuuuuuuaaaguaucugugguugguuggcaucugagaaaucuguagggucaaauaucaaauagacaccccuagcacaaugccacaaaugcacaagggaugaggcuaugaaauuugugaauucuuuuccuuucucaaggaacgacuacacuuacauauacuccaguuaauuguauguucuaguuauguagauccuagagagaaggucuaguguggugauuaauggugacuuuccagagcucagccacguggguuucauucucagugcugccaccugccagcuccaaugugacuaugaacaugucacuuaggcugcugugacuugguuuccucaucuuuaacaugggauggaaauauuaaccaccucaggggauggugugaacagccaaugauguaaauaacacacuuggaacagcacaugauaagaguuaaauacugugccuauuuacuguuuuuaacuacagcuuaaauguauacuuaugacauuucuuuucuuuuuauugcuauuagguuuugaaaaugguauaaaaauaucauuuguuuuucacagguaauguuuuucuuggggcuuauuauuuuagaaaaaaaaaaaauauauauauauauauaaagagcuauccuuuacugggcgcuaugccuaguaaguucccaacugcugacuauaggcucagagcccugcagagaugggauguaaacaagcauaaaacaguguuuucagugaagugcauauuaacaauaaugggcugaacaaagaauguucauugguggaguuugggagggacagacugaagaauaaucuguugaagagguaacagguaaacugggacaugaugaaugaauagaaaucuacaaagaagguagcaaacaggacacuguagaaacagggaauggcacccguagcagaugaagagugauaugguuuggcuguguccucacucaaaucucaucuugaauuguaauccucauaauccccaugugucuagagaaagaccuggugggacggaauuggaucaugggagugguuuccccaugcuguucucgugacagugagggaguucucaggagaucugacaguuuuauaaggggcuguucccacucugcuccucgcucuucucuuuccugccgccuuaugaagaaggauguguuugcuuccccuucugccaugauuguaaguuuccugaggccuccucagccaugcagaacugugagucaauuaaaccucuuuccuuuauaaacuacccagucuugguuauaucuuuauagcagugugaaaauggacucauacaaagagugcuacaggaauugccaauucucaguaugguggaggaggggguggacugcaggaagggagcugacuagcuguagcucugcucuuuuaugaagggcuuuguuucacaggcugaggagucuggaccaucaucuagaugcagagccuaguagaaaagccugaagcagaagaguggcaagguuaguuguauugcaacaaacaugagcuagcagaagcauggaggacagauagguggaggagcgacaguugggaugugaaggcggugcucgugaagccuacugagaacuuggauaaaauaacagcacagaacuggugacuggggaugaagggagugaguaagaggaggaaucugaugcuuugaguuggagaauaguuacuaaugguaacagaggauacaggaggaauuaagaaauggagcuaauggguucagcuuugaucaugguagacuugagauucuguaagaccccgcuggagaggcauacagcagacagcugaaaacaaagaacaaaaaaaucugagccacuaauacacaggcacugcuuuucuauuuccauuaaauaaacagugcugcacuuuguuguuuuuuaaacuaaagagcugccauuccugaaagaccacagauaauagaccagaugcccacucacuuucugcauggauaauaugucccacugugauaccauuauuuaaguagaaacaaaaucuagccuuaugaagucuaauuauaccauuccuccuccuuccuuccccucucucucccugcaagcauaauucaagacugcuuucccauucagagaucuaugugagaauuuuaaaacauuguugcugauuagucucucuaaucaauaaaagaaaucuacuaucggccaggcacgguggcucaggccuguaaucccagcacucugggaggcugaggcgggcggaucuugaggacaggagaucgagaccauccuggcuaacacagugaaaccccaucucuacuaaaacacaaaaaauagcugggcaugguggcgggcgccuauagucccaguuacuugggaggcugaggcaggagaauggcgugaaccugggaggcagagccugcagugagccaagaucaugccacugcacuccagccugggcgacagagcaagacuucucaaaaaaaaaaagaaaaagaaaaagaaaaaaagaaaagaaaaagaaaucuauuaucgauuagauuugauaaaucuauuauugacuagagagaccaaucaggaacaaugucuaaaauuguguaugaaaagccauucacucaucaaaugcuaguggcugcuaagugucuggcauucugcuggauccgaggcuccaaaagggaaaaagauaagcucccuguacucagagagauuacauucuauggggggagagaacgacaacgaaccaauaaaauacuaaaaugugauucauuucagaauggaaguaaauaggcugcuaggauugagaauaaugaagaagggguguuuucuucagaaaagaaugaucagggccaggcaugguggcucaugccuguaauucuagcacucugggagacggaggugggaggacugcuugaguucaggaguuugagacaagccugggcaacaaagugagaucuugucuccacuaaaaauuaaaaaaaaauuagccaggugcagccuguagucccagcuacucaggaggaucuccagagccagggaggucaaggcuacagugagccaugaucaugccacugcacuccagccuaggugacagagcaggaccuugucuccaaaaaacagaaugaucaagggaauucauucuggaaagauggcaacaaaacugaggcugaaggugggaccuuggaacauccauuauagacaaugagaucugucagcccggggguuagcaagcuggggauauugacuugugugacacugagcaggggagagucgggggaaagagaggcauggggugauacugcggagguagggaggagcugggucaaauacacuaauaccuguaaggaauguaggaggucaaaccugacaccaacuacguguuuguuaguuguuacccguuaucaauuauccucagcauauccaaauaaggcuucauuguuuucucucugugcacuugguuuuuaagcguauugguaagccacgaacacaacuuaaauuuggggguuccaggaucugcuuuauguaaauaaacacucuacauccuggcugcuguacagagaauggcuuggugugggagaagaaagcagcgcaugugucagggagagagaacgagagcagagauuagcaggauacggaaauaacuccagcaagaaacaaugggaguuuagauuagugcuggaaaagauggagauaaguggauaaauccagaauucauaggaugugcagaagagacgaugaugaguucuagguucucagcaauaaucccuaggagagggcauaggaccauuacugagauagaauagcuuugagagaaccacauugaggacuggguagcaggggaauuaagaacucucauuuggacauguuaggauucauaugccuaugaaauaacuagguagagucuggccuagagaaauaaaccuuggccuagucuacuuacaaaugguauuuaaagucaagggcauggauuacagcaaucaggaagagcgagccagaaagaaaaauaguauaauaauuguaaagagauagccagugucaggaauuuaauggaugaaaugucaaaacaaaacaaaaucagccaagacaggauaauuaaaaccacaaaggcuagggugggggugggggguagaacuggggggugggcacuccuaaagccugcauaaacaauguguaggaaagacaggcuggaaaugacagugacacacagguuacuagacaaagggcuucugagaaauggcaaagguaaccaauucuaagaacuuacuaaucuuaaggugauuuauagauaaaagucccauccuauaaaugucuggauucuugagcccagagauauucugggucugucuguacugguauucugcugggcagguaaagggguuaugaagagaaguacuaucuuacuugccugucaacuaauacugaugacagagcaaaagcgucaugcacuuuacagucguggucauagccaaagauugcagauguccuagacacaguauuugagacagagaauggaacauacauagccaaguuacuaauauacauguuggguaagaagauucccaaauggaaggaagguaaaaaagcucuguucuaguacaaccauuugaggauaguauggagauuccucaaaaaacuaaaaauagagcuaccauacgauccagcaaucccacuacugggcauuuaucuaaaggaagagaaaucaguauauuaaaagagguaucugcacucccauauuuacugcagcacuacucacaauagccaagauauggaauaaccuagauguccaaagagacuaauggaugaagaaaaugugauguguguguguguguguauguguguguguccgugcgugcaugcacguauaaugaaauacuauuaagccauacaaaagaauaaaauccugucauuugaagcaacauggauggaacuggaggacauauguuaagugaaauaagccaaaaacagaaaguuaaacaccacaugcucucauaugcagaagcuagaaaauguugauuucauagacguaaagaguagaacagaggaugauggaggcugggaaggguagguagaaacugaggauagagaaagauuuguuaaaggauaccaaauuacagcuagauaagaggaauaaguucuagugcucuacagcacuguaggaugacuacaguuaacaguaauauaugacauaaucucaaacagcuagaagcaggauauugaauuuucccaacacaaagaaaugauacaugccugagaugaauaugcugaucagucugaucugaucacuguguacccuguaaauguguacaauuauuacaugucaauuuuuaaaaauaaaaauuuuuaaaaagguaccuuuuaaugaacggucuaugcuuaaaauguugcuagguguguuucaacaccaaugaguuauaucugagguuggaccauaacuagacgaggcacuuagagaugcgguaacuguggucucagcauccuguuccacugcacuuaguuccaccaucauuguauuacaguaaaugcaauauugcuauccugugacuaccuuguaaacauauuuucauaaaaccaaagugcuucauuaccacuucugauauguguaugaguccuuggcuccaauuuuccaauaauaguagcuauacaauuauguugaaaaccauuugaggcuaaccauuaacauucaaaugacguacaaugggaaacgaaugaauaguauauucuaggagauaaaagaucaaaccuuugauauaucuucucuuacuuauuaguaguuagaguuuaagauacaauauuucuucuaaaaccauuucaaaaauauaauuuaaauauaaaauugaagauccuaaaaaaguauagaaguuuuaaaguagaaugacuuugcuauuugaauaccuauuuaaauuucuauuuaaaauguccaaaacagcccaaaucaauucuaccuucauuuuuauagcaguuuucuaaucaugagacaucauacuuucuaguccuuuuugcuucccuaaaauaaaaaaacuccuacauauuuaaauucauaaauaagaauuaucauuacuugauuacuaccaaaacuaauuuuaauaauguucucaaccuuaucuaggauagaagugcuuaaggagccauuacguauuauuauugauuaugauuacaagaccuacaauaauuuuaaaauaacuaauuaaaaagggaacauguuauaauagccaugauuaucaaaccagaggugggagaugagucauugagccccaaggagagucuuuguauucgacagugugagaugauggguagagaagugauuugacuaagaaaaaaaucaccccagcuggcgcggugucucacgccuguaaucccagcacuuugggagcccgaggcaggcggaucaccugaggucaggaguucgagaccagucuggccaacguggugauacccugucucuacuaaaaauguaaaaacuagcugggcgugguggcaggcacccguaaucccagcuacuugggaggcugagguaggagaauugcuugaacucaggagacggagguugcagugagccgagauugugccacugcacuccagucugggcgacagagucuuaaacaaacaaacaaacaaaaaaaacaucccaugcugcuggccugcucccccaacaauuccaaucuacgcauuuuaaacaaguccacuguaaacuuuaccggcuugauaugcauuuacaccaauuagucguuuuggaagcaaauaccgugauacagauuauugcaauuuuccccauguuugagguaaagaaauaggcucaaaaagauuauauaugaggguaaagcacauuuuaaaccuuugaagauauuuuugaagcaaagauuaucuuauuuacuuacaagucuuuucuuuccuugacuacuuggaugcgucuauuacaccugguuucuguuuccacccaaugucuuuuuaggcagguuaguucuaucaucaugaaaucacuguaagugcaauacugcccuuuccuucaugaugucauucaucucuuucccaguuuguuaucuaacacguauuaacauuuuaguauccaacuacauuaaucucaugacuacuagcauugaaagaacugauaaaaagauaaaagcaaacccuuacugccugguuugacaauaaguaacagcucuucacaaaggcuggcaauuaggucacuaagcaaaaaaucuuggaagaccaaauucgaccaacagcaaacaguggucucaaauguaaaagaaaacuuagguuauaugcuacgcuuacaauagcaaauuauguauacugcuugaauuacuauugaucuaaauaaaauggugcuaugcuauaaagauuauuuucaaauaauuucuaauaucaaacuauacuuuugaauacccuuggcaaaucuuuuccagaauuacacauuccuaaaacaaugagccaauccacaggcacguguggccuacuauaugcucaacauucacuucucuuuaaaacaauuuacaugacaaaacaaaguacaacagugaacauucaucaguugcaccuucaaaugucugacaacacaaucagaugaucuguguguccuuuacuuauuaaauugauaacaaauagaaaauaaaauguagaucugaaggaagcacuuaauuuuuuuaauuugcucaauugcaaaaaauuuauuuauauaaauauauaaaaugaauugcuauauuaaaagaauaauacaaauuaaaauacuauaaauaauaacuugacugccuuacaaaaucaauuugagcuacuguauuuacagauugaguaauccuuauccaaacugccugggaccagaaguguuucagauuucagauuuuuuucaaauuuugggauauuuccauacauauaagauauguuggagaugggacccaaguauaaacauaaaauucauuuauguuucaaaaauaccuuauacacacagccugaaggcaauuuuauacaacauuuuaaauaauuuuuguuucagaaaggaaguuuguauacauugaacacauaaagucacauaauuuucuacguuugcugucaugucagugcucaaaacauuuuggauuuuagggcauuucagauuuuggauuagggaugcucaaccuguauuuuaugguaauaaaccgcauuucuuuaaaaauauuguacauucuuggcugggcaugguagcuuaugccuguaaucccagcacuuugggaggccgaggccaguggaucacuugaggucaggaauucgagaccagccugaccaacauggugaaaccucgucucuacuaaaaauacaaaaauuagccaggcauggugguuggcaccuguaaucccagcgacucgggaggcuaaggcaggagaaucgcuugaaccugggaggcagagguugcagugagcccaaaucacaccacugcacuccagccugggcaacagagugagacuccgucuccauuaaaaaaaaaaaaaaaaagcugaguguggaagcaggcaccuguaauccucgggagacugaggcaggaguaccacuugaacuugggaggggagguugcagugagcugagauugcaccauugcacugcagccugggugacagagcgagacucuaucucaaaacaaacaaacaaacaaacaaacaaacaguacauucuagaguuuaagcuaaugaagacuguucucccaguaucucacuccauacaaaaauauauauuaaaaauucaggugaucauggcuuuggcuaaguggcauuagucuaccaccuacaauuuuacauugaaacacuggggauacugcaaauguuaccuaguaaacuaaaaguguuacuuuguaaacagggagggcaaaaaaggaagcuaguuagcucccacuugggacagauuuuguucacucucuaccucuacucaaaggaaauaguuugaacaucucuaaauuauuuucguaauaauugccuuccuuccaaaacaaacauggacuuauaauuuugcugaguuccuugugguaaguuacugguacuaguuuaagccacauggcucccaaguaaagccaacaguuuuuggcuugauaugcuaauauguagauuuugaggccacaguaaaauuaauuaacuaauuaaaggguuauuuuuccaugucacaauggagaguccuaucuaaauuagggguuuuacacugaagauacaaauauccagaugguuucaacaagaaauuaauguuucgguguacuauugccagagaccaguuaaaaucauaagaaucuguauuuucuuccucuuuuccuacuauuuuuaagccagggaauuuguacaguuuaauuaaaagauacuggagggaagaaaagaguccaugcaucaguagcuuaggauccuuagcacugaauaauccaacccuccaaauaacucuuacaaaugaauccuacaguauuucucauucagcaauauccuguuacuggggcaaccugugccauuaggucucaguaagcagcacagucucauugccagauguagcucagacagcagcaacucaagcccugcacuacagaggcaucuccucuuccagccaucaccugcuuggaaacaaaaacagaccccacugguuuggccacacaucuguaaucugcuuaaggcuauaaaaguguuuugcuuuucuuuuugacauacauguaguccaaguuuauucaauacaggaaucgagcauuucuaaauaaggaccucaaaacuggcagccaguucccucaaaagaaaaugcaaguuucugcuauucuccuauucgucauuuucaaaugaguucuccuauuucaguauagacagucagaaagccucacacaguccuggaagcugccaacccagcauuaugacagcugcuucucaaagccaugagccauuucauuaaauccacucuuacuugacucauccacuggcaaagauuuaaagcuuuaauuuaucuuuuguaugauucacuuugcggcccucuaaaguuguuagguuuuuuuuccuugagcauuuaauaucauuucucaaaaugcaaugcagaaaggcagcugaaagauuauauauucaaaaacuuguaacuccagagauacaaauaaaaagauauauagucaaauacagccucucuuucucucucaccuaauuuuaaagacaaaguacugaauagacauaaauucucaugacagccugagcucaucagguaaggcuaugaauguuucaacaucacuagcuaaguggaagaccggcaugugcauaauuuauuacaugauugaaugacaaguuuucacuaacuacaaaucauguauuugugaaaugcaccaucuauaauaccaucugguuauuauuuucugagaaaaguucucagagcacaaugaccauaauuaaauuugcuuuugacuagauguagcacugugccaccuacaaauugagccugugcaagcguuuuaugaugacugcauugauuauuguuaucaagauuucaccccuuggucuggcgugguggcucaugccuguaaucucaacacuuugggaggcccaggcaggaggaucacuugaggccaggaguuugaaaacagucugggcaacauagugagaccccugucucuacaaaaaaaauaaauaaaucaaaauaaauuaggcaggcaugguggcaauguguuuguagucuuagccauuugggaggcugaggcaggaggaucacuugagcccaggaguucaagguuacacugaucuaugguugcaauacugcacuccagcaugugugacagcaagaaccugucuccuaaaaaaaaaaaucacuuuaauauaguaucuggaacauaucaaaugcucaagagguuuagugcccuucauuacacuggaggaaaaaggugacauuuuguaccucugcaugcucagauacaguuuguuuuugaguuggaaauauuucauacuucaucuuuucuuauucuuacaauuuuccuuuauuuauaauguagccaucccucuucugcccauggaaauaaugaaacaugggacccaucaugcuauguuauuagacuccugaugcaauuuuacuuaauuacugcaugucuagaaugauauuccuuaguuuuucuuuucuuuucuuuucuuuuuuuuuugagacagagucuugcucuguugcccaggcugaagugcaguggugcgaucucagcucacugcaaccuccaccuccuggguucaagcgauucucuggcagucuccccaguagcugggauuacaggcacaugccaccaugccuggcuauuuuguauuuuuaguagagaggggguuuuuccauguuggccaggcuggucuugaacuccugacaucaagagaucugccagccucggccucccaaagugcugggauuacaggcaugagccaccaugccuggccuaguuuuucuuuuuuaaagaccaguuaguuuuggugacacuauuaaccuuaaguuaacaugaugacguagguguauguguuugaugugaaugccaaugugauucaacucaaauacuuguugagcaccuaacuaccuaacuuauagaaaauuaugccaaguauuuuccugcaucagguuguacaggccucauaauaaauguaaauucuugguaaguaggauaggcuguuaaccuuuagaauaccaucaggucuuggacacaauuuuaccuuugaguucugagcacuucuaacuacuugugggcugauauucucacuuuauccauucauagagaaaaagaaauuuaaucgacuaaaacucauucuagcuuguacuuaaccaugagucugagauaugguaugaaccucgaucuuuuuccuauauuguguuccuauguuacaaaauauuuaucauccgaagaauuauuucaucauuagccaucaacuauuuaaaaacugugcuaaagaagacaaaauaauaugagcaugaaagaaugauauaauugccuagaaaggugaugcaauagggaaauuaucacauuuuuauugcuguguucccaaaguacugcaucaucuuucaagaugguuuaaaaaaagucugcauagucccagcuacuugggauguugaggcaugaggaucacuugagcccaggaguuugcagcuguaaugcaccauacucacaccagugaauagccacugcgcucaagucugggcaacagagugaggucccaucucuuuaaaaagcaugauaaaaagaagucuggagacucacugaauauagucaaaaaucaucuuccacauauuggcaaauaggaacaacugacagaaggaggcauuuuaccaauuagauaaaccagaagaagaaugaaauugaucacguaaguaaaaccuuaggcuaugagccuucacaugauauccuagaugaauuuucucaagcucaagaauugacaagugagcaauguauuucuuucuuucuuucuuucuuuuuugagguggaguuucgcucuuauugcccaggcuggagugugauggugcaaucuuggcucacugcaaccucugccucccugguucaauugauucuccugccucagccucccgaguagcugggauuacaggcaugcgccaccacgccuagcuaauuuuguauuuuuaguagggaugggcuuucuccauguuggucaggcuggucucgaacucccaaccucaggcgaucggcccaccucggccucccaaagugcugggauuacaggcgugagcuacugcgcccggcugagcaauguauuucuaagaauaaaaaggaaauaugguauucucauccacuuagucauucaacaggaaggauaucaucacucaauauuaugugacaaaaacauuaaccaucauugcuaaaaugaugugacaguauuccuugccauuuuaugaugcuuaugcaacacauuuuaugucugugcaacacauuuauuugauaccauuaggaaguggacaaaugcccaaggcaggaaucucucuaaggugauuagaagagauaaugcagaaaaaaagggggaaaaaaagacuggcuugaucauuuuaauagcuguuuacaaauccaaacuugaaaacauuuuauuccugagggaagauggcuauauucucucuucaauaaaauuaugagcugucaauguuuuaaauaucuuaaauuuuuacaauaauuaaaugaaauugcaaguauaaaaaaaaaagaccaagaaauaugaugaaccuaauagagauguauuugaaauguagaaccaguauuuguaagacggauauauuucagguucgugcauggcaggugauuagcagcuagcugcauuccaaaggauaaugcucauuucagaaauccauaccuucaaaacugggaaaauacagaauaaacauguggguuuaccauauuuaaauucuucguaaaauuaaaauauuuacuauguuaacucuuauuaaaauugcuaauaguuauuucucacuauuccuuuauucuuaguucuguaaauuguuuaccaaauaaucuaaaaauaugaaacaauaauaauauaaacggcccacuguaucuagauagucaauggugcuggccugguuuucugguguaguuagagggcaaggugacgucuugccauaugugacacuccagcaaucaccagaacugaugaaguuuaaacuggguucaauacggaauuguauauuccaaugcacgcacaccugcauacauggccauacgcacccacacaagccaccccgagcuguauuaguucauuugcauguugccgauaaaggcauaccugagacuggguaauuuacagaagaaagagguuuaacuggacuuacaguuccacauggcuggggaagccucacaaucacgguggaaggcaaggaggagcaagucaugucuuacauguauggcagcaggcaaagagagagaacuugugcaggggaaccccucuuuuuaaaaccaucagaucucgugagacuuauucacuucacaggaacagcaugggaaagacuugcccccaugauucaauugccucccaccgagucccuuccacaacacaugggaauucaagaagagaucugggugggaaaaaagccaaaacauaucacugccccccaaaccagagaguaacauuaacuaaccuggccaacauggugaaacccugucucuacuaaaaauacaaaaauuagcugggugugguggugaacaccuguaaucccaauuacucgggaagcugagucaggagaaucguuugaacccaggaggcagagguugcagugagccaagaucacaccacuguacuccagccugggcaacaagagcaaaaacuucaucuuaaaaaaaaaagaaaaagaaaaagaaaaaaaaaaacucuuccaaguuauacagucuuaaugaaaauaagacacggucaaaaggaaucacuccuccagaucuuaagcagcucuuuaaaaaaaaaauguucaaagaaauagaaaaaaaaaaucaucuaauuauccagaaagauacaucaaguuaccucucagcacacgcucaccagugucugcaaaccuaaaccuaaaagaauacaucgauaauuaaagauuguuucuuaaaaaaaaugugaguaccuccucugcaagaggaaaagugugacucuacaacaauuagagggucuucuaacauuucauuugcuuuacgaauucagcaacccccauggaccacuggguucaaucagauucugcaguuccaggugaggagcagcucugccuccagggcuaggcugccuaccuggcuagucuuacaaguuagcuuuccaaaugaauuuucccauggaaaaaaaucuuacccacgauggcuggagucuguguauuauuaacauuauguacguaauuauuauuauuaacauuaugcuacauaauguuaguaacagucuggauuaugcuacauuacagacugcauaaauagguauuuugaggugaucugagaauaugaccauuacaacacuggagaaaaauauacucgguaauuuacacauaaauuucugaaacacuaccuguuuugccuauguuaaagauuuaccucuuuuucauaccucuuuuucaaugaggucauaaaacagagcucauccuacaaggaauguuucucuaaaugccccauuagcgauagaaaaacacucaucuucuaucaaaacaagccucauuaacuaccaaacaacaaaauacugugaaucaaauauuguuuccaggaaaaugguagcucguuucuccuucuucaagaauugucacguagcauccccugaagauguuuuaagucagguacguuaaacuucuauucugauuuuacauuucaagugucaaaaggagggcugguuccuggaacaaggaggcugccaguuggcaggagcccaccuuguguguggaucagugaugcaacaccuuucugguuuuguccacaugaaagaagcccugcccgccugcagggcuacaggaaaagaaguuaaaaaauaaaauggugcaagugaccugauauacuaauuauacugaauccaaaccaauuuuuuuaaauuuuaaaaacaagaauaguuaaaaacaauaauaaaaauucaguggcucagccuuagaaaacauuacuagguuauacaaaccgucugucuuaauggaaaaauaaagagugauaagaaauuucaagucauccaggaacuacacuguccaaauauaguagucaccagccacauguaacuaucaaacacaguguguggcuaguaugaauugagacgugcuguuaaauguuaaaagaaguguuaagacuucuuacgaaagaaagaaacauaaaaaaagaaugugaacuaucuuauuaaauuuuucauauuggucacaugauauuucagauauacuggauuaaauaaaauguuguuaaaauuaaauucaccuguuucuuuuuacuauuuuuaaacugucuauuagaaaaugaaaaaguaaggccaggcacgguggcucaagccuguaaucccagcacuuugggaggcugagguugguggaugacgaggucaggaguucgagaucagcccggccaacauggugaaaccccaccucuacuaaaaguacaaaaaaaaaaaaauuagcugggcaugcuggcacaugucuguaaucccagcuacuuaggaggcugaggcaggagaaucgcuugaacccgggagguggagguugcagugagccgagaucacgccacugcacuccagccugggugacagagcgagacuccaucuuaaaaaaagaaaacgaaaaaguauguggcucacauuacauuuguauuagacaguucuuugcuaaaagaugggaggcucuauaacagggccuauagaaaaaaaaaggcaaaaaaauuucauaauguuuuaagaaaguuuaugaauuuguguugguccgcauucaaagucguccugggcagugggcuggauaagcuuucuacaauauccaaucguggaccaugaaguccuuaccaaaagcuaugaaaaaaaauuuaaaauauacaauuuacuuugucuaauauuuauugaggaccuaugugcaagacauaccagacacauaaacuauaguuuggauucuaacagauaaaaagagauaugacuacaauuaauuggaagauaaguuauggucuuauaagaaaaagguaaagcaaggguaguauagcagagcaaggcaccuguaaagacuuguaaaggcugcaucuuuucaggugaacauuuauaaauauauagauuuugacgggucauaagaaguggcacuuuagaguugacaaauaucuuuaucauacauuaaccccauuugacaaaaaaaggaaaaauauuucagauggggcagaacggugggaaugaaagccuagagaaagaaaaggucaaugguuuuaggaugccaggagagucacauacauguauaaggcugaaaaugcaggcugaagccauguaagagacuucugaaugcccugcaagagaauuuggacuuuucuacagguagaauaaaccaucaaauauuuccuaccaacugucaacaggauuaaaaacacauaguagaaagauaguaacacaugggaaagaauuaucugggaggaggguggaugaagccugggggugugggggagagggagacugaaaaugcaagaaagggagaggagaugauugagaguccagcagaacauaaucauaaaagggaagacaggaaacaaagggauagaagaagguacaagaguugcugaaguacaggagaaaauucaaugguuuauucaacaaacacguacugggcaccuaccaaaugucagguaccauguugcagaaauucacaauggaugacgguggaggggucaucuguagagcaugagagagaguuacgcugggaaccaaggagaaugaaguugggcuggaucaacugcuauggggaagaugauaggucaucaagacagagauaauuaggugcaucuaguaacauuaagaucccagcugauguuacagcaugaauaagaaauggaauuaagugguaagguuacaugacuugauacuuuagaaaucccagaagcaacuaaagaaagaaauuaauuuuuccuagcuauggagaauugacaaaaauauguuuagaaaaugugaaggguuucagccaagucaaggauguucaauggaauagguaagaaugguuauccauugauuccauccugauuagaaaggcaggcagggaaaaagaggauaauggacuaaaagccugaacuggggaggugauuaugagggaagaucaugaucagagaggaauaucaaagcuauaaaccuuaugguacuauuucuaaggaauuucagagucuaaagcaugacuguguucagguacugaaaugggauguaaaugaagguaacuaggaaggagcuggcuagcauuucaacugaauaucaaccuggauagugacaucaucacugaagacuguaauugguggggguaaccauaugacccaguuugccuggauccuucaguuuaugacuguggucccaguguucuagcugauauagacaauaaacucuaugggggcccuaguagcagauuacaccagaaauuaaaagaaaaaaaaacaagcauccuguaguuugccgauuauaaacuuacaacuccuauugaaugugcuguuuggaaaucuguagcucuagggaacaucuaagagaauacugaaggaauaagauaagugauacaaucaucacccuucgggggaugagacagcauaaaaucaaugccugaaccagauggcauuuccaacccaaagauucucauuuuauaauuuuaugauuugaauauagauguuugccuucaguuaagaaugagaaucagguaagaaguaacgggacuaagcucccuaagaaaaagaggcgaaaauagguuucuuuacaaucaacaaaucaaagguaguuaaaaaaaauuaacaagcauuuauuaaugccuuugacuuccacuaugaaggaaaagaaaugauaaaaggccaaaaaaaaacccuuacacauccacacagagaacgcccaaaaucucaaaccaaaccuuuaacgaaaauucaccuuaaacuaaugacugacaaucccagagagcauuuaaaaauauuuuuaaauuaaugaccaaaacagaacgccauuauuauuucaacucccuguuagaacuaccaguaaccuaugauaguuaucagugggauuuugaucccaaguuuaauauuaaauaguuaaaauuaacucugugaugggugacugauauuauuaauucaacaggaugccauaaaaauucauaguucagauuuuugcauaacagcagacucugaugggagugggcagagaccuuuucagugauaaacagaaagauuaauuuacaggauacaaauacuccauacaagauguuucagcaucucugaggcugaacacaaaggccaccuuaccucccaucugcauagucugugucugcuccgccccaccagacauccgagucauccuccuccgcaucagcagaauccacauugucacuuucuucagccagugggcaacacacaaacucuaccccucggaacuugucaauuccgcagggcagcaacaugccguagucaugcaaguugguacucuucucacugcaugucuacaaaguguaaggagaaaacagugagugguagaguagauguguuucauuguaagaaaacuccacauaaaauaaucaacaugcagacccaauauauuaggaaccaauuucacaaaggaaaagauuauuugcuuuuugagugaauuuacaacaggauuuuuuuuagcauggguuacacuuugguacucuuuuuauucuuguuuauuauuuauuuaauaagaccacgauguuauauaauagagguuuauacgaacaacuggaauggaaacuaauugggaaauaagauguagcagucuccacuggugaacagauaccagagaauuaaugccuucuggcuuaauucguguauccagaaauugugcgcauuccagguagauccccagcucacuccuaccucccuuacagauggaaguuuaucucacauggaccugccuuauccuagaaauucugacucucuugguucacuuucagaguaacaauccugggaagagaagaaauuauccccugcagccacuaagaaucagaacuuacagucauuagagauuucuccuugaaugucuuuuugcuuuucugggauuugcuaaauuugcacaaaucuagauuagcauaaaguucugagagcauccacuagugauaaaugaaggaugaauaauucaagacauaaagguagacaaugaaaauauuacagacuguauuuugaccuuaugggagucauuuccguuucuuagagacaaaggauuuuucuuuugaaaacacagaaggaauaaaaaaugagguuaucaaauagguagcuggacuucaaauuauuugguuuguuuucuuaaacucagcaagcucuuaaaccuccaaaacacauuuuuacauaaaaaacauuuuauucuacaguggauccaaauauacuauuuuauaagaggcauaaaauaauacuaaaucuucagugguauuuucugucuaacagcuauaaagcuaugauacaaugguuaagcuaagcuagaucagauuucucaaccccagcacuauugauguuuuggacugccuaauucuuggggguggcgggugguuauccuguugacuguaggauguuuagcagaaucucuggccucugggcacuaucagaugccaguaacaccacucccucaagcuguaauaacaaaaaaugucuccagacauguuccggugagggacaggggaucaaaauugacucaagugaagcacuaugagcuagauaaaggagccuaauucuaguuagccuaagacugaucuugccacaaauaaaccuauauaaauuuauuaggaaaccuaucaaggggacacagcagcugugaagguggucuuaccacacagugaccuuuucaugcuaaguaucuuacaucuuuuauuggcuuagccaaaagcagagguuaaccaagugcucggucagacucacccuguggaaaaaucaagaugguaggcauggccugcugaauauaaaacuggaugguauaacugagaaacugaauucuaacuggagcuuucaggcugguauaaaaaagcuacuucacuguucuaccacuguauucacuaauagauaacaggggaaaaggcuaaauuauuaaaaaauuguauaugacaaaagaaaacaacaggugcauaaaaauaaucugaaggguaaacuuuaaaguuauaacuauuagagauuauauuuuuaaguuauaaggcauggcacagacaacuuauauuuuuaaguugcgaaacacggcacaggcacauaaugaaucuaguucaacuggcccuauuuuugacuuuuuaaaaauauucauggauggggaggcugcgcauguguggggacaggggguacacgggaacucuauuuucuguucgauuuugcugugaaccuaaaaucacucuaaaaacuaaaaucuggguuacggauaguagcacuggguuuuuuucuuaaauaacuuaucaacauagcuguugccucaaaauaccccuaaaaugccauuaagcacguccccaggaaaucuucacuuugcaauaagaaagaauuuaugggcugguaccucuuuggcgacggugugccagugaagaugaguuucgcaaacauccauccucuccugguguaagaauuugcacuugucaggaacgagaagggcaucacuuacaaacucaccaacugaaagaaaggaaaaccacuucccgucauuccaucuguaucacaguguucuuaccgcagaagacaucaaggaaagauagacuucaagacaaguuaaacagccuuuuaaugccuaagcaacccaaucaagacccuacuaccuuuagaauguuacgucuggccuccuuaagcaacuccguuucuugccacuucaaguuugaugguuaaaauaaugccuaaaugcugcaagugaaauugucccuuaauuaaucugaauuucuugcuucaaaauuaauccuaaaaaagcugcuuaacuagagaaccaauuaccauucuacuacaacaggggaguaaaauauaaauauugacauugucuagguaagcauuugagcagaaucaauauaaaucccuacuuuucuuucuuggacauuuuaaucugcuuguaaguaacagaaauuuuagcauuuuucuacuuccuaagcaaaaaacccaaaaguguauuuuauauauauguuuacauaacacacauaagagagagagaguuuaauucaguuuauucugaaaacugucccucagacuuuuguuaaaucuuuaaagaaaauguauauuaugcaaauuauuucuaggcauuucugguauugaagauauaaagauauuacauaaaguccuacaugaacucagucuaaugaagguaaaagauggauaauuaccacauuauauguaagcuguaaacuuaauuuuuguuuacugcaauauucccagcuuuuagcacagauucuugcacauaguaggcaauaaauaucuguuaaugaaugaacaaguuaaauucuguaauagagauaaggaaagugucaggccaguaucuugggugcagugggaaaaaccucaaagaagaaacaauauucgagaugaaucugaauggugagaaguaguaugccacaugggaaaugaauugaacuuccauaacguaaggauagacucugucuugcuugccauuauacccccacaauuccuggccuaguucugucaaacaucaagaacucuauuauagaauccaaauggauggauggauggguagcaaaagacccuucaaaaugagggagccuccugugcaaagacagaguaaagaaccagcaaggcauauuugcagcccaucuggauauggguggaagcagaaagcaaguggcaaagggaguccagaaggaaguagcacuggggaagcaugcuggacuccaauuuuaaagaggcuuagguuuuggaugccauuuuggaagaagcaacauaggccaaaaguuuuuuuuuuuuuuuuuuuuuuuuuaagauagacucuauaauuaagugaaggauagaucagcauagugaaaccaugaaagcagggagaccaccaaguaggucacugugguccuucaggcaaaacaugcaagaauagacauaaacccacaacucccacggagcaaggaauacagaucguccacacagcagcaaagacaggaaugaaugucuuucuuucauaguacgcuauagggcauuuucugaaaugcaacauaaagagggauuaaaagcccuaagaaggggaaggaaguaacuuuucauucucauaaaaggguuuaaacuuuagucuguuucuagcucaaacauguaagauguagcaugauacugaaguacuuauuucaauaaguacuauuuagauaaaaaucuaagcaaaucauaggggagaauaagcacuguaucuugucauuccuuaaaucuuuaaaaugaucaaugaugcccauagcaguauaguguguguugcagggaaugcaaaaauuaugagacaugguaccccaaaggcugcaggugucacuuugcagggaagaaaccagugaguacugagcacacaccccaugcagcuccacagggccacaucacggguucuuuuauaaaccucacuucccaggggaggaaucuccgccaagaaaccuaaggcuaccuaacucaggagauuauaaccuagccccagagauaagcauuaagauauaaauuauaaggaaagaaauaacaugauaaugcaaaugauaccacauuucucuuuuacauagaaugauauaaaacaaaacaaaacaaaacaaaaacaaaaaacacaagaagaccuggagaauggaaaguaaagguaaucucauccaaaacaaauacaccauucccagguggauuucucaggguuucugagggcucucaggguuucugaggucagggacuaacccuagcugcuuggaagaauaccugauaucugaggcaucccaauuuucuagguuacaggaggccagaaguacccuauggccugaagaugcccaccucaucugucagcucugcucagucauauuugcaaauguccaaacuaagaagugaugcuuuucuauuugacaaguaacuacuggaaagauuaaaugccugucauguacaaauaggucaaagaguuuaaaaaaucuaaugcuggcccaaagcuacuaaaucaguucgugagaagagccagagcagguaucagauacacucgaccuuggccugcaagaguucuugggggcauaaaucagacaguaagugccaaaccacaaaaccaaaucaucuuguuuuaucugcccuuagucaaucugcugacgacuagauuauaaugcaaagcuaaaguuaccaaaacauauuuacuuauucaccaaaaggacauguacugcauuaaucuuuuuguuuguuuguuuucagacaaggucucacucugucacccuggcuggaauguagugguuggaucaauggcucacugcagcuucgaccuccgggggucaugcaauccucccaccucagccuccugaguagcugggacuacagcugugcaccaucaugcccagcuaauuauuucacuuuuugcagagacagggucuagauauguugcccaggcuggucucgaacuccuaggcucaagcaaucugccugccucagccucccaaagugccgggauuacagacaugagccaccacgaccagccagucugaacauuuuuaaugaggaguugguaaacaagcuuuucuuaaaagccugaauuaauuaaaaguugccuuggauauuaggaguucauuagcuaaggauguuacucuuacuuucaucuggcagaaaaucuauccaagagaaccauauucuugaacuuguguuuaggacagagguuggcaaacuacuacuuguggaccaagucugcccacccaccaccccccugcccccaacaccuguauuucugcauuagacugacuauaacaauuguucauuauguuuauaagugguuacugaacuuucuaacuugcaaaacauuucauuugauacugccaagauggucuuagcuucuuauauugcacaaagcuaagaaauaugugucccucaaaaugagaaugguuuuuuaaaggauuaaaacugguuacuuaauaagcucucaggacuaauggcaaaauagaaaccucauuguauucuaacauuaaaauaaaauuuagcaguggacagcacugcuuacauuacuuuuaaaauuugaugaaacauguuagaagguuacacaucagaaauuguaagcgauucaaccacaaaaaucuguuuuuaaaaacuuuuaauaagcguuaagagugcuaaaaguauaaugaagccuuuuucaccaacuggcuuagcacgguuuauauuuucucuuuuuaauuaaaaaauauuguacuuaaaaaucuuugcuaggacagcaguuacauggaaacuguacuuucuacucaaacuugcugugaacuuccacugcuuuguuuuuaaaaacaaaguuuauuaauuuuaaaaagccuaugaucguauauaccuggaguuucucuccacagccacguauaccuuauuuuuauaaaugcuucugcuuauuugcuuugaucuuucagguaaaaagaguucuuaacagaauucugauguaagagaucaaagacuaaaacaaauuaaacaucauaaugagaaaucauguuccuguuuacagcaaacuuuaggcaauuuggcaccauuuauuucaaguggauaaauucaucaauauacaguaugcauguuuauugagaaacauacaaccugguuucuugcuaaaacaauucacaauuuauauucaaaacgcaugucacacaccacacacacacacacacacacacacacccaacugaaaggguguuuucaaagcuaaugaacaaaaucugggucuggcuucuuggcuaugaagucuuggcaaggugaacaaggauggcaaauucaauaggagucugcaggccucaaucugcuagcucuuugguggucuuugggaggacugucuagcucaaauuaccucauuuugcagaugggaggaaaagagcucaggucaagugacuugcccacagagccaacuggcagaagaacuagacugaaaauccaggucuccaguucuccauccaagagugguaacucaacucacucauuuaaacucuguucaaaaugguucauuuggcccauuuccuuuggcuuuuacaaaaguaguucacuuuuagacugugaaguacuuuaauauuauaaucuacaauguggucaauuugacaauaaaacuagacuuaaauuagcuagcaagccauauagaacagcugggaaugcagucagcggcagagaauagaccacaugucaaaccguggcuuaaacacacgguaggauuauguaucucaccuaagaagugacacugaagcuagggccacugcagauauuccaugaugccaucagggaccagcguauuccuaucuuucuguacugccauccugagcacguugguuuuauccucguguuuuauggucacagaaauucaagacucuguguccaaguuccagacagaaggcaggagaaacaagacaaaggugaaagguuuucuguuguuguuuuuuccucuaauaaagcuuugcuguuacuugggagggacauacuccucagcaaauuccacugaggccauaugugccauuacugugaucuggucacaugcaccugcaagggaaucugugaaaguauuuucagcagagcacauugucacccugaacaaaaaaaaucuggaauucuuuuagaaaggaaaaaaugggaaugaauaucaaacaggcgaguagcagaggcucccacacuauggaauuuaaaguauauuuuucgauuucuuuauguugucuuuucaaaagacagacagaauuccaggaagcaaacagaauucagaguaaaaaguacugcaacuaaaaccacaguaacuucccaauccaugacauugggaagaaugagaagggaaagauguaucaaaacugacucugcugccaggauggcggcaccugggggugucaucccagcuacuugggaggcuguggugggaggaucacuugagcccaggaauuugaggccagccugcauaacuuagagagacccuaccucuaaaaauaaauguuuaaaauaaagacauuaggccgggcgcgguggcucacgccuguaaucccagcacuuugggaggccgaggcgggcggaucacaaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagcgagacuccgucucaaaaaaaaaaauaauaauaaagacauuaaaauaaaaaaaaaacagacugcugaaguuuugagcaucagagugggguugaguagauuaauguaaaagauucuagagccauacacagguucuucaaggcacagauuauuugaauaucagauuaaaagacaauauuucuaugaacugcuggggacuaaaaugauguuggccagaaucaugggaaugaaaggccaaaaaugccugaggucuuuggacuucugcccgaggugugcccucucuuccucaucucucaagagguaaagaugauucaagaaagugggggaaauguucuggcaauguaauuacuguaaaaugccaaagccucgguuuccuugugcuaugggcccagaucugccuugugaagauaaaacaccaguauuguuaguaacucugaacugugugccugccaccacccucaauacuucacgugcgucuucucucaccguccucagaaccacaccaaagcagcuacaaugauuucacuuuauaagagaaggcaagggccgggcacaguggcucaagucuguaaucccagcacuuugggaggccgagacggguggaucacaaggucaggaguucgagaccagucuggcuaauauggugaaaccccgucucuacuaaaaauacaaaaaaauuagccaggcgugguggugcaugccuguaaucccagcuacucaguaggcugaggcaggagaaucgcuugaaccugggagguggagguugcagugagccaagauagcaccacugcaguccagacugagcgaaagagcgagacuccgucucaaaaaaaaaaaaaaaaaaaaaaaaaaaaaaaaagagagggugagacugagagacuauguaacaguccaggucacauagagaguaaauggcagaacugggagaauuaaaugaauuaauaucccuaaaguacucaacuagugcccagaacaaaguugcucaauaaauuauauuaauaguauccuucuccccaguaucuaucucaucaaccacaguaguuucucauaauaauaaucauaguaaucaaaacagcaacagcuacucuucaucauucacuaaucaccuauuucgcaccuacugaagacacugggguuuuauauguucauugcaccaucaccaccuacuuguagccccacagagaugacaugguacuguuuuacaugugaguacugcuuaugauggggugaauacaugacagcaaucaacacagcgggguggagucccuacgacuggagaagcagagaaucugagugaucaacucuuucaacucuugcaccgagugcugguccuggcugggaggggguguuuccuaaauccccucuugcagccacuguccuuuauccacuaacucuucacugcauacuuacaauuaugucucagugcuaagaauacagcagugaacaaaacagauaaaacgauauaugauccuagcggggaagcgauaaaaaauacagauaaaaauacagugucuguuggaugguaauaaauguuacauagauaaagcagagaaaggggugguuuguuuguuuuuucugaggggugaaauuuuaaauaggguggucagggaaugccuacuugaaaauaugacauuucagugaagacuugaggaagugagggaacaaaguauucagaaucaaagggaagaauauucuagccagaggaagcaacaaguauuacacaaagucuugaggcagaugcaugccuggugaacucacagaagaacaaggagaucagugcugucguggaggaaugauguggaagagaucagugggcaagcgagugagugacagccaggacaggacagggacagcugacugcacggggccuuaaacauuguccaacucuggccaguacucagaguaaugcuggaaggcucuggggugguuuucuaagcuaauuauucuugcccuagggggucaagacuagaagugagaagaccaggaagggggcucuggcauuaauccaggugggagaugacaaugacuuggaccaggaugagagcaguagagguggugcguguucucagauucuggaugucgucugaaggucagaucuaaauaaucaaauagaaaggagucaagaaucuagcuuguuucuauuccaacagcuagaagaugcuuuauacugaagaugauggaaaagucuggacaagacuuuccuaauuuuucuguguagauguguagacagguagaacuuuugagaauuauguacuuacuaacuuguauacacuagauauguguauaugaaaaugacagcuacagauaaauguuuucuuaagugauuuuuuauuuuaccauuucagacucuuacuccacaaauuuuuuugucuugaaugugcucauuauaugcuaucuuuuguaacuuucacauuaacaaauaggcugggaaaauuuuccugggaggcaucuguacucaagagacgggacgauuacuucacagaaacagccaaacauuucucaacaaacuuuccaugugauaaaacuguuaugguuuuagcuucagagugugggcaguuacuggguucucaaagaggacaugagggugaauuacacauccuuuuaaaaaguggcuguugccgucaccagcauuucacuguaacuauuaccggauaauagugagaacugacagaugggauucuucagaugagaacuauuugccagaugguaggaacuaaauggaucaagauaagcaaaaaggcaaaagaagugaaaacuaaaaguuuuaccuaaaucaucucuccaacuuuuccaagugcacagauccagccucacauacguaccauauacacacacagauggcagagugaguauaagacagaauagugcuggccgggagugguggcucaugccuguaaucccagcacuuugggaggccgagguggaucacaaggucaggaguuugaaaccagccuggccaauauggugacacuccgucucuacuaaaaauacaaaaauuagcugagcauguuggcgcgcaccuauagucccagcuacucgggaggcugaggccgaagaaucucccgaaccagggaggcggagguugcagugagccaagaucacaccacugcacuccagcaugggugacagagcgagacucugucucaaaaaacaaacaaacaaacaaacacacacacacacacacacacacacacagaauaguguuuaacccaggcucugaauaacacuggucuuaaaauaauaaaaauagugcaaaggauuuacuuuaaaaaagagaaaagaaaaaaaaaaccacgggaacaaaauaaguauuuauggccaggcaugguggcucacaccuauaaucccagcaauuugggaggccgaggcaaguggaucaccugaggucaggaguucgagaccagccuggcuaacauggugaaaccccgucucuacuaaaaauacaaaauuagcugggcaugguggcgggugccuguaaucuuagcuacucgggaggcuggggcaggagaaucgccugagccggggaagcagagguugcagugggcugagauugugucauugcacuccagccugggugacagagggagacucugucucaaauaaauaaauaaauaaauaaauaaauaaauauuuguuagcagucuugcagcuuuuaaaaagauccauauagguguggguuaacaaauuuuuuuauauuuuuuauuuuuuauuuuuuuaagaaagagucuuacucugucucccaggcuggagugcaauggcacgaucacagcucacugcagccuugacuuccugggcucaggugauccucccaccucagcuucucggguagcugggacuacaggcacaugcuaccaugaccagcaauuuuuuuguauuuuuaguagacaugggguuaugccauguugcccaggcuggucucaaauuccugggcucaagcaauccaccugccucagccucccaaaguauugggauuacaggcaugagccacuguacccagccuggguuaacaauucugauacggcuacgcacauauacugaaacugaacaauuaaguacauagaugguggauggagugagaauuuauacauaaccaaggaggagagauauaguguccaugugguaauacguuagaguaggaaacauccggaugaacuuguauuuagcuuaauauagacuagauauuauagcuuaauauaaauacaacuaguuagcuauagaaauauuuauagaucugcauaacauaagggugaacauggacaaauacauugccuugcucuaucaacugagaagucuuaaaagcaaagaaacuccaguggcaacgagcauccuuaacauccagauuuuaauacuauucuccaauaacauuacucuccaauaaaaggaacaagggcuccuuggaggaacagcugauucuaggauuagggcugaaaauaugcaagaugagacugcagcaucuuguaagaaaaaaaaaaaagaggcuaugucaaaugagcauaggaaccaagugaaagggcuucuaauagcuaaagccggaauaauuugagcaauaaaaauuaugaaguagugcuggauuagaaaucaaaguacaauguaaauauccaugagucuaaaugacugaaugaaugaauacauaaauaggaaaaaagagacaaaucuccugcgcagaagaauuccaaauaauuuauguagauacucugcccucaagaaaaugaagcauaauucucugcuccuuaauugugggcugugcaaacugacuuccuuccaaagaguagagcacauaaagugggaagacgaguaauuuucaaguggagaaacucaacaaccaccaccugagccaggugaucaaggucaaugccaacagggcuguaucauguugauaaacacguacccuugauaugaugugaugaaaugggcauuuuaccucuguggucuuccuucuuaaaaccaauaaccccaggcaaagcaugagaaaauucccacagaggggaauccuacaaauuaucugaccaauacaaaaccuuuaagguuauuaaaaaacuagagaaguauaaagaaacugucauagccaagaggaaaggaggcuauggagaccugacaauuaaauauaaugcgccuuccuggauggcauccuggaacacagaaaggacauuagacaaaaacuaaggacaucugaauaaaguauagacuuuaguuaauaaccauguaucaaaauugguuuacugacugcaacaaauguaccauauuaauauaagauguuaacaauagggaaaacuggaugcaaagccuaugggaacucucuggacuauccucucaauuuuccuguaaauuuaaaacuguuguaaaauauaaagucuauuuuaaaaaaauuuaauggcuugauauaaaaguucacauaauaaggugucaugccaaacuccuacugacugcaauguggauggcaccagguucaagagccagaagaggcccagagcuagugaaccguaugucucauaggguuuuacugggggcuugcauacaggguagagaguccaguggugguggguuggacagaggaaccgcagccgcuugcaaaaggcauguggucucuacagcauucucauuuaacacccucccccuaacaaucuccaccuggcaacuuccacuuaacucauaacaaagggucucaauccccggcgaggcccauguuccacagaaggagaugagggcucagauguuccuuacagauaaggaauggcucucuggguuagccacuccuggauuucuuuguuguuguuuuuuuguuuuggguuuuguuguugcuguuguuugaaacagagucucauucugucgcccaggcuggagugcacuggcgugaucuuggcucacugcaaccuccaccucccggguucaagcaauucuccugccucagccuccaaaguagcugggacuacaggccugcgccaccacgcccagcugguuuuuguauuuuuaguagagacgggguuuugccacauuggccaggcuggucuuggacuuccgaccucaaaugauccaccugccucggccucccaaagugcugggauuacaggcaccggccaccccgcccggcccacucccggauuucuuaacucagaacucagaaucaggugcaccugccacacaggaucauugucagggcauguucaagucaagugaucccugucaggugcaucuaccauacauagaggcauaccuauuugauuccacaucaacauucuagccuucaaaaaaaagucuauaaaauuauuguaguugaaaagaacuagaauuaaaaagagcuuaccaacucaggcaucucaucugugguaucuauuaauaacuagacagcgcuugguuugacuuuuuuuuagaaaaaaauauaaguaauguggcauuuaaauuuuuuaaaaauucaagaauuucaaaauuaucacauauauaccgaaaauucuuugcuuuccaaauuuaaccuugucuuaggaauguaaacuaacuggucagagaauucauuccccuuuacaaaugaggaaucuugagccugaugagguuugcacaaagcuaaugacagaggugggcucaacucugaaaaccgacucucauuccaauguucaggaccccaagaaauguuacaguagucuuacuaauuuugaaugacagcuuccucauuaaccaacccaagauaaguuauaggugcuuuuuuguugccucuuuuugacugcacuauuagucauaucuugauuuuaucaauaacaggacuucuuguuacaaguauuuaauaauuccaacauucguuaaaagauggaauuguaagaguaauaguuguuaaagcuuuccagauuagggguuuucaaacucaaaccaugcuucaaaaucaccugggauccugaucagucugcagauucaucuucucccuagcuccacagccuagaucugauuuacguguucugggacgcgccugaaaacagaccuucccaggguggcucugcuucagguggcucauggaucacacuuugagaaaugauauuuggagcagggcuucucaagcuuuacagugccuaugaaucaccugggggccuuguuaaaaugcagguuuugauuggacaagucuagggugggacugagucugcuuuucuaacaagcucccaagugaugugauucagcuguuccuuccggcaguaagggucuacuuaagauaacccauuacaacuaaucucauuaagguuuuuaaaaauuuuaaguuacaaguuauugcuuuguaagacacucuuugcuuacccacuuuuaauuauacaguuuaguguuaaguagauucauaucguuguacaaccaucacuaccuuccaucuccagaacuguuuucaucuugcuaaacuaaaacccugcacaccauuaaacaacuccccauucccccaccuccacuccccauucccccaccuccacuccccauucccccaccuccagaaccuggaaaccaccauucuguuuuccaucuuuuugaauuugacucuucaaauucaaaaagguaccgcauauaaguagaaucaaguaucugucuuuuggugacuagcuugcuguguccuuuuaaaaaauaaaaauuuucaugcuucucuuccauaaaccugcaucucauccuauagauuugucacuuuuggcaccaacuuaaggacugagcgccuuuucacacaucccuaagagccaagcugcuccugguucgccuuuuguuuaauuauagaaguuacaaaauaagguagaaagaguucuagauuugaaaacaacacaaugacucaagcagaucaagugauuuccaaauauuaaaaggugauaugauaaaugccuccuggccagagaggugcacauagggugagagacaagaauaaaaauuaaaacuuaacauaauuugauaagagaucaucucugcuacugcugaguauuacuaaauaccauucuaugcagguccauguaggauacaaaagaaccgagauauaguucuggaccaaaacagcuuggagcagcuuugucucacagaaauauaauagaggccacauaucuaauuuaaaauuuccuguagccacauuaacauaaaaagguaaaaagaaacagguaaaauuaauuuuauuaauauauuuuaacccaguacauccuaaauuucaucauuucaacaugcaaucaauguaaauaauuaucauuaagacauucuacauuuguuuuuuucucccagacuaacuuuuuaauaucugguggguuuuuuauacucacagcauaguuuggacuagccagguuucaaauauucaauggccauggguggcuaguggccaccguugggcaagacagacuuagcaucagauuuuagagaucaauaauauauuucaaggaguagugacuugaauguggacagguugggguuaugggagaaaaucuaaagccaaagacacaaaccuaggcagagaaaccauaauaagcuugaauacacugagacugcaguacaccauuuuaugcgcuaugcuaucuuaacgcauacauuuuagucaaugggaggcauaucacuaggauucuauguuaccaucauuaacccuauugaucagcaaacugcucaucuccccccauuucucuuguugcaguucucauaucauaaauuguauuuauaggugugugauuaauucuaauacagaaauuaauuuaagguuuccuuuagacuugaaccuacuuuagcuuaguucaguccucuguaucccgagagaugagcugaaaaagcagauauaguagagauaauucuaaauucccuacuuuguuucuucaaaauauagguauucucacugguugcuuucuccuaacacuuuccuuucuuucugccuuauuuaaaaaaaaaaaacaaaaaacucaaagccugauagauuuuagagacgcaauuaauuaagguuauauacggggcuuuuuaaaaaccacauaauugccgacaaaauaccaaccagguugguguuccgugaggcaaaagaaccacaagucauuaccaaaaccuuaacucauaugggaagguaaaaauauacagcaugcuguuuucacauaccauacucagaaagccaugugcgagggaggcuauaaucaagacaggaagaggcauuuucacagauaacuucuuaacgggguuguagacugucacucucacgccccucacuuguucuuuccaaccuauuaccaucuggccuugcuccaacaaucugcaacucuucuuucaaggucaagaacaacaaaugccaucagucucuucucagcccuccaguucucugacuacucugccacauucucuuuuuuuuuuuuuuuuuaaagagacggggauacccucugucaaccaggcuggagugcagugcugugaucauagcucacugcagccuccugggcucagacaaccuuccugucucagccuuccaaguagccgggacuaccggcacaugccaacaugccuggcuaauuuuuuuuuuaauuauuuuuuguagagacaggggucucgccacguugcccaagcugaucucaaacuccuggccucaagcaacucuccuagcuucagccucccaauuugcugggauucuaggcaugggccacugaacuuggcccacuuuucuucuuuaaauucaaucuucuccaguuuccaccaaucuaucucaagccaaucauucuuucccucucauuggcuccucuuuucauaauucugauuauaaaguaaggcucugucuucuacucuucuugcuuucucacucagacauaucauccaugccuaagggucaacagccuccuccacucuuucaauucugaccuuucacuuagcauucccagucgcuugcugcaugcuuccaauugcaggguauuaauuacuuuuagcaaauguacuagaaucaagugcccaacugauuaucaaauuccggaaguguacccaaaggacaaugacuaauuccucauugggucaaagucuuuccuauguggaagcaagagaaaggaacagaacuaacacugaacauugugaggagcccaaaacaugacuccugcugaacacauucuauuugguuguagaacccaaccaauauaggccccguugaucgauuuccccacaacaagaggaggucauaaaaaucaugcuuccacuuucucaauagauacuuaucgcucaugaaugucugugaaucagaagaccaugggacuauaacucuacuccacucaaacucuccauacucccaaagcuggaccucaugguccucagaucauguaauacucagacacagcacuccaguaaaccacuuucuggccagaaacucauccuucccauaguuccucucccuuccauccacuacagcuuguucaucaugauccugagguccuggaugcugcagcacucucugcaguuaucaggggaggcuucacugccuucaguucauuucccugccagccuggucuaggacccucagcacacacacucaucacugcacauaucaccaacgaccacccacaugcuuuugaugcccaggcucauuugguccagccuauuucucuccuaagugugagacucaauaaauacacaaccaccccacugugcucuucaagagcuuauuaacugccucuuuuagauucuccuggguauaguccagacuuaaaaugccucacuuugggagacaauguaauuuaaccauuggaggaacaaauguuggucuauauauuucaggcauuuuccaaauaaaaaccuccaagaaaaagcaaacuuguaucuuaaaagaugcagaacuauuuagggcaaaaaguacacagagaaugagaaagaaaaaagaugucacugcauuuaacaaaagaguuaacaauauuguuaacaauaacaagaguuagccaugaaguaauuaggauauaguacuugaaacuggcaccaccuuuuaccaggcauuacaauauugcuaugaguucacaaagcucuguuagagcagaggaaaaagaaggauuugaauucugucacuguacuagcaacaccaccuagggaugaggaagacaauaucuaauagaauaacaaauaaaguaaguauacaugauucaucaagcucuucaauaaaaauguauuuuagaauuuaucaacaucccuuuugaaucauguuucaaaaaucacacaaucuguucaaacacggauagacccccagauaaaucagaaucucucucucuguuaccacgccucuguggacuuagaaaucaccacuuagauuuguaaacaaggcuuaguuucauuauuguaaaucaauuuggcaggacuuaucacuccacagagagcugaaauaauugaauuucuggacuucuaaggaagaagguuuaaguacauuaaggcuuccaaaaggaagaucaccaacucuucuuuagcagaaaaugccccuggagaauuuugaaccauuucuugaucuaguggcaacuggauguuaucaguggcaacuaagguaucugucuacaccugcugaggcucacaaguaaaaacuaaaaaguacugugaaucucugugauaauggagcguaaagcuaccacuuaagucuuuauuacuaguaaguaacggauuuuaagaaaaaaagagauacucaaaucuaucuauagauaaccaaaaaaccaaacaaaacacccagaaaaaucuaagguugaagaacauauauaauuugagacuuuugaaacaaaacacccagaaaaaucuaagguugaagaacauguauaauuugagacuucugaucagagccuuccucaauaauguaaguuuaaaaacuauuaccaaagugacaagaucccaugucagauagcagaaugagaacaaggcuacucuucaacuuagucauccucuuuuaucacuacaacuucaaucauagauguaaauggaaauuucugcuuccuuugcuacuuuucugcuugacugaauuuuauaaugaaaaacgucuguuccuuccaggcagagcacgagugucauucaaauuguacacaccaggcaaagagugaaugcauuuguuuagaugcaaaaaucauuuaaauaugugucauuauaggcugcagcacauuugcggauucggcaguuuaaaauucucuuaagcaauaaagcaaggcaucaaaugaaagugcacucaggcuucaaacaucuucagacuauguuuuccuguuugcacacagcgagccccgccuuccuuuccugaccccacucaaacagaaagcaguggaaccaugcccuagcccauccuauuaccccaaacgucuuccaggucagcaauccaaagucacgugaaagcuccaucuucaguuucccucuccagggagcaaauauuuugaagagcaagcauuccaagcaagcagaaacucagccuuuaaaucaaacuaagcuuaaaaguaagguccugccgcacacagaaggcaacagaaaagugucugaagagauagcucccauuuuauauuuaacauuuagaaaugagaaaacugugugugauuaaugcuuauaauuagaggggguuaacccuuauuucaaauaauguaguuccugucuuucauuuaaaauuauaaagaugacuaaaauguacaugaaaggaaaauuacaguuaggaucugcuguguuuuaacccagaacugugguuuuuugaagaaaaugcuggaaaagauucugauuugguaagaauaucuggauaugagaaucuucuaagaaaggugauuuaccauuuucaggccaaaggcagagaguuucuaacaaugauaaaauuaacaggcuguaggaucuucauucucuaagcuucaggugacccuuuuaaugacuaaauaaaguguguacucaaggucacccacgaggaagaaaaaggucaguucccucucuugagggacccccuccccacucacgcuauuacacagcaauucuagagauucacuucauuuuugguuuauguucaaacugucuggauauuucagggccuucgcuuuuaaguuuccauaauagggcaguugacuauuuauauaagucccuggaaaauguguauuuuuaacgucaucuagaguaggccaccuuugggggaaaacagcuaauggguuaaaaagccaacugguguaccaaguauguacaaaagacaucuuuuauaacaguucucacgugcaaaagaacauucauuaaguauaacaauaaauaacaggcaauaugugcauuuuuccagacccuaagcacuugauaaagccauauugucauuuuacacucauuuuuaguagcuguuuaauugguauuccuguauaggacaguuuuguagguuuccggauuauuucacauucucuucuuccuaguuauaaauuuugguacaacuguaagcucuccucacacuguaauaauuacauugcugagaccacaucuguuuuuuuaaaaaagauauuuugcaaaaaauauauuuaaguugaaguaucugaaauacuuuucaacgucaaacuuugagaggauuaugcuuaauuauauaucuucacaucuuuaaauuguuaaaaaugaaugcauaaauauuuccuagggauuuaugcuugauucauuugauucuuacauacuaguuguuauuuaccggcagagaaagcaaaagcaaaaaaaaagaaagcaaaaacaacaaaaauaguugauucuggugcuaguccagaaucagguugauuucugcaucaauagcaggguuucuacauuaaauucauucaaauuuaauuaguucucugcauaaaaucaagggucuaggagaauuuaauaaaagcugaaaacaauccuauccuuugccugaaacagauuuuuaucccaaaugguacucagcaauaagccaacagagaaaaauggaauaacagacauaugccauguucacgaguucucuguuuaaccuaagaagucugaauuugccauuuuuugauaaggaacugguguacaucuuagaagaaauauuccauugagucugaauucuugguggagcacccgcagaaagagaaccaguaaauaguauguaugaggccuggccuggacauaaugacucaggaaucaucaaugcaggccucugaaaaaccacugcacuuaugagaucuccuagcaaguauguguugugugagaaaauggacaaccccaggguacuccuauuaaacacugauauuuagaauuucugaauucugauucuaaauauuuugcaauauuuggaauuucugaauccuaaauauugcaaaagguggcgcggggaggacggggaagggagccugaaaggaaaauggaggacagcagaaagaaaaucagaagcagcagaaugacaucaguguggggagaaugcacccaucaaccgaugccacugagagacuguggaggacacaacagugcccagugaguccgacaaccagaaugauagcaaagagcucauucccuggagcucaaggaacagaugccugauaacaggugacuguggagggaacuggagguuacgaagaucacacaggaacuucugacuaccauauaaagaagcauaucugugaagagacagagcgaggguggaaguuaaaggaauacacagaguugaaugacuggagugagggaucagggagcucuaaagaagaggaaaaauaugagaaggcuaaauacuauugagaugugaaauuaaauacagggucaguaggccaagggucuuuaugaagucaaagaucagauacaaugagaguaaaggaccuacugaagaagcugugugcacagaugcccaggaauucagacucaccuaagaauuuagaacaaagguggaaaaagaaaacuaagcucaaauuauuuaaauaguacaacaggguaacuucuugacauacugaacaugagccuauucauguuaaauaugcuuggagaauaucauuaguccauggcuuacaaucaauucuaagcuuucaagaaagcaagagcuacaggaccuauucauaaaaauauagcaacauugggaaacuaauuaucuucccagcugauaaagauaccauccaauaaauagggggaucuucagugacauccaaaccuucaaaaaauauauuuuaaaauguuauaccacguucucggaagguaguuaacacuaaaaaagauuugggggaacugaagcugaguaauauucuugaaaauacagguaccuaaucaauaaauaaagagaaugccccccaaauuuuucauggcaugaaaauacuuaaagguuuaagaggggaguaccuacaucuauuaauacaccaaacaccuacugaaacgccacauucauguaaucacuuaauaaagacauuaaaauaggaugacaggaguucauguuuagcauuuauaaauaguauccuaaccuuuaagguacaacauaagaaucugaaauuucuaaaaucuauuaucacugaauaauauuuagaagcagauuucugugaaaauuaauucuuaaggccaggcgugguggcucacgccuguaauuccagcacuaggccgaggcgggcagaucuguugaggucaggagaucgagaccaucgugggcaacauggugaaacccccucucuacuaaaaauacaaaaauuagccaggcaugauggcgugugccuguaguccuagcuacuuggguggcugaggcaagagaaucgcuugaacccgggaggcggagguugcagugagcagagauugcgucacugcacuccagccugggugacagagagacugugucucacaaaaaaaaaaaaaucuuuaucauuagccuuaaaaacuaaggacaaugaaacuauuauaaaugaaucuaaugguauguuuuaucucuaaacacagaugccucugauacacugacuuuuuacuagacauguguaggauagguuuaacccuauuucuggaguugaauguucuuuuuauuaagauccaaagacacuugguuucuucucuucugagaucccuauguuacuucuugguuguuacauaaaaccugcucuuccuuuguugaucaauaaggaguaaguaaaguaaaugauuuugccauaaucucagaaauucuuuuaggcaugugaaauugcugcuccacaucuucugucuuucuaauguuugggcuauucuuucuuuucccuuuccuuuuccaauauuuggcuacauccucaauucauucauuaaaucuauauauuuauuaaauauguacuauguaccagacauguucaagcucugggaauauuucagugaauugacaaaagucucaauuaucgaagagcuuacauuuugaacaaaaagcaauuauuucccaauguuugagcaccgcaggaaaggguuaaccaucagcaucaugcacuacuuauucacaauauagcugcacaauuauuguuuccucuuaucaggcccucaaagccacugauuauaauacuuugucccaaccuauuacccuacaaguuugcuaguaaaauucgaagaugaccaggagcuauuugcaggauacuacaggcuaugaaaguauuacuccagaguauaaucaguuuuuuccccaauccaauuguaucaucuauuaaaagagcuaacauaauaaaaagcuauauccugaugcccagaauuuacagcguaacaaggacuaagaaagcagguaucuuagagguaacuuuagccuauuaaugacaugugcaguacaaauaaaaccacauugaauguacagauauuuuucuggacaucgaauaagagaaauaaucaaaugaauuaaugucuguccaaaucaaaaaucucuacaaguguuccaacuuuaaugaaccaacuuaguucuauucuaauuuucuauuauuauuucucaaggcuaccaacacaaacuacuuucccuggaacauccccaugaauauauuuauuuauuuauuguuuaauuuuuuuugagacggaguuucgcucuugucauccaggcuggcgugcaguggcgcgaucucggcucacugcaaucuccgcuucccgguuucaagugauucuccugccucagccuccugaguagcugggauuacaggcgcccaucaccaugccuggcuaauuuuuguacuuuuaguagagacgggguuucacuauguuggccaggcuggucuccaacuccuaaccucaggugaucugcccaccucggccucccaaagugcugggauuacaggugugagcuaccacgcccaggccccauaaacauuuuuaaaucuacaccucuucauuuucuuuacguaucccucaggauccacaucaugggucuacuuucuuucaaacaacuuuuaccauaugcuccagcucacacuaccaucucccuaccuccuaugcucacaacaaccccucauaugacuuacauuaaaaaguuuacaauuauuaauuaggauuggaaguuuccaacagauuuguagucaggagagacuauucagggaacaugagucuaguuuugaucacauugaguuugaaguuccugaacaaacacgugucacuaaaggagugaagauaaacaugcuucuagaguaaaaacaaucacaaguacaaaccucuacaacaucuuacacagggaaauucagcccuaaagucuaucaaaugggcauaaagguaauuuuauauuuguauaaucuuagguuauagccaagaaaaagcaaacaucuugugaaguugagauauagcauacaacaaacucagcucaauuaaaccacaguuuagcuuuaucuaauucaaaguuaggacgccuuuaacaguaacuugacuugcaacuucuaagcuuaaaagaaauuuuaggcugggcgcaguggcucacgccuguaaucccggcacuuugggaggccgaggugggcggaucacgagaucaggagauggagaccauccuggcuaacacgaugaaacccagucuccacuaaaaauacaaaaaauuagccgggcgugguugugggcgccuguagucccagcuacucaagaggcugagacaggagaauggcgugaacccaggaggcggaggcugcgaugagccaagacugcgccacugcgcuccagccugggcgacagagugagacucugucucaaaaaaaaaaaaaaaagaaagaaagaaaaaaagaaauuuuccagauuaaaacaaaugucuggaaaccuuaaacucaacuucuuccugccaucaaauauaggccuccuugaucgauuucuccauaacaagaggaggucauaaaaaucauucacggccaucucauuuaguugucucuucugcaacuuacucccuaaacucugugcuuaaauaacuauucuccugauuuuuccgcuguaggucuucccacuauggaacaugagcccaccccuuucccuucccaccauccuacugguaugguuuuaccccauauauggcaucuguauugugagucugccagaacgcucauacuuaggcguauuuuuaucuucguaucuuacaacgcuguuauuuuguacuuuuggcuuuucuuugucuacaguuaauauuugccccauuuaaaaaauuugccucauuuucuaugcauccaucaauacuguaucuuucccaaacgcuccaguagaacccuaagaagcaugcuaaguacaggaaaaucuuuaacgcagguaaugcaucaaugccauuuuuuccuggaggccucucuccugcgaccagccucguucgucuccuccaaucuggacuagcugcucuccagacgguugcacagcuguugccugagauuucccuucacuauaggguuucaaagccaaagccuaagacucacugacaggagaaggaaaaaaaaaaaaaaaaaaagacagacacuccugggaugcaucaccaacaaguugaaauuuaucaggggauauggaagagggaauguuuaaugaaaccacucagugacuaauaugauaaaagagaaagacgacagaauuuauccuuucacugaacacugaaacaaauauugagaaccuucuuugucaaguacuaaaaucugaauauuuccuaacagccuuugacacugaaauuaaaauacgucuuaauccagacuguagauucaucuuuaugucguuucuuauauccaugaugcuuauuuguguaccugaaaaaaagcauauucuuuuccucagugcuaauugagaacuggcuuuaaaaauucauucuuuauuuaaucacaaacaucaaauaacuuuuuaaaaauauaauacgugagaaaaaaauuguccuuaauuucauuucaguauucccuucauaauaaguaaauaaacaguucugcuuuuauggguauuaucuggaauuauaaagauaugcuguaccuaauucacaauaguaaacugaaaaauuuuaaguccacaaagaagcacuuguuuaguucuuuuccuagggaagaaauacaucaaaaguucccauaauuuauuaugagaagucuaugucuaauauauuuuacauauuuauauacuauuuuuaauguaguucauuauuuaaaacauaaugaaagcuuggguuucauggcaaaggcugaaguuaauucaguuaaugccauuauuuuauguuguauguaagcuacucuucuaccccaagaaucguaauaauagcugucuguaccacucuaaacacuuccuuaaauuucauauucuucaucuggcuacaauuauccacauggcauaaaccauagagcucucaaucccaaaaucuuaaguuuugucacacacaaauucuguuuucuacuacagcugucuggaaaguuauuuacuggcuugaaugguuaaaaaaaacaucaaacucggcagggugugguggcucacgccuguaaucccagcacuuugggaggccgaggcgcggaucaccugaggucgggagcucgagaccagccugaccaacacggagaaaccccgucucuacuaaaaacagaaaaauagcugggcaugguggcacaugccuguaaucccagcuacuuggcaggcuuaggcaggagaaucacuugaacccaggaggcggagguuggggugagcugagauugugccauugcacuccagccugggcaacaaagagugaaacuccaucucaaaaaaaaaaaaaaaaaaucaaacucaagacaauaucucaagauuuuuauuugcuuuggaaaaugacacgaugagaagaggguucugaagacaaaggggaaaacuguuuccuuucucugcuugggguagggacugauggaaacacagugcuugagaaagaugcucagaagcggcuagaguagaaaaagaacuuugaagaaaguccacuuucuucuuugauuccucaucauaaccauuuguaaucauuuaccucagaauaaaagagaaaauuccacgacaauaaacacagcuugagguuagcuagaaauacuguucacauuaaauuuaugguaaaacagcaagcugaaauggugugggaauuaucuaauaauuuccaagacugaauuacgcagcuauaaagcaacagcagcuguuuacugguuggcccagaaaaguucacauuucagaccaccagaucagacauaacaguauuaauuccucauacagggagaaauuuuugaagacucaacauaacagaaauccaguguucagcugauacguuauuaaaucugacggcauuuuuauggcauuuuuaaacuaugacacagcuucaggaaguccugaaaacuugagccucuaaaggcauuuuugucuuuuuuauacaacauaggugcaaaaagcugaaaaaugugaccaugaccgugugaaauuuaaauuauaccuuacuuuuuauuuuuacuucuguggaugccagugucugucuuagucuguuucucccuauauacacuguauauggaaaccaacuaaaagccuaucuaggccgggaaugguggcucacgccuguaaucccagcauuuugggagaccaagguggguggaucaccugaggucagaaguucgaaaccagccuggccaacauggugaaacccugucucuauuaaaaauacaaaaaucugcuaggugugguggugcacgccuguaaucccagcuacucgggaggcugaggcaggagaaucacuugaacccgggaggcagagguugcagugagccgagaucucaccauugcacuucagccuaggugacaggagugaaauuccgucucaauaaacaaacaaacaaacaaagcagcauccauaagaaauuaacacaaaauauguuuagcuguucauuugaaagcaaaugacugggguuauaauucacuuguaacacuuaauaaucucaaaguuuugauuugugaauuccauuaucucuuggagaaagcuacaacacacauauaauuaguggucuaacucaaauagugcuggaauuuccuauagaaauggcuaagcaugaauaaccaaagucgcaggugauuccuaagauucugcucauuuuuuaaguuuuuuuuuaaguuuuuuguuucuuucugcucauuuuuuuuacaugacugaauuaaaauagcuuuuaaaaaauuuccugcuuuccgccggguugugguggcucaugccuguaaucucaguacuuugggaggcugaggcggguggaucacgaggucaggaguucaagaccagacuggccaagguggucaaauuccgucucuacuaaaaauacaaaaaaaaauuagccaguagugguggcaggcaccuguaaucccagcuacucgguaggcugaggcagagaauggcuugaacucaggaggcagagguugcagugagccaagaucgcaccacugcacuccagccugggcgacgaagcuagacucuaucucaaaaaaaaaaaaaaagaaaaaaaaauccugcuuuccaaagauuacugguaucuuuuacuggaaaaugguuccuaaagaccauaaucuaggugcaguacugguguuuaccgcuacugaguuggucuuuuaggccuuuucauuauuuuuaggccugcagcggacaguauuuauggggaaaaaauguuaucugaaaucuacaacaauauguuauacugagaaaugauaccuaaaagucaaacucaugacuacaggguaucuuuuuaauagauuauauguuacaugugaaucuucuuuuaccacaucaaaauucugauucucaaauacaugggaugauugaauuaaaauaucacacaacuauucacuuauguuacaccauauuacuuaugcaccaggcucagaauuacacacuaauacuaccaccauuaauagaaaaacaguuguuucuuuacccacaucuucuucucauucuuccccauuaaaguuacugucacaacaaggcuguuuauuucaccugggugcaggcaggcugaguccgaaaaagagucaggaaagggagaugggguagggccauuuuguaagauucggguagguaaaggaaaauugcagucaaaggggguuguucucuggggggcaggggugggggucacagggugcucagugggggaguuuuugagccaggaugagccagaagaaggaauuucacaagauaaugucaucacuuaaggcaaggaccggccauuuucacuucuuuugugguggaaugucaucaguuaaggcaggaacaggccauuuucacuucuuuugugauucuucacuugcuucgggccaucugggcgaauacgugcaggucacaggggaugguuuagcuugggcucagaggccugacaguuacagaaucucuuuauugucacagcauguagcuguggaauacuauauuaucauacuuuuuaccaucguugagucuuaguuuuuauguuucuccuuaaugcucauuacccauccuuauaucaguuuuucucuagguauuuuggguaucugaaacuuguucucuagcagauucuacaggaaaauaaugugaaaauaugcccugaguuauuguacguugauauuuauuucaugugaucauaucugaaugucaguuugauugaauauaaaauccuuguuuuggcugggcaugauggcucaugucuguaaucccaggacuuugggaggccaagauggguggaucaccugaggucaggaguuugagaccaaccuggccaacaugaugaaaccccaucucuacuaaaaagacaaaaaauuagcugggcgugguggcgggugccaguaaucccagcuacucaggaggccgaggcaggagaaucgcuugaucccaggaaguggagguugcagugagccgagaucacgccauugcacuccagccggggcaacaagagugaaacuccaucucaaaaaugaauaaaauaaauaaauaaauaaauaauccuuguuuugcauuggcuuucuuugauauguuaaauguugcuuuauuuuccuuuggcauaaagcacugcugucaaaaaacucuuauuaaaauauaguuucuuuguaagugaaaaacaaaaauauuuccugcccucaaaaauuauaaacuuaguuaccaaaaagcaaaaaguacuauguguauacauaaaagcaauauacauucauuaccaucuugaaaacaauuauuuggauauaaacuuuaaaauuauaaaauaauaguauucauuauaaaugaaugaaaacaguaaugauuuuuaaaaacuacuacucuuaucaugaccaauuaccucuucuuuuugaaaagugaacuaguuccuaccuuaaagacuuuguugacccucugucugaauaccuaaaauacaucuccuuucuugccuugaaaucuuauccuugaaaucuuggcucacaaugcuacuuccugucaagucuuccuuaaauuccugagcugaaaucccauccccuucaggcccacuaucaacucuguaagagggaggcccacauuucacccaccuccaggggcucacacacugugggugaucaauaaaacguacacaaugaauacguaacugaccuuuuauuggucaauuuuguaggacuuauuucucugagaauauucaauuaacuacuuccuaagguggaaauuuggaaaagcaauauuuaaaauuguuuaaauagauuuaaauaguaauuauuuuaaauggccuuaaguagaaauuacaggcgcuuuuacucuaucaauaaaaaaaucauagcuaaauguagggguauccaugcuuauguuaaacucaggaucauaaaucaguauuaaaauuuuccuccauauuuucauaaacaauuauguggcgcauauauuuuauuacaccaacuauaagauuugcaaggcauuccgccaauaacuguuauauaaaaaucaacuaaacacaaauuuaucuaccaggauguuuaucacagcaucauuuauaacaacuauuacaccaccacaaaauaaagaaaaccaccuaaaugaccauaaaaaagaguaaacacauuacagugucuggugugaugcuacauuaaaaauuaugcucuccaagaauauuuaauuucacagguagaguauucuaaaaauguuagguguaaaaagcaagucacaaaacaggaaacgauuaaauaacacuaaaaacaaaagcaaaacauacaugaaaaaaauguagacugcaaggaagccaaaugguuuugauuauuuuuagcuagugguuguauuuucucaacuuuguacguugaauauauguuacuuuuguaaucagagaaauuucuuuugagcacacauuugcaauucuuagcauguacuacaaaucagauguccauuagccuugcuauucauuuuucaaagcaauuacuaacaagccuugggacaauaucaugccaaauaagcuggguuucuuuuucucaccuaucaucuaggaccuacagagauagauaaauucugugcuucaagaaaauaucagcaaagcccacucauaagccauaacagcaguuuuucaaaaguuaucguuucuuuuuaaugccucguuacuuaaugacaccugaauacaacuccaguaaagaagacaaaacugaagauguaaugaaguauaaaucacccaugcuauuagagcucuuaucaaucaaaacauuaguuguuaaaagucccagaaagaggacacaauaccagguacaauaauuaaaaugaaaagaaacaaaacuggaaacggagccaagaaacaccacuacgcuuccuucuuuucaaaaugcgauuguuaaaaaagucagucuccucaacucauccucuguccugaguuuuagaaagcaaaucaagcaggagccaaugcaauugaggcaauuauggaacuugggacagggccaaggaagugcugcagugagccauggaggaugaccuaccuagaagggcuccauuuuuuuuuuuuuuuuuuuuuuuuuuuuugagacugagucucgcucugucccccaggcuggagcgcaguggcgcgaucucggcucacggcaagcuccgccucccggguucacgccauucuccugccucagccucccgaguagcugggauuacaggcgcccgcaccacgccuggcuaauuuuuuuguauuuuuaguagagacgggguuucaccguuguuagccaagacagucucaaucuccugaccuugcgauccgcccaucucggccucccgaaguucugggauuacaggcgugagcaccgcgcccggccgaagacaccauuuuuauagguguucuugcuuaaucaaauggaagagggcuucacuuucuaagucuuccucacccagaaggaaucugugagauaaauguaagcucuucccauucuuccuucuggccugaaacaaauguggcugccauaugcaauuuuggagggaaaaaaaauuaaggaagaucaagaaucuuccugaagaaucagugaugauuaaugcugcuuaaauuuuguugaagaucguaugaaugaacguuauuuucuuuuauuuuggcaucaugguguuuucaaaacuaaaguguauuuucccauacuguauguauaaagcucauaaaguacaacuaccaagagauaaaacaaauuaaugaucauucugugucgacuuucaagucuuuugacuuuuuucuauuauccuucaaugguacuacauacaaauacaaaauuauauguacugauuucauagucuaucuuuugcugauuauaaaagcuacucauuuauuauacaaagucauagaaaauugcuuaaauaaaaucaaaaucaccuguaaucccacuguugggagauaaacacugauaagauuucuuuuccggacauguuuucuuuuacuuaguaugcugguucugaagcaugauuaacguugaccauucaaaggucccaugggaaggccacauauaaaggagucugaugucucuccaaggauggcugauuagccuuuccugaugaagaaaugcccagcaauucuggucauuccuuaugagaccaugauguaaacaaucaagaacauucaagaauuugcauccuucuuguaugcagcagcugggcucauuaaauaaugagaaugaugaagucaucauucucaucacagugcauguauaggucccacacaugcaucucccaugacuucaaaauuaguaggauuuccacagugcaggucgguggggagaggaggcgccaugggcaccaauucucuagcacacuggauuacauacggggauuuacaagauccuuaaagucuacaauaaaaauguuuuuccauccucaucgccaucuuuaaaguuuggugaacucucaugugacauuucugacuauuguguuguacugaugugucucaagagaguuguuguuuacauaaauucaaagaauuacccugguauaaaaugucacaguauucaaauacauccuuuccaugcuaaagaagauagcuguagauaauugauacaaaggcagccaagaaacccagaaaacaaggcaugcuuuuccuaaaauuguauuaaaacaauaaaauucaaaauuaauaugaauugaauaccuuucucauuugaccauaucugauaagauuucuggucauuacuacuuacacauuuggaaggucuuaauuacaaaaugaaacagaaugacauuuaagguaaaauucuuucacuuguaauuccuuuuuuggauuaagcuauuaaccugacuuugccccaauaauucaacaguaauuuauuuuacgcaauguuccuugccuuugcuggucagagacaaguacagaaaagugccaauuucaacaguggaucuauuacaccaugaagagcagucauucaaauggaaaggguugaaagcuuugcaaagaaaauauucuccuugaguaacaguaaugaugugcuugaaucacacaugagauaauuaauaaaauguucacaugauuaagaugaaucuuacccucugguuccagagguacuaccaaaagcaaagggugagaugagaaagccaacuuauucucaagggaaauuauccacuccaugggaagaaaguggcaacagcaaccugacauacuuuccccaugcagacaagaaauguauagcacauauguccgaggcaaaauauuacagaaaaauaauccagugccacacuggauccuucaucugauaaagagguuaggaagguuguaugccacacauaacaagcauuuuucucucuucaagcuuuguuuugaauuuuaacacgcuuaauguuuaagauaauuuuauuuuguuugcuaggucaguaaaaaaaaaaaacucuugucuaaaacauauauuuggauacagucaagagauuuuagagcauacuuauguuaaugcugaacaguaauucuuuguuaagcaggaauaauauguaagaauguuaccuacuacuacuauaaaguagaaaacauaucacauggagauuuauccuauacuaggucaugguugucuccucugucaacacaacgauagcugugaguuucuuuuuuagugcuauugucucuaauucauagugaauauuuguuuuaaaacaaauuuuuguguauacuguaaaaaacacuggaccaauaaucaagagagcuuggacuguagugcugacucucccauuuauuugcugugaguuauagcaagaaauucaaccucucuggaucuugguaguuguauagccugugaagagagacgaagaacuaacacugccugucuauuaagugcaaguaaaauguacaucaguuacaccuaugucccuauguuaccuauguuacaccuauuggaaaaccuauguuuuucaguuccuuuuccugaaagacaaggcaugcucuacauacucuaccagguuauuuuaucaacucuguauuauacucugggcuugagaccuuuggaaaauuugccacuaccuaagaaaaaagcagcaccuauauuccuuaauucuaaucuaagguuaauaacaaaguaagagacaacauaugcucuacuugucauauuagggucuaauuucagguccaauggaaaaggaccagugauucauaaaaugagaaaauaugguaaaaugauucaacacgccaaguaccuacaggaaauagcaaaugauuaucuagucccauaguagucaagaacaguuagugucaacgugcucauuucacaucagacacaaccagaacugagaaauuugcuuaacaugucacaagugacccaacuuuuugaauuauguaccuccacaucaaaggagcccagaaucuguucggaggaugaaagagaaaucugauaaugguugauggcaaagccuuggcaggaauaaacuccuucccugagaaagaauuauuuuauaggcuucucuccauuucuccuugccagucuccagccugugcuucacagcuggguaauuaucugucaguggaaugauauauuuucaagugguucucuuuccauaaugguuaaaaacauaaggugaggacaggucauuaacuuuacuaucaaacagguauuugguagaugagauuaauuauuuaaaaccacauuacuuaggcuguuguuucccuaaauggugcauaaugcaguguagcacaacaaauacaaauauuuggacagucuccguguaauuauaauauuauuauaaaaucuucugacuugauauugagaucugagaacaucuuuuauauccuuuauuacuuguuguacuguucguucacuuggagguuuuuuuguuuguuuuuguuuuuuuaagagacggggucucauuauguugcccaggcuggucucuaacugcugggcucaagcaaucuucccaccucggccucuuacagugcugggauuauaggcuugagccaccacacccaguggaaggagagcuuuucagagaugaggaggcuugaagagcaggggcaaaggaagugaucaacagauaggauaaaauagaccugggguucaaaggauauuugcuacaacaacuggcacuagguaguaaauaacaaucuuaauguggauuucaucuuuccaucaacuuuaauacaaaucauucugaauagaauaugaagcagaaaaaucuauguaaaaugauaaguucacuucugaaacaugacugcaguuuugagugucauaccaggagcaauaaugcccauccaaagcccuaccuguucucagugagcuuacauucuaaugaaaauauauuuggaauacuucauagaacagguaaguaagaaccaaaagaaacaaaucauuaacaaagccuggcccaucaaauuaacagacucaugaucuacuuccuaacuuguacugaauuguucaaucucuguguguuauuucuugguguaauaacuaagugaguauaaaauacacaguuccuggggacagaugacuucuauauuuuuuugaguaggaguucuguaucuagaauuuaagugcugcuuauuuucaucuaauuaaacugcacuuuuugaugaaccagaaaagaguugaggccuuauaaagcauauaggaacaaggaauaaggaggaaaaaggaaacucuugaauuaucagauguuuaagaaaucuaguuuucuacacucucuucaucaauuacauuguaaguaaauucaccaggugaaaucuucuuucuaaugcccaguguuuucauuuuaugucucaaauuaugcacaugaaugaacagcaaucaguaugcucuuaggacauucauuuuugaccauauauuacauagaucuccggaaucuucaguaaauauccuuacuuuguaaguuugcuguuggauuuucuuugaaauauuccuuuuaaccuuuauaagaagucaucagaauauacaucaauauuuguccacaaucuccacagacaaucucuauauccuuauuuacaaccugccuacugaugaauacacuuguggaaaacaucuagauguaagauaccagagcaaagaacuugacuucugcaaugacuggucacauaaaaacaacaacuaggaacagacuaauaaccaaguuagauuaaauauggaguaugacaguuuccagaggaaaagagcacgauaccacauaaaacuacucaauuuuuuuaaauaaaauguugagguaaauuugagguuugugacaaaacaaacauuaaacauuaguaaucagacuguuuccuccaguuugauguaagcagaaaaaaagccuucccaauuccaauuccucuacuaucaccaaauaagaggaguaguuauuguagaacagccuuuuuuuuuuuuuuuuuuuuuuuuuuagaaauuaacaaaaugcugcagcuucacauuagauucuuucuucuagaaagucuaugugaagaaacacacaaggccccuguucaugagaaucaucuaugcgauacgguaaaauaagaauucccggauccgcuacuauaggcauuuuucauucaggaguccuggaacuggcccaggaauuuguaauuucaauauacacccuggguaaauucauucugaggcagggaacucaaaaauacugcuccuauagggucagugcacagaauguaacugcaagaguccaaaacacaguacaacacagaguggcaaugugcugaagaacaagucuguguaugugaccuaacaggagcauccucuuuuucuucccucaagaccaggcccccaaucaacaccagccccacggccggccggcucaccuaagcagcgguagggaaucacaaaguggggaugggucuugcacugcuugcggccccgcuugcaccaguucuggauggucacugguugguuggcuucuaccacauuggugaucugcaguucaggguagaccugggagagcacacaaaaagaaucaauuguuacuugaggcaggggcuggcauuuacaagcaucuaacaagccuccacuguaagguacagguggagugucccuuauccaaaaugcuugggaccagaagugcuuucaaggucucugacuuuuuccgauuuuagaacaucugcauuauauacuuacugguugagcaucuggaauccggaaaguccaaaauccaaaauacuccaaugagcauuuccuuugagcaucauguugacaugcaaauaguuuuggguuuuugagcauuucggacucuggauuuuuaaauuugggauacucaaccuauaccacuauccacuaagagucaagccugcucuaccucugaccaagcuaaagaaauucaguacaaagaaaaagauagcaaaugaacaagcaucuagcuauuccauucaaaauauuaagcaaugcaacuuuuuaauuuauuguacucauuuagacuuaaaauauuauuuuuccaggggagcuaaaauagaaacaagagggggaaaggaggauucuuacaagcauggggugauuuuugaugugaaauaaauugguguaggauaauagucuguaauguccuaaacaaacguuacaguagauauggcuggggauauuauguuuaguaaaauucaaccucccccuaucucucacuaaucggacaaacauuuuacaggauaugacacauagaaagcuuucuauauaaaaauccugcucuuauuccaaguaauuuacaugaaaauaacuuaucgaaaaguuaucaagggugucauuuagauaaaaauaaacucaugaauucucuuugcuccuauaacuaacuacagccccuugcuuugauuacuguugugaauacaucaugguguuuaacugagcacuuagaaugaaaugugaaacuugaucaauuaaaucacauuugugaaauaucaaaccacuucuauuuauuaaugaguagagauuugaaagaaaaacauaaacauaaaaaucuauuucgaaaaugugcauucccuugcauaaaccuugcauugcaacagggugguuguuuugccagauaaauaacaacgaauagagaagugacgguauaagcaagggaaugauuagaaugcugggccaugcaaucucaaguggcaaaagugagaacaugaggggaauuagacacagguaaaaggugguagggaccaguggaaucugaguccacugaucacacuccaggggcuaaagaauguauggcgcacaggacuggagaaagugaggugguaauaaguaguacuuggagagucaaauaauugaaauuaaaauuuuggaggaguugcagugauuggucauugcaaggaguauaauaugaccauuguaagcaaugggugauggagaaugaugaaaacaaggucacuggagggaugagaaucaugaacugacaaauuggaauacuggaaggaucauugagaucaauauuaggaucacuuaagaaucagcaaaugaagcagcuacaccugaugacagcaaggcaggagcuaaaaucuucaaagucugaauggugaacaucgaugagguagaaagaggucuggagaugaccaacagguggaggagcaaagugauuugucugaaagcaugcacuucaagcugagguaggggggcuuuuagggaagagaaaggaagagugguuuggaaacaaaaaugaagaggaaaagaggaaaugaagaggaaaagaggacauucccaccucuaggggcaacgcugugaggauuuugagaaaagaacuucgaccugagaaggcuacaggagaaguagugccuuccuuggagggagaacaagguuucugagcaagauaacauccauggggaguuagacgauacacggaauuucacucacaauuguccaugacauucagagggcuugacaaaucuaaauuaauaaucccuuaucuuugaauaaaaguaacugaaucaggcugaauuuacugcuuccauuuuaauaaggcaguaggagaacuaugcauggcuugaugucaauugagcgugacucaaucucugucuaaaaaguugauauuuuguucaucauggaguuuuuuugcaguaauuuugauuuuuaaaaauauuacauuaaaaauucuuaaucucaauuccugacugccuuguuuaccucaccuuagucccagaccccaaaaaaaucaguuaaaaaauaagguacugugaaugaauaaauaacacugugggguacacaccuagaaaauggaaugucauucaacacuaaaaggaaaugggcuaugaacccaugaaaagacauggaggaacuuaacuaauauugcuaagugaaagaagcccaucugaauaggcuccauacuauaugacauucuucccacuauaugacauucuggaaaaggcagaacuauggagacuaaaaagaucagugguugccacggguuugggugguugggggcagggggaggaugaacagauagagcacagaagauuuuuagggcagugaaacuacucuguaugguacuacaaugauggacauaugucauuauacauuuguccaaacccaaaaaauguauaccgccaagagugaacccucagggaaacuauggacuuugggugcuaaugauguaucaauguugguucaucgauuguaacaaauguaccauucugugggggauguuuauaauaggagaggcuaagcaugugugcagguagcaaguauaugggaaaccucuguaccuuccucucaacuuuucugugaaucuaaaacugcucuaaaaaaccgucuauuuuaaaaacaaaaauuuaaaaauaagguaucaaucaguguagcagcaggggauaaacucagugguagagguauaugcuaagagaacacacaaagaaaucucuaaaucagaauccuggggugggugcugagagaguuauucuugaaaccacugccacaguaaccuagcuccaaagggauccugcuauuaauacuucucuuuauuuuacuuuguucuuaaguaucuuaauaucucaaugcaggcacuuuagaucacagaaaaugcucuaaaaaugccacuaaaaauuuaauauucccauggcuuuuuuccuauauaaugaaaggugaaguggcuuuuuguacaggaauauaauucucccaccgucuuuacuuguuuauuagaucacaaagcugcagcacucaugagucauaaacuguaugacaccugagaguccacccugagggacaugacuuuaugugcaguaaagugugaguuacugcaucuuucuaaaggguucuuuucacugaaagacaacccugcugagaauuuccucaggagucaucgguuuucuauaaacccaguggcaggcauauucacaucaugguucccucuauacaacuuaaaaccaacgaauuguuuguaggguacaaacugauuaccaggagaaaaggaucucuuuuucauguugguugcauaccaucuucagauuccuaugguaauaguuggugcaacagggcaguaacugauuagguugacuauuuccaaguagguagaauugcaaauugacaaauuaaaauccaugaagacggggcuuuucccuaaagacuaguacuagaacuuuauacagugaucagccaaacacagaauuuacuuccaguucccaccaggaaaucuagaacaugcguguuauuuucugugcuucagcuucucucucuauaacaccaacaaugacaauuguuaauaugcagauggauguggagauuacaaaauuugaaccaggccggagacaguggcacacaccuguaaucccagcacuuugggaggccgaggcgggcggcucacgaggucaagagaucaagaccauccuggccaacauggugaaacccugucucuacuaaaaauacaaaaauuagcugggcgucauggcacacgccuguuaagucccagcuacuccggaggcugaggcaggagaaucgcaggaacccaggaagcggauguugcagugagcugagaucacaccacugcacuccagccuggugacagagcgagacucggucucaaaaaaaaaaaaaaaaaaauuugaaccacauaaagcccaugcauaguuuuuuccuacuguccuauuaaaauggaagcaguaaauucaaccugauucaguuacuuuuauucagagauaagggauuauuaauuuagauuuuccaaacauaaugcaauuuugcuguuccaacaucaggagguuuauuuaagggggagaacauuagcaaucaagguaacaaaacuucuucugaagcagagcaagacccuuuugauaaagcaacugccacaugcacagccaacucccagcucagaaagcaaacaacgaaacaaaacaaaaaaagaaacaaacacguuaaaauuuaaaauuccaacaaaaauucccaauaucaucccuagguuuuuauuaaauaaccccaguaaacauccagagaggaaaaaaagccuuuuuauguuuacauagauauaaaaauauuuauauuuauauaaaauauaaauauauagcucauuuauaaagauauaaauauaguucauuuauauuuaaagauauaaauauaaauauaguucaacauuuuagacaagaauaaaaauuucaucagaaauacaaauguucucguggcuagauuaaguuccugauuuuuaucauaacuauaguaguccucccuuaucugugguuuugcuuuccauaguuucaguccaaaaauauuaaauagaaagcucuauaaauaaaugaguuuuauuuuucuauuuauuuaauuaauuuauuuuuuuuuugagauggacucucacucugucgcccagguugcagugcaguggugcaaucucagcucacuguaaccuccaucucccagguucaagcgauucuccugccucagccuccugaguagcugggacuacaggcacccacuaccacacccggcuaauuuuuguauuuucaguaaagacaggguuucaccauguuggccaggaugcucucaaucuccugaccuugugauccacccgccuuggccucccaaaguguugggauuacaggcgugagccaccgugcccggccuauauuuaauuuuaagaaagagauagggucauccuauguugcccaggcuggucucaaacuccuggccucaagagauccuccuguccuggccucccaaaguaccaggauuacaggcaugagccaccaugcccagccaacaauaaguuuuaaauugcgcaccauucugagcagugugaugaaaucucaaacccacacaguccagaaagugaaucaucccuuuguccagcgucuccaugcuguacaugcuaccugccauugaucacuucaucacagcgcuuguguucaaguaacucuuauuugacuuaauaacggccccaaagugcaagaguagugaugguggcguagugucauaauugcucuauucuauuauuaguuguugugaauuacuuacugugccuaauuuguaaauucaacuuuaucacagguauguaccuauaggaaaaaaacauaguauauauuggguuugguacuaucuaagguuucgggcauucacugggggucuuggaaguuauccucugcagauauaggaggacuacuguaaguaucgguucaauguuuuaauauuuucuuugcagcaucucaaaucuuacauaggaaauaaagauaaaaguuccuuaagcugcuuaauuugcauguguuuuccaaaacauacauguauugcuaauaugacaagcauugcaaauaauuugcuaauacagcaaacauuagcaaauccuaacucucauacuccccuucuuuucuaaaauguuuuuuaugugaaacccaauuccaacuauuuccuugauuuuccuuuuuaaaaaaggacucgagauacuuauacuuaaagcagaagcaaacccaagccucugucagcuaguagaaaaauaagcuguccucaaguccuacaaauuuuccuaaauuauagccacacagagcauuugcuguauaaauacguacacuguguuccaaacacacucuuaccuaagaucccuuagacuacacuucaaaugccuacgcccauuaggguccccccacauggacaaaccuccucugcacacagugaaauaaugcuaaccccucuuacagaauguuuucugguauuuaucagugugccucacaucgcuauuaaguuuguaucuguacugccugccuggugaaaagaagcuuuccucaagggcagaaaacauaacguggcauguuauagccuccccguggagccccacauccaucaucuuuggcuuucagacuaucaggaggcugcugacccccaacuccuuuuauguggugcucccacccucagcucucugaaggaggacucauuagugacuguauuucaaacucugcagcaccauccccuauagcuuauuagagcccaagaaaaccaaacuguacguagcauucuuucccucaagggcuuucacgaacacacaaaggcugucguuagauaaggaagaaacuugacuggaggugagcauaagucugagccacagguggcaugucaacacccaugggugcaugguggcuugcgccuauagucccagcuacucgggaggcugaggugggaggacagcuuaagcgaggaggucgaggcugcagugaacugggaucacgucacugcacuccagucugggcaacagagugagaccccgccucaaaaaaacaaaaaacaaaaacagaacguaacaaaaaaacaaagaaaagcccccaaaaaaccauggguggacucaaacuaggcaucuggaagaagcaguuaguccaggaaaggaaaacagggaauacucagagagacaagggaagaugagaaacagacaagacuggaucuggcagagaccggaucugacagggccugccugugcccucuaacucuuuuaagucuugggaugugcauuuggauucuaggagaugccuuguccccuucaauaagcccuauuucuaaacauaagcuccuuuaguagcuuuaugcuccuuccaauugaacaaaagccaagaaaaaggcccggcuugcaugcuaguucacuaauucccaccacaugaugcccucaaucucugugcgcagaccauucuguccuaccacugcauccuccacuugccuugaucacuuuaucugaucccugaccacuugcuaccuccuauucugcugaugggcugucuguccuauuagaauauauaauccuugaaggcagggacaauaugauucaucugguguucccucaacaguggcaaacccugggauagcacaguaagugucugauaagcauguaauuaauauuucugguuaaggucagaauccauucaaucagggacuuucaguauacauuaaguucccuuuggguauuauaaaccuaucucuuaaauaagauauucuaaauaguuguuggauuaugggcuuuugagggaaaguaaguaucucaaugccuuucaauauuguucuuccaaguagauauggacagcuuauacaaaucauagcaucugcuauaagcaguagauuacuguaaauaagcacucagcugaggaaggcauuuaggaagagugacaaguuaagcucucacuugggcuaauggggcccauucaguuaguacaggagucugaaaagcagccuaccuaccuggucauacagccauguuuuaucauugaaagugaauguaucaguacaugaaauaauuuuaagagugcauaggccgggcgcgguggcucaggccuguaaucccagcacuuugggaggccaagacggguggaucacaaggucaguagaucgagaccauccuggcuaacauggugaaaccccgucucuacuaaaaaauacaaaaauuagccgggcaugguggcaggcgccuguagucucagcuacuugggaggcugaggcaggagaauggcgugaaccugggaggcggagcuugcagugagccgagaucgcgccacugcacuccagccugcgaggcagagccagacucugucucagaaaaaaaaaaaaaaaaaaaaaaagagugcauaagaaauuccaaauccuaacaaccaggaaagagggggaauagaaacaaucuuagaucauauuauauuaauauuuuuauauauaauaauuauuauuaauauuaaaagcuuaucaucgguagccuaaguaguuuugucuacugaagaaauaccuuaaaaccuggucaccaucagaauguuuuguuccacauuuuaaaaaucugaagucucucuucucacuaucucuccaaguuggaaauauauugaucucagacaagaugacauuuaaguugcuaaauacguaaagcaagaaaagacauugaugauauuuaagaaagccaagaagagaaauguauauauuaaaaaaaaacuuuguaaagccauauguugucagaguccuacagaaacuuugucucuauucccaacauuaagggcaaauggagaaccgaaaagucccuuuuguaaacaggccaccuaagacaggugauuaaugccaaaaguccuaaaaugaccaaagguauuucaaaaacacaaaaucaaacauggcuaacaaaaggcugaaaacaaaguuaaugaacagaguaaauggaauuggaaauugcuacuaauucugaaaacaguuugccuacuuuucuacuuagucauucaauuuuuaaaauucaccuuuagccaaauucuuauuucuuuuugaaaacgcuaaaaauuaugugguacuaauaaaauguuuuaaauauauuaacaaaacgucaaugaguaacaugugaugcuuuagcacaucuuaauuuacaggucacugaaagagaugagcugaaacccgcauguguuuugccaggauugcuggagaaccugaauaguuaagggaaaaaaccugcauuccagacugacucaggaacaagacugacuagauuugaucauuacugcaauucagugacagauagaugggaggguucauuuuacuauucuuucuacuuguacauaugcuuguaauuuugcauuuaaagcacugaaaauuuaaauaaauacauuuaguccagaggaaacagccagguuucuaaauuuauaacugcaugugaaaaaggaaaaaaaaaaaaacccagauccaaauugugucugcaugacugcagcuagcauauaugaauauauacaugaaacagagaaucaaaugcucuauaccaaauuguuucagagauagccuaucuuguauauuuucaucgucucaaagcuuuuccauaccagucccuuuuucaaagaacauauccaagaagaaaguaagaaaaaugucauaacugaggguuuccuaaguaccagacaucacugcaaauguuuuauguguagcacaucauaauccugaguuaguaauuacuccaauuuauuuaagaugaaacuagaacaacuaaaaucgaugccauuucuaagcauucaaagaguauauuaaucauaaauuuuaaacuacucggacuuaggcauauaaaccaagacaaagcauguccuagacaauauauacuucuguuucuggauuucaaugacauucuuuaaauuuuccuggaauacaaagaaauaucacaucuuaaacuauucucaacaaaaauucuuuuaauaaugaggaauacugaaaauacaaucucuaacuuaauugagaaagagaacuggaaaacgaaaacguucucugcuugcaacuuaaugaggcgcugagaggcagcgugcagcugaugaaacgcuacugcaauaaugggagguaucagcaugcuauguuuccaaaugauggccuuauguaaaagcaaaggcgguaaaaugcugcagggcguuagaauauuucccaauaaucuggccaaacucugcuucugacauucuauauaaauauauuguuauauccacacuuucauacucagaguuggaaaauccugucaaagaaccuuguuugauagauaagcuauucuaauuucaaaguguugaaugaaaaacaaauugugggugggagggaagagaugggagagaaauaaaaauaaauaggacaggacacaauugugaaaacacaagcagauguguacacauagccuagauuuuccuauucucucuuucaauguagggcuaauuuucuuauuuuaaaauauccaaacugccuucaacuuuuuaacccuagaagaaaucuacggucaguaaagcaauccuuacauuuauacagaccagaaaugcauaaaauauauccacauauagacagccugaucccuccauucaaaaacugucucacucaauaugaauuugagaucuuucaaauuccaaaaccacaauguauacgugccuaugauuugccaauuuucagccuacaagggugaagggugcccauagcaaaguaauaauggucaagaauguaccagaccuucuaccauaggauaauguauauaguauaccuuccaacucgguaagauuaaaaagacuaccucuguuguuugcuuuuuauuuaauuuuaauuucauacaacuguagaauggaaaaagaaagguugagaaacaauucgugucugggaaucccauguucaguuauguauuuuagaggagaaaguugggcaaaggaaaugguuuugcucaacucaucuaacaggcaguuucugcuuugugcaggcacugcugugcuuuguuugcugauccuguuaaucuauagauuaagcaacuguucauuuaaagccagaagguuaaaaaggcagagaacagauaauguuaaauggugggaaagaaaacaggaaaaagagaaaauacccauaaaccaauaaaagagaugauaaagccacguucaccuaacuuucccaauuggaaaucucugccugcauuugaggcuuaaccuguucaaaguucccuccagagaccugcccugcaguguaaguuaccagagacaucaacaccuucaagaagccccuagacccuagccccuagcuccaagaagugcacugcauguuauuaaaagaauagagaggcuggaagagccuguuucaaguuaucucuuuuuuuuuccuuuuuuuuuuuuuuuuuuuuuuugggauggagucucacucugucgccaggcuggagugcaguggcgugaucucggcccacugcaaccucggccuccgaguucaagcaauucuccugccucagucucccgaguagcugggacuacaggcgugcgccaccaugcccaucuaauuuuuguauuuuuaguagagacgggguuucaccauguuggcuaggauggucuugaucucuugaucucgucaccagcccgacucggccucccaaugugcugggauuacaggugugagccauggcacccggcccaaguucucucuuuaaaagaggaagaauaguauggggacucauccaauuucuuguuuaacugacaauauguaacucuuacaacacuugccuguguguuucuaucauaaagugaggauaugguuuaagacugugaggauacagucuaagacugaacaggcagccuuccuggacugcucgggugacaaagagcaaugaugcccuuaauacagcaccucaggauaucaugaaugaggggauggacaggaugaucucccacaaugcuuuucacacuauuauuuuguaauuugaauuccuucucuccccaaucuaaucuacucuuggaaacaagcuaauuuuucuaaaagugucuugaccagaaagcauucaugcuaaaaaucugccauagcuuccaccuaucuccagaauaagacccuccaauuugcaaccucauucuaccuuugcaauuuucuaaauuuucuucacaauuuaauuguauuaauagauuuauaagguccuuaugggccaagaaugguaucccgccacucagcaacaccugacacaaaaaccuaacagugcccaauaaauauagacuaaauuugccuguauuaaauuugggaagaaauagauucuugagauguagaauugaaguacacuuccuuuauucuucuggaaucccaaagccuuugguuuaaguaaaacuaugugguuuuuuuuuuuuuuuuuuuuuuggagccggagucucgcucuugucgcccaggcuggagugcagcggcgcgaucucggcucaccgcaagcuccaccucccggguucacgccauucuccugccucagccucccaaguagcugggacuacaggugcccaccaccacgcccggcaaauauuuuuguauuuuuaguagagacaggguuucaccguguuagccgggauggucucgaucuccugaccucgugaucugcccgccucggccucccaaagugcugggauuacaggcgugagccacugcgcccggccaaaacuaugguuuuuaaaaaauuucauuucaucccaaagaaacaggacaauaaaaucuaacaauucuaacuuuuagccccugguuuuagaauauguuucaaggggaauauuauuuuuguuuuguucuauuuauauuuauaaauuccucaggccaaaauuuugguacuauaauaguuuauuaaagcaaguggccacuuuaugcuguuaaaugaugaauaacugccaggcacagugguucgcaccuguaaucccagcacuuugggaggccaagacagguggaucacuugaggucaggaguucgagaccagccuggccaacauggugaaaccccaucucuaguaaaaauacaaaaauuaucugagaauggugugggcaccuguaaucucagcuacuugggaggcugaggcacgagaaucacuugagcccaggaugcaaagaaugcagugagccaagacugcaccacugcacuccagccugguugauggagugggacucugucucaaaaaaaaaaaaaaaaaaaaaaaaaagaugaauaauugacguaguuguauucgaguuguuuccauaaugcuaugagagauacuuuuugcuucuaguauaaauaacagaggaaaagcacuguuuucuaucaaagaaugucaaaagaaaauaacaacucaacagucuacuguggucaucuaugauucacacaaacuacccuaaacacuaaacaaaaagaacaauauaaggauuuugcaugcuuaauguguuuggaagcauacuuuguaauauuacaaccaaauauuuuaagucauacuauggauuuaugacuuuacuauugaauuaucauggccuuugcauuugaagcggauaaaaacaaacugaaggcaaaucuggacuacacgccaacauuccaccaacucuugccuaaacaugucuuuagaauucugucgauggaaggcugggugcaguggcucaugccuguaaucccagcacuuugggaggccgaggcagguaaaucacuagaguucaagaccagccuagccaacauggugaaaccccaucucuaccaaaauacaaaaauuagccacaugugguggcgugcaccuuguaaucccagcuacucaggaggcugaggcaugagaaucacuugaacccaggaggcagagguugcaguggguugacaucaugccacugcacuccagccugggcgauggagugagaucccgucaaaaaaaagaaaaagaaaaaaaagaauucuaucaauggauagaaauggucucugcaaaaggaaaguauaggcuccauuuuaugggaagcucucucagcauaagcuggauacagaacuccugcccauuaccgcuccaaucucugugccagaaacuaccauccacaagcauuuaccuaacgacgacuagcgugcucuaggucagagcuaaguguuggauaaaauccacuguaaggcaugaucccuagaaauguuaauucucacaacacuuugggucuguagggcuuuugccuacagaagccacaguaggucuuugucuuagcucaaaaugcugccuuacugugaauggcuuaaacaacaaaaaugucuuuugucacagcucuggaagcuggaaguccaaaaccaaggugccagcaugaccgaguucuggugaggccgcucuuccuugcuugcagacagccaccuccuugcuguguccuuaugugacuucuucguuugagcagggagaaaaaggcaagcucuuugguaucuuuucuuauaagggcacuaguuccaucacgggggcacauacucaugaccucaucuaacaguuaucaccucccaaagguaucaucuccgaauaccaucuccgaauagccugggguuaggguuucaauaucuaaauuuugggggaacacaaacauucaucccauaacaguccucaauacauacuugaaaaaaaaggggggaaaaaucucaaauggugcuaacacaaaauauuuuuuaaaugcauugaaaggcagguauuugaccaaugacuaggcagaagcaaaacuauuacgauugggaaagaggaaagaauacauaagcacaaagaauuuggaagacuugggauuaaacaaagacucaauuuaaaccauaagauccaaguuaucuucucaaucaaacuuuacaaggguuuauaaccaagagcaaaaauaaaagacuguguuuuuacuuuuucucuugaaccuugcccuugaccaaaaccugguucaaagaaucaagggcaaaaaaaacacuaugaaugauaacaacaaaacaacccaguaacacaaaauacaaauucagagaagcaugagacuaugaaaggagcagaguagauaauucacagucaaaguuauguauuuaucaucauguuaagcuaugcaccaacauguauacugcaaagcaauccuuuggaaaaacaaauuaaacaaugaguuaaacuugugagcaaaaagucaaaacgacgugacggugaugaguucuguugguuuuguucuauccuaggaccagacuguuaacagccaccucagacuuagccagcuaguuaucucuaaaauauuuuggucaugagagacacaaagugagaacgcaaaguaaaaaauucauccaccacuauugggagaaaaaaaaaaucauuaaaugaguagcucugucaaugguaacuaaugguuuccacgcauuuuuuucaaaaaaaaaaaaaaaaaaaaagaagaagaauuugcccaaugacagauaccagaauaccgugaauuuucauggugcugaaucaaacacccaucaaccaggaauucuauaccuaaugaagcaauuguucaauaauaagaaaaacauuguucaacaauaagaaugauuaagaugaaagucauccaacaaaacggaaucaaaauauuaauguaauacaggguuugagaugaucugaugaaaagacuagcuguaaacaaugaguccaguuaaagacagacccuaugaaugagaaguauggcaacagaggagaugguaagauuauaacuuugaaaauauaaaaauaauacaacuuauaaaaccugugagaaggaaacgugguaacauugugagaguauucuuuuccuugccguuccuagcaaugaauccaucaauacgguuuaaaaaauaaaaacaugaaguuaaaaaaaaaaggcaaaacgaacacuuuccaacacacgcaugaaaauccaagccuacaaaugagaacuauucauuauuucuaauuauaaaagaaaaacaccagaauagcuacaauguggaaaguggcaggaagauccugaaauaucuauaaagaauguucuagagaauucaagaugcacaauuugaaagaaaaugucaacacugucuaaaacuucugagugaacuugucuccccugccaccugcucaauacuccccaaaaagccacuuaaaauccuaaugcaugaugcacucccucaccucgcccuguccagccuacaagccuuuucuaauccauacccacuguguugcagcacuggggucauucuucuauuuugcccaugccauuccucaucccucuucuggcaacagcuccucuccccacaucacacggccacacccacaaggccaagaugggcuaguccugauacugagucccugcagauacggugguggcuccaagggcagacguguaacucaaagcagugccaaccagaagcacucccugauaaugcccaugggcagaacaaaguugggaugccaaaccaggacuaacacuaccagaggucguggcuaccaacaucccuggucuccuugaggacacccaucuuagcaggagaaaaggaguaaacacacagcaggaagguaagcagaaacaaaagagacccuaauggggaaauucuaggcaguacugacccucgguuccagcaccuagggaucucauuucuguguacauuuuuaagaaauuggguaagcaucccccacacuacgauccuucccaucagugggagaaaauauucuccauauauaaaauacaaauuguuuaggggguuuuuaucaccuggcaaaagaaacugccuaauuaacccacccuaucuccccauucuuccucagaaaaggagauguucccuccccuuuccaagacccaggcaaucacauauccacuggaucuccuuucugccuaguucuuacagaacugaauaccauagucauagcuuacuguaaccuuguacucuugggcccaagcgauccucucacucaaagcgcugcgacuacaggucugagccacggagcucggccaaaaccuaguucuuaagagauaccugcaacuagugcuuaggauggguaucaguccuucccacaguuuaguuuaagcuuccuuaggcccaaauuccuuccauuuaaaaaucaaaaucacaaagccuuuccuuuugucuucaaugaccucaaagcuuuuugccucuaggucuuuccuccaggaguccacagcugacucaccauugacccacguuguuuuuccugcaauggacuacaacguaacuucuccccaugcuauuccacagggucaacaaugaccuucuauuugccagauccuaacaauguuuugucacacacacauacaaauguccaaaaacaagauaugagcaaaagagauugcuggguguccuagcauugaaaugcagguguugucuugcagacccugaggguggcggggaaaggauuaucugauucuacagcauguuccuccaguugacuugcuacuaaauaagcuauuuuacgacuuacacccuuaaaauucuuacacccuuauuacuuacauccuuacaagcuauuccacacccuuagagcuuuguaaagauggauacugcagacaccccauagcaaugcaaguguuccuguaccauggaaauaauuugacgauauuccagauaauuccagaugauuccuguucauagccaugcaacucaagugugcuggggaaggaauuuuaaaucucuccaagucaaaaugaaccauuuuucacaucuuacaguucaucucauuaaugaauugaauaaaauauuugacauguguucagucugcaugacagacaugauuuuaccaugucaaaaacuacacuucaacugcuuuccguuugcaucaugcuugcacucuuaucuuuccccucauuuagaaauuuacauggcuugccuuccagcauguaacgccuccuacuuccuauccuaucucucuggccacugcucaucucccucauggggaaucgucucucuuuguuugccuucaaugcugcaauuccccaaggugcuuucuucgguucuucuccacaggugucacugaguggguaaaaugagugcaaguacuuagcauaguagcugacccuuugugacccuuugugaaugcucaaugcugaugguauuagugucacugucaccauguaguuuuuagauugcuaaaauuaugauuuuacaagcuuuucucccccuuugaagaacaggcccuguguucuguucaucaaugcacccuuaguauccaaagacauuaugucugaggaggaagagagcaccacaggguucuagaaaggcauauaaucaucuuacauccaaauguauuuaaugaaagauguauuuaaaaggaccccaaacaagccuuguucccugacuugcaacaugcagugaaguucugguugaagguauggagggacucauuucuaccucccucucccacuugccagaucaugggaucuaagacccuuacagcucagagucacugguggcucgggauagcacagagaacagcacuguuccacggaaacagaaugcaacugccuauggaaccucaauuuccucacugccacgugaaacgucaaaagaaacaagugaaaucaauuuuaaucacauaguuacaacucaguaacauuuaugauguauuuaacaacauauucaaaacauaacuauuucaauguuaaaccuauauaaaaaugaaugugaucauuuuacagguuuucucacauuauaucuuugagauacgguaucuaucuuacacuuauagcacacaucaguuuccacuagccacauuucaagugccaaacaaccacauagggccaguggcuacaguacuggacagcacacggcuagaggcugcagcauggcagucucugggagaacgaagauauaugguaggggacauagugauaaagcaagaaggugauuuguuuaaaugcaaaucuacaaucacuccucuucucugaaaaaauaaagucuaggccgggugcggguggcucacgccuguaaucccagcacucugggaggccgaagaggguggaucgcaaggucaggaguucgagaccagccuggccaacauggugaaacccugucucuacuaaaaauaaaaaaaaucccggcgugguggcaggcgccuauaaucccagcuacucgggaggcugaggcaggagaaucauuugaacccaggaggcagagguugcagugagcugagauugugccacugcacugcagccugggccacaagagcaagacucugucucaaaaacaaaagaaaaaaaaagaaaaaaauaaauagauaaaaaauaaagucuagugacuuccuguugcuacaaaauaaagcccaaauccauuaaaauggcucacaagguaugauguuuuggcccuuucuuacuuauggcgccuaauguugaagaaucuggcugguguguaucauccaacaagacuuccgugggugggugguaggcagaggacagauaauaccagaauugcaagaggaaggugacagcaaagggcuaauucuccccacucaugguggccaccaacaaucugguaaaguccagaacugggaagaaccacucugugcucaacccuuugauacaguuuggcucugugucccuacccaaaucucaugucgaauuguaauucccaguguuggaaguggggucuggugggaagggauuggaucaugggggugguuucaauguuuaagcaccaucccucgagugcugucccgugacaguguucucaugagauccggguguuugaaaguguguagcaccucucccuucacacucuuucucuuucuugcucuggccaugugaacaugugucuucuuccccuucaccuccugccaugauucuaaguuuccugaggccuccccagccaugcuucccauacagccuuuggaaccgugaaccacuuaaaccucuuuucuuuauaaauuacccagucucagguaguuuauuacagcaaugugagaacagacuaauacacccugggacaaacaacaggcuaagacagaaaguaaagcuacccaggcauuaguaggaucucuaagugaaacgggaaaagagggguguuccuggggucaagaagaguaauuuuugguauggccaccauacaaaugugaaaacaucugguuauucauacgugaaacuaagggaagaaaaacuuagaugcaaacuaugacacauguaucaaaauagucgauucaccagaaaaggacaauuuggucaaugucauaaacuaaauuuuaauucuagccuuuaaaaaaaguuuauuugacacucagaauacauagucuguaugcauauaucaaaaaaaugguaucaaaaacauauaaguaugcacagaguucugauuuauaaaauuuauaacuuaucuacacaauuguacuacaagaacucuucagcagaauguaaauauuauuucuaacauugacacuuuauaaaagucacacccaggcaaaagcugauuuauuaucaauccauacuuaguaaaucagcacacagaauguucuuguaaaaauacauauaauggaccauacgugguagcucacggcuauaaucccagcacuuugggaggcugacauggguggaucacaaugucaguaguucaagaccagccuggccaauauggugaaacccugucucuacuaaaaauacaaaaaaauuuagcugggcgugguggcgggugccuauagucccaucuacucaggaggcugaggcaggagaaucauuuauacccgggagguggagguugcaguaagcugagauugcaccacugcacuccauccugggcgacagagcaagaugucaucucaaaaaaaaacaaaacaaaacaaaaaauacauauaaugaacuuaaguauuagugauuuccacuauucaucauuucacaucaugguucauacuccuuucaagauaaaaauuacuuaauauguaauauauugugauaauguagaugcuuuuugcuucucaaaacaccaauuaguaauuagagcuuguccuuucuuaaacagagcgcuaucaaaacaaauuaaaccuuuuaauaauaauaauuuuaguauuuacaauuuaaaauaaaaggaucucaauagaauaguaauauuaauuaaacaacaaacauucauuauccaaguaggcuaaagaaaaauuucuaguacaaaaaggauuacaacaaaagaaaauguugccaggcuaucugcuguuuauaaugagugucgagaauucugcuuugccaacaagcauaagacuaauuacuucuaauguucuuaagaugcagucacaaugcagagauaacuaucuaagaagugugagauaaaaugccuggaacuccagcuauuuuaaauugaauaagaaaggagcacccuguauaguaacagcaaaaagacuacaaagaauuaaacaaaaaugaagaucuccacgaaaugacaaaggaugauuuccaggauacaaaguuaaguuaaaaaaaaaaaaaaaaaaaaaagcaaagugcagaacagugaacuuuguacuuuuuuuguacaagaaggaaaaauauguauuuucuuuugccaaaaaaauaaaucaggaacaaugaaaauguuuaucaauagagaaugagugaaaagugagcuuucugaguauauuucauagaacuaacaugauagucaaaaaguaaaauuaauaagggaggaaaaaaccaaacuauaauagaauacaaacagauacaaaugaacuaaaauauguaucaagcugguaacagaaaaaaauuaaugcuagcacuuuuaaccaaaagaccuugacuguagagccguggugagauauauacugaagaugaaaggaguguggagggcugagcaugguggcucauacccguaaucucagcacuuugggagguccagccagaggaucgcuugagcccaggaguuucagacagccuggccaacacaaggagaccccaucucuacuaaaaauuaaaaaaaaucagucaggccugguggcaugugccuauaguccagcuacuugggaggcugaggugggaggauugcuugagcccaguaggucaaggcuacaguaagccauaaucuugccacugcacuccaaccugggugacagagugaggaaaaaaaaaagugcugugacaucuuaaacuacuguuuagugauggucauaauacgacaucauaauuuuaaaaacauuuauauguauaucauaggguaaugcaaauaaauauauuaaugguauggugaaucauuaggaaccaagauuuuuacuguaggguuaaaauacugaugcaaaauacaagaaguuaaauuuuuugaaaacaaaugcaugugauccaacgugaauugcuagccaccggacaggacuuacuucuuggcaauacugcaggaugccuuccuugguaucaaugcagguuuuggucccugauggaucugaaucccacuucccauucuggacauucaugugcauguucagucugccacagaacauggcaaucugggguucagccagcaggccagcauuaccaucaguggguaccugaaagaagaagcuucaguuaguuauaguauccauagcuccaaggcagaggcuuggaggaagaacagggauaacuaucaaaaagaguucuauucuugcucauucucaauuaggaaucagcccggucuucaacacuccuuuagauuaaguguuauguaugcuacagauguucuuagccaccuauaaggcaaugcuuucuuuuauacuaaaacagagaaggaaauuaccaauaccgaaaggaauuuauucaugaaaaauuuacacguuuucccauaugagauuuugugguaccugcugaaagguucugacaacaaaauuacacguuuuccuauaauaaauauaaucacuguggaggcuaccgcauucuuauaauaaacuccacugacucacacagagcaugaugccugccaggcccugccugaugaccaagacugaaaauaauauuugugccaccucucagcacugagagcaaguauggcguugguaguuagcaagugacuguauuaugauuuugaacagaaaaauucacuguagaauucaccauccacaaauauaacugaguauguuggcgaucccuccugguuucccccagaauauucucugguuaucagucucaacucuuaacaagucuguuaagagugcuggugucuccucucccaaccaucugcaaggagccaacauuuucucauuuggagcucuacauagugccugcuggguaguaaguaagggguccuagcuauuaccauugcaggcaauagaccacuucacaaaauaacuucaugaaaaagggugccuucuguauuuucaaacucuucuguguacaggcauuaccuuuacaaaaauauuuuuaaaagagaaaauggaaguccugaaauaucuauaccgugucacuuaacagguucugguaucucaaaaagaaaaaaaaauucagcaagaaaugaaaaauauauccacaggaguaaagguguuauuaaaccaaucaauuagaaggcauauuaaucaugauaggcccucccuugucaaauccagcugcuggggaaaugugagacacccaugccaagaagaauuaacuuccagcagaagccauucguucacacacucaagaacugggugauuccacgauaacuuguaucauuccuaaaaacuguccacaggaggaaaaacaccaacuaaaauugcacugagaaauuuucaguuaaagaaaugaaacaguuuccaaacauuucuucccacauaaauguaaaauaagauaccucuggccauuuuagucauuuuuacacauacuucgucaaaacccaacagaggacuuagguccuuacaacaaaaaaacaaaacaggucuuagauugaaccaagucaugagugcaaaagcugcuggcaaaaucucuagagccauguuuucaaguaacuuuuccaauauuuaacgaaauucugccuuuacauugccagaugguuaagucaaagcagccgaugccaaaauauccagaucaucugcagaaauagcuagaaccccucaacuccaucugagccccuugccacuuccugugacuuccaugaaacuggggggucucauucucugacagaugcaaagcagcaggcuaaguagaaugcucuauaaauuuaaauuucacagcuuuccugagggauuaagaggaaauucauugucuugaucuuagaaaucgaaaugcaaauguugucaaucuuacugaaauaaguaguauagauaauaacacugcaaaaacauuaaagaaagucaaauaauaaucagauaccuguggauaaggcccuacaucagaugcuauggagggcccugcccguaaggaauguacaauccacuaauggaaucgccauuguucccacaguacuuuauucuguucaccuuccgaauucauuccugucccaaagauuuccagucuuggcagcauguuguuaacuguacggagacacuaaugagccuuuaccauagcugguaaauauucuguugaaacagucuccuccucugccucaaacucucucuguacuuuuguuuauccacaaucuguucauuacaaugucuaaggaaagcguucuaccuucuugucaauacaaaugcacuugauuccauuuccuccccgcaaggagaggaaauugacaauuucucuccccaggguagccagccuccaagaaggcccccaauagucccugccuccugcuauucauggacccugggaaacuccacaauguaucagggucugucugugcaacaaauggaguacagcagaagugaugaugguguaacuuccgagcauguauauauuagacuuaaagaugcugcaacucuuuuaaaaacaaacccuuugcuaccagaaaggucacugaagggcaugaugauguguaacauccaaaacaaggucaugaagggcaucacaauucuucauugcucucugggaucacucacugugagggaggucaucagcugccauguucugagacauuuggugcuaaaaccaggaaaguuuuuggcaaaauacacuggaucacccuaccugacaaaccaaguaaaugcuucauuuuuuuuuccucuuuugacuuaacuuccuuugauuucuucuauuuuucacuuugucauccucccugcuucuugacuuuacagcuauuuuaaugucaucuguuggcauauguguguaugcugacuaucaaaaagugguaauuuuuuaaacauuuuuuucaaauaaauuuauuaugacccuauaauugucucauguucuugccauuuuuuaaugccaucuguuggcauauguguguauguugacuaccaaaaagugguaauuuuuaaaacauuuuuuucaaauaacuugauuacggcgcuauaacugucucauguugucuucauuuuaacaaugagaguuuagacuagaaaauauaugcuucaguuccugucagguuuuccaccagaugagauuuaauauuaacuuuaaaaauaaauguuuggagaaucgugaugauuaacaugcucuauuuucuucaaguggagaucauuuaauaauuuaaacugcgaauccucaauaauaggguaagcuguugaauuagaaauuguaaaauugguuguguguauagaucuucuuacauuugacauuacaagaggcccuucacaaauaaauaucaacucacaaaagccauguuucucaaguaaaauuuuuuccccccgaaccaacaccagauguguauauggaaaucagagcaauuagcuuggagauacaaauugaaccagaaaccuuccuauucuuacugaagcccaucugcaaacaauuccaugcuuucacuacauaugccugucucccugaauuaaaacaagacaaacaacucacggcauccucaccugcaucaaauaacccauuuaugaaacaaagccugguugcuaagcgcagccacucccuggcauucagccagaaggaaauguggccacauuaaacauugccauccaaggguuaacucccuuuuccugagugaagccuccaagaaaugacuuaauaaaugauacacaggguccuauucaggaucuguuaauauggacacucuuaaaauugaaaucuuuuaagauucaauuuaccugccaaauaccugaaaucuggcagguauuugcugccaguaaaaaagcacagucuuacaaagucauccuaaagauaauuauuccuaauuuuuuaaacauuuuuauuuucuaaaagaaaagaaauauaaauaccuuaguagaugggaaauauaaccacuuaacuacuacauuuuaguucuauuuaugucuuaacacuauucuaaggugaguuaagauuacuuugcaaaaaucuaagacaacauuuaaaagaugagaacugugauauaacuggccguuuguggucuaugcuuuucuaagacugaauaugaagguaauucuuguaaacugaaugacuugccacugacaucauaaaacuggagaugcuuucccaugggaaaacaguguuccugacaaugaacaaaauaaccagcuaaaaacaaugaagcauucauaaauugccucaaaagcaagaggcuguuuaccaagugcucugaacuacagagacguacauaucaaacuuaaaaaugcuacaagucuuaaaaacagaaagaaaauauuuuuguuaccagaaaaaaaauauuuuugagccacaauauaaagaauacugaagugaaauggacuuuccaaagcaauuuuuagaaauggcuuuaaaagaggcuuaaggggauaacauaaacgaauauaaacauauauaccuaaucuggaccagucugcagaugugaaucuggaaacccuacgccuacaguugcuacaauuuucaauuaaaugcaaagccaccuucuugaacaaguucucuuguuguccuuucaaacaggguguucccuuucuccaaaaaguuucucucuguuaucaucuaggagaucaaaauuccuuauagagcaggcuuggcagcauuccuccccaacagggucucaacuaggagggaaaagugaacaaggagcucucuguuuugcuagcugagagguccuguuuggcaaggagagggcacagauccauagcuuaguugcauccguggauuuauguaauuuuaagguuucuggcuaaugaaagccaucuguuuucugcauuugaaccacccgcugacuagucuaaauagcuggccucauauaaugaaguauuugguacuuuuuaaucaguucaaacuucuucgagucagauucuugcauaaucucaguauuuuuuuuuggauacacugucacacuccaccacccagacuagagugcaguggcaugaucucggcucacugcaaccucuccgccuccuagguucaagcuauucuccugccucagccucccaaguagcugggacuacaggccugugccaccacgcccagauaauuuuuguauuuuuaguagagacaggguuucaccauguuggccaggcuggucucgaacuccuggccucaagugauccuccugccucggccucccaaaauguugggauuacaggcaugagccacugugcccagcuuuguagcgauacuauuucuaucacauccaugguuuccugacauaaauacuggauucccuuaaccugggcauaauucaacuauaccccacaagagugcuuuacauuuucauauuaaaacauuuaaauucuccauugucaaauguaaagaacuauuuucuagaaucauaaucuagaaaaucugagugaaccccuuucaggggaauaauucaucuguaggguuuucuuuuaaaugccaaaaaaguauuuccaguguaagcggaacaucugcaguugcucauuucaucacuaacagagaacugaaauuaaaaucagaaucacaaaaguggaccauaagagggaggaaagggcaccagguaaggauauguccaaggccaugggguuauagggacagagaagggaauucaaccuauuccgucaaggguucuguuaaugugaccgggcugucucucaaauuaaaauggaaaauugcaauuuuccaaggcuuugccccugugugugugugugcauguauuuguggugagcaaaaauagagaagcuauuaaaaaagaaaaauaaaaugugaugacugaaacugcaagugguuucuauuuacccuuguggagaguugccacaucuauucacagccacuauuugcuacacaauuauuucagagcuugaguuucggcuuaaaaaaugauuugccaugaaagcgaauaggagaaaaacaauuccuuucagaggaguaaucuacauauuucacuccuggaaaccugaaauucuuuuugggucacuguugaucuggcuucuaauuacaagcuauccucccuugauguuuuucacggccucuguugauauuagauuggugcaaaaaucgcaauuacuuuugugccaaccuaauaccaagcuuuuuuacuacucaaaggauagauguucucaaguugacccaaaacuccuacccacucauaagaaggccaguaagucaugcuugcugcuggugcccaguaggaaaucaagaggucccucaauaggagucuuuguuauucacuacucgugaaauuaauaaccaacauuugaagcaugcauuuaggcaggacccaguaagaguggcaucuacugcuaggacugauauaaaugaauauaaaaguggaauuacaaaaaauagagccuuaugcauggcaaacaaacucuuagccucaaaaacaguuuacaaucuagucaauguccauuuagucuuaaaaggugaauguuuucuuuuaacuucauauauauacauacacacacacuaacauauaugaaaccauacacauacuauauaguaugugaugaaaugagcgagauguaaaaaguucaucucuuucauucugucuuuacaguuuuucugugugucuuuuguuuuguuucguuuucugagacagagucuugcucagucgcccaggcuggagugcagcggggugaucucggcucaccgcaaccucugccuccuggguucaagcgauucuugugcuuuaaccuccugaguagcugggacuacaggcgugcaccacuacgccuggcuaauuuuuguauuuuuuaguagagacggguuuuugccauguugccacuccugaccucaagugaucugcccgccucggccucccaaagugcugggauuauacgcaugagccacaacgccuggccugucuuuaaaguuuuacugacaugucucauacagucaccaaagggaaaaaaaaaugaaaaaaaaauauauauauaguauuugagaucuuuauccuauucugacucucucaauauugccauaucucaucagccuugaccuugugaacaugcagauagaaaaaggguuagaggcaaaaaucaaagaccuacuaaggccuuugcucauuaucucauuugacucagaaaaaccaagauaagucacuuccacaucuauuuagauaaucagaagggcucaaaacccgccuagagucuacucaagaguguuauuccaaagcacaugcuugcuuuuugacagaacaagccagcuggcauuccugguacuagaugucaagcuuuuuuaauucuucaaucuugaauauuauuuucaaguaauuuuucccccauggcaguacuauuuugcaugucuuuguuacuggcuuuuaaaaaaauuacuuuuagagcaaguaaaacgggaagcaaacccacagcuuaaaugucuaauuugcauuucucaaauuuaaaucacuagauguuaauaucuacuaaccucugguaguuuccucuuuaagaaaucucuccugaaaugcaaacacaaauuucuccaaaguuaguucuuuccuuaaaucuaaugcagccaacugaaucugcaaaguagaaguccaaaucucccaauguuccaacuacuaauguuuaucaacccuuacuuuauuuaauguguauuuucuaguuuuucaacaguugacauauaccuaccuauguacauauacacauguauauauaccugcuauacagcuacuuguaugguauguagugggagugcuagaaugaacacacacacacacacacacauauacacacaguuuaagagcucaauuugcacaaaucucaaaugcugguacuuugcuaagaucucauucuagaauuagugcauuuaaguccauguugcuaacaagguggaggacuugguaacugggcuccucagagagagugguuugaauggcauucacugaaauaaauuugauaguaacaaauaaaugauuuuccaguauggcuucuacuuguucugacagcuaggacagauuagcacccagcacagaauacaacaaagaaaaaucaaaaucuauuauuccucuucauuuuugguacaagagauauucuacauauauucaauuucuaaauuucuacuguuuuauaucaaauguagccaagcuaagccgggaucagcugacccuugagcuugugggcuauaauaaaugguuauuguucuaagccacuaaauuuuggagugaguuuguggcuuugcagcauuuuuguggcaaaagaaauuaacacagucauguauuugauaggaauaacuaaaauacuaagugauagaaucaaggcauagauuguuucagaagguagaaacuuucucaaguugccuuuuuuuaggcagcugggaguacaggcccauaccaccauaccuggcuaauuuuucuguagagacaaggucucaguauguugccgaggcuggucucaacuuccuggccucaaguguuccuccugccuuggucuccuaaagugcugggauuacagaacuggucaccaugccuggccauaaauauuuuauauuuaauguauuauguaagguaggaucaguuauggcuuaugaucuauacacuuuggguuguccuagaauuggaaagaaucugagcagaggcaaauagaaugauacuguaaacacauguacugaagcuuuuaaggagaugguaaucaaucuuugcaaucuuuagaucugauugauuuugugagcuucuuuucuccuacauuuuuuagaccucugcaaaugauaaacaauuuguacaaaggcauaguuuuuaaaaaaaauuaaacauauuuuguuuacacaauauauuucuaaaaggaaauauuucaaaucugaaagcaaucuaaugcuauuaaauagaccccguuccugcucauaccucacauguggcuaugugaauacaaaaaucuuauaauuauacuucucccagcaaaggacaugcaaauuucaucaccaaacauucaugcuacugcaaucacacuccaucaagccauauguguugaaaucuguguaacaaaagcagugagggcucuugccacacguaggcucccgcccagcccucuccgggagguagguauguaugcagagaagagagugggcugagaaauggaauucuggcauguugggucaagcagacugaucaugugacacucgcacugagauccuaccaaauuucaccauguggcagagucagcaccaaacaaaucccaaaguuaaagccucaguuaucaccuggguuuugcugcauagaccuagccaaauauguguaagaguuaugagcucuagacauaauuuauuuuauugcccugaaauagaguauccccacauaauuugcaaguuuaauugcaauuauauuccugggggucacuccucauaccugcacaguuaggauauugccagguuauucaugguaccucacacaacaccuggcaguuauacacagauccucaucuuuuuuuuuuggagacggagucucacucugucgcccaggcuggagugcaguagcgugaucucagcucacugcaaccuccacuucccugguucaagcgauucuccugccucagccuccugaguagcugggauuacaggcgcgcgucaccacacccggcuaauuuuuguauuuuuaguagagaugggguuucaucauguuggucaggcugaucucgaacuccugaccucgugagccaccgcgccuggccuuacagauccucaucuuuuaugcaauaucauauucaucacuaaauaacgacacagcauaaaaaugaacuuuuacuuuaucagugguacuuuacagcacuacagugaguuuucuagaguuuaaggcuuacgcuaauaugcuuaaugcacaaguaagugcaaacuuaacagguuucuuucugguucuuuuauuuuuccccucuauuucuucucauugacccacugcaauguugacccacucggaacguagagcaugggcaaaaaaaagaaccaagagaccauuagagaagagaauaagucuuugaaaagcugcaggugggaauauaauggaaaacaagauuccagaagagguagugggucuaccauuuaacuagaacaugcccaguagagccauacugauaaaucugcaucuuagaguugcugauauacuuggacaaggggaaaaagaagcauauuccucuauccuuugucagcccagaaauuuaucccaacccuauuuuccuauacaguuucuaccagcuuucaggcgucaggccauuguaaaaccaacauagguggagagggcaauucaggcuaggauggggagagguaguuagcgggauuuccaguucugggcuauagugagggagucaguauacacugcugagucugguacauacauuccacauuguccauacccuuuaauaucuuuacaauuucuaauaccaaagugguaugaaaauacuaaugaaguuaaagacccuuaccaaaaugcuaauuuuccagguuaaguuaucauauugucuucaaugugcauuaaaaucucagagcagcuaucgggggauaaggagagugaguacccacuaagcuuggaggccagcuaaacucucuagaaagucauuuccaucugacuucccaccagcaugaggcagagcaguucagagcauuuuucaagugagucggccugccguuaccaaugccaaauuuaaagcacuuauauguuuuaucacaagcccaugagcuugugauuucauaaaaugguacuaacugguccuugccaugaguaaauucaaguaacacguaugaagaagauuuuaauaaaauuuuuuauuagaagauuuuaauaaaauuuuuuuauuaaaagauuuuaauaaaauuuuuuauuuuauuaaaagauuucuuaaaggucauuaacgcaagucauauuagaagagaucacaggcaaguagacaaaaagaauuuacuccgugaaagcucacugaaacaggaauucggauauuugacauuuacuuuuguucuugucucucauauguacacaucaaagcacacacauucacauggauguaaagauaguaagaggccaccugcaaucagaacaagugagauuauaaauaaguauauuauauaagaauccaagacaagaauuccuuacuuuuaaggaaagggcaucagagauuuaugaucuuagaccuuuaccuuucuauuuuuagcagauuuacagaaauauugcaggaacagaacaugaagucacuuauuuuugauaagcacaaaggauauuuacauuauaucgucugguuuauuuccuuucaaagugucauaacauuuacucaucagccuuuacugugugcuuauaacucucauacuguugugguuuuauuacuaggauuuuuggucuaggagaaagcugcuuuacaaacauaauagaaauucagugagaauauuaacuugacauaaaaacccaagauaauuuucaaacagcauucuuguucauuguucaaauuguauucuguuaacuuauuuaguuuaagccaagauuacuucuuuuccugcagacuuggaacacuaaagaauacuccagguuuaaauuccagguuauuugcuugauaagccuggguagauuguccuucuuaaauaacuuacaccaaagcacuaucaaagaagcucucccuuuguagagcccucagauucacagaaggaauuuuucgaauugccauuucuauaggaauaaaggcuaucaggaaccacaauacuaggagaaaauaauucugaaggggagguagcagugaagacucuuauuucuauuuucuugacuauauuuauaaaaaauuguugccgaaagaacagaagaccaagagccaaaaaucacacugcagucuuacucuuggauguaauguuacuaucaguuucagugacacaacaucagaggcaaucugauauugacaaugguaaaaauaugcagacgccaauauuaggagggugcaguuaguugacaguagagccuauaaguauucaucuaaguuuucucuguuugaagagaagaaaagagaacaucaaacauuucuaguauauagagcaaggauuccuaaucuuuuuuuuuuuuuaaugugcaaacaagacaaaaguuacuucacugucuagggguuauucccuacucuuuagcacuggccugacucucucacucccacauauaagcauucaauaaauacuuaugccaacaauuaagaaacaccuggcaugaaaaauaauaacaguaauaaacuagaagguagaaaauguaauuauugacaaagguguggaacaauacaaaauaaauuccacuuuagauaccugugaaauuuuuuauuguggcaccaggagaguaauuuccuaacagagaaaagaaaacauagcauccacaccucugucuuuaccaauuccuaaauaccagcuacaguucaacuuguccacggacuucaggcuccuccuagaaaacaagaaggcuuaaaaagcaagacaaccuauuagcuauguugcucaauaaauuucaauguuaauuuccuaauucuuugauaacacauuccugaacuccuuuguaauucaggcaacauuuuaaaaaucagaugaucuaacuggacuccaagaauuacauaaacagugugagcagugagacuucgaaugugcaaucaacuauuuuuuuaauccugcugcuaaaagccuucaguagcacagaacugguugucagagauuucaguguaaccuaacaccuaacgugaaugacugcuguacaaaaauacagcugaaaauacuaugaggaagagauagaaacggauuguugauggcuaagcaaaacagcaaaugcugaugguuaucaaacacaugccguucccacucuacacagauaagauuucaaagcuguuugaguccuagguuaaguuuugggcaaguucuggcuugaugccuuauauucagauaaacauuuuccaggcagugaacauauucaaaguuggggacagugggguaacccgaaaacauuccugaccuugauggacagauaauccaaugguggagacacaaauaaggccaaauuggcuaaccaaaggugcuggaguguuaaugcagaggucuggcaaggguacaccgaagagcucucaggaaagagugacugguuugacuuggagaaggagaaggaaggcagaccaaagaucagagcagaaaacaugcccaggcugaguaugggucggacaggaagcaugaaagguagcacaaggcuagcguccaaaugaccuugaauuuguaauaaacgugugaagucacugggagcugcugccacauuccaaagcaagcaagagcagcaucccaccaguguaugaggaggaugcgggggccccaggacaacuuucgugggccucuuucucucuuaaaaaaacauuaaaagcuauauuuuagggcucuguugauugguauaaagacaacucuaagucaggcuggauucauuauuguauauucaugauuauuaucuuguucuuuauuuuuccuucugauuuuaaaagaaauuaaacauuuuugagggcuccuaaagguacugcacagccaagacuacggucugacuggaagcaccaggaguaacaggaggcaguaaacaggaguggagguagggaagauucuaaggcuuguaaauuucaaggaugagcacauucggugcgguguuuagggggugagucuagagugcuuucauggccaaggucaacaggcauuauuagagugcaccaggcuacagaaugugaguuuguccugacgggggugggggagaaaaagaaggaaaacaaucacuaccucccugauuuauuagcaaacaucccauucugucuagccccacaucacaucaggaguucuaagagucaaucuggcagagcaauucaucuacguuucauugccuugagugaugggaacuuauuuuaauuuucaaaacuagcauauguuuaacagacuugugcagagcugccuaugugaccuggggaaaaaauuaucuggacucucaccaugcagauuaucagcuugaauugcuaaugcauuccuuacccccgacggaugucuuuuugacaugucuacagaggaauaagcccuaaaacacagaaauaacaaacuguacaaucuauaucucgcccuugggcaggagggguauugcacugugugggaaagauuuacauucuaccaaaaaaucuaagcaaagaguauuuacauaagcacaaaaauuuuuucacaaacuuguucaaauaaacuaagagaagaacacaacugugaucgcaaaacagauaacaucacauagauucuggcuucugacuuuacugcuguuguucauagcauguaauucuagauaauaagaauuuuagguaauuagaauagaagugccucuucagaugugcuaaaauguuacgugcauggcuguuucuaaagagggaauaauguugguguacaccuaacgcuaaccaacugugcccuaaugaagguaaauccccaaauauccauaacacucacuuuguuuucuguguacggccaaucuccagucaagagcuccuuuacccugacacuagucucacccauguuguucagcuaugcagugguucuccaacaggguaagcuuguuaacuacauggguccuaggccacuuugcuuuuugagcccuaugaacuguuucuagguagagguucaaaguucuuggcaaagaugauugucacgacuuggguggugcuacuggcaucuaucuaguagguagaagcuagggauguuacuaaacauccuacaauguacaggcagccuccgcuguaggcccucccccacccaacauaaacaauuauuuggcucaaaaugucaguaauucccagguugaaaacuccaaccuaagccuuuacuuagggggaaagagucaugucuuacuguucucuguauuucuauuuguucacagaacaaaauuagcauucaaauauugguugaaccaaacagaguuuccacucaaaacauaauuaauccaacugacaucauauaaaacaauaacuauguaaacuguaaauccuacaaaauacagccucccuuccacagaagcaaaaaaaaaaaacguuaauuuuuaaaagguaguugguguaucaaaaguuauuaacauuaagcaagauaaccccuucaacucaagauuacagaagauugccccauaauuauuucauauaaaaugaucaaaaauaauuuuauuguauuaacucccugugggucaauuuauaauaguaaucuuuuaauuaagaaaucuugaggguuaauuauccagcuuucauuuaaaaaaaaaaaaugaggugguaacuauuucugggcaaaguucaccaggaagcaagacaaugcacucauaacuaggguuccaagaccaagcaagccagucagaaucucucuguagguaaagacuuucaaauucuagccaaucauuucauaaugaacaacuuagacaaacggagaaaaggcuuaaaaacuggaaucucuuugaauaauguauuaacucuacuggaauaacaaauauauacuaauagguuacauaaaucaaaagcccuaugaaaauauauaacuaaaaaaauuauugcuagaaaccucucuaugucuuguaucugcaacuaugaacagggucuaauccaucacugucuauaucucuagagaccucaggggacuuacagcugggucagggucacuguaggaacuggcugaagggacccacacaugaaaguaccaauaugaucuuuggaaucaaaaggcaaaagucaauucuguauuuaguaauuaccagcuguuuggagaaagccaguuaacuuuaccucuugauuuccuuuaucucucaaauggacauaguaacaucccaccucacaggauauuaugaggauuaaaaugcaguaauauacauaaaauggagaguaagcacuuuaagagcuaaucauauugucucaacuuguaucuagcaggaagagggaaaagaaaagaaaacuaaaaugagcacguucguaagacaucuggggagccugaacugaugaauacacagcauuugaaaucuccugcgagcuaucccuacaaagauaccugcuauuuauucaggaacccugagagaggauuuccugcacuaaagaaaaugcugacuauauaaccacauaugacacacugguuuaaagaaugucuuaugccauuuaaaauagacaaucuuuccuuguuuaucugcaagacgucugccugccaaguugucucuaaaagagacaaacugguaacgacacugcaacacgugugucgucaaccccagcuacacgcucaguguggcagaucugacucaccaagucuacauaguauuuuuaaacuaucuaagauauuuuaacucaugcaguuuaauggcaauuuuagcucuuuucagaaugucugauauaagguucaugaaguccacucugacaauuuacuauccgugaaucacaaugauucuaaacagagcuaagaagcaaauuucaagauauuaaauuuuuuugguucauuucuuuagccacaguauuaaauuuguuucuacacagaacuucucuuguguaagaaauuuguuauugcaugcuuauaccacuaaguuauuaaauauaucacuaguaauguauacucaaaauggcccagugagguuuaagacauucguuucgaaguaugaauaaaugccucauuucauaucuaauucaguguucucaaaaacaguuuucagaaaaugucaacaguuauuaccugggaguggggagaauucugucauaaaacacauaugggaaauggaucauucaagauggauacuggaggcuuuugaaaaaaaaaaccguaauaaugaagucaguuuaacuuuuuuaaaaccaagguuucccaaaauguauuugaccgugggccacuuccauugugacacauuuaacaugcuuggaacugaauuugaaaaauguacuaagagauuugaaauggaugaucaagcaaaacuuaaccagaucauucugagugaaacaaaauaaacaaaaccaaaagaagccuuaaagggaacaaaagcaggaguguuaccaagcuccugcagaaaugaugauuauaauaacacaucagauuuggcucuaggcaaaauaauuacaugacaugaagaauugagagcaagaaaagagaggauuagaaugaaggaguguuuccaaaggccuaaaauauuucagaagcaaaucaugagcauucagaaaaugccaaaaggguacaagucaagaauuuuauaaggucccaaugcaguguaaaauuccaggucuuggacaggcaccauggcucacgccuguaaucccagcacuuugggaagccgaggcagguggaucaugagguuaggaguucaagaccagccuggccaagauggugaaaccccgucucuacuaaaaauacaaaaauuagccaugcgugguggcagcugccuguaaucccagcuacucaggaggcugaagcagagaauugcuugaacccgggaggcagagguugcagugagcugagaucacaccauguauuccagccugggugacagagugagacuccguuucaaaaaaaaaaaaaaauuucaggucuuaggucuuuuaaacuauacaggugaacuaaaucauggugguuuguuccaaacuaaguuaaauuuucacuuagcgauauaaacgugagauggcuaaugacaagcagaugcacaaauuuuaucacaucccuggauuccuaaauugcauuugugaaauucaauaaagugacacgaaguauagacaauaagugaauaagaacuaagaacagaaaaaguagaagacauggauaucugcagcaaagcccacacccgaggggagaaaaacauuagugcuguuguuuccaugauacgagcacagguuccuacacugauuucacaauaaaaaauacaaauuacuucuaauuuucccauuuucacacaagugaaagagaguucagcccaauuucugaauuaaauuuuccuuccuauagagggaaggucuuuagaaaaucuuuacaaaauaguacuacacaugccuugugauauuagggugauacggugauaaauuaaaagcaacagguaauuaauaugauuaauguaauacccagagaacuucacuauuucuuaaauguuuuccugagauguuauauugaaacguugugcuaaaugucauuacauaaaauguugagcaucacacaacagcugacaaacuaaccuuccaaaaagaaaggaauagauggucauucacacgaagguuacauuuuacaaacaaaacuggacacacaauaccauucugugauguuuaagauacaacaaaacauguacugcuuuuuuaaaaauugcuguaaugaggcucucacaguuauucacguuuuauuuagcuacaaguuuuaagauaucugugaaagaaaacuucuuuguuuuaaguucuuguuugaagaucaccaagcuucuauagugucucucugaaguggugacacgcugacuuccaggcacaagccaggcacaagagaagcucugcaggaaacagcaaggccacucuccauaaggagacaggcuuggccaugacaacuguggcuuagagcugaggagcacagcaacucacaacuaaugucuuugaauuuuagguaccagcacugagaaucaaguuccuuuccauguuuuaagaaacuaauaaaauccucaagaagaccuguuuuagauauucaugacauuuccuaaggcauucuauaauguuaaaauacuuagaaaugacucaaccauuuggcuaagcuuacgcuaagggcaaauuccuguuucuagaugcgucaggucuggacagcaccaauaugugagcuucaacacccagagacuugacuucuauuuagcaauuuauauuuuuaguaguagccuucccuuccuuccuuccuuacuaucacagaaaagaacaaagaaaaaaaaauucugcuucaaaagccaaagaguucacuacuaagaauaaauucuauuaucuuccuuagacuaugccuauuacuggguaauauaaauauauguuguuggucagaugcaguggcucccgccuguaaucccagcacuuugggaggccgaggcagguggaucacgugaggucgggaguucgagaccagccugaccaacauggagaaaccccuucucuacuaaaaauauaaaauuagcugggcgugguggcacucacccguaaucccagcuacucaggaggcugaggcaggagaaucgcuugaacccaggaggcggagguugcggugagccaagaucgcaccacugcacuccggcccagguaacaagagcgaaacgccaccucaaaaaauaaauaaauaaauaaauaaauuaauuaauuaauuuaaaaaaaaaggucuguugucaaugaaguagugaaaaggcccguaaaacaaaacacuucauuauuuaccaaaggagcaccgagguuuuccagcgaaaugcaaccauuuuauuguucacagugauucuauaaacguuuuuccuuuaagacaauugcgcauagagcaauacacucagucagucacucauauauuuguuggcucuuuuuacuaagccaaaacaaagauuauuaaacucuuauuagagacaacaacaguguaauggaggcaugcuuaaauaagggaaauaagaaaauuuauacuauacugaguauaauuuaagcauugauagccaaaugaccaauacggcaauacuugagaaauguccagucauaagaagcuccucugaacgauaaagccaaacuuacugacaacugacuugaacuaauaccuaauucaagucaucugagagaucuaaccaacuguucucaucagugagaaacauuauauguuaucuauugcacaauaugacugaaagauagucaugucuugaaucucaaaucuucagaaugauaaaccacaaaacucuacuuugacaccuaauguauacagaugaaugucugucuacuuccuacuggaaucgugauaguugaauuaagauuuuuuuuuuuuucacucagauccuguuuucuuaaauaaggaaaaacaauaauaaacuuaccauauuaaacaacuaaaaaucaguuguccauagaugacaaaugugauacaaucuagcugucacuagauaaaagguuaauuuuguaaacagagucaguuaaaaaaauaaacaaaaaaauaagcaauuuaagauaaaaguacuuuggcauggugagacauuacacucacuggggccaggaguucaaggcuguaguuugcuaugaucgagccugugaauagcuacugcacuccagccucacauagggagacccuaucucuuuaaaaaagaaaaaagugaugucucaaauaugguguuugggacucacuaaaaauaacuaaauuuaagggggaaagauuaaauugguauuauauaugccauaugcuuaaauucugauuuuagcucaaccuuauaauuaaaucuguacuuugcacccauuagacauuucagcaaacugaaguucauucaaaucaaaaucuacaaaaagaacaagaucccaaggcacugaauuagacuuuuaauauucaagauguaaaauaggcacucuuuuaagaaauuacuuuuaguucuccucuaccuuuaaaaaaaaguuucucuccuacucgugaacuaauucagaacuuuacauuucuguuacacagcauaugauuucugcuuuauuacuuggauaucuguuuaguauucacaacauauauguaucuccauuaagcccagaauucuuugacagauggucucacccaaagaacucauaaauacuugauuacuucaacuuaguuugcaaaaauuaaaaaaucaguaaauuauguuacagacuauaguauuuugaguguuaaaaucacuucuaaagaacaccaucacaacagaacccuaaauucagaaucggguugacauggucuaagaaagugaauaaacggguaagugaucuuccuagugcaucauauucuacacuaaaaauucaccauuuauacuucauuucugaaacucaaugucaaagagaagauuaaaaaucugggggcugggcacaguggcucaugccuguaaucacagcacuuagggaggcauggguggguagaucccugagcucaggaguuggagaccagccugggcaacauggcaaaaccccgucucuaaaaaaagauacaaaaauuagcugggcaugguggugcaugccuguagucccagcuacuuaggaggcuguggagggaggaucgcuugagcccagcaggucaaggcugcagucagccaagauugugccacugcacuccagcagaguaaaacccugccccaucucucaaagacaaaacaaaacaaaacaucugacaguuccugaguaaucggcagccuacguaaggaaccuauuaauacugcauaugcaauuuuuauuaacacacuugccaauauccucauuuuaggacuagucuaauguuuguaugaugccagacuaauuuugaaugucugaauuauucacaauuacuaggaagacaaaucauuagacuauggauucagucuacaaucuuauucuauaucuuuuggcuauguuaacugauuaacaacuagaauaggccgggcgcgguggcucaugccuguaaucccagcacuuugggaggccgaggcgggugggaucaugaggucaggaguugaagaccagccuggccaagauggugaaaccucaucucuacuaaaaauacaaaaacuacagcacgcuuguaaucccagcuacucgggaggcugaggcaggagaaucgcuugaaccugaggggcagagguugcagugagccgagaucgcaccacugcacuccagccugggcgacagagcgagacucugucucagaaacaaaacaaaacaaauaacuggaauaaagaaaacaguucccuguccguaucaaaccaaucagaaccaauauaagaaaaugcucuuccaccaaaauacagauuugauaugguugaccagauaauacauuucucuuccuggcccuaaucuagaacuuaacuugguugugacuuugauuucugacauuuacaaaauggcauucaguccuuuauaacccauugacuucgcuuauguugaaauuccuuugcaggaguuuccaaacauguuaaaguacagcauuuggaggagaagcaauguuugccuccuggacucaagcgaucuucccacucagccuccugaguagcuggaaccacaggugcacaccaccacucccagcuauauuuguagagaugaggucucccuauguugcccaggcucaugacaaggaauacugcaugccaauaauggaugccagcugaguguccucuaauucaacuggauucugacacuguacuuggagauuacacaucccacaggcugagggcucaguaccacaaaacucccccaacuucagaugucaaucacaagccccagguuguagccugugcuucugaccaacuggcuaccauuccccagaccccuuacuucguuuugauucauugcuggagcaccuucagagaacuaagagaaauacuugcuuacauucacccauuuauuuuaaaggauauuacaaaggacacacagaugaacagccagauggaagagaugcacggggugaggugcggcugaagagaaaacgagauuccaugcccuuuccugacauccaacccuccaggaaccuccauguguucagcuaucuggaaguucccagaacgcgguccuucaggguuguuaagaaagcuucauuauguagguaucauugaucauuaguuuaucaacucaaacuucagcuccuggagguuggggagggugacugaaaguccuaacccucuaaucacaugguagguuacccagccaccagucaucucauuagcauauaagaccuucuuagcacuggagauuccaaggauuuuaggagcuaaaugucaggaaacauauacaucaggaagaccaaauagaugccacaguaucacaugaccauuuucuuggagucaagauauuuguucuuccuuaaaacuucgauguuucuaaauauccaagguauccacauaagguuaaaaauaaacuucucaccacuccacuugucauuuaaaaucauccaacauuuuaacauuucaucaaaucucuauaucuauacaauagugcccaucucuucauguuuuuaagagcccuguccucacacuauucuuagugaauagacagcaagagauauuauucccuucuuacaauuaugcucugugcauaauaagauagcaagccaaagauaaagccaggauuagaaguacuuucuuaaauugagagcuuaucagaagguaaagcuggcuaacaugauuaucuauguaacagcaccagaccuucucacuucgaaauucaagacaucuccaaccacucagaaaggguauggggguugaaaacagccacauuauaugcacgacuucuauaacuuaaagauagccaaguucauaucaaacuaaguuauugaauuuuauaucacuuucuaacaaguaaucauagaaccaugacaaaacauacaaaauacagaaguuuucuccuugacuuggugcaaauucaauccaauuacuccacagaccucuuuuauuuuagucacucaaacuuugauuuuucauuuccuuagucguacauuaggacaaaugcaaauuauauacagaaggcagcacauuuagccuuauuaucucaaacucauuccuaagcaaguacaucugccuggauggugaggccuccaucagagguuaaaugcaagcccuagcugggaaaguuacuggaagggcauguguccuaccugccuuucucucucaucaucccagaucuuuaucuccccaaugucaccacauuaggaguguuuugcauauaaaucaaaacgaagccccagagagcccuugguaggaauaucuggacuuguguuuuagaaauaguuuugucagccaggcacgguggcucacaccuguaaucccagcacgcuggguggccgaggcaggcggaucacgaggucagaaguucgagaccagccugaacaacacagugaaacccugccucuacuaaaaauacaaaaauuagccaggcaucguggugcacaccuguaauccagcuacucaggaggcugaggcaggagaaucgcuugaacccaggaggcagagguugcaguaagccaagaucacaccauugcacuccagccugggcaacagagugagacucugucucaaaaaagaaaaaagaaaagaaaagaaaagaaaagaaagaaaagaaagaaagaaagaaagaaagaaagaaagaaaagaaaagaaagaaaagaaauaguuuugucacauacacaucugugauccucucacucugcacgccacugccucucugaaagaaccaacauaccacacaggcacgcacacgauggacaauauacagccaccgagcaaucauauacaucuuuuaaaaagaaacaggcaauuucaugauucuacuguacccuggauccaucaggcuuuaucuagggagugcuauuuuuaaaauauguacaggcuuuuuuagguccucaguaagaucauggaaguguuuugcucccuaaggaaaacugaaauuugagguauaagacuggaguuuuacaccucuagaauucaucuuugguaaccaugcccauuugauuuauaaauaaucuaaaaauauggauuuuuaaggagcaguguauuuaccuuaguccaccucaucuuuuucuuuucaggaauguuaucacaaaaaugugugcugauuacuuccuuguaucugagcuuugagcaacuuacaaggcagacacuggaccuaaaacacagguugguuguuuuagaagaagaaaaaaaaaaagcugguuuuaaaucuggauuuaagucuuggcccugacuccaaagcaggccaguuuaugugccugucuucuguugccagaucuguagaaacuagaaugucauucuccgcugagaaaccacaaacuaguuuccuuagaccauucgucuuccuuuuugagacagucucaaugucacccaggcuggagugcaguggcgcgaucucugcucacugcaccuaugccuccuggguucaagagauccaucucugcucacugcaccuaugccuccuggguucaagagauccucccgccuccaccuccgccuccugaguagcugggacuacaggcaugcgccaccacacccagcuaauuuuuccuauuuucaguagagacagcauuuggccauguugcccaggcuaacaucaagugauccgcccaccucggccucccaaagugcugggguuacaggcaugagccacugcgccuggcccuccuuaaaccauuaguuuucaaaccguauuugaaguuccucagaggugcgccaguauuugagagaagguuaagguuucaaugagagcaaaugagauuuuaaaaucuuuucuauaaacggggguucuaucccaucuaaauuuugcuuuuuuaugaaaaggguuacugcccuuuuuuuaaaccuaaguaaaaacccauacccuuuacuuuguuacagguguguuauaauuucaaguugucuuuuaaguaugagauaacuuucauuguuacaaaacaaguggguugggaguggaucaacgagacggagguuugcuccuucauuuaacaaagaaacaagaccagagagcucuuuccucacugggaguuagaaaugaccacagacgcuaagaacagaaagcaagacaccaaaacuaagaaagguuuuaggagcuacaaucucucauuuagaaacuccagauagaauuuuaaagaaaaaaguaaaaacaauauauuucuacaauucaaauaauauaagucagaguaaaaaacaaacaaacaaaccuacuuagcacaacauaaaaauauucugguuacucauccuagagauuuaaaaaaaaaucaggaggugaggcagguccuauuuuuguuccuucauuuaguggaucugagucauggcuguuccaaugauuuuccugaugaaacaaaauacauguuuguuccaucaacaaagggcuacccuaggaaacucaucuucuacugcaguaagaaggguaucauagguauuuuuugugguucuaauggguacucagaaaauccuuaugugauuuaauauacucuuaaaaggaccgucugaaaccaaaacauguacuaauauccaguggccuuucucucuguauacugguuuaauaauaacauucugcaucaaauccuuucagaaaccuaugaacagaaguaaaaugauaugauaccugagaauuauuuuaaaaugcuucagaaaagaaaauggggcagggggaggugcugaaacaagaacagcaaaauguggucaauuuuugaagcuggaugauguauaugucugaaauuuaacauaauaaguuuuaaaaucuucuuagagaguuggcagaucauauacuauacacaaauauuguacauguuauaggaucaaaauaugggauuaaacuaagggacugaaacuacuuauagaaugucauucucaagccaggcacaguggcugaugccuauaaucccagcacuuugggagauuucuugagcccaggaguucaacacuagccuggccaacacagcgaaacucugucucuacaaaaaaaaaaaaaaaaauuagccaggcaugguguuccucuccuguaguccuagcuacuuaggaggcugaggcgggaggaucgcuugagacaaggagguuaaggcuacaguaagccaugaugacuccauggcacuccauccugggugacagagagauagccugucucagaaaacaaaacaaaacaaaacaaaacaaaacaaaacaaaauccuccugcaaauauucuguugguggauaguuuucaauguauacaauacagucaguaccuguuacucaauauuuauccauugcaaacacaacacagaaaccuaaggaacucaaaaagcaaacugacauuugucaggaacugcucccuuguuggucaaagaagaggaaaaggagggcuuucuucgauauuauugucuacuuucuugguaagcaauaaaguguuugcaguuuuauguagacuggcgggguggggcggggaauugugacacgguuacacuuucguauauaucaaguuacucccauacaugauuuuagguagagucuguauuuuaaugugguagaaaggggugauuaguaucuugaacugcagaggcuacaaaaaacaaugaugcaacauuacguaagggaugagaaauaaguaaauaaguaaaaaaaaauaaguaaauugaaaaguuuguuaaugcacaaaaccaaguaacuggagagaaaaggacagaagagucaaagaaucaagguccccagaccuagagugagaauguacauuaucgugugcauaccuuaaucucaaauauaagcucauuaucaaauaauugugcaaaaaaaucaucuguuaccuugugaaggauagaaaggguuauuucuuccaaagcucaaaaugugguccacagauaagguaagguuacauuagugguucuccaauuuuaacuugcaccagacucuacucaagguuuuguuaaauagaucucugggcccacucccagaaaacgguuugagaacuauguguuuauacuauggcuaauucuugcaaaucaucugauuuugaaaccagucacaauuuuuugaaacauucuaugagaaacaucuuauuaauaagaauuuucaacagggcucaguggcucacgccuguaucccagcacuuuaggaggccgaggcaggcagaucacgaggucaagagaucaagaccauccuggccaacaugaugaaaccucgucucuauuaaaaauacagaaauuagcuggacgugguggcacacaccuguagucccagcuacucaggaggcugagggaggagaauugcuugaaggaugcagugagccaauaucgggccacugcacuccagccuggcaacagagcgagacuccgucucaaaacaaacaaacaaacaaacaaacaaacaaacaaacaaacaauuuucuggcaaaguaagaguauuuuacaaagagaacaaucacacugguagagaacugcacugcauggauggccaaauuaaaucauuacaccaaauaauuugcaaacuucaucccuacuuuggucacaauaaguaacauuguacuuuugaaagauauuacugucugagaacagaguuucaucuuacccaaauacagacuaaaaacaaugccaacuucacaguacucacuuacauaguugauaaacagaaccaacaaguccucuaauugguccauuugaaucuggggaagagcuggcuccaaucauugucaauuacaucagcaacuguggaauacucccugagaucaacaaacuguuaacugcagugaccacaacuugacccaggccagagcuuccauccucgggagggugagucaacagcaugucaacacuaacccaacuucuaccacgcacagcaaggcugugcuauuuaggcguggaucacacgcacacugcgccaacuucuaagcuaacaauggacaaccaaagccuccggaacucugucuuggguagaguaaaucaauuuccuuuuguaggauuuucuuggcacaaagccaagugucaggggcuguggagaaggaacugcuggcccaaauuccauccaagguugaccagugguuuaaucccuucucuaaaucaggccucuggcaaaacagcuagaaucaggaagccaauucauauuuaacaaauucaaagucuaucacaacacaggaacuuguuaggcaagaagauaacugaaugaacaccuuuaaaaauucugcuuuuuuaacaaaagcugucuacauuauuuucucaugggaguuuugguacuaguguuaauucauagacucucccuuaaacucaaauaaauuaucuauugaaagaauggcaagaaguacugccaaacuucauagggugguugggcuaaauguucucaaguucuuuuccaacguuaaaacaaccggauuauaagaaacaauucauuuaauggagcauucuggaggaguaaagacagaggauuuggaaugagacugcauagguuuaaauucuaacacuaacuguaauucuggccaaaagguuaugaugugggguccucaucuguaaaauggaguaucuaucucauggagucagugugagaauuaaauaagcacauaaauuucucaacaugacgccuggcaccuagucaacacucaaaauagaggaaggcuaauaaugaugacaugcaaaucugauauugcaaauaccaacgcaaagagucuaaugaaaacuuucuaaauuauaugucauugguucauuauuuaagcuucugagguuuguacaagcacagauuaacucaaauguuacuuaacguuuuacauuuacuauaaacacccugaugauguauuuuacaguuucuugauuuuucccuacaguuugggcacagucuuauuaugacagaaaagaaagcaacaaacccaaaggaaaggcuuuucccuagacugcuuuuaauuuucuauuaacugcccaauuuugaaaaauagaucuacaaaacuggguucuggaugacugaguucuuuuacuuuggggacaagagcugaugcuaaaggagaagacagaggauuaagaaauuuacauucugucauuuacaaacauggguaugaacaugaacagagccucugaaaacaucuggcaaauagaagacacuaugagccaaucaaucaccaaugcuggcuuaguagucauauuaauaaauacuugcugaguauauacuauguucucugggcuguauuauuucuuuuacgccucacaacaacccuaaguuugguacuuuucuaucgguuccaguuuacaaaugaagaaacagggaagaguaaggggaguuuucaaaaagaaauaauaucaacaguuauuacaucaaggguuucacaaaugaagcauucaaaaauucagaaaggcaaugaauugcuuugcuagaccuguggaaggcccucaaccugcacagguagccaacacccgguacauacccaauuacauccaguuaggucaccucuguauggcugcaaggagccagggccauguguggugccuagccacacuauauacauaaccugggaaccaugcagcaagauggaagaauaggaaacaguauccagaauccagauguuagaucucagggguaggguaugcacaaggaguauuugcaccauuuaaggugauaacgcugcugucucauggcaacaugcggggcaguauaagaggcuugguaaauauccacuggaccuucccuaagcuuagcacaaugcguccuggauggagaaaauaucaaagccaccaaucugagcauguuguggaaccagagagacuuaagaggcugcaccaccacacagcccucacucgaucuuucuaggcucugcuaagaauguugcugcuggcucacugcagaaacuaacacuuacucaaagauggugcauccugugcuuauuuucaccaagccucauauccccuucucugccagaccauuuuaauaccauuagauacuucccuauucaaaauuaagacagugucacuggggccaggcacggugguugaugucuauaauuccagcacuuugggagauagaggucggaggcucgccugaggccaggaguucaagaccagucugggcaacacagcaagaccccaucucuacaaaaaaucuuuaaaacugcugggccugguggugcaaaccuguagucccagcuacucaggaggcugagguggcagcaucgcuugagcccaggaagccgaggcugcagugagcuaagaccacaccacugcacucuagccuuggcagcagacugagauccugucucaaaaaaaaaguaaagaaaaagugaaaaaaaacaaaaauagugucacucagcaucacuuaagaaaauuaauaaaaauagguacuaccuguauuucagagauaaguaaaacuuauguugaaauggucaaugcuagauuuuuauaaaaagauguccaauuuuuaaaaacucauucaaguuauaagaaauuuuauaaucuuuauuccaugucaaagauaggcauuagaaaaauucaguauuacuuuacuuuccauaauugucaacuuuuauaaacaaugugguggagugggaauuaaaaucugauaauaguuuugauccauaaaaugagugggaaaaucaauuuuaaggcagaaaaaaaugcuucaaguuaaacacuuacuauuaaauauuuaaacaaaaaaauguaauaaagauaccuucaaaacuggcugggugugauggcucaugccuauaauccuaauaugucgggaggccaaggcaggaggaucacuuagccuaggaguuugagaccagccuaaguaacauagcaagacccagucuuaaaaaauaauaaugaugaugaaguuuugauaaucaaaaguuauuaucccuuuuggcuuuaccauagagcuacagauagguguccugguuaggucacuucuuuuauucuucccuagcuuuacugaaguauaauugacaaaaauuauguauauucaauguauacaacgugauguuuugauauauguauacacugugaaaugauuaucacaaucaagcuaauuaacauauccaucaccucagaguuacuuuuuuuguucugugugguaagaauauuuaacauuuacucucgcagacguuuucaaguguacaauucacuauuauuaacuagucacuaggcuguacauuagguauuaaucucauaacugcaaguuugcacccuuugaccaacaucgccucacuucccccacauccaaacccugguaacaccacccuucuacucuuguuuccaugaguuugaguguuuuagguuccacauauaaaugaaaucaugcaguauuuguuuuucugugucuggcuuauuucacuuagcuuaaggccauaaguaccaggggccuggauuucaaccucaccccuauuguuuauugcuacuugggucaaauuauguagccucccuguauuaaucugaucucacgcugcuaaugaagacauauccaagacucaguaauuuauaaaagaaacagguugaacugacucacaguucagcauggcuggggaggccucaggaaccuuacaauuaggguagacggggaggcaaacacguccuucuucacaugguggcaggaagaagaagugccaagcaaaaggggggaaaagucccuuauaaagugaucaguucucgugagaacuaacucacuauuaccagaacaggaugggggaaaccgccucuaugauucaguuaucuccaccuggucccucccacuacacauggggauuauggggacuacaauucaagaugagauccagguggggauggagccaaaccacaucacucacugaaccucauuuuguuuauacuucauuuugagauaguauuugcucugccuuucugauaaagcuaugcagaauaccaaguuaguaccugguuucauauaugguuuauaauacauuauuccugauacaaucucaauuuacuguuuuuauacagccuauuacugcacaaacauuuuauaucuuaagcaauguggauuuuauuauaaucuccuacacuaaauaguuauaaaaacauuagcuauugguuugggaaaggcuacacucaaucuuaaauuuaaaagucaguuacaauuuuccauuaaaaaaauacaaaauaagcuacagaugucuuaucauggucaauucucuugaacaacuuucuggguuaaaaugcagaaaauauaacagaucucaguauacaauucagugggagaaagaacaguuccacuaaacugcuuucuucugacuuaccaugagaauuccaaagauagcauuaaugucaacuugaaaaaugauauuacaagcaccaaugcuagaaauuuuagaucgagggaguugcuccuugauguucaaugugcugaacaaaguaaagcaaaugggccugaaguaauaauuuaugcuuccaguacuuucaaaagcaaguuuugauauaagaaucaguuacccaugaaaauagaugaaauucacugaaaugaccuaguuuuauaauacaauaaaacguucuuuucaacuuuauaaaaguaauguuccucugaagaacagcugggaggauucuagauaucacaucaaaauacgugccuuccuaacauuagagauguuuuacguggaaugggauggcuugccugugggaugaagucucuggggagaacuaucaaaagcuggcugacuaccuaccaggaauggcagaaccaaggaguccuacauucaagaugugccaagagggagcagccucuaaggcagugaucucuaaccuuuuuggcaccagggacugguuuuguggaagaccauuuauccaugggguguugggggugggauggcaugagacuggaugggaugggaugguuuugggaugaaacucuuccaccucagaucaucagacauuaguuagauucucacaaggacuggaccaggcaaccuggaucccucccauguuuaguucacaauagguuuugugcuccugugagaaucuacugccaggaagcagcacucaggcaguaaugcucacuggcucaccugccugccacucaccuccugcuguguggcccgguuccuagcaggccauggaccaguaccuguccauggcuggguguuggggaccccugcucuaaaguaucugcguacaguuaaaaagacucaaauaguacaaaaggugauaauauacaaaguaaauauguacuaccuucuccuccauuccaauguucucauugcccagagucagauuuugucagauucacuugaaucugcuacugacauaauacacauauaaauuuucuguuuuuuauauaaauuacuguuuaaucugugauuaugccugcauucugaauguuuucacuuauaucgguaugauuuuagauauuucuauacaucaguaugguuaugcccacuuuuaauguaucagcauaauauucuacuguauaagaguuuuuuaaaggcuugcuuaguugauacaaauaaugcucucauaauauccucaucugugcgcauuuauacaauauacuaugaacuaauuaguuucuagaauuccuagaucaagggauauguacauaaaauucuaaaugacugaucuaaaaaauuucuguaccagcugcaugcagcggcucaugccugcagugggcagaucacuugaggucaggaauucgagaccagccuggccaacauggugaaacccugcuucuacuaaaaauacaaaaaaugagccaggcgugguggcucacaccuguaaucccagguacucgggaggcugaggcaggagaaucacuugaaccugggaggcagagguugcagugaguccagacugugccacuguacuccaagcaaagaaauaucuguuaucaauugacaguagaugaaaaugccaaucuggcaagccuuuuuagucuuugcccaucaggguuuuaaaaaacaauguuauaucacuguuuuacuuugcauuucccugacgacuaugagauugagcauaucuucauagguuuauuggcuguguauuuuuuccuguguacuauaaaauucuuugccuuuuuuguccacgucuaauagagauucuguuagacauccacacugaaauauuuauacauaaaauuauagaauugaaauuauuucaaaauaacccagugagggaaaagagaauugagcagguugagaaaggggaauacagauaaaacaagacugggugagagcugaucauugcugagcauucagcgcacuauucucucuuguguauguuuaauucuuuucauaauaaguuuucaaaaauguucauuuuucucugaagauguucauauuuaguauuucuuacugauuuguaagaacacuucauggaauaaaaaaguuugccuuuuguugcugacaaacuguacuggguacauaauacuagguaauccaguauugguacuggguaaauaauuacccaccuuccuucuauguacagucagauaacccaacaccauuaacuaaauaauccaucuuuccccuuucugauguaaaaagacacuuuuaucuugcacuaauuuccaauauaugcacaacuuuauuucuagacuuccaguuugccccauugaccuaucuaugcaugggaugugcaguuuuaauuucuauaucuuuacauuuugcuucugguuuuuuauuggcuauucuuaccuaaugguuuuucccagaugacuuuuauaauaauuguauuaauuuuccuaaguaucuacuacacuuauaaacaccccucccugcagaacuccuucccaaagacagagagccugcuuuucucuuucacacugguauguuuuuauguuuccaccuagggucucaucuguugcaugcaagcucagaauucacuugacaugcugauagcauauaauguuaaagaauucuucucucaguguaaaaaauauuuagcuacuguggaaggucaaacugcuaaaaccgacugguguaacauuugaaugcugcccuuuauauaagcuuuauuuuuauaaauaagcaucugacuagaaagucaguaaaagagcaugauauaaucagucugaagcccaguguuuuaaauauaauacacuaauuuuagacccaaguauuuuaguuuugcuuuauugucuacaguuucuuaagaagauguaacuuaaaagaaaaaaaaaaucuuuuaaauggcucaaucaauuuauuagaaauaagcggcaaagagcaucuguucccacagagcaacuguuaaguuaauccccauuaagucggccucaaagcacuuggaugcagcuacaggaugugggugugauaggaucacacaggcgaacaccugauagggccuuacacacaccgggcuaaucagaacaucaaaaaaaaaaccugaagucucuuggaaggacugaaaaauccaaucccuccccaacccccccaaaaaaaccucccaaaacagacuauuccauucaauucagauuuugugaauuaaugaaauuuaagagccaccugaaaccaccaaagauacacagugauuuucucccgaaucuaagguccaaaugacacagguagaaaaaugcacugauaaaauguuaacaaaaaugcaugucuaauacuuagagcuacgugugagcagguuuuaggagaaggauauugauucucccugaggcaugagcauuacccaccauuucaggaagccucugcaaguggagaagccacaaaccccuucaaaaagaucucucaauuacccacuucccaguccccucugauaugugguaaacaauuauuucaaugagguuggcagagauuuuucaaagcuagcaggcaggcauuuugcagcuaccuccagcugguccaagcagccaaggcugucaccagugccuggucaccgcugaaaacacaaggaggggcaggacuagggcaggagaguagauggagagagcugugucccgaaccaacauucuugagauuccuuugcuaguguuuuuucuucaggguucacugagaagaggaaggucagauggggagggacaaaacccaaggaaaugaggcucauuucaaacucuaacaacuugaucacaaacaaaauguauguagaauuacaaauaaguuauucuguuuucaggcaucaaaaauguuaucaaugaaauguugagaugcuaaagcagugaaaugugaaacgaagcagugucacaggcaacugggccucuccccuggcccaucccaggagggaugaaggguggcugauaugaacucuaaggauuauucugaaggggccaacaaauguuacaaagaggcucaaaaauaaaaaucagaaccauuuuucccucauucauccagggccuacuccuggccauguucugugcuuugcacuuuauucaauuuaauucaauuuuucuccuaagcaaucuauuuagauacuuuguagauguggaaauugguuuagggaagcuuacaucauuuucuugcagucauauuucuaguaaauugaaagaguugugacucagauccaaggucugaaugacuccaacauccacacucagaacuuccuucacuugggauugagaaaaagggaaauaauggaauugggagggggagagaagacaccaaguagagauaucagcauucagaacuuccugcaggagagggugaaagaagcuggcagccaggaacugagggccuuacugauuacuuuaguaucuuaccaaucaauugcauuccaaggcuugcuuacuuaggaggcugacugcuuaguccaagaagaaacacuggcugaacucuuugacuuauuuugcuggaggcagagaagauaagugguuaagaguaaagacaaugaaaacauaguuuaaacccaguccacuggccagcucccucccagcuggggauaacaguagguaccucacaggcugcugaaaagaaaaaauuaagugaaagcacuuuucaacaaggccugguucauagaaugagcuacauacaguaccugguaauuaguauuacuauugccacaaccaaggaggccucucagcaaacuauuuuuacauaugccagaaauacaguuauuuuuuccagacuaauaaaucacaaacaauauggcacgguugaccgccagguuacugaugcaauuucuuuucacuggaaccaaaaaacaaaaccaccaccaaaucugaacuaaguauaauacaauaauucucccugucuuaaauuuuaaaauacagaagaaaagaugaauugcuguauacucuaaacgcucuuuuaaauguuuggaguacagaaugucuuucaugaaaucaucuugauuaaaauguacauucuuuuccaagaagggaguaaacugaguauggaagacccucaccauuaguuuuuauaaaugauugaucaaugggaaucgucacugaaaaauugcauacaauuuuuggaaugaaugcaaauugauggaauguuuguaagcucaugugcuucuuccaacaccccagcaugcucccaccucacagccuuuacacuguauuguucucuccagguuuaauacuuguagaaaaggggaaaaaaaccuuuuuucucuacccuguuagguucagcacaugaggccuugccaauuaaacugacgagacagauucgcaggggaaaaaacacaaauuuuauuuaauguuauuauuuuuacaugagggaggggagaggagggagcuccacagaaaagcaaaaacccaaaagaagcaguuaggccugagagcauacacaccauuuuaacaaagagcaauaaacuguggagaagucacaagacaaaggagaggggauuagggcuuccaggggaagugugguaagguaaauauaugggggaaacuaauagaagauaaggguuauuucaauaagguuuguuucugcaggcgauggugccaccucuaguggucucuccagggauggagaggggaaggaggauaccuucacacagcaaaauuuuuauaaaaaggggguaaagcuuguccugggucugcuauuucucgauugucuucagcucaaauuaguacuuugcugaaauggcauauuuggggguagcauauucugauccccuucauacccuuccagacugugucucuauccagcuccucacuggcuuaauuuuucuucauagcacugaccaccaaguggcacagaguauacugauugacaucuagauagacagauagauagacagauagauagacagacagacagacagauugacugauuugcucucugccccacccaacaaaguacaagcucugugagaucaggaagcuggccucuuucaugguuguaucccaaugcuuggcauaguguugguguucaauuaaugcaccaaauaaaugaacggauuuccauauuauaucaauauuuucuuacaauuagaauuucugugauguugauaguguaagaauuuguuuuuauuaguuuucaacaguaucaacauuuacucauuauguaguuacaguauuguauuuuuuuaaaguaaacaauaaacaacacugucuuugcuccaaauaccuauaaugugaaauauauaaaacuggccgacugaccacagaaacggcaguuaauaaucaaaauuacaugugucuggcugaauggacuccacgaccuuacacuagguucuguaacagcagcauuucaucacaauuuguuaaauuugaagauaaauaccgucucuuuucuggucaaagauucuuauaucuuuggaaacuugacagaauuaauguuuuugacuuguuuuucaccacauaacaucaggagagacuuuaacagcagugaaguggcaaggaggacgcuuuauuuauauccguguaaucauguaacccacuucaugcucccacugaauggcuccaguaaacugaaaucacaauuucacuaauaucuacauuccagcuccagcuacauuugccugucaaaugcaacaacuuacaguuaagcuucugccuacacgagcaaucacagaaccauuaaauaagaggauugcuuguuugaacuacuagaucagccuuuccuuauuuuugcuaaucugugugguguacguucauuaccuuuuuuuuuuauguuaaagaccaccaugcguaacacuacuugacagcagcaauuuauagcagugguccccagccuuucuggcaccagggaaugguuugaugaaagacaauuuugugguuugguuucgggaugaaacugcuccaccucagaucaucaggcauuagauucuaauaaggagugugcaacgcagcucucacuuucuuacaugcgguucacaauaggguuugcgcuccuaugagcaucuaaugcccugcugaugugacaagaggcagggcucaggcagcaacacucacucacccauugcucaccuacugcugugcagcaaagcuccuaacacgccacagaccgguaccaguccauggcccagggguuagggacuccugauucacagcauuacaauaaauaauaaauaauuaaaauauuaccugauauuuggcaaacaaucccucucuaagucacuacuuccagccuauguucaggcuagaaaugccaaauaaaaaagcacaugucugucugggcacgguggcucacgccuguaaucccagcacuuugggaggccgaggcggggggaucacgaggucaggagaucaagaccauccuggccaacauggugaaacccuaucucuacuaaaaauacaaaacaaaaacaaaauuagccgggcgugguggcgggcgcccguagucccagcuacucgggaggcugaggcgggagaauggcgugaacccgggaggcggagcuugcagugagccgagaucgcgccacugcacuccagucugggcgacagagcaagacuccaucucaaaaaaaaaaaaaaaaaaaaaaaugggccaaggaucugaauagacauuucuaaaaagcaaauguacaaacaaacaaaacaaaacaaaacaaaagcacaaguccacaacuacauagcuccaguuucccuaaacagauuuacccauucaguaaacauuacauguacaaagaacuuaaaauaguaugagauuuaauguuaagaaauaaaauguaggaucuaaaacguaaucuauagcauaaucucaaaaaugguuuagaaaugacauaauaauacagacauuugugggugguaggauuaugcauauuuuuauauauuuuuaaauauauuuuucaaaagcuuccuauaaagaauguaauucuuucccaauuccaaaucuagcuuaaacauaauuuuacaaaaauuauucucucagaauguaaacuaguaccaccucuauggaaaacauuauggagauuuccuaaagaguuaaaaguagaucuaccauuugauccagcaaucuuaauacuggguaucuacccggaggaaaagaagucauuguaugaaaaagacacuuguacacauauguuuacaggaccacaauucacaaaugcaaagaugcagaaccaaccuaaguggccacugacuaaugagaggauaaagaagauguggcauauauauaucagggacuacuacucagccauuacaaggaacaaaauaaugucuuuugcaacaacuuggauagagcuggaggccauuauucuaaguaaaguaauucaggaauuggaaaaccaaaaaccguauguucucucuuauaagugggaacuaaguuaggaauaagcaaaggcacacagagggacauauuggacuuuagagacucacgaggaggaggguaauaggggacuagggauuaaaagaaaaacuagacauuagguacaagguacccuacuuaagugcacuaaaaucucagaauucaccacuacguaauucaacuaaguaacaagaaaccacuuguaccccaaaagcuacugaaauaaaaauuauucucucaaaaauuuuaagcccuaaacuucaguuccuauuguuuauauuuacuaagaaaaacaacagaaaacacuguuuuaaaaaugguggauuuuuuuaagguuaaagguauauaagacagcugccuaaggaaacgcagauaccccuguaccuuguuguuguuguuguuuuucacuuuuuuaaaaaacauagagaugggaucuccuuaugcugcccaggcuugucucaaacuccugagcucaagcaauccucugaccucagacucucaaaguuuugggacuacaggcgacagucaccaugccagccaauauccuuguacuuuuaacucauuccuacaagccaugaauccucuaagcauugucccagacacagcacuggcaaacuucaaucguuuucaucagaauauaaagaaacacagggcaugcuuaacuucaagguugauauuuccuuugugaguaaagccuugccacagaugagaaguccugaggaucaaacaggaaaacuuuaaguuuaauuaaaucuaaaaucauaaaaccuaaguuauaugacuaagcaaacucuucaaagcacucagucaacauccaugcugguaaauauuucaggaaugaaaugaaaaauaacuuucaauucuaaaaguucauccaucaugcaugcuucacguuguaaagcaaauauuucacaaaaaugaguuuacaacaaaagaacaccaaucccacuucuccaacccuccaugucaggcaguaagcuuuccacauuugcuuacauucugaaaauaacuauuuuacaugccaggaaugcaauaggcuuaagcugucaaaaaguaucauacuuuaaguguaacuggguaagaacuaugggcacacacacaauaagccuuccaaaacaaggggagguaaaugaaaucuuaauaccuguguuuccagaagcccagaaaugaagugcaauuccuuauaaucuguacauguuuacauacccauacagacaauaaaauguguaagguaaugacagguccaucucuccccuuccuuuuagugggcaucugacauuucaggguucagaaucacauauccugggucccaaaagguccccccauuccuauuccaacagugcucacaauagaaaaagaugaacugaucacuggacccuacaucaucucauauauguauaauacuaguccacagagagguugaagauaugccugguaacucuauucauccuaccccacaaguuuuguccaaaucaggccaugccuucaagugggccagauugucuuaaagcuccuggcuuaauauuuaacugauagcaacaaccuaacguuaguaccuuaguaacuaaaggggaugcagcaacaugaagcagaaaaagugaugaagaaagagauuagaaguuagagaacagggacugggcucuugauccuuaaaaugugggugauuuugaacaacucaacaucuccagauauuacuuucuucaucuguaaaguggagaagcuuaaaaaggaggucuuauagauucuaccuguuccagaaacuaugauucucuuccuagacagcugcagguugaagagacucuccuagagcugcacuguccaauacaguaaccacuagccaucuguggcuacuaaguacuugacaugcagcuggucugaauuaaaauaugugaaauauguaaucaggugcgguggcucacaacuguaaucccggcacuuugggaggccaaagcggcaagucacuugaggucaggaguucaagaccagccuggccaacauggugaaaucucaucccuaccaaaaauaaaaaaauuagcugggugugauggcacacgccuguaaucccagcuacucaggaggcugaggcaggaaaacugcuugaacccaggagguggagguugcaaugagccaagauugcaaugagcaagcuagauugcacucuagccugggcaaccgacugagugagacuccgucucaaaaaaauaguaauaauaaaauaaaaaauaaauaugugaaaugugaacauuuugaagacauaauaugaaaaaauaauguauuucauaaauagcuuuuauauugacccccuguugaaauaacauuuugaauuuagugacagacuaaaauuaauuucgccugcuuauuuuuuuauguggcuacuugaaaacuuuaaauuagaucuaacgguccuauuauaccucuacuggauaauucugcuuuaaagucaguccugggcaugcaugacgcccagaggaauucacagauaaaaugagcccaggaaucuguauggaauacagaccuguagguuaccauuuccauauuaaauguguaaagggcuguuuuaaaaccaugcuuuuguuuucuuauuuugugcaccaacaauaaaucaacagcaaauaucauugggucuaaaaauaauugauaucuggcugggcgcgguggcucaugccuguaaucccagcacuuugggaggccgagacggguggaucaugaggucaggagaucaagaccauccuggcuaacauggugaaacccugucucuaccaaaaauacaaaaaaacguagcugggagugguggcggaagccuguagucccagcuacucgggaggcugagggaggagaauggcgugaacccaggagggaggcagagcuugcagugagccgagaccgugccacugcacuccagccuggacaacagagcgagacuucgucucaaaaaaaaaaaaaaaaaaaaagauaccacuucauuuaugcuaugccugaauccuaauuaucaacuguaggccuuaacaauaauccuaaguggaugugccuuuaugcaggcacuuguggccuuuuuguuuucuuugaauuaaauauacaaaguaauaauuuaucuuacuucauaaaaagauuauaaucucccauuuuuuaaaacacauuugauauuaguaggaauaacuaaaaugaacucguaugaauagaccauuuuuauuucauugauaucuaacuaggaacguugcaacuaauuuuugcaaucuguaucaauuuguuuaauauauuuuaaaugaacaaagaagcagagauaguuucuagagagcuuauuuacuuaaaaauacaacagauauuaaucaauaaaauauuaauaagauucaggugagucgagagugaguacucaaguucucuuuucucacaacguauucuuggagugccaaccuuuucaguucaaugauuuuaugcaaagguauacaucuaacugccugcaaaauaaacuacugacuauuuuaaaucagauaaagcaaacaacagcccccagcucugcaauccaaagccagcaaaggucacccauuucagacuggguuugaagcauagccaguuaugauagcucaaauauuuucagauguaugaaagcagaacagaauucagaaauauacauucuuuggcagacaauuuuuuuagaaccaaguuucucaaauuauauaauacaaacuauaugacuauuagaaaauuaugcaugaauuaaaggagauuuauuuaauuuucaaauucuaauauaauuaaaauuuucaaacuuaacuauaugggcuucacgggugaaaaaaaguauaauuuaaaaauaugagcaauauaauaugacagaaauauacauucaaacacucuuucuaauuuuucauaaauuaacaacuauuugagacaugcacaaauuuucauguguuuuucugaaggugguauccagaagugauaauuuuccugacaguuuaacauuuuuuaaagacaugccaagauuuaaauaauguagcuuuuugauuacucuuuuuuuuugagacagagucuggcucuguugcccaggcuggaaugcagugguaugaucucggcucacugcaaccuccgccuccuggguucaagggauucuccugucucagccucccgaguaacugagacuacaggcaugcaccaccacgcucggcugauuuuuguauuuuuuguagagacgggguuucaccauguuggccaggcuggccuugaacuccugaccucaagugauccacccaccucagucucccgaagugcugggauuacaggugugagccaccgugcccggccuuuuugauuacucuuaaaacugcgggaucaaaaugaaauguuagaaaguaaaaccaacagcagaaaguaaaaccaagagcagcuucugaggaaucauauuuuagacauuucuuucagacagauucuguaaugugucaaacuauuggaacauauuucaacuaaauauuuaagugaagacaaaaucccuacuacaaaaccuccaaauacucuaacaaugaugauucuaucaggccuacucagaacuacagguuuuccccacaucuugauuucaaagcauacuuucugugacguaucuucauuuaaucacuuuuagaauaauugaacaagaaaauagguaaggaauuaaaauaaauuuuaaaauggcagucccauucuuacugacauaaauuuauuaagaucaauguuccuuuuugcauagaucuucccauucuguuucaauaacaccagcaagcauaaacagauuugaaaagcuacgcagccacagaaaacagguucagcaugacagacagaucuagcucaaaagaggugcucagugucaagcucuuuucuaaaaaccucaaagcuuguuuugucugcuguugcuuucaaagaacaagcacaacaaaauuguuuugaggaagucucuagaucaaacgaaagacaguuaaccaacagggagaguaaacugacugccacugcuguccacacagggccacagaaaucauugcuuuguuccaucacucuagcuggaaggccuucccaggaaugcaagucugaaccaucuagaguucucucagccagaaugaaggcucagcucuuggauguuucuaccauaaaaaugagaaagcauuuccuaccuccuccucugucacuccacaaagaugugcuuccuguguggcuggcuagcagauaagagaagguaagcaaaucccaaaagccuacucuaaucgcucacggagaaucuuagcuuugguucagaacguuaagucuacccauuuuccucuaucccuuuaugguacuguauuucuucuacaucccagaaugccaguugccacucaauauccuaccucuccuuuacccuuaagaagagagccggaaauguaauuucugauagcaaugcucccagcuaauagagcacauuuacaugcucccuugcaucgaggugucacuaucuggcccaugagauuaagcagaccuugaaaaggacuucuacaaaagcuccuaaaccuaacugaaccaugaauaucaaugccucguccccauuuuaggaacauuuaaaaguacuccauuucuaagaaaaugaaguucaaacucauuaagggcauccaaaauuuauaauuucacacugucuccuucacuuauuauaccccugggcuucccccuuugaaacucuacacccucgcuguuuuuucugucugggaagcccuccccaccccaguucaccuucacacauccuugaaaccuaguucaaauucugccugccuucucugggaagaguuuguaccuccucuauuauagccuuuggcacacuguaccuaauuauuucuccgucucuuucuuccuccacuggacugcggaauuccucaaggcacagacugaguuaccuuucuauuuacucacagccccacccagauucuagaucuccugucauaacugaaacacagaauccaugcaguauguccauaaaaugaauaauaauuucacaaauucaaaaugagagaaacaauaagauaguaaauuuuuuuuuuuuuugagacggagucucgcucuguugccuaggcuggagugcaguggcacgauggcucacugcaagcucugccucccagguucacaccauucuccugccucagccucccgaguagcugggacuacaggugccugucaccacgcccgguuaauuuguuguauuuuuaguggagacaggguuucaccauguuagccaggauggacuggaucuccugaccucgugauccacccgccuuggccucccaaagugcugggauuacagguguaagccaccgcaccaggccauaaauuaguaauuuuuuaaacaucuaacuccaaauaaaugucaacaucacagaagucaaucacaaaugcccugagaaaacuugcaguagagacauaaaaggggaaugcacaauccaaauauucagcuaaacauucugcauuaaaccuucccccucaucugcacacagaagaaucacgggcuuaggcuuggcuuuguguucaaccucugauagaaaugagcaaacgagcaaugaagucaacaugucagauugcuuuguaaaucuaaauaacuucgcaugugauaauaaauucuaagaaugcauccaaugucuuuuucucugcaacaacaagacacuaauauuuuuuucucaucucaucggcuauuuauuaaaucaauaaauacaauuaaaaacacaugcgcauaagaaauacucucaauaaacugaagggaugcuucccaucugugucccuacaauaugacccagaaaauucacaaugauauaaauuuaaccuuugagucuagcucacaaaagugaagugaaauauccaaauagcaaauacgaagaaaggaacuaccaagaaacaaggaaagucagccuccaauuuuguucauuuaaguauacccucucugccaccacaacauucauuauguuuguccuggacagcucuaauggccaugcugauugauacucaguguuaaggccaccucuguccaacagacagagguggcuucuacucuguuucagccaaauacucacauggcuacucuaucaucaccuggaaaucucccagcuucccucaggaauuccccccucuccuauuucacugaacaagcaggaauaagugauuccaaaauugcaauuuugucucaaauguacucuuaaaagugaaacccuccacaauucaacuagcagcaguucuguaagcugccuuuacauucaaacacccuauggguuagccaagaacgccccuccacaacaaccauagaauuuuuauauucguuuuacuucuguugcauuuaaauuuucuggauucugugguauaagaggauuuaacacuugacacaaaacauucaaaauaagauugagaaaauacuagcaagauacaaggcuaaucauaaugaccucaauuagauuuucaauuccugucaaguuaaugguauauaguaguauuggcuucaagcucuucaaauugaaaaauacaauucuuuuagauaacagagguaauagaauucaauauauuuuuuuaaagggccaauuuugauccuugucacacuaaacacuagcuguaaaauggccaaaaaaggagccaaaaaaaaagacaaugacagagaaauuuucauuuucaugccacuaaauuuaauuccaauacacauuuucuuuccaaacucuacuaacuucuucacacaaaauuaugucuaggcacccucuauugaaagugucccaaucaaucagggcauggaugaaauauuucaaaaaugaggcauuuuuucuuuuugcaggccaacugaauuuuugaaauacaauugcaaaugacugaacgugauguauugacaguauuuaugaaaccuuuucacaauaaaauguuccaaaaagaggcugaaaaaaaagaaucuuauuuaaaaggcuuuaaucuucuuucuaugcuuguucgcaguuucuuaaauguugagaagguugcacagcuguucgaaucuucaaucugaacguaauucuuuaucaccacaacauagaauuucuagagaacucauuuauuuaguacauacaaaauguaaggcauuaucaugagugaucaaacaaauuacuguauagaaaagugugugaucacaaucaacacuaacuucucucucccaccacuuguuuucaacauuuaaucacccaaaguagaucuucugucuacaauuauucuuuuacaauguaguaaauauauaguuccuucccccaguuaucuaaguuuaccuucacauacugaaaugaucagagaacuuugacaauacuacagaaacuauugcauucacaacacacauccuucuacguagcauucucuuauauuccuuacccaacuuaauuuuuuccaagucacuuccuuccuccuuuuuauucugucuacccucuugggggcaaggaccucgaaaauauuugugaaaugaaggaguggcccuuucuugguuguaccccuaagaaucuagguuucuuuguguaugaaaauaagcuaauuuccacagaaauuuggcuuuaauuuuaaauugcuaaucaauuuaauauguaaguaucuaugauuaauuauucuuagaauaauuagucugcauauuuucacauuucuaugggaguuucuuagguacucuucaguuauauccucaaacuaauuuacuguaaugacaaaauuauauuuguguuaaaccauaauaagcaauugagagcaucaggauggagaauauuugcuacuacauaucacuuuucauaugauggguuuuaauguuagucucugaagacuuaagcuaagacuucaaaaacuuugcaucgguuuuaaaggcuuaaucuuugaaguagaugaggauuuuuuuuuugaaagauaaaaaaaucaauaaauacaguuaagaaacagugcuuauccaucuuuauucuaugagccuaucaauucaauuauaaacaaaauaacugaguaaugauauuuauaaaaacaacauuggccaggcacaauagcucacaccuguaaucuagcacuuuggaaggucgaggcaggaggaucgcuugagcccaggaguucaagaucagccugggcaacauaguggggaccccaucucuacaaaacauuuaagaaauuagucagaugugguggcacaugccuguagucccagcuacucuggaggcuggggcaggaagauggcuucagcccaggaggccacggcuacagaucacaccacugcacuucagccugggugacagagugaggacuugucccgaaaacaaacaaaaccaaacacaguaucaauaugcuuuugaaaauucauccaauaguaggaguagauauaacaaguccuuuuuuaagaugaauaaaccuuuaauggauaaagccauuuucuuuacuuucucuuaaaaauaaaauuuauguugccucacuaauuuuacugugaaauaacgagcacacagacaaggaaaaacuaaacaaaugaguuuguaguaacuugggaugaggggcaggucuaaaacacguuaagucuaucucaacaguaggauuaaaccucucauuuuucuuccuguaaaauaucuccagggggucaaaauauauuaguuauucaauguuugaaauuuagcaaagcagcaagaguaauaaugcauuucuucacuuaacacaaaugacuuuucuuuaugcaacagaucucuuauucucauaaguaucuuuuauggcugaaaaguaauuuaucagucuguaucaucuaggaugccuuacauuuuucaaugaagacaguauguggcuuucuggaagcuaaugaaagccaaauuauuaaauaagagacaaauuauuagauucucucaaaaaaagcaucaggcaaaaaaaaaaauuccuaucaaaaucaccaaaaaauuggccaggugcaguggcucacaccuguuaucccagcacuuugggaggccuagguggguggaucacuugaagucaggaguucgagaccacccuggccaauguagugaaacccugucucuacuaaaaaaaaaaaaaacaaaaacaaaaauuagccaggcgugguggcacaugccuguaaacccagcuauucaggaggcugaggcaugagaauugcuugaacccgggaggcagagguugcaguaagccaagacacgccacugcacuccagccugggugacacaguaaaacucagucucaaaaaaaaaaaaaaaaaaaaaaaaaaaaaucaccaaaaaacaaaagaagugacaauuauucuuguugaaucaaauuucucauaagaaaaccuucugacuuugugaagaaaaaaaggaaccaucuggaaauuaagagauucaaacacuguuugggguccaucauuaauaagaccuuaaggaaucacugcacuucauucaucaggauccauuaauuuacaaaacaggcuuauucaucuuuucccuuuuccaaaauguuuguccuauuuauuccucaucccugcucaugaacccuccacuccugcuucuggaaccaucuuaaucacuccucacuguaucuacuguaaucaggauguuuaucacaaauauggcuucugucauuacacauccucguaugugaacccacuucuugucuucuugucuuuaguuggacaggacaauuauaauuacaugagcugguuaacaaaaacccaugugaauucuuugggacucugcuucuugauuuuucccugcguucaucaucauuuaaccacaguaucaccaguuucauacacucaaggcuuucaaauauccuuggccugcuuuugaagcuaaaaaccuuuuauuuuugagcaacauaugcugauuuuuaaaaaaaauauauaauuucaauuaaacagcagaucacuauaaaguuuuaaagauguaacagccauaacauggcugguuacacaaauucacuuuacugcagcugggcgcgguggcucacgccuguaaucgcagcacuuugggaggccgaggcaggcggaucacgaggucaagaguuugagaccagccugaccaacauagugaaaccccgucucuacuaaaaauauaaaaauuagcugggcauaguggcacacgccuguaaucccagcuacucgggaggcugaggcaggagaaucgcuugaaccugagaggcggagauugcagugagcugagaucgcaccacugcauuccagcuugggcgacagggcgagacuccgucucaaaaacaaaacaaaacaaaaaauucauuuuauuuugaaacugauuuccuagagaaaugccgcauucucaagcaaucugcuuuuugguuucccuguccuugggugaacauaacuucaagcuuccauauuaggaccaaaauucuuuugcuggcauuugaaaucuuccauuucuacccagauuggcaaagccuguuuauucguuuugcuagcaaagauucuacugaaaacuaaaccaagucuguucacaguuccuugcacauagcugauagccaacuaauaguuaauaaucaagccaguguauaaacuugcucaauauuagacaucuguggcaagcugccaguguguacaacauuaaaaaauaggucucugggaggccgaggugggcagaucacuugaggucaggaguuugagaccagccuggccaacauggugaaaccccaucucuacuuaaaaaauacaaaaauuagcugggcaugguggcgagugcccauagucccagcuacucaggaggcugaggcaggagaaucgcuugaacccaggaggcggagguugcagugagccgagaucgcgccacugcacuccagccugggugacagagggagauucugucucaaaaaaaaaaaaaaaaggucuacauccauguuauguggaaaaaaagaaaaaaaaaaacuagguauuucccauuuguguaaaaaaugcuuaugcuuuuugcacauuucuguacuguuuuaaauuuuucaaugagcaugaauuauuuucauuuuucaaaaaaccaauugaaauacacaauacauauuuaauaaaugaaauuuuauaacauguauucuaaaaauuguaucugagauaccaugugcuuuuuaaauuuagaucaaacucauagacaacaaucugucaauuuccugcaauagucuuaauuggccaauaaguaauuugucaauaagugaaacaucaucuagauuuuuaacuuucaacuaugcaggaaacuuacauauacccauuguacaucaacaucaucaccauacauagcagcaacuaacacacagugcuuaugcuaugccaucagguuacauauauauuaacucacacacuguuucaagcauuuaacaaagauauuaauucgauccucaauaacuagaaguacucaucccauuuuacaaaggaaaaaacugaggcacagaaacuugcccauggucacuagcucaaaagaaacaaagacagaauuuaugcccaugcauuccugcccuggucuaaacucuccugauuagugugcaaugcugccuucucuacauaccugagaaacacucaaugacucaguguuauuggccuaacaucacgccuggcaucaaauucaacauuauaaauugagaacaacucugguucguucuacagaggugacauuuuuaaaaaccucucaucuuccccauuuuaacuaucuucuuucguaagauacugugagucucgcaagguucaagcuaaaucucuauugcauguuucuucaacauguagccacacaaaauaaaccuaaauaaaaugaucucuuagguuucuauuucagcagauuuaauacaugugaaccugagacuucuguggcccucucugaauacucagcuagcuaaucuacuaagcaucccuguuucauaaagcuauuaauugaugcacauauccaggcuuuuaaauuuaaauaugugaauuuauuccuagagcaaucauuguacuccaguuuuugccagauuucuacuucugaagagguaccacucaagcauaauaauaaucuauaaccaagauuaaucuaaagaggaaaauuugccaaacuuuuuuuuccaagaaaaauacuaguguccucacaguaaugauuauuucuuaagccauccacacuaaacugaaaaaauaguuacauaacauuucccccuuuacuaagcuuuucacuugcaaaaucagcuucaggguuugaguucugucugcuuuucuucuuauacaacaauaaaaaaagaaauacauauuuuauugauuaaacuugcuacucauucuggggugugcucauuccuuccccugccaccuucugucuucuguguacagaugaggguguuaucuguacacuggcugugagacccacagggugacagcguuuccaaggguuugcaaaagacggcauuucccauccauccccacuccauacauuugcaucugagcucucacuaugaaaaggaaaagauuuuuuuauuucuguuuucuucagcccuuuucugucuacaaagccaaucuccucuguucaacucaucggaacauuuauacuauuuuacagaauaguguugccugaauguagaaucacaacaaagccaguugagaucuuuaaauuaaaaaaagaaaaaaaaaagauuucauaaucaagcauagucaagugaaacagagagagguugaaaaccaccagacaaaaacaaaacacaaacagaaaaugugauuuuucccuauccuccucguugccacuguucaucucauacucugcccaucaagaugcuacugaagcucucugguccugcauucagccccuuaccuuugaccucucaacuccuuauuucaaauucccuacuccuguugagaauacccugcaccagcaucugucacucaagugagagagagagagagagagagagagagagagagaaagagagagaaagagacagagggugugugugugugugugugugugugucugucugucugucugguagaggcagagaggaauguaaacaaauauuguauaugcagaaacuuaaccuccaauccccagaccugggauauaaaccuggcuggaaauuuacuaccaggaaaugcuccaggauuaucuaugaucucaucccauuguuccuuacuuuuuaaauacaggaaguuuucucuguaacauauuuacucaguauaccuaaucuguauuuuccuuuugguauuuuaguacauuccacuuuguuuuauuaucaugugcauguuuuauuuacccugcaaacuuccugggaguaaggggagggaggagggaaggggagguaaugagguaugcagucgaacuaaaccuuacauucuggaagcuuuaaauuuaaaaugcaucuguacagguuuaucuuuacauuuguaauugauagagauuuuaaaagaaauguauuaaugaaagaugcuuuguaagauucucaagguaauacaauuugcagaaacaauguacauuucuacugaauuuaaugcacuucucacugauaguuuaguggccacgugaaaugcaaguaauagcuaugcuuauuuccagaaugacugacaacauucauacaaauaucuguagaagacucuaguaugcaaaaaacaguaacauaaaauagagauccucuagcaacaagacuuaacauaaagacaaccucucccauuccuucaaaccaauauuguugaucacguuauuucuuuuuaauuuuuuugaaucagccauuccucauuuaaccucgugaacuugcauguuccuuuucauuuccucagucaggaccaguauuauuccaucuaguaacuucuccgcaguacuaauagccuugcaaaugucguucaggagccucugcugguuccggugacaagagaaaagcuucugcagucugccaguuaucaugguuucucaucgauuagcaagaaccgugacuccuuacagaucaccaucaaaccugagcuuuacuauucugugugucggcuucuaccuuuagcgagguacuagucaguagcagcagguuuccauaaacuauaaauuagcacuaccacaaagguaagaugauugugacuagguuaaacccucaacagagggaaauaaaacuuaagaggaagcuagauuuaaaaauaaauaaauaaauaaauauuaggguagugaaacaucauauagauuaggguuuguuaaacucacaccucuaucaacauaccagccaaaaucaucaacccagauaauaaccauguuucccccgauagccaaggccccauuaucauugcccuuauucauuucuuuucuacagccaccugcagcagaccuauuuucuaagcucuauaaaagacagucaacucguaauuacaucuuuucaguggacacagagagaaccagauaaaccacccucaaaccucaguagacugaauuaccuacccuucuaccaacacuucgcaaaauggcauaaugugaaucucaccuccacccuuuaaaggaguuaacaauagcuacugaaaaggucccaaaagauggcagaaagagcauauuaaugcaauuaaacagaccaaaaacuaaauucgaaucugccuacaugcuuccucuuuuuauacagaaagaaauauugcucaacaaaguuacauauuuaaguuuugacaaaagcuucaaaaauacgguuaucauaugcuuuuaauuccuuaaauguaugguuuuuaaucuguaguaagaccauucgggaaaacuggaauaauucuacaaauaaauguaaguaagucaugagagaaaucagaauucucuuaguuaagugcauuuuuuuaaaacauggaaaacgaaauucuuuaacucuuaaaacaaccugucuuaacuagcccuaaggugauuccugagccacuuguggguaaaaaucagaagagaaaaaaguucaaugaccuugcaaauuagaaacuaaaaaacuaauggugugauagucuguacagccucaguggaauuacaggaaaacaucugcccggaaauugcuuuuuuucuuuuggaaaauuacuaggaggcugggggaaaagaggggaaaaacggguaaggaagguugcaaauguuaagaugccaaacaggaacccaaccgaaguccgaagugaaauacagccuccucuggcccaacugucaugcaaacaacuucuaagcaucuucagauguaaagaaaaacagucauugugcacaggcguuagcugaauguucgagaguuggaugaauggggaagacuuguuauacaccuagugguggguggauuucacuaggcugcagccuccacacagcuuuucuuugcugcacugcagaggcgccaucuucuccgucuuaaucuucacucaauucgauccuuuuaucugcacccuaaaaaaaagacccuucggacccuccccagcauccugugcccccaggggaacuaaaccagaguccccagagcugccagggaagaggccgcgccuuaaucagacaaacgccuccuuggaugcacaggacagagcccgugccuccccaccauccgccacugcccuuuccagacgcacaucccacucuccgccuuauuuccuccccgccaaggacuuuacagcccagcacagaauuaagccucggaggugauccgagggugggaagcagaggggccccgaggcuccgccagaagccccggcagcgucucugcccccucccaggcggacgcgcagccccgggaagggagccgggcgggagccucgguggcgcacugagacuaacgcggcucggcccacggcgagggcggggugucgcggcuuuuguucccgcggaccuucugccucucagacagagcuuagggugcgagcgaacucccgggacguccagacuuggggaaggcgcgggguggcuaugggucuccgaccccucccauuucucgcaaguuacacaaaagggagacgcggacaugcacaaaguuugccuguggaaggcggugcgcgaccccgacgccggcucgggcuagggucgcacccaggcugccgccgccagcagccgcgaaaagagguuggagcaaggaagggggaugggggugagagaggaaggugaaacgaggcggagaacgcagggaaaagcgaggggcuccuagcuuccugggcugucccgacuccuccuccuccuccccagggcccaagagaaaggaaagggcaacgauucaagagcgaaggacuggcuuuagggacgcugcguuuucgguuuuccccacgugcuccuucccccuuccccccugucugaaugucucucgccucccccgacccccgcuuccaaggcagggacuaagucggggucugggcucagggucgcccccuacccuucucgccccgggcuggcgcggaaccagggagaccagcgccucgcccgcucccucucagcgggccggagcgcgacucccuggggcagggcugggccgaaagcggggaugcgcuggacguccgcaagcgggggcggagaggagaggggucccauugacggacccccggcuucucugcauuaaagacuuggguuaaggucuugggggguaucgcguccccaccgugcagccuccccccgccuuccgaggcgcggcacccaccuccagcgcccgagccguccaggcggccagcaggagcagugccaaaccgggcagcaucgcgacccugcgcggggcaccgagugcgcugcugugcgagugggauccgccgcguccuugcucugcccgcgccgccaccgccgccgucucccggggcccccgcgcacgcuccuccgcgugcucucgccuaccgcugccgaggaaacugacggagcccgagcgcggcggcggggcucagagccaggcgagucagcugaucc

SEQ ID NO: 192644 - RNA, 290278 nt, Homo sapiens
ggaucagcugacucgccuggcucugagccccgccgccgcgcucgggcuccgucaguuuccucggcagcgguaggcgagagcacgcggaggagcgugcgcgggggccccgggagacggcggcgguggcggcgcgggcagagcaaggacgcggcggaucccacucgcacagcagcgcacucggugccccgcgcagggucgcgaugcugcccgguuuggcacugcuccugcuggccgccuggacggcucgggcgcuggaggugggugccgcgccucggaaggcggggggaggcugcacgguggggacgcgauaccccccaagaccuuaacccaagucuuuaaugcagagaagccggggguccgucaaugggaccccucuccucuccgcccccgcuugcggacguccagcgcauccccgcuuucggcccagcccugccccagggagucgcgcuccggcccgcugagagggagcgggcgaggcgcuggucucccugguuccgcgccagcccggggcgagaaggguagggggcgacccugagcccagaccccgacuuagucccugccuuggaagcgggggucgggggaggcgagagacauucagacaggggggaagggggaaggagcacguggggaaaaccgaaaacgcagcgucccuaaagccaguccuucgcucuugaaucguugcccuuuccuuucucuugggcccuggggaggaggaggaggagucgggacagcccaggaagcuaggagccccucgcuuuucccugcguucuccgccucguuucaccuuccucucucacccccaucccccuuccuugcuccaaccucuuuucgcggcugcuggcggcggcagccugggugcgacccuagcccgagccggcgucggggucgcgcaccgccuuccacaggcaaacuuugugcauguccgcgucucccuuuuguguaacuugcgagaaaugggaggggucggagacccauagccaccccgcgccuuccccaagucuggacgucccgggaguucgcucgcacccuaagcucugucugagaggcagaagguccgcgggaacaaaagccgcgacaccccgcccucgccgugggccgagccgcguuagucucagugcgccaccgaggcucccgcccggcucccuucccggggcugcgcguccgccugggagggggcagagacgcugccggggcuucuggcggagccucggggccccucugcuucccacccucggaucaccuccgaggcuuaauucugugcugggcuguaaaguccuuggcggggaggaaauaaggcggagagugggaugugcgucuggaaagggcaguggcggaugguggggaggcacgggcucuguccugugcauccaaggaggcguuugucugauuaaggcgcggccucuucccuggcagcucuggggacucugguuuaguuccccugggggcacaggaugcuggggaggguccgaagggucuuuuuuuuagggugcagauaaaaggaucgaauugagugaagauuaagacggagaagauggcgccucugcagugcagcaaagaaaagcuguguggaggcugcagccuagugaaauccacccaccacuagguguauaacaagucuuccccauucauccaacucucgaacauucagcuaacgccugugcacaaugacuguuuuucuuuacaucugaagaugcuuagaaguuguuugcaugacaguugggccagaggaggcuguauuucacuucggacuucgguuggguuccuguuuggcaucuuaacauuugcaaccuuccuuacccguuuuuccccucuuuucccccagccuccuaguaauuuuccaaaagaaaaaaagcaauuuccgggcagauguuuuccuguaauuccacugaggcuguacagacuaucacaccauuaguuuuuuaguuucuaauuugcaaggucauugaacuuuuuucucuucugauuuuuacccacaaguggcucaggaaucaccuuagggcuaguuaagacagguuguuuuaagaguuaaagaauuucguuuuccauguuuuaaaaaaaugcacuuaacuaagagaauucugauuucucucaugacuuacuuacauuuauuuguagaauuauuccaguuuucccgaauggucuuacuacagauuaaaaaccauacauuuaaggaauuaaaagcauaugauaaccguauuuuugaagcuuuugucaaaacuuaaauauguaacuuuguugagcaauauuucuuucuguauaaaaagaggaagcauguaggcagauucgaauuuaguuuuuggucuguuuaauugcauuaauaugcucuuucugccaucuuuugggaccuuuucaguagcuauuguuaacuccuuuaaaggguggaggugagauucacauuaugccauuuugcgaaguguugguagaaggguagguaauucagucuacugagguuugagggugguuuaucugguucucucuguguccacugaaaagauguaauuacgaguugacugucuuuuauagagcuuagaaaauaggucugcugcagguggcuguagaaaagaaaugaauaagggcaaugauaauggggccuuggcuaucgggggaaacaugguuauuaucuggguugaugauuuuggcugguauguugauagaggugugaguuuaacaaacccuaaucuauaugauguuucacuacccuaauauuuauuuauuuauuuauuuuuaaaucuagcuuccucuuaaguuuuauuucccucuguugaggguuuaaccuagucacaaucaucuuaccuuugugguagugcuaauuuauaguuuauggaaaccugcugcuacugacuaguaccucgcuaaagguagaagccgacacacagaauaguaaagcucagguuugauggugaucuguaaggagucacgguucuugcuaaucgaugagaaaccaugauaacuggcagacugcagaagcuuuucucuugucaccggaaccagcagaggcuccugaacgacauuugcaaggcuauuaguacugcggagaaguuacuagauggaauaauacugguccugacugaggaaaugaaaaggaacaugcaaguucacgagguuaaaugaggaauggcugauucaaaaaaauuaaaaagaaauaacgugaucaacaauauugguuugaaggaaugggagagguugucuuuauguuaagucuuguugcuagaggaucucuauuuuauguuacuguuuuuugcauacuagagucuucuacagauauuuguaugaauguugucagucauucuggaaauaagcauagcuauuacuugcauuucacguggccacuaaacuaucagugagaagugcauuaaauucaguagaaauguacauuguuucugcaaauuguauuaccuugagaaucuuacaaagcaucuuucauuaauacauuucuuuuaaaaucucuaucaauuacaaauguaaagauaaaccuguacagaugcauuuuaaauuuaaagcuuccagaauguaagguuuaguucgacugcauaccucauuaccuccccuucccuccucccuccccuuacucccaggaaguuugcaggguaaauaaaacaugcacaugauaauaaaacaaaguggaauguacuaaaauaccaaaaggaaaauacagauuagguauacugaguaaauauguuacagagaaaacuuccuguauuuaaaaaguaaggaacaaugggaugagaucauagauaauccuggagcauuuccugguaguaaauuuccagccagguuuauaucccaggucuggggauuggagguuaaguuucugcauauacaauauuuguuuacauuccucucugccucuaccagacagacagacagacacacacacacacacacacacacacccucugucucuuucucucucuuucucucucucucucucucucucucucucucucucacuugagugacagaugcuggugcaggguauucucaacaggaguagggaauuugaaauaaggaguugagaggucaaagguaaggggcugaaugcaggaccagagagcuucaguagcaucuugaugggcagaguaugagaugaacaguggcaacgaggaggauagggaaaaaucacauuuucuguuuguguuuuguuuuugucuggugguuuucaaccucucucuguuucacuugacuaugcuugauuaugaaaucuuuuuuuuuucuuuuuuuaauuuaaagaucucaacuggcuuuguugugauucuacauucaggcaacacuauucuguaaaauaguauaaauguuccgaugaguugaacagaggagauuggcuuuguagacagaaaagggcugaagaaaacagaaauaaaaaaaucuuuuccuuuucauagugagagcucagaugcaaauguauggaguggggauggaugggaaaugccgucuuuugcaaacccuuggaaacgcugucacccugugggucucacagccaguguacagauaacacccucaucuguacacagaagacagaagguggcaggggaaggaaugagcacaccccagaaugaguagcaaguuuaaucaauaaaauauguauuucuuuuuuuauuguuguauaagaagaaaagcagacagaacucaaacccugaagcugauuuugcaagugaaaagcuuaguaaagggggaaauguuauguaacuauuuuuucaguuuaguguggauggcuuaagaaauaaucauuacugugaggacacuaguauuuuucuuggaaaaaaaaguuuggcaaauuuuccucuuuagauuaaucuugguuauagauuauuauuaugcuugagugguaccucuucagaaguagaaaucuggcaaaaacuggaguacaaugauugcucuaggaauaaauucacauauuuaaauuuaaaagccuggauaugugcaucaauuaauagcuuuaugaaacagggaugcuuaguagauuagcuagcugaguauucagagagggccacagaagucucagguucacauguauuaaaucugcugaaauagaaaccuaagagaucauuuuauuuagguuuauuuuguguggcuacauguugaagaaacaugcaauagagauuuagcuugaaccuugcgagacucacaguaucuuacgaaagaagauaguuaaaauggggaagaugagagguuuuuaaaaaugucaccucuguagaacgaaccagaguuguucucaauuuauaauguugaauuugaugccaggcgugauguuaggccaauaacacugagucauugaguguuucucagguauguagagaaggcagcauugcacacuaaucaggagaguuuagaccagggcaggaaugcaugggcauaaauucugucuuuguuucuuuugagcuagugaccaugggcaaguuucugugccucaguuuuuuccuuuguaaaaugggaugaguacuucuaguuauugaggaucgaauuaauaucuuuguuaaaugcuugaaacagugugugaguuaauauauauguaaccugauggcauagcauaagcacuguguguuaguugcugcuauguauggugaugauguugauguacaauggguauauguaaguuuccugcauaguugaaaguuaaaaaucuagaugauguuucacuuauugacaaauuacuuauuggccaauuaagacuauugcaggaaauugacagauuguugucuaugaguuugaucuaaauuuaaaaagcacaugguaucucagauacaauuuuuagaauacauguuauaaaauuucauuuauuaaauauguauuguguauuucaauugguuuuuugaaaaaugaaaauaauucaugcucauugaaaaauuuaaaacaguacagaaaugugcaaaaagcauaagcauuuuuuacacaaaugggaaauaccuaguuuuuuuuuuucuuuuuuuccacauaacauggauguagaccuuuuuuuuuuuuuuuugagacagaaucucccucugucacccaggcuggagugcaguggcgcgaucucggcucacugcaaccuccgccuccuggguucaagcgauucuccugccucagccuccugaguagcugggacuaugggcacucgccaccaugcccagcuaauuuuuguauuuuuuaaguagagaugggguuucaccauguuggccaggcuggucucaaacuccugaccucaagugaucugcccaccucggccucccagagaccuauuuuuuaauguuguacacacuggcagcuugccacagaugucuaauauugagcaaguuuauacacuggcuugauuauuaacuauuaguuggcuaucagcuaugugcaaggaacugugaacagacuugguuuaguuuucaguagaaucuuugcuagcaaaacgaauaaacaggcuuugccaaucuggguagaaauggaagauuucaaaugccagcaaaagaauuuugguccuaauauggaagcuugaaguuauguucacccaaggacagggaaaccaaaaagcagauugcuugagaaugcggcauuucucuaggaaaucaguuucaaaauaaaaugaauuuuuuguuuuguuuuguuuuugagacggagucucgcccugucgcccaagcuggaaugcaguggugcgaucucagcucacugcaaucuccgccucucagguucaagcgauucuccugccucagccucccgaguagcugggauuacaggcgugugccacuaugcccagcuaauuuuuauauuuuuaguagagacgggguuucacuauguuggucaggcuggucucaaacucuugaccucgugauccgccugccucggccucccaaagugcugcgauuacaggcgugagccaccgcgcccagcugcaguaaagugaauuuguguaaccagccauguuauggcuguuacaucuuuaaaacuuuauagugaucugcuguuuaauugaaauuauauauuuuuuuuaaaaaucagcauauguugcucaaaaauaaaagguuuuuagcuucaaaagcaggccaaggauauuugaaagccuugaguguaugaaacuggugauacugugguuaaaugaugaugaacgcagggaaaaaucaagaagcagagucccaaagaauucacauggguuuuuguuaaccagcucauguaauuauaauuguccuguccaacuaaagacaagaagacaagaaguggguucacauacgaggauguguaaugacagaagccauauuugugauaaacauccugauuacaguagauacagugaggagugauuaagaugguuccagaagcaggaguggaggguucaugagcagggaugaggaauaaauaggacaaacauuuuggaaaagggaaaagaugaauaagccuguuuuguaaauuaauggauccugaugaaugaagugcagugauuccuuaaggucuuauuaaugauggaccccaaacaguguuugaaucucuuaauuuccagaugguuccuuuuuuucuucacaaagucagaagguuuucuuaugagaaauuugauucaacaagaauaauugucacuucuuuuguuuuuuggugauuuuuuuuuuuuuuuuuuuuuuuuuuuuugagacugaguuuuacugugucacccaggcuggagugcaguggcgugucuuggcuuacugcaaccucugccucccggguucaagcaauucucaugccucagccuccugaauagcuggguuuacaggcaugugccaccacgccuggcuaauuuuuguuuuuguuuuuuuuuuuuuuaguagagacaggguuucacuacauuggccaggguggucucgaacuccugacuucaagugauccacccaccuaggccucccaaagugcugggauaacaggugugagccacugcaccuggccaauuuuuuggugauuuugauaggaauuuuuuuuuuugccugaugcuuuuuuugagagaaucuaauaauuugucucuuauuuaauaauuuggcuuucauuagcuuccagaaagccacauacugucuucauugaaaaauguaaggcauccuagaugauacagacugauaaauuacuuuucagccauaaaagauacuuaugagaauaagagaucuguugcauaaagaaaagucauuuguguuaagugaagaaaugcauuauuacucuugcugcuuugcuaaauuucaaacauugaauaacuaauauauuuugacccccuggagauauuuuacaggaagaaaaaugagagguuuaauccuacuguugagauagacuuaacguguuuuagaccugccccucaucccaaguuacuacaaacucauuuguuuaguuuuuccuugucugugugcucguuauuucacaguaaaauuagugaggcaacauaaauuuuauuuuuaagagaaaguaaagaaaauggcuuuauccauuaaagguuuauucaucuuaaaaaaggacuuguuauaucuacuccuacuauuggaugaauuuucaaaagcauauugauacuguguuugguuuuguuuguuuucgggacaaguccucacucugucacccaggcugaagugcaguggugugaucuguagccguggccuccugggcugaagccaucuuccugccccagccuccagaguagcugggacuacaggcaugugccaccacaucugacuaauuucuuaaauguuuuguagagaugggguccccacuauguugcccaggcugaucuugaacuccugggcucaagcgauccuccugccucgaccuuccaaagugcuagauuacaggugugagcuauugugccuggccaauguuguuuuuauaaauaucauuacucaguuauuuuguuuauaauugaauugauaggcucauagaauaaagauggauaagcacuguuucuuaacuguauuuauugauuuuuuuaucuuucaaaaaaaaaauccucaucuacuucaaagauuaagccuuuaaaaccgaugcaaaguuuuugaagucuuagcuuaagucuucagagacuaacauuaaaacccaucauaugaaaagugauauguaguagcaaauauucuccauccugaugcucucaauugcuuauuaugguuuaacacaaauauaauuuugucauuacaguaaauuaguuugaggauauaacugaagaguaccuaagaaacucccauagaaaugugaaaauaugcagacuaauuauucuaagaauaauuaaucauagauacuuacauauuaaauugauuagcaauuuaaaauuaaagccaaauuucuguggaaauuagcuuauuuucauacacaaagaaaccuagauucuuagggguacaaccaagaaagggccacuccuucauuucacaaauauuuucgagguccuugcccccaagaggguagacagaauaaaaaggaggaaggaagugacuuggaaaaaauuaaguuggguaaggaauauaagagaaugcuacguagaaggauguguguugugaaugcaauaguuucuguaguauugucaaaguucucugaucauuucaguaugugaagguaaacuuagauaacugggggaaggaacuauauauuuacuacauuguaaaagaauaauuguagacagaagaucuacuuugggugauuaaauguugaaaacaaguggugggagagagaaguuaguguugauugugaucacacacuuuucuauacaguaauuuguuugaucacucaugauaaugccuuacauuuuguauguacuaaauaaaugaguucucuagaaauucuauguuguggugauaaagaauuacguucagauugaagauucgaacagcugugcaaccuucucaacauuuaagaaacugcgaacaagcauagaaagaagauuaaagccuuuuaaauaagauucuuuuuuuucagccucuuuuuggaacauuuuauugugaaaagguuucauaaauacugucaauacaucacguucagucauuugcaauuguauuucaaaaauucaguuggccugcaaaaagaaaaaaugccucauuuuugaaauauuucauccaugcccugauugauugggacacuuucaauagagggugccuagacauaauuuugugugaagaaguuaguagaguuuggaaagaaaauguguauuggaauuaaauuuaguggcaugaaaaugaaaauuucucugucauugucuuuuuuuuuggcuccuuuuuuggccauuuuacagcuaguguuuagugugacaaggaucaaaauuggcccuuuaaaaaaauauauugaauucuauuaccucuguuaucuaaaagaauuguauuuuucaauuugaagagcuugaagccaauacuacuauauaccauuaacuugacaggaauugaaaaucuaauugaggucauuaugauuagccuuguaucuugcuaguauuuucucaaucuuauuuugaauguuuugugucaaguguuaaauccucuuauaccacagaauccagaaaauuuaaaugcaacagaaguaaaacgaauauaaaaauucuaugguuguuguggaggggcguucuuggcuaacccauaggguguuugaauguaaaggcagcuuacagaacugcugcuaguugaauuguggaggguuucacuuuuaagaguacauuugagacaaaauugcaauuuuggaaucacuuauuccugcuuguucagugaaauaggagaggggggaauuccugagggaagcugggagauuuccaggugaugauagaguagccaugugaguauuuggcugaaacagaguagaagccaccucugucuguuggacagagguggccuuaacacugaguaucaaucagcauggccauuagagcuguccaggacaaacauaaugaauguugugguggcagagaggguauacuuaaaugaacaaaauuggaggcugacuuuccuuguuucuugguaguuccuuucuucguauuugcuauuuggauauuucacuucacuuuugugagcuagacucaaagguuaaauuuauaucauugugaauuuucugggucauauuguagggacacagaugggaagcaucccuucaguuuauugagaguauuucuuaugcgcauguguuuuuaauuguauuuauugauuuaauaaauagccgaugagaugagaaaaaaauauuagugucuuguuguugcagagaaaaagacauuggaugcauucuuagaauuuauuaucacaugcgaaguuauuuagauuuacaaagcaaucugacauguugacuucauugcucguuugcucauuucuaucagagguugaacacaaagccaagccuaagcccgugauucuucugugugcagaugagggggaagguuuaaugcagaauguuuagcugaauauuuggauugugcauuccccuuuuaugucucuacugcaaguuuucucagggcauuugugauugacuucugugauguugacauuuauuuggaguuagauguuuaaaaaauuacuaauuuauggccuggugcgguggcuuacaccuguaaucccagcacuuugggaggccaaggcggguggaucacgaggucaggagauccaguccauccuggcuaacauggugaaacccugucuccacuaaaaauacaacaaauuaaccgggcguggugacaggcaccuguagucccagcuacucgggaggcugaggcaggagaauggugugaaccugggaggcagagcuugcagugagccaucgugccacugcacuccagccuaggcaacagagcgagacuccgucucaaaaaaaaaaaaaauuuacuaucuuauuguuucucucauuuugaauuugugaaauuauuauucauuuuauggacauacugcauggauucuguguuucaguuaugacaggagaucuagaaucuggguggggcugugaguaaauagaaagguaacucagucugugccuugaggaauuccgcaguccaguggaggaagaaagagacggagaaauaauuagguacagugugccaaaggcuauaauagaggagguacaaacucuucccagagaaggcaggcagaauuugaacuagguuucaaggaugugugaaggugaacugggguggggagggcuucccagacagaaaaaacagcgaggguguagaguuucaaagggggaagcccagggguauaauaagugaaggagacagugugaaauuauaaauuuuggaugcccuuaaugaguuugaacuucauuuucuuagaaauggaguacuuuuaaauguuccuaaaauggggacgaggcauugauauucaugguucaguuagguuuaggagcuuuuguagaaguccuuuucaaggucugcuuaaucucaugggccagauagugacaccucgaugcaagggagcauguaaaugugcucuauuagcugggagcauugcuaucagaaauuacauuuccggcucucuucuuaaggguaaaggagagguaggauauugaguggcaacuggcauucugggauguagaagaaauacaguaccauaaagggauagaggaaaauggguagacuuaacguucugaaccaaagcuaagauucuccgugagcgauuagaguaggcuuuugggauuugcuuaccuucucuuaucugcuagccagccacacaggaagcacaucuuuguggagugacagaggaggagguaggaaaugcuuucucauuuuuaugguagaaacauccaagagcugagccuucauucuggcugagagaacucuagaugguucagacuugcauuccugggaaggccuuccagcuagagugauggaacaaagcaaugauuucuguggcccuguguggacagcaguggcagucaguuuacucucccuguugguuaacugucuuucguuugaucuagagacuuccucaaaacaauuuuguugugcuuguucuuugaaagcaacagcagacaaaacaagcuuugagguuuuuagaaaagagcuugacacugagcaccucuuuugagcuagaucugucugucaugcugaaccuguuuucuguggcugcguagcuuuucaaaucuguuuaugcuugcugguguuauugaaacagaaugggaagaucuaugcaaaaaggaacauugaucuuaauaaauuuaugucaguaagaaugggacugccauuuuaaaauuuauuuuaauuccuuaccuauuuucuuguucaauuauucuaaaagugauuaaaugaagauacgucacagaaaguaugcuuugaaaucaagauguggggaaaaccuguaguucugaguaggccugauagaaucaucauuguuagaguauuuggagguuuuguaguagggauuuugucuucacuuaaauauuuaguugaaauauguuccaauaguuugacacauuacagaaucugucugaaagaaaugucuaaaauaugauuccucagaagcugcucuugguuuuacuuucugcuguugguuuuacuuucuaacauuucauuuugaucccgcaguuuuaagaguaaucaaaaaggccgggcacgguggcucacaccuguaaucccagcacuucgggagacugagguggguggaucacuugaggucaggaguucaaggccagccuggccaacauggugaaaccccgucucuacaaaaaauacaaaaaucagccgagcgugguggugcaugccuguagucucaguuacucgggaggcugagacaggagaaucccuugaacccaggaggcggagguugcagugagccgagaucauaccacugcauuccagccugggcaacagagccagacucugucucaaaaaaaaagaguaaucaaaaagcuacauuauuuaaaucuuggcaugucuuuaaaaaauguuaaacugucaggaaaauuaucacuucuggauaccaccuucagaaaaacacaugaaaauuugugcaugucucaaauaguuguuaauuuaugaaaaauuagaaagaguguuugaauguauauuucugucauauuauauugcucauauuuuuaaauuauacuuuuuuucacccgugaagcccauauaguuaaguuugaaaauuuuaauuauauuagaauuugaaaauuaaauaaaucuccuuuaauucaugcauaauuuucuaauagucauauaguuuguauuauauaauuugagaaacuugguucuaaaaaaauugucugccaaagaauguauauuucugaauucuguucugcuuucauacaucugaaaauauuugagcuaucauaacuggcuaugcuucaaacccagucugaaaugggugaccuuugcuggcuuuggauugcagagcugggggcuguuguuugcuuuaucugauuuaaaauagucaguaguuuauuuugcaggcaguuagauguauaccuuugcauaaaaucauugaacugaaaagguuggcacuccaagaauacguugugagaaaagagaacuugaguacucacucucgacucaccugaaucuuauuaauauuuuauugauuaauaucuguuguauuuuuaaguaaauaagcucucuagaaacuaucucugcuucuuuguucauuuaaaauauauuaaacaaauugauacagauugcaaaaauuaguugcaacguuccuaguuagauaucaaugaaauaaaaauggucuauucauacgaguucauuuuaguuauuccuacuaauaucaaauguguuuuaaaaaaugggagauuauaaucuuuuuaugaaguaagauaaauuauuacuuuguauauuuaauucaaagaaaacaaaaaggccacaagugccugcauaaaggcacauccacuuaggauuauuguuaaggccuacaguugauaauuaggauucaggcauagcauaaaugaagugguaucuuuuuuuuuuuuuuuuuuuuugagacgaagucucgcucuguuguccaggcuggagugcaguggcacggucucggcucacugcaagcucugccucccuccuggguucacgccauucuccucccucagccucccgaguagcugggacuacaggcuuccgccaccacucccagcuacguuuuuuuguauuuuugguagagacaggguuucaccauguuagccaggauggucuugaucuccugaccucaugauccacccgucucggccucccaaagugcugggauuacaggcaugagccaccgcgcccagccagauaucaauuauuuuuagacccaaugauauuugcuguugauuuauuguuggugcacaaaauaagaaaacaaaagcaugguuuuaaaacagcccuuuacacauuuaauauggaaaugguaaccuacaggucuguauuccauacagauuccugggcucauuuuaucugugaauuccucugggcgucaugcaugcccaggacugacuuuaaagcagaauuauccaguagagguauaauaggaccguuagaucuaauuuaaaguuuucaaguagccacauaaaaaaauaagcaggcgaaauuaauuuuagucugucacuaaauucaaaauguuauuucaacagggggucaauauaaaagcuauuuaugaaauacauuauuuuuucauauuaugucuucaaaauguucacauuucacauauuuauuuuuuauuuuauuauuacuauuuuuuugagacggagucucacucagucgguugcccaggcuagagugcaaucuagcuugcucauugcaaucuuggcucauugcaaccuccaccuccuggguucaagcaguuuuccugccucagccuccugaguagcugggauuacaggcgugugccaucacacccagcuaauuuuuuuauuuuugguagggaugagauuucaccauguuggccaggcuggucuugaacuccugaccucaagugacuugccgcuuuggccucccaaagugccgggauuacaguugugagccaccgcaccugauuacauauuucacauauuuuaauucagaccagcugcaugucaaguacuuaguagccacagauggcuagugguuacuguauuggacagugcagcucuaggagagucucuucaaccugcagcugucuaggaagagaaucauaguuucuggaacagguagaaucuauaagaccuccuuuuuaagcuucuccacuuuacagaugaagaaaguaauaucuggagauguugaguuguucaaaaucacccacauuuuaaggaucaagagcccagucccuguucucuaacuucuaaucucuuucuucaucacuuuuucugcuucauguugcugcauccccuuuaguuacuaagguacuaacguuagguuguugcuaucaguuaaauauuaagccaggagcuuuaagacaaucuggcccacuugaaggcauggccugauuuggacaaaacuugugggguaggaugaauagaguuaccaggcauaucuucaaccucucuguggacuaguauuauacauauaugagaugauguaggguccagugaucaguucaucuuuuucuauugugagcacuguuggaauaggaauggggggaccuuuugggacccaggauaugugauucugaacccugaaaugucagaugcccacuaaaaggaaggggagagauggaccugucauuaccuuacacauuuuauugucuguauggguauguaaacauguacagauuauaaggaauugcacuucauuucugggcuucuggaaacacagguauuaagauuucauuuaccuccccuuguuuuggaaggcuuauugugugugugcccauaguucuuacccaguuacacuuaaaguaugauacuuuuugacagcuuaagccuauugcauuccuggcauguaaaauaguuauuuucagaauguaagcaaauguggaaagcuuacugccugacauggaggguuggagaagugggauugguguucuuuuguuguaaacucauuuuugugaaauauuugcuuuacaacgugaagcaugcaugauggaugaacuuuuagaauugaaaguuauuuuucauuucauuccugaaauauuuaccagcauggauguugacugagugcuuugaagaguuugcuuagucauauaacuuagguuuuaugauuuuagauuuaauuaaacuuaaaguuuuccuguuugauccucaggacuucucaucuguggcaaggcuuuacucacaaaggaaauaucaaccuugaaguuaagcaugcccuguguuucuuuauauucugaugaaaacgauugaaguuugccagugcugugucugggacaaugcuuagaggauucauggcuuguaggaaugaguuaaaaguacaaggauauuggcuggcauggugacugucgccuguagucccaaaacuuugagagucugaggucagaggauugcuugagcucaggaguuugagacaagccugggcagcauaaggagaucccaucucuauguuuuuuaaaaaagugaaaaacaacaacaacaacaagguacagggguaucugcguuuccuuaggcagcugucuuauauaccuuuaaccuuaaaaaaauccaccauuuuuaaaacaguguuuucuguuguuuuucuuaguaaauauaaacaauaggaacugaaguuuagggcuuaaaauuuuugagagaauaauuuuuauuucaguagcuuuugggguacaagugguuucuuguuacuuaguugaauuacguaguggugaauucugagauuuuagugcacuuaaguaggguaccuuguaccuaaugucuaguuuuucuuuuaaucccuaguccccuauuacccuccuccucgugagucucuaaaguccaauaugucccucugugugccuuugcuuauuccuaacuuaguucccacuuauaagagagaacauacgguuuuugguuuuccaauuccugaauuacuuuacuuagaauaauggccuccagcucuauccaaguuguugcaaaagacauuauuuuguuccuuguaauggcugaguaguagucccugauauauauaugccacaucuucuuuauccucucauuagucaguggccacuuagguugguucugcaucuuugcauuugugaauugugguccuguaaacauauguguacaagugucuuuuucauacaaugacuucuuuuccuccggguagauacccaguauuaagauugcuggaucaaaugguagaucuacuuuuaacucuuuaggaaaucuccauaauguuuuccauagaggugguacuaguuuacauucugagagaauaauuuuuguaaaauuauguuuaagcuagauuuggaauugggaaagaauuacauucuuuauaggaagcuuuugaaaaauauauuuaaaaauauauaaaaauaugcauaauccuaccacccacaaaugucuguauuauuaugucauuucuaaaccauuuuugagauuaugcuauagauuacguuuuagauccuacauuuuauuucuuaacauuaaaucucauacuauuuuaaguucuuuguacauguaauguuuacugaauggguaaaucuguuuagggaaacuggagcuauguaguuguggacuugugcuuuuguuuuguuuuguuuuguuuguuuguacauuugcuuuuuagaaaugucuauucagauccuuggcccauuuuuuuuuuuuuuuuuuuuuuugagauggagucuugcucugucgcccagacuggagugcaguggcgcgaucucggcucacugcaagcuccgccucccggguucacgccauucucccgccucagccucccgaguagcugggacuacgggcgcccgccaccacgcccggcuaauuuuguuuuuguuuuguauuuuuaguagagauaggguuucaccauguuggccaggauggucuugaucuccugaccucgugauccccccgccucggccucccaaagugcugggauuacaggcgugagccaccgugcccagacagacaugugcuuuuuuauuuggcauuucuagccugaacauaggcuggaaguagugacuuagagagggauuguuugccaaauaucagguaauauuuuaauuauuuauuauuuauuguaaugcugugaaucaggagucccuaaccccugggccauggacugguaccggucuguggcguguuaggagcuuugcugcacagcaguaggugagcaaugggugagugaguguugcugccugagcccugccucuugucacaucagcagggcauuagaugcucauaggagcgcaaacccuauugugaaccgcauguaagaaagugagagcugcguugcacacuccuuauuagaaucuaaugccugaugaucugagguggagcaguuucaucccgaaaccaaaccacaaaauugucuuucaucaaaccauucccuggugccagaaaggcuggggaccacugcuauaaauugcugcugucaaguaguguuacgcaugguggucuuuaacauaaaaaaaaaagguaaugaacguacaccacacagauuagcaaaaauaaggaaaggcugaucuaguaguucaaacaagcaauccucuuauuuaaugguucugugauugcucguguaggcagaagcuuaacuguaaguuguugcauuugacaggcaaauguagcuggagcuggaauguagauauuagugaaauugugauuucaguuuacuggagccauucagugggagcaugaaguggguuacaugauuacacggauauaaauaaagcguccuccuugccacuucacugcuguuaaagucucuccugauguuauguggugaaaaacaagucaaaaacauuaauucugucaaguuuccaaagauauaagaaucuuugaccagaaaagagacgguauuuaucuucaaauuuaacaaauugugaugaaaugcugcuguuacagaaccuaguguaaggucguggaguccauucagccagacacauguaauuuugauuauuaacugccguuucuguggucagucggccaguuuuauauauuucacauuauagguauuuggagcaaagacaguguuguuuauuguuuacuuuaaaaaaauacaauacuguaacuacauaaugaguaaauguugauacuguugaaaacuaauaaaaacaaauucuuacacuaucaacaucacagaaauucuaauuguaagaaaauauugauauaauauggaaauccguucauuuauuuggugcauuaauugaacaccaacacuaugccaagcauugggauacaaccaugaaagaggccagcuuccugaucucacagagcuuguacuuuguuggguggggcagagagcaaaucagucaaucugucugucugucugucuaucuaucugucuaucuaucugucuaucuagaugucaaucaguauacucugugccacuugguggucagugcuaugaagaaaaauuaagccagugaggagcuggauagagacacagucuggaaggguaugaaggggaucagaauaugcuacccccaaauaugccauuucagcaaaguacuaauuugagcugaagacaaucgagaaauagcagacccaggacaagcuuuacccccuuuuuauaaaaauuuugcugugugaagguauccuccuuccccucuccaucccuggagagaccacuagagguggcaccaucgccugcagaaacaaaccuuauugaaauaacccuuaucuucuauuaguuucccccauauauuuaccuuaccacacuuccccuggaagcccuaauccccucuccuuugucuugugacuucuccacaguuuauugcucuuuguuaaaaugguguguaugcucucaggccuaacugcuucuuuuggguuuuugcuuuucuguggagcucccuccucuccccucccucauguaaaaauaauaacauuaaauaaaauuuguguuuuuuccccugcgaaucugucucgucaguuuaauuggcaaggccucaugugcugaaccuaacaggguagagaaaaaagguuuuuuuccccuuuucuacaaguauuaaaccuggagagaacaauacaguguaaaggcugugaggugggagcaugcugggguguuggaagaagcacaugagcuuacaaacauuccaucaauuugcauucauuccaaaaauuguaugcaauuuuucagugacgauucccauugaucaaucauuuauaaaaacuaauggugagggucuuccauacucaguuuacucccuucuuggaaaagaauguacauuuuaaucaagaugauuucaugaaagacauucuguacuccaaacauuuaaaagagcguuuagaguauacagcaauucaucuuuucuucuguauuuuaaaauuuaagacagggagaauuauuguauuauacuuaguucagauuugguggugguuuuguuuuuugguuccagugaaaagaaauugcaucaguaaccuggcggucaaccgugccauauuguuugugauuuauuagucuggaaaaaauaacuguauuucuggcauauguaaaaauaguuugcugagaggccuccuugguuguggcaauaguaauacuaauuaccagguacuguauguagcucauucuaugaaccaggccuuguugaaaagugcuuucacuuaauuuuuucuuuucagcagccugugagguaccuacuguuauccccagcugggagggagcuggccaguggacuggguuuaaacuauguuuucauugucuuuacucuuaaccacuuaucuucucugccuccagcaaaauaagucaaagaguucagccaguguuucuucuuggacuaagcagucagccuccuaaguaagcaagccuuggaaugcaauugauugguaagauacuaaaguaaucaguaaggcccucaguuccuggcugccagcuucuuucacccucuccugcaggaaguucugaaugcugauaucucuacuuggugucuucucucccccucccaauuccauuauuucccuuuuucucaaucccaagugaaggaaguucugaguguggauguuggagucauucagaccuuggaucugagucacaacucuuucaauuuacuagaaauaugacugcaagaaaaugauguaagcuucccuaaaccaauuuccacaucuacaaaguaucuaaauagauugcuuaggagaaaaauugaauuaaauugaauaaagugcaaagcacagaacauggccaggaguaggcccuggaugaaugagggaaaaaugguucugauuuuuauuuuugagccucuuuguaacauuuguuggccccuucagaauaauccuuagaguucauaucagccacccuucaucccuccugggaugggccaggggagaggcccaguugccugugacacugcuucguuucacauuucacugcuuuagcaucucaacauuucauugauaacauuuuugaugccugaaaacagaauaacuuauuuguaauucuacauacauuuuguuugugaucaaguuguuagaguuugaaaugagccucauuuccuuggguuuugucccuccccaucugaccuuccucuucucagugaacccugaagaaaaaacacuagcaaaggaaucucaagaauguugguucgggacacagcucucuccaucuacucuccugcccuaguccugccccuccuuguguuuucagcggugaccaggcacuggugacagccuuggcugcuuggaccagcuggagguagcugcaaaaugccugccugcuagcuuugaaaaaucucugccaaccucauugaaauaauuguuuaccacauaucagaggggacugggaaguggguaauugagagaucuuuuugaagggguuuguggcuucuccacuugcagaggcuuccugaaaugguggguaaugcucaugccucagggagaaucaauauccuucuccuaaaaccugcucacacguagcucuaaguauuagacaugcauuuuuguuaacauuuuaucagugcauuuuucuaccugugucauuuggaccuuagauucgggagaaaaucacuguguaucuuuggugguuucagguggcucuuaaauuucauuaauucacaaaaucugaauugaauggaauagucuguuuugggagguuuuuuuggggggguuggggagggauuggauuuuucaguccuuccaagagacuucagguuuuuuuuuugauguucugauuagcccgguguguguaaggcccuaucagguguucgccugugugauccuaucacacccacauccuguagcugcauccaagugcuuugaggccgacuuaauggggauuaacuuaacaguugcucugugggaacagaugcucuuugccgcuuauuucuaauaaauugauugagccauuuaaaagauuuuuuuuuucuuuuaaguuacaucuucuuaagaaacuguagacaauaaagcaaaacuaaaauacuugggucuaaaauuaguguauuauauuuaaaacacugggcuucagacugauuauaucaugcucuuuuacugacuuucuagucagaugcuuauuuauaaaaauaaagcuuauauaaagggcagcauucaaauguuacaccagucgguuuuagcaguuugaccuuccacaguagcuaaauauuuuuuacacugagagaagaauucuuuaacauuauaugcuaucagcaugucaagugaauucugagcuugcaugcaacagaugagacccuagguggaaacauaaaaacauaccagugugaaagagaaaagcaggcucucugucuuugggaaggaguucugcagggagggguguuuauaaguguaguagauacuuaggaaaauuaauacaauuauuauaaaagucaucugggaaaaaccauuagguaagaauagccaauaaaaaaccagaagcaaaauguaaagauauagaaauuaaaacugcacaucccaugcauagauaggucaauggggcaaacuggaagucuagaaauaaaguugugcauauauuggaaauuagugcaagauaaaagugucuuuuuacaucagaaaggggaaagauggauuauuuaguuaaugguguuggguuaucugacuguacauagaaggaagguggguaauuauuuacccaguaccaauacuggauuaccuaguauuauguacccaguacaguuugucagcaacaaaaggcaaacuuuuuuauuccaugaaguguucuuacaaaucaguaagaaauacuaaauaugaacaucuucagagaaaaaugaacauuuuugaaaacuuauuaugaaaagaauuaaacauacacaagagagaauagugcgcugaaugcucagcaaugaucagcucucacccagucuuguuuuaucuguauuccccuuucucaaccugcucaauucucuuuucccucacuggguuauuuugaaauaauuucaauucuauaauuuuauguauaaauauuucaguguggaugucuaacagaaucucuauuagacguggacaaaaaaggcaaagaauuuuauaguacacaggaaaaaauacacagccaauaaaccuaugaagauaugcucaaucucauagucgucagggaaaugcaaaguaaaacagugauauaacauuguuuuuuaaaacccugaugggcaaagacuaaaaaggcuugccagauuggcauuuucaucuacugucaauugauaacagauauuucuuugcuuggaguacaguggcacagucuggacucacugcaaccucugccucccagguucaagugauucuccugccucagccucccgaguaccugggauuacaggugugagccaccacgccuggcucauuuuuuguauuuuuaguagaagcaggguuucaccauguuggccaggcuggucucgaauuccugaccucaagugaucugcccacugcaggcaugagccgcugcaugcagcugguacagaaauuuuuuagaucagucauuuagaauuuuauguacauaucccuugaucuaggaauucuagaaacuaauuaguucauaguauauuguauaaaugcgcacagaugaggauauuaugagagcauuauuuguaucaacuaagcaagccuuuaaaaaacucuuauacaguagaauauuaugcugauacauuaaaagugggcauaaccauacugauguauagaaauaucuaaaaucauaccgauauaagugaaaacauucagaaugcaggcauaaucacagauuaaacaguaauuuauauaaaaaacagaaaauuuauauguguauuaugucaguagcagauucaagugaaucugacaaaaucugacucugggcaaugagaacauuggaauggaggagaagguaguacauauuuacuuuguauauuaucaccuuuuguacuauuugagucuuuuuaacuguacgcagauacuuuagagcagggguccccaacacccagccauggacagguacugguccauggccugcuaggaaccgggccacacagcaggaggugaguggcaggcaggugagccagugagcauuacugccugagugcugcuuccuggcaguagauucucacaggagcacaaaaccuauugugaacuaaacaugggagggauccagguugccugguccaguccuugugagaaucuaacuaaugucugaugaucugagguggaagaguuucaucccaaaaccaucccaucccauccagucucaugccaucccacccccaacaccccauggauaaauggucuuccacaaaaccagucccuggugccaaaaagguuagagaucacugccuuagaggcugcucccucuuggcacaucuugaauguaggacuccuugguucugccauuccugguagguagucagccagcuuuugauaguucuccccagagacuucaucccacaggcaagccaucccauuccacguaaaacaucucuaauguuaggaaggcacguauuuugaugugauaucuagaauccucccagcuguucuucagaggaacauuacuuuuauaaaguugaaaagaacguuuuauuguauuauaaaacuaggucauuucagugaauuucaucuauuuucauggguaacugauucuuauaucaaaacuugcuuuugaaaguacuggaagcauaaauuauuacuucaggcccauuugcuuuacuuuguucagcacauugaacaucaaggagcaacucccucgaucuaaaauuucuagcauuggugcuuguaauaucauuuuucaaguugacauuaaugcuaucuuuggaauucucaugguaagucagaagaaagcaguuuaguggaacuguucuuucucccacugaauuguauacugagaucuguuauauuuucugcauuuuaacccagaaaguuguucaagagaauugaccaugauaagacaucuguagcuuauuuuguauuuuuuuaauggaaaauuguaacugacuuuuaaauuuaagauugaguguagccuuucccaaaccaauagcuaauguuuuuauaacuauuuaguguaggagauuauaauaaaauccacauugcuuaagauauaaaauguuugugcaguaauaggcuguauaaaaacaguaaauugagauuguaucaggaauaauguauuauaaaccauauaugaaaccagguacuaacuugguauucugcauagcuuuaucagaaaggcagagcaaauacuaucucaaaaugaaguauaaacaaaaugagguucagugagugaugugguuuggcuccauccccaccuggaucucaucuugaauuguaguccccauaauccccauguguagugggagggaccagguggagauaacugaaucauagaggcgguuucccccauccuguucugguaauagugaguuaguucucacgagaacugaucacuuuauaagggacuuuuccccccuuuugcuuggcacuucuucuuccugccaccaugugaagaaggacguguuugccuccccgucuacccuaauuguaagguuccugaggccuccccagccaugcugaacugugagucaguucaaccuguuucuuuuauaaauuacugagucuuggauaugucuucauuagcagcgugagaucagauuaauacagggaggcuacauaauuugacccaaguagcaauaaacaauaggggugagguugaaauccaggccccugguacuuauggccuuaagcuaagugaaauaagccagacacagaaaaacaaauacugcaugauuucauuuauauguggaaccuaaaacacucaaacucauggaaacaagaguagaagggugguguuaccaggguuuggaugugggggaagugaggcgauguuggucaaagggugcaaacuugcaguuaugagauuaauaccuaauguacagccuagugacuaguuaauaauagugaauuguacacuugaaaacgucugcgagaguaaauguuaaauauucuuaccacacagaacaaaaaaaguaacucugaggugauggauauguuaauuagcuugauugugauaaucauuucacaguguauacauauaucaaaacaucacguuguauacauugaauauacauaauuuuugucaauuauacuucaguaaagcuagggaagaauaaaagaagugaccuaaccaggacaccuaucuguagcucuaugguaaagccaaaagggauaauaacuuuugauuaucaaaacuucaucaucauuauuauuuuuuaagacugggucuugcuauguuacuuaggcuggucucaaacuccuaggcuaagugauccuccugccuuggccucccgacauauuaggauuauaggcaugagccaucacacccagccaguuuugaagguaucuuuauuacauuuuuuuguuuaaauauuuaauaguaaguguuuaacuugaagcauuuuuuucugccuuaaaauugauuuucccacucauuuuauggaucaaaacuauuaucagauuuuaauucccacuccaccacauuguuuauaaaaguugacaauuauggaaaguaaaguaauacugaauuuuucuaaugccuaucuuugacauggaauaaagauuauaaaauuucuuauaacuugaaugaguuuuuaaaaauuggacaucuuuuuauaaaaaucuagcauugaccauuucaacauaaguuuuacuuaucucugaaauacagguaguaccuauuuuuauuaauuuucuuaagugaugcugagugacacuauuuuuguuuuuuuucacuuuuucuuuacuuuuuuuuugagacaggaucucagucugcugccaaggcuagagugcagugguguggucuuagcucacugcagccucggcuuccugggcucaagcgaugcugccaccucagccuccugaguagcugggacuacagguuugcaccaccaggcccagcaguuuuaaagauuuuuuguagagauggggucuugcuguguugcccagacuggucuugaacuccuggccucaggcgagccuccgaccucuaucucccaaagugcuggaauuauagacaucaaccaccgugccuggccccagugacacugucuuaauuuugaauagggaaguaucuaaugguauuaaaauggucuggcagagaaggggauaugaggcuuggugaaaauaagcacaggaugcaccaucuuugaguaaguguuaguuucugcagugagccagcagcaacauucuuagcagagccuagaaagaucgagugagggcugugugguggugcagccucuuaagucucucugguuccacaacaugcucagauugguggcuuugauauuuucuccauccaggacgcauugugcuaagcuuagggaagguccaguggauauuuaccaagccucuuauacugccccgcauguugccaugagacagcagcguuaucaccuuaaauggugcaaauacuccuugugcauacccuaccccugagaucuaacaucuggauucuggauacuguuuccuauucuuccaucuugcugcaugguucccagguuauguauauaguguggcuaggcaccacacauggcccuggcuccuugcagccauacagaggugaccuaacuggauguaauuggguauguaccggguguuggcuaccugugcagguugagggccuuccacaggucuagcaaagcaauucauugccuuucugaauuuuugaaugcuucauuugugaaacccuugauguaauaacuguugauauuauuucuuuuugaaaacuccccuuacucuucccuguuucuucauuuguaaacuggaaccgauagaaaaguaccaaacuuaggguuguugugaggcguaaaagaaauaauacagcccagagaacauaguauauacucagcaaguauuuauuaauaugacuacuaagccagcauuggugauugauuggcucauagugucuucuauuugccagauguuuucagaggcucuguucauguucauacccauguuuguaaaugacagaauguaaauuucuuaauccucugucuucuccuuuagcaucagcucuuguccccaaaguaaaagaacucagucauccagaacccaguuuuguagaucuauuuuucaaaauugggcaguuaauagaaaauuaaaagcagucuagggaaaagccuuuccuuuggguuuguugcuuucuuuucugucauaauaagacugugcccaaacuguagggaaaaaucaagaaacuguaaaauacaucaucaggguguuuauaguaaauguaaaacguuaaguaacauuugaguuaaucugugcuuguacaaaccucagaagcuuaaauaaugaaccaaugacauauaauuuagaaaguuuucauuagacucuuugcguugguauuugcaauaucagauuugcaugucaucauuauuagccuuccucuauuuugaguguugacuaggugccaggcgucauguugagaaauuuaugugcuuauuuaauucucacacugacuccaugagauagauacuccauuuuacagaugaggaccccacaucauaaccuuuuggccagaauuacaguuaguguuagaauuuaaaccuaugcagucucauuccaaauccucugucuuuacuccuccagaaugcuccauuaaaugaauuguuucuuauaauccgguuguuuuaacguuggaaaagaacuugagaacauuuagcccaaccacccuaugaaguuuggcaguacuucuugccauucuuucaauagauaauuuauuugaguuuaagggagagucuaugaauuaacacuaguaccaaaacucccaugagaaaauaauguagacagcuuuuguuaaaaaagcagaauuuuuaaagguguucauucaguuaucuucuugccuaacaaguuccuguguugugauagacuuugaauuuguuaaauaugaauuggcuuccugauucuagcuguuuugccagaggccugauuuagagaagggauuaaaccacuggucaaccuuggauggaauuugggccagcaguuccuucuccacagccccugacacuuggcuuugugccaagaaaauccuacaaaaggaaauugauuuacucuacccaagacagaguuccggaggcuuugguuguccauuguuagcuuagaaguuggcgcagugugcgugugauccacgccuaaauagcacagccuugcugugcgugguagaaguuggguuaguguugacaugcuguugacucacccucccgaggauggaagcucuggccugggucaaguuguggucacugcaguuaacaguuuguugaucucagggaguauuccacaguugcugauguaauugacaaugauuggagccagcucuuccccagauucaaauggaccaauuagaggacuuguugguucuguuuaucaacuauguaagugaguacugugaaguuggcauuguuuuuagucuguauuuggguaagaugaaacucuguucucagacaguaauaucuuucaaaaguacaauguuacuuauugugaccaaaguagggaugaaguuugcaaauuauuugguguaaugauuuaauuuggccauccaugcagugcaguucucuaccagugugauuguucucuuuguaaaauacucuuacuuugccagaaaauuguuuguuuguuuguuuguuuguuuguuuguuuguuuguuuugagacggagucucgcucuguugccaggcuggagugcaguggcccgauauuggcucacugcauccuucaagcaauucuccucccucagccuccugaguagcugggacuacaggugugugccaccacguccagcuaauuucuguauuuuuaauagagacgagguuucaucauguuggccaggauggucuugaucucuugaccucgugaucugccugccucggccuccuaaagugcugggauacaggcgugagccacugagcccuguugaaaauucuuauuaauaagauguuucucauagaauguuucaaaaaauugugacugguuucaaaaucagaugauuugcaagaauuagccauaguauaaacacauaguucucaaaccguuuucugggagugggcccagagaucuauuuaacaaaaccuugaguagagucuggugcaaguuaaaauuggagaaccacuaauguaaccuuaccuuaucuguggaccacauuuugagcuuuggaagaaauaacccuuucuauccuucacaagguaacagaugauuuuuuugcacaauuauuugauaaugagcuuauauuugagauuaagguaugcacacgauaauguacauucucacucuaggucuggggaccuugauucuuugacucuucuguccuuuucucuccaguuacuugguuuugugcauuaacaaacuuuucaauuuacuuauuuuuuuuuacuuauuuacuuauuucucaucccuuacguaauguugcaucauuguuuuuuguagccucugcaguucaagauacuaaucaccccuuucuaccacauuaaaauacagacucuaccuaaaaucauguaugggaguaacuugauauauacgaaaguguaaccgugucacaauuccccgccccaccccgccagucuacauaaaacugcaaacacuuuauugcuuaccaagaaaguagacaauaauaucgaagaaagcccuccuuuuccucuucuuugaccaacaagggagcaguuccugacaaaugucaguuugcuuuuugaguuccuuagguuucuguguuguguuugcaauggauaaauauugaguaacagguacugacuguauuguauacauugaaaacuauccaccaacagaauauuugcaggaggauuuuguuuuguuuuguuuuguuuuguuuuguuuuguuuucugagacaggcuaucucucugucacccaggauggagugccauggagucaucauggcuuacuguagccuuaaccuccuugucucaagcgauccucccgccucagccuccuaaguagcuaggacuacaggagaggaacaccaugccuggcuaauuuuuuuuuuuuuuuuuguagagacagaguuucgcuguguuggccaggcuaguguugaacuccugggcucaagaaaucucccaaagugcugggauuauaggcaucagccacugugccuggcuugagaaugacauucuauaaguaguuucagucccuuaguuuaaucccauauuuugauccuauaacauguacaauauuuguguauaguauaugaucugccaacucucuaagaagauuuuaaaacuuauuauguuaaauuucagacauauacaucauccagcuucaaaaauugaccacauuuugcuguucuuguuucagcaccucccccugccccauuuucuuuucugaagcauuuuaaaauaauucucagguaucauaucauuuuacuucuguucauagguuucugaaaggauuugaugcagaauguuauuauuaaaccaguauacagagagaaaggccacuggauauuaguacauguuuugguuucagacgguccuuuuaagaguauauuaaaucacauaaggauuuucugaguacccauuagaaccacaaaaaauaccuaugauacccuucuuacugcaguagaagaugaguuuccuaggguagcccuuuguugauggaacaaacauguauuuuguuucaucaggaaaaucauuggaacagccaugacucagauccacuaaaugaaggaacaaaaauaggaccugccucaccuccugauuuuuuuuuaaaucucuaggaugaguaaccagaauauuuuuauguugugcuaaguagguuuguuuguuuguuuuuuacucugacuuauauuauuugaauuguagaaauauauuguuuuuacuuuuuucuuuaaaauucuaucuggaguuucuaaaugagagauuguagcuccuaaaaccuuucuuaguuuuggugucuugcuuucuguucuuagcgucuguggucauuucuaacucccagugaggaaagagcucucuggucuuguuucuuuguuaaaugaaggagcaaaccuccgucucguugauccacucccaacccacuuguuuuguaacaaugaaaguuaucucauacuuaaaagacaacuugaaauuauaacacaccuguaacaaaguaaaggguauggguuuuuacuuagguuuaaaaaaagggcaguaacccuuuucauaaaaaagcaaaauuuagaugggauagaacccccguuuauagaaaagauuuuaaaaucucauuugcucucauugaaaccuuaaccuucucucaaauacuggcgcaccucugaggaacuucaaauacgguuugaaaacuaaugguuuaaggagggccaggcgcaguggcucaugccuguaaccccagcacuuugggaggccgaggugggcggaucacuugauguuagccugggcaacauggccaaaugcugucucuacugaaaauaggaaaaauuagcugggugugguggcgcaugccuguagucccagcuacucaggaggcggagguggaggcgggaggaucucuugaacccaggaggcauaggugcagugagcagagauggaucucuugaacccaggaggcauaggugcagugagcagagaucgcgccacugcacuccagccugggugacauugagacugucucaaaaaggaagacgaauggucuaaggaaacuaguuugugguuucucagcggagaaugacauucuaguuucuacagaucuggcaacagaagacaggcacauaaacuggccugcuuuggagucagggccaagacuuaaauccagauuuaaaaccagcuuuuuuuuuuucuucuucuaaaacaaccaaccuguguuuuagguccagugucugccuuguaaguugcucaaagcucagauacaaggaaguaaucagcacacauuuuugugauaacauuccugaaaagaaaaagaugagguggacuaagguaaauacacugcuccuuaaaaauccauauuuuuagauuauuuauaaaucaaaugggcaugguuaccaaagaugaauucuagagguguaaaacuccagucuuauaccucaaauuucaguuuuccuuagggagcaaaacacuuccaugaucuuacugaggaccuaaaaaagccuguacauauuuuaaaaauagcacucccuagauaaagccugauggauccaggguacaguagaaucaugaaauugccuguuucuuuuuaaaagauguauaugauugcucgguggcuguauauuguccaucgugugcgugccugugugguauguugguucuuucagagaggcaguggcgugcagagugagaggaucacagauguguaugugacaaaacuauuucuuuucuuucuuuucuuuucuuucuuucuuucuuucuuucuuucuuucuuuucuuucuuuucuuuucuuuucuuuucuuuuuucuuuuuugagacagagucucacucuguugcccaggcuggagugcaauggugugaucuuggcuuacugcaaccucugccuccuggguucaagcgauucuccugccucagccuccugaguagcuggauuacaggugugcaccacgaugccuggcuaauuuuuguauuuuuaguagaggcaggguuucacuguguuguucaggcuggucucgaacuucugaccucgugauccgccugccucggccacccagcgugcugggauuacaggugugagccaccgugccuggcugacaaaacuauuucuaaaacacaaguccagauauuccuaccaagggcucucuggggcuucguuuugauuuauaugcaaaacacuccuaauguggugacauuggggagauaaagaucugggaugaugagagagaaaggcagguaggacacaugcccuuccaguaacuuucccagcuagggcuugcauuuaaccucugauggaggccucaccauccaggcagauguacuugcuuaggaaugaguuugagauaauaaggcuaaaugugcugccuucuguauauaauuugcauuuguccuaauguacgacuaaggaaaugaaaaaucaaaguuugagugacuaaaauaaaagaggucuguggaguaauuggauugaauuugcaccaagucaaggagaaaacuucuguauuuuguauguuuugucaugguucuaugauuacuuguuagaaagugauauaaaauucaauaacuuaguuugauaugaacuuggcuaucuuuaaguuauagaagucgugcauauaauguggcuguuuucaacccccauacccuuucugagugguuggagaugucuugaauuucgaagugagaaggucuggugcuguuacauagauaaucauguuagccagcuuuaccuucugauaagcucucaauuuaagaaaguacuucuaauccuggcuuuaucuuuggcuugcuaucuuauuaugcacagagcauaauuguaagaagggaauaauaucucuugcugucuauucacuaagaauagugugaggacagggcucuuaaaaacaugaagagaugggcacuauuguauagauauagagauuugaugaaauguuaaaauguuggaugauuuuaaaugacaaguggaguggugagaaguuuauuuuuaaccuuauguggauaccuuggauauuuagaaacaucgaaguuuuaaggaagaacaaauaucuugacuccaagaaaauggucaugugauacuguggcaucuauuuggucuuccugauguauauguuuccugacauuuagcuccuaaaauccuuggaaucuccagugcuaagaaggucuuauaugcuaaugagaugacugguggcuggguaaccuaccaugugauuagaggguuaggacuuucagucacccuccccaaccuccaggagcugaaguuugaguugauaaacuaaugaucaaugauaccuacauaaugaagcuuucuuaacaacccugaaggaccgcguucugggaacuuccagauagcugaacacauggagguuccuggaggguuggaugucaggaaagggcauggaaucucguuuucucuucagccgcaccucaccccgugcaucucuuccaucuggcuguucaucuguguguccuuuguaauauccuuuaaaauaaaugggugaauguaagcaaguauuucucuuaguucucugaaggugcuccagcaaugaaucaaaacgaaguaaggggucuggggaaugguagccaguuggucagaagcacaggcuacaaccuggggcuugugauugacaucugaaguugggggaguuuugugguacugagcccucagccugugggauguguaaucuccaaguacagugucagaauccaguugaauuagaggacacucagcuggcauccauuauuggcaugcaguauuccuugucaugagccugggcaacauagggagaccucaucucuacaaauauagcugggagugguggugugcaccugugguuccagcuacucaggaggcugagugggaagaucgcuugaguccaggaggcaaacauugcuucuccuccaaaugcuguacuuuaacauguuuggaaacuccugcaaaggaauuucaacauaagcgaagucaauggguuauaaaggacugaaugccauuuuguaaaugucagaaaucaaagucacaaccaaguuaaguucuagauuagggccaggaagagaaauguauuaucuggucaaccauaucaaaucuguauuuugguggaagagcauuuucuuauauugguucugauugguuugauacggacagggaacuguuuucuuuauuccaguuauuuguuuuguuuuguuucugagacagagucucgcucugucgcccaggcuggagugcaguggugcgaucucggcucacugcaaccucugccccucagguucaagcgauucuccugccucagccucccgaguagcugggauuacaagcgugcuguaguuuuuguauuuuuaguagagaugagguuucaccaucuuggccaggcuggucuucaacuccugaccucaugaucccacccgccucggccucccaaagugcugggauuacaggcaugagccaccgcgcccggccuauucuaguuguuaaucaguuaacauagccaaaagauauagaauaagauuguagacugaauccauagucuaaugauuugucuuccuaguaauugugaauaauucagacauucaaaauuagucuggcaucauacaaacauuagacuaguccuaaaaugaggauauuggcaaguguguuaauaaaaauugcauaugcaguauuaauagguuccuuacguaggcugccgauuacucaggaacugucagauguuuuguuuuguuuugucuuugagagauggggcaggguuuuacucugcuggagugcaguggcacaaucuuggcugacugcagccuugaccugcugggcucaagcgauccucccuccacagccuccuaaguagcugggacuacaggcaugcaccaccaugcccagcuaauuuuuguaucuuuuuuuagagacgggguuuugccauguugcccaggcuggucuccaacuccugagcucagggaucuacccacccaugccucccuaagugcugugauuacaggcaugagccacugugcccagcccccagauuuuuaaucuucucuuugacauugaguuucagaaaugaaguauaaauggugaauuuuuaguguagaauaugaugcacuaggaagaucacuuacccguuuauucacuuucuuagaccaugucaacccgauucugaauuuaggguucuguugugaugguguucuuuagaagugauuuuaacacucaaaauacuauagucuguaacauaauuuacugauuuuuuaauuuuugcaaacuaaguugaaguaaucaaguauuuaugaguucuuugggugagaccaucugucaaagaauucugggcuuaauggagauacauauauguugugaauacuaaacagauauccaaguaauaaagcagaaaucauaugcuguguaacagaaauguaaaguucugaauuaguucacgaguaggagagaaacuuuuuuuuaaagguagaggagaacuaaaaguaauuucuuaaaagagugccuauuuuacaucuugaauauuaaaagucuaauucagugccuugggaucuuguucuuuuuguagauuuugauuugaaugaacuucaguuugcugaaaugucuaaugggugcaaaguacagauuuaauuauaagguugagcuaaaaucagaauuuaagcauauggcauauauaauaccaauuuaaucuuucccccuuaaauuuaguuauuuuuagugagucccaaacaccauauuugagacaucacuuuuuucuuuuuuaaagagauagggucucccuaugugaggcuggagugcaguagcuauucacaggcucgaucauagcaaacuacagccuugaacuccuggccccagugaguguaaugucucaccaugccaaaguacuuuuaucuuaaauugcuuauuuuuuuguuuauuuuuuuaacugacucuguuuacaaaauuaaccuuuuaucuagugacagcuagauuguaucacauuugucaucuauggacaacugauuuuuaguuguuuaauaugguaaguuuauuauuguuuuuccuuauuuaagaaaacaggaucugagugaaaaaaaaaaaaaucuuaauucaacuaucacgauuccaguaggaaguagacagacauucaucuguauacauuaggugucaaaguagaguuuugugguuuaucauucugaagauuugagauucaagacaugacuaucuuucagucauauugugcaauagauaacauauaauguuucucacugaugagaacaguugguuagaucucucagaugacuugaauuagguauuaguucaagucaguugucaguaaguuuggcuuuaucguucagaggagcuucuuaugacuggacauuucucaaguauugccguauuggucauuuggcuaucaaugcuuaaauuauacucaguauaguauaaauuuucuuauuucccuuauuuaagcaugccuccauuacacuguuguugucucuaauaagaguuuaauaaucuuuguuuuggcuuaguaaaaagagccaacaaauauaugagugacugacugaguguauugcucuaugcgcaauugucuuaaaggaaaaacguuuauagaaucacugugaacaauaaaaugguugcauuucgcuggaaaaccucggugcuccuuugguaaauaaugaaguguuuuguuuuacgggccuuuucacuacuucauugacaacagaccuuuuuuuuuaaauuaauuaauuaauuuauuuauuuauuuauuuauuuuuugagguggcguuucgcucuuguuaccugggccggagugcaguggugcgaucuuggcucaccgcaaccuccgccuccuggguucaagcgauucuccugccucagccuccugaguagcugggauuacgggugagugccaccacgcccagcuaauuuuauauuuuuaguagagaagggguuucuccauguuggucaggcuggucucgaacucccgaccucacgugauccaccugccucggccucccaaagugcugggauuacaggcgggagccacugcaucugaccaacaacauauauuuauauuacccaguaauaggcauagucuaaggaagauaauagaauuuauucuuaguagugaacucuuuggcuuuugaagcagaauuuuuuuuucuuuguucuuuucugugauaguaaggaaggaaggaagggaaggcuacuacuaaaaauauaaauugcuaaauagaagucaagucucuggguguugaagcucacauauuggugcuguccagaccugacgcaucuagaaacaggaauuugcccuuagcguaagcuuagccaaaugguugagucauuucuaaguauuuuaacauuauagaaugccuuaggaaaugucaugaauaucuaaaacaggucuucuugaggauuuuauuaguuucuuaaaacauggaaaggaacuugauucucagugcugguaccuaaaauucaaagacauuaguugugaguugcugugcuccucagcucuaagccacaguugucauggccaagccugucuccuuauggagaguggccuugcuguuuccugcagagcuucucuugugccuggcuugugccuggaagucagcgugucaccacuucagagagacacuauagaagcuuggugaucuucaaacaagaacuuaaaacaaagaaguuuucuuucacagauaucuuaaaacuuguagcuaaauaaaacgugaauaacugugagagccucauuacagcaauuuuuaaaaaagcaguacauguuuuguuguaucuuaaacaucacagaaugguauuguguguccaguuuuguuuguaaaauguaaccuucgugugaaugaccaucuauuccuuucuuuuuggaagguuaguuugucagcuguugugugaugcucaacauuuuauguaaugacauuuagcacaacguuucaauauaacaucucaggaaaacauuuaagaaauagugaaguucucuggguauuacauuaaucauauuaauuaccuguugcuuuuaauuuaucaccguaucacccuaauaucacaaggcauguguaguacuauuuuguaaagauuuucuaaagaccuucccucuauaggaaggaaaauuuaauucagaaauugggcugaacucucuuucacuugugugaaaaugggaaaauuagaaguaauuuguauuuuuuauugugaaaucaguguaggaaccugugcucguaucauggaaacaacagcacuaauguuuuucuccccucgggugugggcuuugcugcagauauccaugucuucuacuuuuucuguucuuaguucuuauucacuuauugucuauacuucgugucacuuuauugaauuucacaaaugcaauuuaggaauccagggaugugauaaaauuugugcaucugcuugucauuagccaucucacguuuauaucgcuaagugaaaauuuaacuuaguuuggaacaaaccaccaugauuuaguucaccuguauaguuuaaaagaccuaagaccugaaauuuuuuuuuuuuuuugaaacggagucucacucugucacccaggcuggaauacauggugugaucucagcucacugcaaccucugccucccggguucaagcaauucucugcuucagccuccugaguagcugggauuacaggcagcugccaccacgcauggcuaauuuuuguauuuuuaguagagacgggguuucaccaucuuggccaggcuggucuugaacuccuaaccucaugauccaccugccucggcuucccaaagugcugggauuacaggcgugagccauggugccuguccaagaccuggaauuuuacacugcauugggaccuuauaaaauucuugacuuguacccuuuuggcauuuucugaaugcucaugauuugcuucugaaauauuuuaggccuuuggaaacacuccuucauucuaauccucucuuuucuugcucucaauucuucaugucauguaauuauuuugccuagagccaaaucugauguguuauuauaaucaucauuucugcaggagcuugguaacacuccugcuuuuguucccuuuaaggcuucuuuugguuuuguuuauuuuguuucacucagaaugaucugguuaaguuuugcuugaucauccauuucaaaucucuuaguacauuuuucaaauucaguuccaagcauguuaaaugugucacaauggaaguggcccacggucaaauacauuuugggaaaccuugguuuuaaaaaaguuaaacugacuucauuauuacgguuuuuuuuuucaaaagccuccaguauccaucuugaaugauccauuucccauauguguuuuaugacagaauucuccccacucccagguaauaacuguugacauuuucugaaaacuguuuuugagaacacugaauuagauaugaaaugaggcauuuauucauacuucgaaacgaaugucuuaaaccucacugggccauuuugaguauacauuacuagugauauauuuaauaacuuagugguauaagcaugcaauaacaaauuucuuacacaagagaaguucuguguagaaacaaauuuaauacuguggcuaaagaaaugaaccaaaaaaauuuaauaucuugaaauuugcuucuuagcucuguuuagaaucauugugauucacggauaguaaauugucagaguggacuucaugaaccuuauaucagacauucugaaaagagcuaaaauugccauuaaacugcaugaguuaaaauaucuuagauaguuuaaaaauacuauguagacuuggugagucagaucugccacacugagcguguagcugggguugacgacacacguguugcagugucguuaccaguuugucucuuuuagagacaacuuggcaggcagacgucuugcagauaaacaaggaaagauugucuauuuuaaauggcauaagacauucuuuaaaccagugugucauaugugguuauauagucagcauuuucuuuagugcaggaaauccucucucaggguuccugaauaaauagcagguaucuuuguagggauagcucgcaggagauuucaaaugcuguguauucaucaguucaggcuccccagaugucuuacgaacgugcucauuuuaguuuucuuuucuuuucccucuuccugcuagauacaaguugagacaauaugauuagcucuuaaagugcuuacucuccauuuuauguauauuacugcauuuuaauccucauaauauccugugaggugggauguuacuauguccauuugagagauaaaggaaaucaagagguaaaguuaacuggcuuucuccaaacagcugguaauuacuaaauacagaauugacuuuugccuuuugauuccaaagaucauauugguacuuucaugugugggucccuucagccaguuccuacagugacccugacccagcuguaaguccccugaggucucuagagauauagacagugauggauuagacccuguucauaguugcagauacaagacauagagagguuucuagcaauaauuuuuuuaguuauauauuuucauagggcuuuugauuuauguaaccuauuaguauauauuuguuauuccaguagaguuaauacauuauucaaagagauuccaguuuuuaagccuuuucuccguuugucuaaguuguucauuaugaaaugauuggcuagaauuugaaagucuuuaccuacagagagauucugacuggcuugcuuggucuuggaacccuaguuaugagugcauugucuugcuuccuggugaacuuugcccagaaauaguuaccaccucauuuuuuuuuuuuaaaugaaagcuggauaauuaacccucaagauuucuuaauuaaaagauuacuauuauaaauugacccacagggaguuaauacaauaaaauuauuuuugaucauuuuauaugaaauaauuauggggcaaucuucuguaaucuugaguugaagggguuaucuugcuuaauguuaauaacuuuugauacaccaacuaccuuuuaaaaauuaacguuuuuuuuuuuugcuucuguggaagggaggcuguauuuuguaggauuuacaguuuacauaguuauuguuuuauaugaugucaguuggauuaauuauguuuugaguggaaacucuguuugguucaaccaauauuugaaugcuaauuuuguucugugaacaaauagaaauacagagaacaguaagacaugacucuuucccccuaaguaaaggcuuagguuggaguuuucaaccugggaauuacugacauuuugagccaaauaauuguuuauguugggugggggagggccuacagcggaggcugccuguacauuguaggauguuuaguaacaucccuagcuucuaccuacuagauagaugccaguagcaccacccaagucgugacaaucaucuuugccaagaacuuugaaccucuaccuagaaacaguucauagggcucaaaaagcaaaguggccuaggacccauguaguuaacaagcuuacccuguuggagaaccacugcauagcugaacaacaugggugagacuagugucaggguaaaggagcucuugacuggagauuggccguacacagaaaacaaagugaguguuauggauauuuggggauuuaccuucauuagggcacaguugguuagcguuagguguacaccaacauuauucccucuuuagaaacagccaugcacguaacauuuuagcacaucugaagaggcacuucuauucuaauuaccuaaaauucuuauuaucuagaauuacaugcuaugaacaacagcaguaaagucagaagccagaaucuaugugauguuaucuguuuugcgaucacaguuguguucuucucuuaguuuauuugaacaaguuugugaaaaaauuuuugugcuuauguaaauacucuuugcuuagauuuuuugguagaauguaaaucuuucccacacagugcaauaccccuccugcccaagggcgagauauagauuguacaguuuguuauuucuguguuuuagggcuuauuccucuguagacaugucaaaaagacauccgucggggguaaggaaugcauuagcaauucaagcugauaaucugcauggugagaguccagauaauuuuuuccccaggucacauaggcagcucugcacaagucuguuaaacauaugcuaguuuugaaaauuaaaauaaguucccaucacucaaggcaaugaaacguagaugaauugcucugccagauugacucuuagaacuccugaugugauguggggcuagacagaaugggauguuugcuaauaaaucagggagguagugauuguuuuccuucuuuuucucccccacccccgucaggacaaacucacauucuguagccuggugcacucuaauaaugccuguugaccuuggccaugaaagcacucuagacucacccccuaaacaccgcaccgaaugugcucauccuugaaauuuacaagccuuagaaucuucccuaccuccacuccuguuuacugccuccuguuacuccuggugcuuccagucagaccguagucuuggcugugcaguaccuuuaggagcccucaaaaauguuuaauuucuuuuaaaaucagaaggaaaaauaaagaacaagauaauaaucaugaauauacaauaaugaauccagccugacuuagaguugucuuuauaccaaucaacagagcccuaaaauauagcuuuuaauguuuuuuuaagagagaaagaggcccacgaaaguuguccuggggcccccgcauccuccucauacacuggugggaugcugcucuugcuugcuuuggaauguggcagcagcucccagugacuucacacguuuauuacaaauucaaggucauuuggacgcuagccuugugcuaccuuucaugcuuccuguccgacccauacucagccugggcauguuuucugcucugaucuuuggucugccuuccuucuccuucuccaagucaaaccagucacucuuuccugagagcucuucgguguacccuugccagaccucugcauuaacacuccagcaccuuugguuagccaauuuggccuuauuugugucuccaccauuggauuaucuguccaucaaggucaggaauguuuucggguuaccccacuguccccaacuuugaauauguucacugccuggaaaauguuuaucugaauauaaggcaucaagccagaacuugcccaaaacuuaaccuaggacucaaacagcuuugaaaucuuaucuguguagagugggaacggcauguguuugauaaccaucagcauuugcuguuuugcuuagccaucaacaauccguuucuaucucuuccucauaguauuuucagcuguauuuuuguacagcagucauucacguuagguguuagguuacacugaaaucucugacaaccaguucugugcuacugaaggcuuuuagcagcaggauuaaaaaaauaguugauugcacauucgaagucucacugcucacacuguuuauguaauucuuggaguccaguuagaucaucugauuuuuaaaauguugccugaauuacaaaggaguucaggaauguguuaucaaagaauuaggaaauuaacauugaaauuuauugagcaacauagcuaauagguugucuugcuuuuuaagccuucuuguuuucuaggaggagccugaaguccguggacaaguugaacuguagcugguauuuaggaauugguaaagacagagguguggaugcuauguuuucuuuucucuguuaggaaauuacucuccuggugccacaauaaaaaauuucacagguaucuaaaguggaauuuauuuuguauuguuccacaccuuugucaauaauuacauuuucuaccuucuaguuuauuacuguuauuauuuuucaugccagguguuucuuaauuguuggcauaaguauuuauugaaugcuuauaugugggagugagagagucaggccagugcuaaagaguagggaauaaccccuagacagugaaguaacuuuugucuuguuugcacauuaaaaaaaaaaaaagauuaggaauccuugcucuauauacuagaaauguuugauguucucuuuucuucucuucaaacagagaaaacuuagaugaauacuuauaggcucuacugucaacuaacugcacccuccuaauauuggcgucugcauauuuuuaccauugucaauaucagauugccucugauguugugucacugaaacugauaguaacauuacauccaagaguaagacugcagugugauuuuuggcucuuggucuucuguucuuucggcaacaauuuuuuauaaauauagucaagaaaauagaaauaagagucuucacugcuaccuccccuucagaauuauuuucuccuaguauugugguuccugauagccuuuauuccuauagaaauggcaauucgaaaaauuccuucugugaaucugagggcucuacaaagggagagcuucuuugauagugcuuugguguaaguuauuuaagaaggacaaucuacccaggcuuaucaagcaaauaaccuggaauuuaaaccuggaguauucuuuaguguuccaagucugcaggaaaagaaguaaucuuggcuuaaacuaaauaaguuaacagaauacaauuugaacaaugaacaagaaugcuguuugaaaauuaucuuggguuuuuaugucaaguuaauauucucacugaauuucuauuauguuuguaaagcagcuuucuccuagaccaaaaauccuaguaauaaaaccacaacaguaugagaguuauaagcacacaguaaaggcugaugaguaaauguuaugacacuuugaaaggaaauaaaccagacgauauaauguaaauauccuuugugcuuaucaaaaauaagugacuucauguucuguuccugcaauauuucuguaaaucugcuaaaaauagaaagguaaaggucuaagaucauaaaucucugaugcccuuuccuuaaaaguaaggaauucuugucuuggauucuuauauaauauacuuauuuauaaucucacuuguucugauugcagguggccucuuacuaucuuuacauccaugugaaugugugugcuuugauguguacauaugagagacaagaacaaaaguaaaugucaaauauccgaauuccuguuucagugagcuuucacggaguaaauucuuuuugucuacuugccugugaucucuucuaauaugacuugcguuaaugaccuuuaagaaaucuuuuaauaaaauaaaaaauuuuauuaaaaucuuuuaauaaaaaaauuuuauuaaaaucuucuaauaaaaaauuuuauuaaaaucuucuucauacguguuacuugaauuuacucauggcaaggaccaguuaguaccauuuuaugaaaucacaagcucaugggcuugugauaaaacauauaagugcuuuaaauuuggcauugguaacggcaggccgacucacuugaaaaaugcucugaacugcucugccucaugcuggugggaagucagauggaaaugacuuucuagagaguuuagcuggccuccaagcuuaguggguacucacucuccuuaucccccgauagcugcucugagauuuuaaugcacauugaagacaauaugauaacuuaaccuggaaaauuagcauuuugguaagggucuuuaacuucauuaguauuuucauaccacuuugguauuagaaauuguaaagauauuaaaggguauggacaauguggaauguauguaccagacucagcaguguauacugacucccucacuauagcccagaacuggaaaucccgcuaacuaccucuccccauccuagccugaauugcccucuccaccuauguugguuuuacaauggccugacgccugaaagcugguagaaacuguauaggaaaauaggguugggauaaauuucugggcugacaaaggauagaggaauaugcuucuuuuuccccuuguccaaguauaucagcaacucuaagaugcagauuuaucaguauggcucuacugggcauguucuaguuaaaugguagacccacuaccucuucuggaaucuuguuuuccauuauauucccaccugcagcuuuucaaagacuuauucucuucucuaauggucucuugguucuuuuuuuugcccaugcucuacguuccgagugggucaacauugcagugggucaaugagaagaaauagaggggaaaaauaaaagaaccagaaagaaaccuguuaaguuugcacuuacuugugcauuaagcauauuagcguaagccuuaaacucuagaaaacucacuguagugcuguaaaguaccacugauaaaguaaaaguucauuuuuaugcugugucguuauuuagugaugaauaugauauugcauaaaagaugaggaucuguaaggccaggcgcgguggcucacgaggucaggaguucgagaucagccugaccaacaugaugaaaccccaucucuacuaaaaauacaaaaauuagccggguguggugacgcgcgccuguaaucccagcuacucaggaggcugaggcaggagaaucgcuugaaccagggaaguggagguugcagugagcugagaucacgcuacugcacuccagccugggcgacagagugagacuccgucuccaaaaaaaaaagaugaggaucuguguauaacugccagguguugugugagguaccaugaauaaccuggcaauauccuaacugugcagguaugaggagugacccccaggaauauaauugcaauuaaacuugcaaauuauguggggauacucuauuucagggcaauaaaauaaauuaugucuagagcucauaacucuuacacauauuuggcuaggucuaugcagcaaaacccaggugauaacugaggcuuuaacuuugggauuuguuuggugcugacucugccacauggugaaauuugguaggaucucagugcgagugucacaugaucagucugcuugacccaacaugccagaauuccauuucucagcccacucucuucucugcauacauaccuaccucccggagagggcugggcgggagccuacguguggcaagagcccucacugcuuuuguuacacagauuucaacacauauggcuugauggagugugauugcaguagcaugaauguuuggugaugaaauuugcauguccuuugcugggagaaguauaauuauaagauuuuuguauucacauagccacaugugagguaugagcaggaacggggucuauuuaauagcauuagauugcuuucagauuugaaauauuuccuuuuagaaauauauuguguaaacaaaauauguuuaauuuuuuuuaaaaacuaugccuuuguacaaauuguuuaucauuugcagaggucuaaaaaauguaggagaaaagaagcucacaaaaucaaucagaucuaaagauugcaaagauugauuaccaucuccuuaaaagcuucaguacauguguuuacaguaucauucuauuugccucugcucagauucuuuccaauucuaggacaacccaaaguguauagaucauaagccauaacugauccuaccuuacauaauacauuaaauauaaaauauuuauggccaggcauggugaccaguucuguaaucccagcacuuuaggagaccaaggcaggaggaacacuugaggccaggaaguugagaccagccucggcaacauacugagaccuugucucuacagaaaaauuagccagguauggugguaugggccuguacucccagcugccuaaaaaaaggcaacuugagaaaguuucuaccuucugaaacaaucuaugccuugauucuaucacuuaguauuuuaguuauuccuaucaaauacaugacuguguuaauuucuuuugccacaaaaaugcugcaaagccacaaacucacuccaaaauuuaguggcuuagaacaauaaccauuuauuauagcccacaagcucaagggucagcugaucccggcuuagcuuggcuacauuugauauaaaacaguagaaauuuagaaauugaauauauguagaauaucucuuguaccaaaaaugaagaggaauaauagauuuugauuuuucuuuguuguauucugugcugggugcuaaucuguccuagcugucagaacaaguagaagccauacuggaaaaucauuuauuuguuacuaucaaauuuauuucagugaaugccauucaaaccacucucucugaggagcccaguuaccaaguccuccaccuuguuagcaacauggacuuaaaugcacuaauucuagaaugagaucuuagcaaaguaccagcauuugagauuugugcaaauugagcucuuaaacuguguguauauguguguguguguguguguguucauucuagcacucccacuacauaccauacaaguagcuguauagcagguauauauacauguguauauguacauagguagguauaugucaacuguugaaaaacuagaaaauacacauuaaauaaaguaaggguugauaaacauuaguaguuggaacauugggagauuuggacuucuacuuugcagauucaguuggcugcauuagauuuaaggaaagaacuaacuuuggagaaauuuguguuugcauuucaggagagauuucuuaaagaggaaacuaccagagguuaguagauauuaacaucuagugauuuaaauuugagaaaugcaaauuagacauuuaagcuguggguuugcuucccguuuuacuugcucuaaaaguaauuuuuuuaaaagccaguaacaaagacaugcaaaauaguacugccaugggggaaaaauuacuugaaaauaauauucaagauugaagaauuaaaaaagcuugacaucuaguaccaggaaugccagcuggcuuguucugucaaaaagcaagcaugugcuuuggaauaacacucuugaguagacucuaggcggguuuugagcccuucugauuaucuaaauagauguggaagugacuuaucuugguuuuucugagucaaaugagauaaugagcaaaggccuuaguaggucuuugauuuuugccucuaacccuuuuucuaucugcauguucacaaggucaaggcugaugagauauggcaauauugagagagucagaauaggauaaagaucucaaauacuauauauauauuuuuuuuucauuuuuuuuucccuuuggugacuguaugagacaugucaguaaaacuuuaaagacaggccaggcguuguggcucaugcguauaaucccagcacuuugggaggccgaggcgggcagaucacuugaggucaggaguggcaacauggcaaaaacccgucucuacuaaaaaauacaaaaauuagccaggcguaguggugcacgccuguagucccagcuacucaggagguuaaagcacaagaaucgcuugaacccaggaggcagagguugcggugagccgagaucaccccgcugcacuccagccugggcgacugagcaagacucugucucagaaaacgaaacaaaacaaaagacacacagaaaaacuguaaagacagaaugaaagagaugaacuuuuuacaucucgcucauuucaucacauacuauauaguauguguaugguuucauauauguuaguguguguguauguauauauaugaaguuaaaagaaaacauucaccuuuuaagacuaaauggacauugacuagauuguaaacuguuuuugaggcuaagaguuuguuugccaugcauaaggcucuauuuuuuguaauuccacuuuuauauucauuuauaucaguccuagcaguagaugccacucuuacuggguccugccuaaaugcaugcuucaaauguugguuauuaauuucacgaguagugaauaacaaagacuccuauugagggaccucuugauuuccuacugggcaccagcagcaagcaugacuuacuggccuucuuaugaguggguaggaguuuugggucaacuugagaacaucuauccuuugaguaguaaaaaagcuugguauuagguuggcacaaaaguaauugcgauuuuugcaccaaucuaauaucaacagaggccgugaaaaacaucaagggaggauagcuuguaauuagaagccagaucaacagugacccaaaaagaauuucagguuuccaggagugaaauauguagauuacuccucugaaaggaauuguuuuucuccuauucgcuuucauggcaaaucauuuuuuaagccgaaacucaagcucugaaauaauuguguagcaaauaguggcugugaauagauguggcaacucuccacaaggguaaauagaaaccacuugcaguuucagucaucacauuuuauuuuucuuuuuuaauagcuucucuauuuuugcucaccacaaauacaugcacacacacacacaggggcaaagccuuggaaaauugcaauuuuccauuuuaauuugagagacagcccggucacauuaacagaacccuugacggaauagguugaauucccuucucugucccuauaaccccauggccuuggacauauccuuaccuggugcccuuuccucccucuuaugguccacuuuugugauucugauuuuaauuucaguucucuguuagugaugaaaugagcaacugcagauguuccgcuuacacuggaaauacuuuuuuggcauuuaaaagaaaacccuacagaugaauuauuccccugaaagggguucacucagauuuucuagauuaugauucuagaaaauaguucuuuacauuugacaauggagaauuuaaauguuuuaauaugaaaauguaaagcacucuugugggguauaguugaauuaugcccagguuaagggaauccaguauuuaugucaggaaaccauggaugugauagaaauaguaucgcuacaaagcugggcacaguggcucaugccuguaaucccaacauuuugggaggccgaggcaggaggaucacuugaggccaggaguucgagaccagccuggccaacauggugaaacccugucucuacuaaaaauacaaaaauuaucugggcgugguggcacaggccuguagucccagcuacuugggaggcugaggcaggagaauagcuugaaccuaggaggcggagagguugcagugagccgagaucaugccacugcacucuagucugggugguggagugugacaguguauccaaaaaaaaauacugagauuaugcaagaaucugacucgaagaaguuugaacugauuaaaaaguaccaaauacuucauuauaugaggccagcuauuuagacuagucagcgggugguucaaaugcagaaaacagauggcuuucauuagccagaaaccuuaaaauuacauaaauccacggaugcaacuaagcuauggaucugugcccucuccuugccaaacaggaccucucagcuagcaaaacagagagcuccuuguucacuuuucccuccuaguugagacccuguuggggaggaaugcugccaagccugcucuauaaggaauuuugaucuccuagaugauaacagagagaaacuuuuuggagaaagggaacacccuguuugaaaggacaacaagagaacuuguucaagaagguggcuuugcauuuaauugaaaauuguagcaacuguaggcguaggguuuccagauucacaucugcagacugguccagauuagguauauauguuuauauucguuuauguuauccccuuaagccucuuuuaaagccauuucuaaaaauugcuuuggaaaguccauuucacuucaguauucuuuauauuguggcucaaaaauauuuuuuuucugguaacaaaaauauuuucuuucuguuuuuaagacuuguagcauuuuuaaguuugauauguacgucucuguaguucagagcacuugguaaacagccucuugcuuuugaggcaauuuaugaaugcuucauuguuuuuagcugguuauuuuguucauugucaggaacacuguuuucccaugggaaagcaucuccaguuuuaugaugucaguggcaagucauucaguuuacaagaauuaccuucauauucagucuuagaaaagcauagaccacaaacggccaguuauaucacaguucucaucuuuuaaauguugucuuagauuuuugcaaaguaaucuuaacucaccuuagaauaguguuaagacauaaauagaacuaaaauguaguaguuaagugguuauauuucccaucuacuaagguauuuauauuucuuuucuuuuagaaaauaaaaauguuuaaaaaauuaggaauaauuaucuuuaggaugacuuuguaagacugugcuuuuuuacuggcagcaaauaccugccagauuucagguauuuggcagguaaauugaaucuuaaaagauuucaauuuuaagaguguccauauuaacagauccugaauaggacccuguguaucauuuauuaagucauuucuuggaggcuucacucaggaaaagggaguuaacccuuggauggcaauguuuaauguggccacauuuccuucuggcugaaugccagggaguggcugcgcuuagcaaccaggcuuuguuucauaaauggguuauuugaugcaggugaggaugccgugaguuguuugucuuguuuuaauucagggagacaggcauauguagugaaagcauggaauuguuugcagaugggcuucaguaagaauaggaagguuucugguucaauuuguaucuccaagcuaauugcucugauuuccauauacacaucugguguugguucggggggaaaaaauuuuacuugagaaacauggcuuuugugaguugauauuuauuugugaagggccucuuguaaugucaaauguaagaagaucuauacacacaaccaauuuuacaauuucuaauucaacagcuuacccuauuauugaggauucgcaguuuaaauuauuaaaugaucuccacuugaagaaaauagagcauguuaaucaucacgauucuccaaacauuuauuuuuaaaguuaauauuaaaucucaucugguggaaaaccugacaggaacugaagcauauauuuucuagucuaaacucucauuguuaaaaugaagacaacaugagacaguuauagcgccguaaucaaguuauuugaaaaaaauguuuuaaaaauuaccacuuuuugguagucaacauacacacauaugccaacagauggcauuaaaaaauggcaagaacaugagacaauuauagggucauaauaaauuuauuugaaaaaaauguuuaaaaaauuaccacuuuuugauagucagcauacacacauaugccaacagaugacauuaaaauagcuguaaagucaagaagcagggaggaugacaaagugaaaaauagaagaaaucaaaggaaguuaagucaaaagaggaaaaaaaaaugaagcauuuacuugguuugucagguagggugauccaguguauuuugccaaaaacuuuccugguuuuagcaccaaaugucucagaacauggcagcugaugaccucccucacagugagugaucccagagagcaaugaagaauugugaugcccuucaugaccuuguuuuggauguuacacaucaucaugcccuucagugaccuuucugguagcaaaggguuuguuuuuaaaagaguugcagcaucuuuaagucuaauauauacaugcucggaaguuacaccaucaucacuucugcuguacuccauuuguugcacagacagacccugauacauuguggaguuucccaggguccaugaauagcaggaggcagggacuauugggggccuucuuggaggcuggcuacccuggggagagaaauugucaauuuccucuccuugcggggaggaaauggaaucaagugcauuuguauugacaagaagguagaacgcuuuccuuagacauuguaaugaacagauuguggauaaacaaaaguacagagagaguuugaggcagaggaggagacuguuucaacagaauauuuaccagcuaugguaaaggcucauuagugucuccguacaguuaacaacaugcugccaagacuggaaaucuuugggacaggaaugaauucggaaggugaacagaauaaaguacugugggaacaauggcgauuccauuaguggauuguacauuccuuacgggcagggcccuccauagcaucugauguagggccuuauccacagguaucugauuauuauuugacuuucuuuaauguuuuugcaguguuauuaucuauacuacuuauuucaguaagauugacaacauuugcauuucgauuucuaagaucaagacaaugaauuuccucuuaaucccucaggaaagcugugaaauuuaaauuuauagagcauucuacuuagccugcugcuuugcaucugucagagaaugagaccccccaguuucauggaagucacaggaaguggcaaggggcucagauggaguugagggguucuagcuauuucugcagaugaucuggauauuuuggcaucggcugcuuugacuuaaccaucuggcaauguaaaggcagaauuucguuaaauauuggaaaaguuacuugaaaacauggcucuagagauuuugccagcagcuuuugcacucaugacuugguucaaucuaagaccuguuuuguuuuuuuguuguaaggaccuaaguccucuguuggguuuugacgaaguauguguaaaaaugacuaaaauggccagagguaucuuauuuuacauuuaugugggaagaaauguuuggaaacuguuucauuucuuuaacugaaaauuucucagugcaauuuuaguugguguuuuuccuccuguggacaguuuuuaggaaugauacaaguuaucguggaaucacccaguucuugagugugugaacgaauggcuucugcuggaaguuaauucuucuuggcaugggugucucacauuuccccagcagcuggauuugacaagggagggccuaucaugauuaauaugccuucuaauugauugguuuaauaacaccuuuacuccuguggauauauuuuucauuucuugcugaauuuuuuuuucuuuuugagauaccagaaccuguuaagugacacgguauagauauuucaggacuuccauuuucucuuuuaaaaauauuuuuguaaagguaaugccuguacacagaagaguuugaaaauacagaaggcacccuuuuucaugaaguuauuuugugaaguggucuauugccugcaaugguaauagcuaggaccccuuacuuacuacccagcaggcacuauguagagcuccaaaugagaaaauguuggcuccuugcagaugguugggagaggagacaccagcacucuuaacagacuuguuaagaguugagacugauaaccagagaauauucugggggaaaccaggagggaucgccaacauacucaguuauauuuguggauggugaauucuacagugaauuuuucuguucaaaaucauaauacagucacuugcuaacuaccaacgccauacuugcucucagugcugagagguggcacaaauauuauuuucagucuuggucaucaggcagggccuggcaggcaucaugcucugugugagucaguggaguuuauuauaagaaugcgguagccuccacagugauuauauuuauuauaggaaaacguguaauuuuguugucagaaccuuucagcagguaccacaaaaucucauaugggaaaacguguaaauuuuucaugaauaaauuccuuucgguauugguaauuuccuucucuguuuuaguauaaaagaaagcauugccuuauagguggcuaagaacaucuguagcauacauaacacuuaaucuaaaggaguguugaagaccgggcugauuccuaauugagaaugagcaagaauagaacucuuuuugauaguuaucccuguucuuccuccaagccucugccuuggagcuauggauacuauaacuaacugaagcuucuucuuucagguacccacugaugguaaugcuggccugcuggcugaaccccagauugccauguucuguggcagacugaacaugcacaugaauguccagaaugggaagugggauucagauccaucagggaccaaaaccugcauugauaccaaggaaggcauccugcaguauugccaagaaguaaguccuguccgguggcuagcaauucacguuggaucacaugcauuuguuuucaaaaaauuuaacuucuuguauuuugcaucaguauuuuaacccuacaguaaaaaucuugguuccuaaugauucaccauaccauuaauauauuuauuugcauuacccuaugauauacauauaaauguuuuuaaaauuaugaugucguauuaugaccaucacuaaacaguaguuuaagaugucacagcacuuuuuuuuuuccucacucugucacccagguuggagugcaguggcaagauuauggcuuacuguagccuugaccuacugggcucaagcaauccucccaccucagccucccaaguagcuggacuauaggcacaugccaccaggccugacugauuuuuuuuaauuuuuaguagagauggggucuccuuguguuggccaggcugucugaaacuccugggcucaagcgauccucuggcuggaccucccaaagugcugagauuacggguaugagccaccaugcucagcccuccacacuccuuucaucuucaguauauaucucaccacggcucuacagucaaggucuuuugguuaaaagugcuagcauuaauuuuuuucuguuaccagcuugauacauauuuuaguucauuuguaucuguuuguauucuauuauaguuugguuuuuuccucccuuauuaauuuuacuuuuugacuaucauguuaguucuaugaaauauacucagaaagcucacuuuucacucauucucuauugauaaacauuuucauuguuccugauuuauuuuuuuggcaaaagaaaauacauauuuuuccuucuuguacaaaaaaaguacaaaguucacuguucugcacuuugcuuuuuuuuuuuuuuuuuuuuuuaacuuaacuuuguauccuggaaaucauccuuugucauuucguggagaucuucauuuuuguuuaauucuuuguagucuuuuugcuguuacuauacagggugcuccuuucuuauucaauuuaaaauagcuggaguuccaggcauuuuaucucacacuucuuagauaguuaucucugcauugugacugcaucuuaagaacauuagaaguaauuagucuuaugcuuguuggcaaagcagaauucucgacacucauuauaaacagcagauagccuggcaacauuuucuuuuguuguaauccuuuuuguacuagaaauuuuucuuuagccuacuuggauaaugaauguuuguuguuuaauuaauauuacuauucuauugagauccuuuuauuuuaaauuguaaauacuaaaauuauuauuauuaaaagguuuaauuuguuuugauagcgcucuguuuaagaaaggacaagcucuaauuacuaauugguguuuugagaagcaaaaagcaucuacauuaucacaauauauuacauauuaaguaauuuuuaucuugaaaggaguaugaaccaugaugugaaaugaugaauaguggaaaucacuaauacuuaaguucauuauauguauuuuuuguuuuguuuuguuuuuuuuugagaugacaucuugcucugucgcccaggauggagugcaguggugcaaucucagcuuacugcaaccuccaccucccggguauaaaugauucuccugccucagccuccugaguagaugggacuauaggcacccgccaccacgcccagcuaaauuuuuuuguauuuuuaguagagacaggguuucaccauauuggccaggcuggucuugaacuacugacauugugauccacccaugucagccucccaaagugcugggauuauagccgugagcuaccacguaugguccauuauauguauuuuuacaagaacauucugugugcugauuuacuaaguauggauugauaauaaaucagcuuuugccugggugugacuuuuauaaagugucaauguuagaaauaauauuuacauucugcugaagaguucuuguaguacaauuguguagauaaguuauaaauuuuauaaaucagaacucugugcauacuuauauguuuuugauaccauuuuuuugauauaugcauacagacuauguauucugagugucaaauaaacuuuuuuuaaaggcuagaauuaaaauuuaguuuaugacauugaccaaauuguccuuuucuggugaaucgacuauuuugauacaugugucauaguuugcaucuaaguuuuucuucccuuaguuucacguaugaauaaccagauguuuucacauuuguaugguggccauaccaaaaauuacucuucuugaccccaggaacaccccucuuuucccguuucacuuagagauccuacuaaugccuggguagcuuuacuuucugucuuagccuguuguuugucccaggguguauuagucuguucucacauugcuguaauaaacuaccugagacuggguaauuuauaaagaaaagagguuuaagugguucacgguuccaaaggcuguaugggaagcauggcuggggaggccucaggaaacuuagaaucauggcaggaggugaaggggaagaagacacauguucacauggccagagcaagaaagagaaagagugugaagggagaggugcuacacacuuucaaacacccggaucucaugagaacacugucacgggacagcacucgagggauggugcuuaaacauugaaaccacccccaugauccaaucccuucccaccagaccccacuuccaacacugggaauuacaauucgacaugagauuuggguagggacacagagccaaacuguaucaaaggguugagcacagagugguucuucccaguucuggacuuuaccagauuguugguggccaccaugaguggggagaauuagcccuuugcugucaccuuccucuugcaauucugguauuaucuguccucugccuaccacccacccacggaagucuuguuggaugauacacaccagccagauucuucaacauuaggcgccauaaguaagaaagggccaaaacaucauaccuugugagccauuuuaauggauuugggcuuuauuuuguagcaacaggaagucacuagacuuuauuuuuuaucuauuuauuuuuuucuuuuuuuuucuuuuguuuuugagacagagucuugcucuuguggcccaggcugcagugcaguggcacaaucucagcucacugcaaccucugccuccuggguucaaaugauucuccugccucagccucccgaguagcugggauuauaggcgccugccaccacgccgggauuuuuuuuauuuuuaguagagacaggguuucaccauguuggccaggcuggucucgaacuccugaccuugcgauccacccucuucggccucccagagugcugggauuacaggcgugagccacccgcacccggccuagacuuuauuuuuucagagaagaggagugauuguagauuugcauuuaaacaaaucaccuucuugcuuuaucacuauguccccuaccauauaucuucguucucccagagacugccaugcugcagccucuagccgugugcuguccaguacuguagccacuggcccuaugugguuguuuggcacuugaaauguggcuaguggaaacugaugugugcuauaaguguaagauagauaccguaucucaaagauauaaugugagaaaaccuguaaaaugaucacauucauuuuuauauagguuuaacauugaaauaguuauguuuugaauauguuguuaaauacaucauaaauguuacugaguuguaacuaugugauuaaaauugauuucacuuguuucuuuugacguuucacguggcagugaggaaauugagguuccauaggcaguugcauucuguuuccguggaacagugcuguucucugugcuaucccgagccaccagugacucugagcuguaagggucuuagaucccaugaucuggcaagugggagagggagguagaaaugagucccuccauaccuucaaccagaacuucacugcauguugcaagucagggaacaaggcuuguuugggguccuuuuaaauacaucuuucauuaaauacauuuggauguaagaugauuauaugccuuucuagaacccuguggugcucucuuccuccucagacauaaugucuuuggauacuaagggugcauugaugaacagaacacagggccuguucuucaaagggggagaaaagcuuguaaaaucauaauuuuagcaaucuaaaaacuacauggugacagugacacuaauaccaucagcauugagcauucacaaagggucacaaagggucagcuacuaugcuaaguacuugcacucauuuuacccacucagugacaccuguggagaagaaccgaagaaagcaccuuggggaauugcagcauugaaggcaaacaaagagagacgauuccccaugagggagaugagcaguggccagagagauaggauaggaaguaggaggcguuacaugcuggaaggcaagccauguaaauuucuaaaugaggggaaagauaagagugcaagcaugaugcaaacggaaagcaguugaaguguaguuuuugacaugguaaaaucaugucugucaugcagacugaacacaugucaaauauuuuauucaauucauuaaugagaugaacuguaagaugugaaaaaugguucauuuugacuuggagagauuuaaaauuccuuccccagcacacuugaguugcauggcuaugaacaggaaucaucuggaauuaucuggaauaucgucaaauuauuuccaugguacaggaacacuugcauugcuauggggugucugcaguauccaucuuuacaaagcucuaaggguguggaauagcuuguaaggauguaaguaauaaggguguaagaauuuuaaggguguaagucguaaaauagcuuauuuaguagcaagucaacuggaggaacaugcuguagaaucagauaauccuuuccccgccacccucagggucugcaagacaacaccugcauuucaaugcuaggacacccagcaaucucuuuugcucauaucuuguuuuuggacauuuguaugugugugugacaaaacauuguuaggaucuggcaaauagaaggucauuguugacccuguggaauagcauggggagaaguuacguuguaguccauugcaggaaaaacaacgugggucaauggugagucagcuguggacuccuggaggaaagaccuagaggcaaaaagcuuugaggucauugaagacaaaaggaaaggcuuugugauuuugauuuuuaaauggaaggaauuugggccuaaggaagcuuaaacuaaacugugggaaggacugauacccauccuaagcacuaguugcagguaucucuuaagaacuagguuuuggccgagcuccguggcucagaccuguagucgcagcgcuuugagugagaggaucgcuugggcccaagaguacaagguuacaguaagcuaugacuaugguauucaguucuguaagaacuaggcagaaaggagauccaguggauaugugauugccugggucuuggaaaggggagggaacaucuccuuuucugaggaagaauggggagauaggguggguuaauuaggcaguuucuuuugccaggugauaaaaacccccuaaacaauuuguauuuuauauauggagaauauuuucucccacugaugggaaggaucguagugugggggaugcuuacccaauuucuuaaaaauguacacagaaaugagaucccuaggugcuggaaccgagggucaguacugccuagaauuuccccauuagggucucuuuuguuucugcuuaccuuccugcuguguguuuacuccuuuucuccugcuaagauggguguccucaaggagaccagggauguugguagccacgaccucugguaguguuaguccugguuuggcaucccaacuuuguucugcccaugggcauuaucagggagugcuucugguuggcacugcuuugaguuacacgucugcccuuggagccaccaccguaucugcagggacucaguaucaggacuagcccaucuuggccuuguggguguggccgugugauguggggagaggagcuguugccagaagagggaugaggaauggcaugggcaaaauagaagaaugaccccagugcugcaacacaguggguauggauuagaaaaggcuuguaggcuggacagggcgaggugagggagugcaucaugcauuaggauuuuaaguggcuuuuuggggaguauugagcagguggcaggggagacaaguucacucagaaguuuuagacaguguugacauuuucuuucaaauugugcaucuugaauucucuagaacauucuuuauagauauuucaggaucuuccugccacuuuccacauuguagcuauucugguguuuuucuuuuauaauuagaaauaaugaauaguucucauuuguaggcuuggauuuucaugcguguguuggaaaguguucguuuugccuuuuuuuuuuaacuucauguuuuuauuuuuuaaaccguauugauggauucauugcuaggaacggcaaggaaaagaauacucucacaauguuaccacguuuccuucucacagguuuuauaaguuguauuauuuuuauauuuucaaaguuauaaucuuaccaucuccucuguugccauacuucucauucauagggucugucuuuaacuggacucauuguuuacagcuagucuuuucaucagaucaucucaaacccuguauuacauuaauauuuugauuccguuuuguuggaugacuuucaucuuaaucauucuuauuguugaacaauguuuuucuuauuauugaacaauugcuucauuagguauagaauuccugguugauggguguuugauucagcaccaugaaaauucacgguauucugguaucugucauugggcaaauucuucuucuuuuuuuuuuuuuuuuuuuuugaaaaaaaugcguggaaaccauuaguuaccauugacagagcuacucauuuaaugauuuuuuuuuucucccaauagugguggaugaauuuuuuacuuugcguucucacuuugugucucucaugaccaaaauauuuuagagauaacuagcuggcuaagucugagguggcuguuaacagucugguccuaggauagaacaaaaccaacagaacucaucaccgucacgucguuuugacuuuuugcucacaaguuuaacucauuguuuaauuuguuuuuccaaaggauugcuuugcaguauacauguuggugcauagcuuaacaugaugauaaauacauaacuuugacugugaauuaucuacucugcuccuuucauagucucaugcuucucugaauuuguauuuuguguuacuggguuguuuuguuguuaucauucauaguguuuuuuuugcccuugauucuuugaaccagguuuuggucaagggcaagguucaagagaaaaaguaaaaacacagucuuuuauuuuugcucuugguuauaaacccuuguaaaguuugauugagaagauaacuuggaucuuaugguuuaaauugagucuuuguuuaaucccaagucuuccaaauucuuugugcuuauguauucuuuccucuuucccaaucguaauaguuuugcuucugccuagucauuggucaaauaccugccuuucaaugcauuuaaaaaauauuuuguguuagcaccauuugagauuuuuccccccuuuuuuuucaaguauguauugaggacuguuaugggaugaauguuuguguucccccaaaauuuagauauugaaacccuaaccccaggcuauucggagaugguauucggagaugauaccuuugggaggugauaacuguuagaugaggucaugaguaugugcccccgugauggaacuagugcccuuauaagaaaagauaccaaagagcuugccuuuuucucccugcucaaacgaagaagucacauaaggacacagcaaggagguggcugucugcaagcaaggaagagcggccucaccagaacucggucaugcuggcaccuugguuuuggacuuccagcuuccagagcugugacaaaagacauuuuuguuguuuaagccauucacaguaaggcagcauuuugagcuaagacaaagaccuacuguggcuucuguaggcaaaagcccuacagacccaaaguguugugagaauuaacauuucuagggaucaugccuuacaguggauuuuauccaacacuuagcucugaccuagagcacgcuagucgucguuagguaaaugcuuguggaugguaguuucuggcacagagauuggagcgguaaugggcaggaguucuguauccagcuuaugcugagagagcuucccauaaaauggagccuauacuuuccuuuugcagagaccauuucuauccauugauagaauucuuuuuuuucuuuuucuuuuuuuugacgggaucucacuccaucgcccaggcuggagugcaguggcaugaugucaacccacugcaaccucugccuccuggguucaagugauucucaugccucagccuccugaguagcugggauuacaaggugcacgccaccacauguggcuaauuuuuguauuuugguagagaugggguuucaccauguuggcuaggcuggucuugaacucuagugauuuaccugccucggccucccaaagugcugggauuacaggcaugagccacugcacccagccuuccaucgacagaauucuaaagacauguuuaggcaagaguugguggaauguuggcguguaguccagauuugccuucaguuuguuuuuauccgcuucaaaugcaaaggccaugauaauucaauaguaaagucauaaauccauaguaugacuuaaaauauuugguuguaauauuacaaaguaugcuuccaaacacauuaagcaugcaaaauccuuauauuguucuuuuuguuuaguguuuaggguaguuugugugaaucauagaugaccacaguagacuguugaguuguuauuuucuuuugacauucuuugauagaaaacagugcuuuuccucuguuauuuauacuagaagcaaaaaguaucucucauagcauuauggaaacaacucgaauacaacuacgucaauuauucaucuuuuuuuuuuuuuuuuuuuuuuuuuugagacagagucccacuccaucaaccaggcuggagugcaguggugcagucuuggcucacugcauucuuugcauccugggcucaagugauucucgugccucagccucccaaguagcugagauuacaggugcccacaccauucucagauaauuuuuguauuuuuacuagagaugggguuucaccauguuggccaggcuggucucgaacuccugaccucaagugauccaccugucuuggccucccaaagugcugggauuacaggugcgaaccacugugccuggcaguuauucaucauuuaacagcauaaaguggccacuugcuuuaauaaacuauuauaguaccaaaauuuuggccugaggaauuuauaaauauaaauagaacaaaacaaaaauaauauuccccuugaaacauauucuaaaaccaggggcuaaaaguuagaauuguuagauuuuauuguccuguuucuuugggaugaaaugaaauuuuuuaaaaaccauaguuuuggccgggcgcaguggcucacgccuguaaucccagcacuuugggaggccgaggcgggcagaucacgaggucaggagaucgagaccaucccggcuaacacggugaaacccugucucuacuaaaaauacaaaaauauuugccgggcgugguggugggcaccuguagucccagcuacuugggaggcugaggcaggagaauggcgugaacccgggagguggagcuugcggugagccgagaucgcgccgcugcacuccagccugggcgacaagagcgagacuccggcuccaaaaaaaaaaaaaaaaaaaaaaccacauaguuuuacuuaaaccaaaggcuuugggauuccagaagaauaaaggaaguguacuucaauucuacaucucaagaaucuauuucuucccaaauuuaauacaggcaaauuuagucuauauuuauugggcacuguuagguuuuugugucagguguugcugaguggcgggauaccauucuuggcccauaaggaccuuauaaaucuauuaauacaauuaaauugugaagaaaauuuagaaaauugcaaagguagaaugagguugcaaauuggagggucuuauucuggagauagguggaagcuauggcagauuuuuagcaugaaugcuuucuggucaagacacuuuuagaaaaauuagcuuguuuccaagaguagauuagauuggggagagaaggaauucaaauuacaaaauaauagugugaaaagcauugugggagaucauccuguccauccccucauucaugauauccugaggugcuguauuaagggcaucauugcucuuugucacccgagcaguccaggaaggcugccuguucagucuuagacuguauccucacagucuuaaaccauauccucacuuuaugauagaaacacacaggcaaguguuguaagaguuacauauugucaguuaaacaagaaauuggaugaguccccauacuauucuuccucuuuuaaagagagaacuugggccgggugccauggcucacaccuguaaucccagcacauugggaggccgagucgggcuggugacgagaucaagagaucaagaccauccuagccaacauggugaaaccccgucucuacuaaaaauacaaaaauuagaugggcaugguggcgcacgccuguagucccagcuacucgggagacugaggcaggagaauugcuugaacucggaggccgagguugcagugggccgagaucacgccacugcacuccagccuggcgacagagugagacuccaucccaaaaaaaaaaaaaaaaaaaaaaaggaaaaaaaaagagauaacuugaaacaggcucuuccagccucucuauucuuuuaauaacaugcagugcacuucuuggagcuaggggcuagggucuaggggcuucuugaagguguugaugucucugguaacuuacacugcagggcaggucucuggagggaacuuugaacagguuaagccucaaaugcaggcagagauuuccaauugggaaaguuaggugaacguggcuuuaucaucucuuuuauugguuuauggguauuuucucuuuuuccuguuuucuuucccaccauuuaacauuaucuguucucugccuuuuuaaccuucuggcuuuaaaugaacaguugcuuaaucuauagauuaacaggaucagcaaacaaagcacagcagugccugcacaaagcagaaacugccuguuagaugaguugagcaaaaccauuuccuuugcccaacuuucuccucuaaaauacauaacugaacaugggauucccagacacgaauuguuucucaaccuuucuuuuuccauucuacaguuguaugaaauuaaaauuaaauaaaaagcaaacaacagagguagucuuuuuaaucuuaccgaguuggaagguauacuauauacauuauccuaugguagaaggucugguacauucuugaccauuauuacuuugcuaugggcacccuucacccuuguaggcugaaaauuggcaaaucauaggcacguauacauugugguuuuggaauuugaaagaucucaaauucauauugagugagacaguuuuugaauggagggaucaggcugucuauauguggauauauuuuaugcauuucuggucuguauaaauguaaggauugcuuuacugaccguagauuucuucuaggguuaaaaaguugaaggcaguuuggauauuuuaaaauaagaaaauuagcccuacauugaaagagagaauaggaaaaucuaggcuauguguacacaucugcuuguguuuucacaauuguguccuguccuauuuauuuuuauuucucucccaucucuucccucccacccacaauuuguuuuucauucaacacuuugaaauuagaauagcuuaucuaucaaacaagguucuuugacaggauuuuccaacucugaguaugaaaguguggauauaacaauauauuuauauagaaugucagaagcagaguuuggccagauuauugggaaauauucuaacgcccugcagcauuuuaccgccuuugcuuuuacauaaggccaucauuuggaaacauagcaugcugauaccucccauuauugcaguagcguuucaucagcugcacgcugccucucagcgccucauuaaguugcaagcagagaacguuuucguuuuccaguucucuuucucaauuaaguuagagauuguauuuucaguauuccucauuauuaaaagaauuuuuguugagaauaguuuaagaugugauauuucuuuguauuccaggaaaauuuaaagaaugucauugaaauccagaaacagaaguauauauugucuaggacaugcuuugucuugguuuauaugccuaaguccgaguaguuuaaaauuuaugauuaauauacucuuugaaugcuuagaaauggcaucgauuuuaguuguucuaguuucaucuuaaauaaauuggaguaauuacuaacucaggauuaugaugugcuacacauaaaacauuugcagugaugucugguacuuaggaaacccucaguuaugacauuuuucuuacuuucuucuuggauauguucuuugaaaaagggacugguauggaaaagcuuugagacgaugaaaauauacaagauaggcuaucucugaaacaauuugguauagagcauuugauucucuguuucauguauauauucauauaugcuagcugcagucaugcagacacaauuuggaucuggguuuuuuuuuuuuuccuuuuucacaugcaguuauaaauuuagaaaccuggcuguuuccucuggacuaaauguauuuauuuaaauuuucagugcuuuaaaugcaaaauuacaagcauauguacaaguagaaagaauaguaaaaugaacccucccaucuaucugucacugaauugcaguaaugaucaaaucuagucagucuuguuccugagucagucuggaaugcagguuuuuucccuuaacuauucagguucuccagcaauccuggcaaaacacaugcggguuucagcucaucucuuucagugaccuguaaauuaagaugugcuaaagcaucacauguuacucauugacguuuuguuaauauauuuaaaacauuuuauuaguaccacauaauuuuuagcguuuucaaaaagaaauaagaauuuggcuaaaggugaauuuuaaaaauugaaugacuaaguagaaaaguaggcaaacuguuuucagaauuaguagcaauuuccaauuccauuuacucuguucauuaacuuuguuuucagccuuuuguuagccauguuugauuuuguguuuuugaaauaccuuuggucauuuuaggacuuuuggcauuaaucaccugucuuagguggccuguuuacaaaagggacuuuucgguucuccauuugcccuuaauguugggaauagagacaaaguuucuguaggacucugacaacauauggcuuuacaaaguuuuuuuuuaauauauacauuucucuucuuggcuuucuuaaauaucaucaaugucuuuucuugcuuuacguauuuagcaacuuaaaugucaucuugucugagaucaauauauuuccaacuuggagagauagugagaagagagacuucagauuuuuaaaauguggaacaaaacauucugauggugaccagguuuuaagguauuucuucaguagacaaaacuacuuaggcuaccgaugauaagcuuuuaauauuaauaauaauuauuauauauaaaaauauuaauauaauaugaucuaagauuguuucuauucccccucuuuccugguuguuaggauuuggaauuucuuaugcacucuuuuuuuuuuuuuuuuuuuuuuucugagacagagucuggcucugccucgcaggcuggagugcaguggcgcgaucucggcucacugcaagcuccgccucccagguucacgccauucuccugccucagccucccaaguagcugagacuacaggcgccugccaccaugcccggcuaauuuuuguauuuuuuaguagagacgggguuucaccauguuagccaggauggucucgaucuacugaccuugugauccacccgucuuggccucccaaagugcugggauuacaggccugagccaccgcgcccggccuaugcacucuuaaaauuauuucauguacugauacauucacuuucaaugauaaaacauggcuguaugaccagguagguaggcugcuuuucagacuccuguacuaacugaaugggccccauuagcccaagugagagcuuaacuugucacucuuccuaaaugccuuccucagcugagugcuuauuuacaguaaucuacugcuuauagcagaugcuaugauuuguauaagcuguccauaucuacuuggaagaacaauauugaaaggcauugagauacuuacuuucccucaaaagcccauaauccaacaacuauuuagaauaucuuauuuaagagauagguuuauaauacccaaagggaacuuaauguauacugaaagucccugauugaauggauucugaccuuaaccagaaauauuaauuacaugcuuaucagacacuuacugugcuaucccaggguuugccacuguugagggaacaccagaugaaucauauugucccugccuucaaggauuauauauucuaauaggacagacagcccaucagcagaauaggagguagcaaguggucagggaucagauaaagugaucaaggcaaguggaggaugcagugguaggacagaauggucugcgcacagagauugagggcaucauguggugggaauuagugaacuagcaugcaagccgggccuuuuucuuggcuuuuguucaauuggaaggagcauaaagcuacuaaaggagcuuauguuuagaaauagggcuuauugaaggggacaaggcaucuccuagaauccaaaugcacaucccaagacuuaaaagaguuagagggcacaggcaggcccugucagauccggucucugccagauccagucuugucuguuucucaucuucccuugucucucugaguauucccuguuuuccuuuccuggacuaacugcuucuuccagaugccuaguuugaguccacccaugguuuuuugggggcuuuucuuuguuuuuuuguuacguucuguuuuuguuuuuuguuuuuuugaggcggggucucacucuguugcccagacuggagugcagugacgugaucccaguucacugcagccucgaccuccucgcuuaagcuguccucccaccucagccucccgaguagcugggacuauaggcgcaagccaccaugcacccauggguguugacaugccaccuguggcucagacuuaugcucaccuccagucaaguuucuuccuuaucuaacgacagccuuuguguguucgugaaagcccuugagggaaagaaugcuacguacaguuugguuuucuugggcucuaauaagcuauaggggauggugcugcagaguuugaaauacagucacuaaugaguccuccuucagagagcugagggugggagcaccacauaaaaggaguugggggucagcagccuccugauagucugaaagccaaagaugauggauguggggcuccacggggaggcuauaacaugccacguuauguuuucugcccuugaggaaagcuucuuuucaccaggcaggcaguacagauacaaacuuaauagcgaugugaggcacacugauaaauaccagaaaacauucuguaagagggguuagcauuauuucacugugugcagaggagguuuguccauguggggggacccuaaugggcguaggcauuugaaguguagucuaagggaucuuagguaagaguguguuuggaacacaguguacguauuuauacagcaaaugcucuguguggcuauaauuuaggaaaauuuguaggacuugaggacagcuuauuuuucuacuagcugacagaggcuuggguuugcuucugcuuuaaguauaaguaucucgaguccuuuuuuaaaaaggaaaaucaaggaaauaguuggaauuggguuucacauaaaaaacauuuuagaaaagaaggggaguaugagaguuaggauuugcuaauguuugcuguauuagcaaauuauuugcaaugcuugucauauuagcaauacauguauguuuuggaaaacacaugcaaauuaagcagcuuaaggaacuuuuaucuuuauuuccuauguaagauuugagaugcugcaaagaaaauauuaaaacauugaaccgauacuuacaguaguccuccuauaucugcagaggauaacuuccaagacccccagugaaugcccgaaaccuuagauaguaccaaacccaauauauacuauguuuuuuuccuauagguacauaccugugauaaaguugaauuuacaaauuaggcacaguaaguaauucacaacaacuaauaauagaauagagcaauuaugacacuacgccaccaucacuacucuugcacuuuggggccguuauuaagucaaauaagaguuacuugaacacaagcgcugugaugaagugaucaauggcagguagcauguacagcauggagacgcuggacaaagggaugauucacuuucuggacuguguggguuugagauuucaucacacugcucagaauggugcgcaauuuaaaacuuauuguuggcugggcaugguggcucaugccuguaauccugguacuuugggaggccaggacaggaggaucucuugaggccaggaguuugagaccagccugggcaacauaggaugacccuaucucuuucuuaaaauuaaauauaggccgggcacgguggcucacgccuguaaucccaacacuuugggaggccaaggcggguggaucacaaggucaggagauugagagcauccuggccaacauggugaaacccugucuuuacugaaaauacaaaaauuagccgggugugguagugggugccuguagucccagcuacucaggaggcugaggcaggagaaucgcuugaaccugggagauggagguuacagugagcugagauugcaccacugcacugcaaccugggcgacagagugagaguccaucucaaaaaaaaaauaaauuaauuaaauaaauagaaaaauaaaacucauuuauuuauagagcuuucuauuuaauauuuuuggacugaaacuauggaaagcaaaaccacagauaagggaggacuacuauaguuaugauaaaaaucaggaacuuaaucuagccacgagaacauuuguauuucugaugaaauuuuuauucuugucuaaaauguugaacuauauuuauauuuauaucuuuaaauauaaaugaacuauauuuauaucuuuauaaaugagcuauauauuuauauuuuauauaaauauaaauauuuuuauaucuauguaaacauaaaaaggcuuuuuuuccucucuggauguuuacugggguuauuuaauaaaaaccuagggaugauauugggaauuuuuguuggaauuuuaaauuuuaacguguuuguuucuuuuuuuguuuuguuucguuguuugcuuucugagcugggaguuggcugugcauguggcaguugcuuuaucaaaagggucuugcucugcuucagaagaaguuuuguuaccuugauugcuaauguucucccccuuaaauaaaccuccugauguuggaacagcaaaauugcauuauguuuggaaaaucuaaauuaauaaucccuuaucucugaauaaaaguaacugaaucagguugaauuuacugcuuccauuuuaauaggacaguaggaaaaaacuaugcaugggcuuuaugugguucaaauuuuuuuuuuuuuuuuuuugagaccgagucucgcucugucaccaggcuggagugcaguggugugaucucagcucacugcaacauccgcuuccuggguuccugcgauucuccugccucagccuccggaguagcugggacuuaacaggcgugugccaugacgcccagcuaauuuuuguauuuuuaguagagacaggguuucaccauguuggccaggauggucuugaucucuugaccucgugagccgcccgccucggccucccaaagugcugggauuacaggugugugccacugucuccggccugguucaaauuuuguaaucuccacauccaucugcauauuaacaauugucauuguugguguuauagagagagaagcugaagcacagaaaauaacacgcauguucuagauuuccuggugggaacuggaaguaaauucuguguuuggcugaucacuguauaaaguucuaguacuagucuuuagggaaaagccccgucuucauggauuuuaauuugucaauuugcaauucuaccuacuuggaaauagucaaccuaaucaguuacugcccuguugcaccaacuauuaccauaggaaucugaagaugguaugcaaccaacaugaaaaagagauccuuuucuccugguaaucaguuuguacccuacaaacaauucguugguuuuaaguuguauagagggaaccaugaugugaauaugccugccacuggguuuauagaaaaccgaugacuccugaggaaauucucagcaggguugucuuucagugaaaagaacccuuuagaaagaugcaguaacucacacuuuacugcacauaaagucaugucccucaggguggacucucaggugucauacaguuuaugacucaugagugcugcagcuuugugaucuaauaaacaaguaaagacggugggagaauuauauuccuguacaaaaagccacuucaccuuucauuauauaggaaaaaagccaugggaauauuaaauuuuuaguggcauuuuuagagcauuuucugugaucuaaagugccugcauugagauauuaagauacuuaagaacaaaguaaaauaaagagaaguauuaauagcaggaucccuuuggagcuagguuacuguggcagugguuucaagaauaacucucucagcacccaccccaggauucugauuuagagauuucuuuguguguucucuuagcauauaccucuaccacugaguuuauccccugcugcuacacugauugauaccuuauuuuuaaauuuuuguuuuuaaaauagacgguuuuuuagagcaguuuuagauucacagaaaaguugagaggaagguacagagguuucccauauacuugcuaccugcacacaugcuuagccucuccuauuauaaacaucccccacagaaugguacauuuguuacaaucgaugaaccaacauugauacaucauuagcacccaaaguccauaguuucccugaggguucacucuuggcgguauacauuuuuuggguuuggacaaauguauaaugacauauguccaucauuguaguaccauacagaguaguuucacugcccuaaaaaucuucugugcucuaucuguucauccucccccugcccccaaccacccaaacccguggcaaccacugaucuuuuuagucuccauaguucugccuuuuccagaaugucauauagugggaagaaugucauauaguauggagccuauucagaugggcuucuuucacuuagcaauauuaguuaaguuccuccaugucuuuucauggguucauagcccauuuccuuuuaguguugaaugacauuccauuuucuagguguguaccccacaguguuauuuauucauucacaguaccuuauuuuuuaacugauuuuuuuggggucugggacuaaggugagguaaacaaggcagucaggaauugagauuaagaauuuuuaauguaauauuuuuaaaaaucaaaauuacugcaaaaaaacuccaugaugaacaaaauaucaacuuuuuagacagagauugagucacgcucaauugacaucaagccaugcauaguucuccuacugccuuauuaaaauggaagcaguaaauucagccugauucaguuacuuuuauucaaagauaagggauuauuaauuuagauuugucaagcccucugaaugucauggacaauugugagugaaauuccguguaucgucuaacuccccauggauguuaucuugcucagaaaccuuguucucccuccaaggaaggcacuacuucuccuguagccuucucaggucgaaguucuuuucucaaaauccucacagcguugccccuagaggugggaauguccucuuuuccucuucauuuccucuuuuccucuucauuuuuguuuccaaaccacucuuccuuucucuucccuaaaagccccccuaccucagcuugaagugcaugcuuucagacaaaucacuuugcuccuccaccuguuggucaucuccagaccucuuucuaccucaucgauguucaccauucagacuuugaagauuuuagcuccugccuugcugucaucagguguagcugcuucauuugcugauucuuaagugauccuaauauugaucucaaugauccuuccaguauuccaauuugucaguucaugauucucaucccuccagugaccuuguuuucaucauucuccaucacccauugcuuacaauggucauauuauacuccuugcaaugaccaaucacugcaacuccuccaaaauuuuaauuucaauuauuugacucuccaaguacuacuuauuaccaccucacuuucuccaguccugugcgccauacauucuuuagccccuggagugugaucaguggacucagauuccacuggucccuaccaccuuuuaccugugucuaauuccccucauguucucacuuuugccacuugagauugcauggcccagcauucuaaucauucccuugcuuauaccgucacuucucuauucguuguuauuuaucuggcaaaacaaccacccuguugcaaugcaagguuuaugcaagggaaugcacauuuucgaaauagauuuuuauguuuauguuuuucuuucaaaucucuacucauuaauaaauagaagugguuugauauuucacaaaugugauuuaauugaucaaguuucacauuucauucuaagugcucaguuaaacaccaugauguauucacaacaguaaucaaagcaaggggcuguaguuaguuauaggagcaaagagaauucaugaguuuauuuuuaucuaaaugacacccuugauaacuuuucgauaaguuauuuucauguaaauuacuuggaauaagagcaggauuuuuauauagaaagcuuucuaugugucauauccuguaaaauguuuguccgauuagugagagauagggggagguugaauuuuacuaaacauaauauccccagccauaucuacuguaacguuuguuuaggacauuacagacuauuauccuacaccaauuuauuucacaucaaaaaucaccccaugcuuguaagaauccuccuuucccccucuuguuucuauuuuagcuccccuggaaaaauaauauuuuaagucuaaaugaguacaauaaauuaaaaaguugcauugcuuaauauuuugaauggaauagcuagaugcuuguucauuugcuaucuuuuucuuuguacugaauuucuuuagcuuggucagagguagagcaggcuugacucuuaguggauagugguauagguugaguaucccaaauuuaaaaauccagaguccgaaaugcucaaaaacccaaaacuauuugcaugucaacaugaugcucaaaggaaaugcucauuggaguauuuuggauuuuggacuuuccggauuccagaugcucaaccaguaaguauauaaugcagauguucuaaaaucggaaaaagucagagaccuugaaagcacuucuggucccaagcauuuuggauaagggacacuccaccuguaccuuacaguggaggcuuguuagaugcuuguaaaugccagccccugccucaaguaacaauugauucuuuuugugugcucucccaggucuacccugaacugcagaucaccaaugugguagaagccaaccaaccagugaccauccagaacuggugcaagcggggccgcaagcagugcaagacccauccccacuuugugauucccuaccgcugcuuaggugagccggccggccguggggcugguguugauugggggccuggucuugagggaagaaaaagaggaugcuccuguuaggucacauacacagacuuguucuucagcacauugccacucuguguuguacuguguuuuggacucuugcaguuacauucugugcacugacccuauaggagcaguauuuuugaguucccugccucagaaugaauuuacccaggguguauauugaaauuacaaauuccugggccaguuccaggacuccugaaugaaaaaugccuauaguagcggauccgggaauucuuauuuuaccguaucgcauagaugauucucaugaacaggggccuuguguguuucuucacauagacuuucuagaagaaagaaucuaaugugaagcugcagcauuuuguuaauuucuaaaaaaaaaaaaaaaaaaaaaaaaaaggcuguucuacaauaacuacuccucuuauuuggugauaguagaggaauuggaauugggaaggcuuuuuuucugcuuacaucaaacuggaggaaacagucugauuacuaauguuuaauguuuguuuugucacaaaccucaaauuuaccucaacauuuuauuuaaaaaaauugaguaguuuuaugugguaucgugcucuuuuccucuggaaacugucauacuccauauuuaaucuaacuugguuauuagucuguuccuaguuguuguuuuuaugugaccagucauugcagaagucaaguucuuugcucugguaucuuacaucuagauguuuuccacaaguguauucaucaguaggcagguuguaaauaaggauauagagauugucuguggagauuguggacaaauauugauguauauucugaugacuucuuauaaagguuaaaaggaauauuucaaagaaaauccaacagcaaacuuacaaaguaaggauauuuacugaagauuccggagaucuauguaauauauggucaaaaaugaauguccuaagagcauacugauugcuguucauucaugugcauaauuugagacauaaaaugaaaacacugggcauuagaaagaagauuucaccuggugaauuuacuuacaauguaauugaugaagagaguguagaaaacuagauuucuuaaacaucugauaauucaagaguuuccuuuuuccuccuuauuccuuguuccuauaugcuuuauaaggccucaacucuuuucugguucaucaaaaagugcaguuuaauuagaugaaaauaagcagcacuuaaauucuagauacagaacuccuacucaaaaaaauauagaagucaucuguccccaggaacuguguauuuuauacucacuuaguuauuacaccaagaaauaacacacagagauugaacaauucaguacaaguuaggaaguagaucaugagucuguuaauuugaugggccaggcuuuguuaaugauuuguuucuuuugguucuuacuuaccuguucuaugaaguauuccaaauauauuuucauuagaauguaagcucacugagaacagguagggcuuuggaugggcauuauugcuccugguaugacacucaaaacugcagucauguuucagaagugaacuuaucauuuuacauagauuuuucugcuucauauucuauucagaaugauuuguauuaaaguugauggaaagaugaaauccacauuaagauuguuauuuacuaccuagugccaguuguuguagcaaauauccuuugaaccccaggucuauuuuauccuaucuguugaucacuuccuuugccccugcucuucaagccuccucaucucugaaaagcucuccuuccacugggugugguggcucaagccuauaaucccagcacuguaagaggccgaggugggaagauugcuugagcccagcaguuagagaccagccugggcaacauaaugagaccccgucucuuaaaaaaacaaaaacaaacaaaaaaaccuccaagugaacgaacaguacaacaaguaauaaaggauauaaaagauguucucagaucucaauaucaagucagaagauuuuauaauaauauuauaauuacacggagacuguccaaauauuuguauuuguugugcuacacugcauuaugcaccauuuagggaaacaacagccuaaguaaugugguuuuaaauaauuaaucucaucuaccaaauaccuguuugauaguaaaguuaaugaccuguccucaccuuauguuuuuaaccauuauggaaagagaaccacuugaaaauauaucauuccacugacagauaauuacccagcugugaagcacaggcuggagacuggcaaggagaaauggagagaagccuauaaaauaauucuuucucagggaaggaguuuauuccugccaaggcuuugccaucaaccauuaucagauuucucuuucauccuccgaacagauucugggcuccuuugauguggagguacauaauucaaaaaguugggucacuugugacauguuaagcaaauuucucaguucugguugugucugaugugaaaugagcacguugacacuaacuguucuugacuacuaugggacuagauaaucauuugcuauuuccuguagguacuuggcguguugaaucauuuuaccauauuuucucauuuuaugaaucacugguccuuuuccauuggaccugaaauuagacccuaauaugacaaguagagcauauguugucucuuacuuuguuauuaaccuuagauuagaauuaaggaauauaggugcugcuuuuuucuuagguaguggcaaauuuuccaaaggucucaagcccagaguauaauacagaguugauaaaauaaccugguagaguauguagagcaugccuugucuuucaggaaaaggaacugaaaaacauagguuuuccaauagguguaacauagguaacauagggacauagguguaacugauguacauuuuacuugcacuuaauagacaggcaguguuaguucuucgucucucuucacaggcuauacaacuaccaagauccagagagguugaauuucuugcuauaacucacagcaaauaaaugggagagucagcacuacaguccaagcucucuugauuauugguccaguguuuuuuacaguauacacaaaaauuuguuuuaaaacaaauauucacuaugaauuagagacaauagcacuaaaaaagaaacucacagcuaucguuguguugacagaggagacaaccaugaccuaguauaggauaaaucuccaugugauauguuuucuacuuuauaguaguaguagguaacauucuuacauauuauuccugcuuaacaaagaauuacuguucagcauuaacauaaguaugcucuaaaaucucuugacuguauccaaauauauguuuuagacaagaguuuuuuuuuuuuacugaccuagcaaacaaaauaaaauuaucuuaaacauuaagcguguuaaaauucaaaacaaagcuugaagagagaaaaaugcuuguuauguguggcauacaaccuuccuaaccucuuuaucagaugaaggauccaguguggcacuggauuauuuuucuguaauauuuugccucggacauaugugcuauacauuucuugucugcauggggaaaguaugucagguugcuguugccacuuucuucccauggaguggauaauuucccuugagaauaaguuggcuuucucaucucacccuuugcuuuugguaguaccucuggaaccagaggguaagauucaucuuaaucaugugaacauuuuauuaauuaucucaugugugauucaagcacaucauuacuguuacucaaggagaauauuuucuuugcaaagcuuucaacccuuuccauuugaaugacugcucuucaugguguaauagauccacuguugaaauuggcacuuuucuguacuugucucugaccagcaaaggcaaggaacauugcguaaaauaaauuacuguugaauuauuggggcaaagucagguuaauagcuuaauccaaaaaaggaauuacaagugaaagaauuuuaccuuaaaugucauucuguuucauuuuguaauuaagaccuuccaaauguguaaguaguaaugaccagaaaucuuaucagauauggucaaaugagaaagguauucaauucauauuaauuuugaauuuuauuguuuuaauacaauuuuaggaaaagcaugccuuguuuucuggguuucuuggcugccuuuguaucaauuaucuacagcuaucuucuuuagcauggaaaggauguauuugaauacugugacauuuuauaccaggguaauucuuugaauuuauguaaacaacaacucucuugagacacaucaguacaacacaauagucagaaaugucacaugagaguucaccaaacuuuaaagauggcgaugaggauggaaaaacauuuuuauuguagacuuuaaggaucuuguaaauccccguauguaauccagugugcuagagaauuggugcccauggcgccuccucuccccaccgaccugcacuguggaaauccuacuaauuuugaagucaugggagaugcaugugugggaccuauacaugcacugugaugagaaugaugacuucaucauucucauuauuuaaugagcccagcugcugcauacaagaaggaugcaaauucuugaauguucuugauuguuuacaucauggucucauaaggaaugaccagaauugcugggcauuucuucaucaggaaaggcuaaucagccauccuuggagagacaucagacuccuuuauauguggccuucccaugggaccuuugaauggucaacguuaaucaugcuucagaaccagcauacuaaguaaaagaaaacauguccggaaaagaaaucuuaucaguguuuaucucccaacagugggauuacaggugauuuugauuuuauuuaagcaauuuucuaugacuuuguauaauaaaugaguagcuuuuauaaucagcaaaagauagacuaugaaaucaguacauauaauuuuguauuuguauguaguaccauugaaggauaauagaaaaaagucaaaagacuugaaagucgacacagaaugaucauuaauuuguuuuaucucuugguaguuguacuuuaugagcuuuauacauacaguaugggaaaauacacuuuaguuuugaaaacaccaugaugccaaaauaaaagaaaauaacguucauucauacgaucuucaacaaaauuuaagcagcauuaaucaucacugauucuucaggaagauucuugaucuuccuuaauuuuuuuucccuccaaaauugcauauggcagccacauuuguuucaggccagaaggaagaaugggaagagcuuacauuuaucucacagauuccuucugggugaggaagacuuagaaagugaagcccucuuccauuugauuaagcaagaacaccuauaaaaauggugucuucggccgggcgcggugcucacgccuguaaucccagaacuucgggaggccgagaugggcggaucgcaaggucaggagauugagacugucuuggcuaacaacggugaaaccccgucucuacuaaaaauacaaaaaaauuagccaggcguggugcgggcgccuguaaucccagcuacucgggaggcugaggcaggagaauggcgugaacccgggaggcggagcuugccgugagccgagaucgcgccacugcgcuccagccugggggacagagcgagacucagucucaaaaaaaaaaaaaaaaaaaaaaaaaaaaauggagcccuucuagguaggucauccuccauggcucacugcagcacuuccuuggcccugucccaaguuccauaauugccucaauugcauuggcuccugcuugauuugcuuucuaaaacucaggacagaggaugaguugaggagacugacuuuuuuaacaaucgcauuuugaaaagaaggaagcguagugguguuucuuggcuccguuuccaguuuuguuucuuuucauuuuaauuauuguaccugguauuguguccucuuucugggacuuuuaacaacuaauguuuugauugauaagagcucuaauagcaugggugauuuauacuucauuacaucuucaguuuugucuucuuuacuggaguuguauucaggugucauuaaguaacgaggcauuaaaaagaaacgauaacuuuugaaaaacugcuguuauggcuuaugagugggcuuugcugauauuuucuugaagcacagaauuuaucuaucucuguagguccuagaugauaggugagaaaaagaaacccagcuuauuuggcaugauauugucccaaggcuuguuaguaauugcuuugaaaaaugaauagcaaggcuaauggacaucugauuuguaguacaugcuaagaauugcaaaugugugcucaaaagaaauuucucugauuacaaaaguaacauauauucaacguacaaaguugagaaaauacaaccacuagcuaaaaauaaucaaaaccauuuggcuuccuugcagucuacauuuuuuucauguauguuuugcuuuuguuuuuaguguuauuuaaucguuuccuguuuugugacuugcuuuuuacaccuaacauuuuuagaauacucuaccugugaaauuaaauauucuuggagagcauaauuuuuaauguagcaucacaccagacacuguaauguguuuacucuuuuuuauggucauuuaggugguuuucuuuauuuuguggugguguaauaguuguuauaaaugaugcugugauaaacauccugguagauaaauuuguguuuaguugauuuuuauauaacaguuauuggcggaaugccuugcaaaucuuauaguugguguaauaaaauauaugcgccacauaauuguuuaugaaaauauggaggaaaauuuuaauacugauuuaugauccugaguuuaacauaagcauggauaccccuacauuuagcuaugauuuuuuuauugauagaguaaaagcgccuguaauuucuacuuaaggccauuuaaaauaauuacuauuuaaaucuauuuaaacaauuuuaaauauugcuuuuccaaauuuccaccuuaggaaguaguuaauugaauauucucagagaaauaaguccuacaaaauugaccaauaaaaggucaguuacguauucauuguguacguuuuauugaucacccacagugugugagccccuggaggugggugaaaugugggccucccucuuacagaguugauagugggccugaaggggaugggauuucagcucaggaauuuaaggaagacuugacaggaaguagcauugugagccaagauuucaaggauaagauuucaaggcaagaaaggagauguauuuuagguauucagacagagggucaacaaagucuuuaagguaggaacuaguucacuuuucaaaaagaagagguaauuggucaugauaagaguaguaguuuuuaaaaaucauuacuguuuucauucauuuauaaugaauacuauuauuuuauaauuuuaaaguuuauauccaaauaauuguuuucaagaugguaaugaauguauauugcuuuuauguauacacauaguacuuuuugcuuuuugguaacuaaguuuauaauuuuugagggcaggaaauauuuuuguuuuucacuuacaaagaaacuauauuuuaauaagaguuuuuugacagcagugcuuuaugccaaaggaaaauaaagcaacauuuaacauaucaaagaaagccaaugcaaaacaaggauuauuuauuuauuuauuuauuuuauucauuuuugagauggaguuucacucuuguugccccggcuggagugcaauggcgugaucucggcucacugcaaccuccacuuccugggaucaagcgauucuccugccucggccuccugaguagcugggauuacuggcacccgccaccacgcccagcuaauuuuuugucuuuuuaguagagaugggguuucaucauguuggccagguuggucucaaacuccugaccucaggugauccacccaucuuggccucccaaaguccugggauuacagacaugagccaucaugcccagccaaaacaaggauuuuauauucaaucaaacugacauucagauaugaucacaugaaauaaauaucaacguacaauaacucagggcauauuuucacauuauuuuccuguagaaucugcuagagaacaaguuucagauacccaaaauaccuagagaaaaacugauauaaggauggguaaugagcauuaaggagaaacauaaaaacuaagacucaacgaugguaaaaaguaugauaauauaguauuccacagcuacaugcugugacaauaaagagauucuguaacugucaggccucugagcccaagcuaaaccauccccugugaccugcacguauucgcccagauggcccgaagcaagugaagaaucacaaaagaagugaaaauggccuguuccugccuuaacugaugacauuccaccacaaaagaagugaaaauggccgguccuugccuuaagugaugacauuaucuugugaaauuccuucuucuggcucauccuggcucaaaaacucccccacugagcacccugugacccccaccccugccccccagagaacaacccccuuugacugcaauuuuccuuuaccuacccgaaucuuacaaaauggcccuaccccaucucccuuuccugacucuuuuucggacucagccugccugcacccaggugaaauaaacagccuuguugugacaguaacuuuaauggggaagaaugagaagaagauguggguaaagaaacaacuguuuuucuauuaauggugguaguauuaguguguaauucugagccuggugcauaaguaauaugguguaacauaagugaauaguugugugauauuuuaauucaaucaucccauguauuugagaaucagaauuuugaugugguaaaagaagauucacauguaacauauaaucuauuaaaaagauacccuguagucaugaguuugacuuuuagguaucauuucucaguauaacauauuguuguagauuucagauaacauuuuuuccccauaaauacuguccgcugcaggccuaaaaauaaugaaaaggccuaaaagaccaacucaguagcgguaaacaccaguacugcaccuagauuauggucuuuaggaaccauuuuccaguaaaagauaccaguaaucuuuggaaagcaggauuuuuuuuucuuuuuuuuuuuuuuugagauagagucuagcuucgucgcccaggcuggagugcaguggugcgaucuuggcucacugcaaccucugccuccugaguucaagccauucucugccucagccuaccgaguagcugggauuacaggugccugccaccacuacuggcuaauuuuuuuuuguauuuuuaguagagacggaauuugaccaccuuggccagucuggucuugaacuccugaccucgugauccacccgccucagccucccaaaguacugagauuacaggcaugagccaccacaacccggcggaaagcaggaaauuuuuuaaaagcuauuuuaauucagucauguaaaaaaaaugagcagaaagaaacaaaaaacuuaaaaaaaaacuuaaaaaaugagcagaaucuuaggaaucaccugcgacuuugguuauucaugcuuagccauuucuauaggaaauuccagcacuauuugaguuagaccacuaauuauauguguguuguagcuuucuccaagagauaauggaauucacaaaucaaaacuuugagauuauuaaguguuacaagugaauuauaaccccagucauuugcuuucaaaugaacagcuaaacauauuuuguguuaauuucuuauggaugcugcuuuguuuguuuguuuguuuauugagacggaauuucacuccugucaccuaggcugaagugcaauggugagaucucggcucacugcaaccucugccucccggguucaagugauucuccugccucagccucccgaguagcugggauuacaggcgugcaccaccacaccuagcagauuuuuguauuuuuaauagagacaggguuucaccauguuggccaggcugguuucgaacuucugaccucaggugauccacccaccuuggucucccaaaaugcugggauuacaggcgugagccaccauucccggccuagauaggcuuuuaguugguuuccauauacaguguauauagggagaaacagacuaagacagacacuggcauccacagaaguaaaaauaaaaaguaagguauaauuuaaauuucacacggucauggucacauuuuucagcuuuuugcaccuauguuguauaaaaaagacaaaaaugccuuuagaggcucaaguuuucaggacuuccugaagcugugucauaguuuaaaaaugccauaaaaaugccgucagauuuaauaacguaucagcugaacacuggauuucuguuauguugagucuucaaaaauuucucccuguaugaggaauuaauacuguuaugucugaucugguggucugaaaugugaacuuuucugggccaaccaguaaacagcugcuguugcuuuauagcugcguaauucagucuuggaaauuauuagauaauucccacaccauuucagcuugcuguuuuaccauaaauuuaaugugaacaguauuucuagcuaaccucaagcuguguuuauugucguggaauuuucucuuuuauucugagguaaaugauuacaaaugguuaugaugaggaaucaaagaagaaaguggacuuucuucaaaguucuuuuucuacucuagccgcuucugagcaucuuucucaagcacuguguuuccaucagucccuaccccaagcagagaaaggaaacaguuuuccccuuugucuucagaacccucuucucaucgugucauuuuccaaagcaaauaaaaaucuugagauauugucuugaguuugauuuuuuuuuuuuuuuuuugagauggaguuucacucuuuguugcccaggcuggagugcaauggcacaaucucagcucaccccaaccuccgccuccuggguucaagugauucuccugccuaagccugccaaguagcugggauuacaggcaugugccaccaugcccagcuauuuuucuguuuuuaguagagacgggguuucuccguguuggucaggcuggucucgagcucccgaccucaggugauccgcgccucggccucccaaagugcugggauuacaggcgugagccaccacacccugccgaguuugauguuuuuuuuaaccauucaagccaguaaauaacuuuccagacagcuguaguagaaaacagaauuugugugugacaaaacuuaagauuuugggauugagagcucuaugguuuaugccauguggauaauuguagccagaugaagaauaugaaauuuaaggaaguguuuagagugguacagacagcuauuauuacgauucuugggguagaagaguagcuuacauacaacauaaaauaauggcauuaacugaauuaacuucagccuuugccaugaaacccaagcuuucauuauguuuuaaauaaugaacuacauuaaaaauaguauauaaauauguaaaauauauuagacauagacuucucauaauaaauuaugggaacuuuugauguauuucuucccuaggaaaagaacuaaacaagugcuucuuuguggacuuaaaauuuuucaguuuacuauugugaauuagguacagcauaucuuuauaauuccagauaauacccauaaaagcagaacuguuuauuuacuuauuaugaagggaauacugaaaugaaauuaaggacaauuuuuuucucacguauuauauuuuuaaaaaguuauuugauguuugugauuaaauaaagaaugaauuuuuaaagccaguucucaauuagcacugaggaaaagaauaugcuuuuuuucagguacacaaauaagcaucauggauauaagaaacgacauaaagaugaaucuacagucuggauuaagacguauuuuaauuucagugucaaaggcuguuaggaaauauucagauuuuaguacuugacaaagaagguucucaauauuuguuucaguguucagugaaaggauaaauucugucgucuuucucuuuuaucauauuagucacugagugguuucauuaaacauucccucuuccauauccccugauaaauuucaacuuguuggugaugcaucccaggagugucugucuuuuuuuuuuuuuuuuuuuccuucuccugucagugagucuuaggcuuuggcuuugaaacccuauagugaagggaaaucucaggcaacagcugugcaaccgucuggagagcagcuaguccagauuggaggagacgaacgaggcuggucgcaggagagaggccuccaggaaaaaauggcauugaugcauuaccugcguuaaagauuuuccuguacuuagcaugcuucuuaggguucuacuggagcguuugggaaagauacaguauugauggaugcauagaaaaugaggcaaauuuuuuaaauggggcaaauauuaacuguagacaaagaaaagccaaaaguacaaaauaacagcguuguaagauacgaagauaaaaauacgccuaaguaugagcguucuggcagacucacaauacagaugccauauaugggguaaaaccauaccaguaggauggugggaagggaaaggggugggcucauguuccauagugggaagaccuacagcggaaaaaucaggagaauaguuauuuaagcacagaguuuagggaguaaguugcagaagagacaacuaaaugagauggccgugaaugauuuuuaugaccuccucuuguuauggagaaaucgaucaaggaggccuauauuugauggcaggaagaaguugaguuuaagguuuccagacauuuguuuuaaucuggaaaauuucuuuuuuucuuucuuucuuuuuuuuuuuuuuuugagacagagucucacucugucgcccaggcuggagcgcaguggcgcagucuuggcucaucgcagccuccgccuccuggguucacgccauucuccugucucagccucuugaguagcugggacuacaggcgcccacaaccacgcccggcuaauuuuuuguauuuuuaguggagacuggguuucaucguguuagccaggauggucuccaucuccugaucucgugauccgcccaccucggccucccaaagugccgggauuacaggcgugagccacugcgcccagccuaaaauuucuuuuaagcuuagaaguugcaagucaaguuacuguuaaaggcguccuaacuuugaauuagauaaagcuaaacugugguuuaauugagcugaguuuguuguaugcuauaucucaacuucacaagauguuugcuuuuucuuggcuauaaccuaagauuauacaaauauaaaauuaccuuuaugcccauuugauagacuuuagggcugaauuucccuguguaagauguuguagagguuuguacuugugauuguuuuuacucuagaagcauguuuaucuucacuccuuuagugacacguguuuguucaggaacuucaaacucaaugugaucaaaacuagacucauguucccugaauagucucuccugacuacaaaucuguuggaaacuuccaauccuaauuaauaauuguaaacuuuuuaauguaagucauaugagggguuguugugagcauaggagguagggagaugguagugugagcuggagcauaugguaaaaguuguuugaaagaaaguagacccaugauguggauccugagggauacguaaagaaaaugaagagguguagauuuaaaaauguuuauggggccugggcgugguagcucacaccuguaaucccagcacuuugggaggccgaggugggcagaucaccugagguuaggaguuggagaccagccuggccaacauagugaaaccccgucucuacuaaaaguacaaaaauuagccaggcauggugaugggcgccuguaaucccagcuacucaggaggcugaggcaggagaaucacuugaaaccgggaagcggagauugcagugagccgagaucgcgccacugcacgccagccuggaugacaagagcgaaacuccgucucaaaaaaaauuaaacaauaaauaaauaaauauauucauggggauguuccagggaaaguaguuuguguugguagccuugagaaauaauaauagaaaauuagaauagaacuaaguugguucauuaaaguuggaacacuuguagagauuuuugauuuggacagacauuaauucauuugauuauuucucuuauucgauguccagaaaaauaucuguacauucaaugugguuuuauuuguacugcacaugucauuaauaggcuaaaguuaccucuaagauaccugcuuucuuaguccuuguuacgcuguaaauucugggcaucaggauauagcuuuuuauuauguuagcucuuuuaauagaugauacaauuggauuggggaaaaaacugauuauacucuggaguaauacuuucauagccuguaguauccugcaaauagcuccuggucaucuucgaauuuuacuagcaaacuuguaggguaauagguugggacaaaguauuauaaucaguggcuuugagggccugauaagaggaaacaauaauugugcagcuauauugugaauaaguagugcaugaugcugaugguuaacccuuuccugcggugcucaaacauugggaaauaauugcuuuuuguucaaaauguaagcucuucgauaauugagacuuuugucaauucacugaaauauucccagagcuugaacaugucugguacauaguacauauuuaauaaauauauagauuuaaugaaugaauugaggauguagccaaauauuggaaaaggaaagggaaaagaaagaauagcccaaacauuagaaagacagaagauguggagcagcaauuucacaugccuaaaagaauuucugagauuauggcaaaaucauuuacuuuacuuacuccuuauugaucaacaaaggaagagcagguuuuauguaacaaccaagaaguaacauagggaucucagaagagaagaaaccaagugucuuuggaucuuaauaaaaagaacauucaacuccagaaauaggguuaaaccuauccuacacaugucuaguaaaaagucaguguaucagaggcaucuguguuuagagauaaaacauaccauuagauucauuuauaauaguuucauuguccuuaguuuuuaaggcuaaugauaaagauuuuuuuuuuuuugugagacacagucucucugucacccaggcuggagugcagugacgcaaucucugcucacugcaaccuccgccucccggguucaagcgauucucuugccucagccacccaaguagcuaggacuacaggcacacgccaucaugccuggcuaauuuuuguauuuuuaguagagaggggguuucaccauguugcccacgauggucucgaucuccugaccucaacagaucugcccgccucggccuagugcuggaauuacaggcgugagccaccacgccuggccuuaagaauuaauuuucacagaaaucugcuucuaaauauuauucagugauaauagauuuuagaaauuucagauucuuauguuguaccuuaaagguuaggauacuauuuauaaaugcuaaacaugaacuccugucauccuauuuuaaugucuuuauuaagugauuacaugaauguggcguuucaguagguguuugguguauuaauagauguagguacuccccucuuaaaccuuuaaguauuuucaugccaugaaaaauuuggggggcauucucuuuauuuauugauuagguaccuguauuuucaagaauauuacucagcuucaguucccccaaaucuuuuuuaguguuaacuaccuuccgagaacgugguauaacauuuuaaaauauauuuuuugaagguuuggaugucacugaagaucccccuauuuauuggaugguaucuuuaucagcugggaagauaauuaguuucccaauguugcuauauuuuuaugaauagguccuguagcucuugcuuucuugaaagcuuagaauugauuguaagccauggacuaaugauauucuccaagcauauuuaacaugaauaggcucauguucaguaugucaagaaguuacccuguuguacuauuuaaauaauuugagcuuaguuuucuuuuuccaccuuuguucuaaauucuuaggugagucugaauuccugggcaucugugcacacagcuucuucaguagguccuuuacucucauuguaucugaucuuugacuucauaaagacccuuggccuacugacccuguauuuaauuucacaucucaauaguauuuagccuucucauauuuuuccucuucuuuagagcucccugaucccucacuccagucauucaacucuguguauuccuuuaacuuccacccucgcucugucucuucacagauaugcuucuuuauaugguagucagaaguuccugugugaucuucguaaccuccaguucccuccacagucaccuguuaucaggcaucuguuccuugagcuccagggaaugagcucuuugcuaucauucugguugucggacucacugggcacuguuguguccuccacagucucucaguggcaucgguugaugggugcauucuccccacacugaugucauucugcugcuucugauuuucuuucugcuguccuccauuuuccuuucaggcucccuuccccguccuccccgcgccaccuuuugcaauauuuaggauucagaaauuccaaauauugcaaaauauuuagaaucagaauucagaaauucuaaauaucaguguuuaauaggaguacccugggguuguccauuuucucacacaacacauacuugcuaggagaucucauaagugcagugguuuuucagaggccugcauugaugauuccugagucauuauguccaggccaggccucauacauacuauuuacugguucucuuucugcgggugcuccaccaagaauucagacucaauggaauauuucuucuaagauguacaccaguuccuuaucaaaaaauggcaaauucagacuucuuagguuaaacagagaacucgugaacauggcauaugucuguuauuccauuuuucucuguuggcuuauugcugaguaccauuugggauaaaaaucuguuucaggcaaaggauaggauuguuuucagcuuuuauuaaauucuccuagacccuugauuuuaugcagagaacuaauuaaauuugaaugaauuuaauguagaaacccugcuauugaugcagaaaucaaccugauucuggacuagcaccagaaucaacuauuuuuguuguuuuugcuuucuuuuuuuuugcuuuugcuuucucugccgguaaauaacaacuaguauguaagaaucaaaugaaucaagcauaaaucccuaggaaauauuuaugcauucauuuuuaacaauuuaaagaugugaagauauauaauuaagcauaauccucucaaaguuugacguugaaaaguauuucagauacuucaacuuaaauauauuuuuugcaaaauaucuuuuuuaaaaaaacagauguggucucagcaauguaauuauuacagugugaggagagcuuacaguuguaccaaaauuuauaacuaggaagaagagaaugugaaauaauccggaaaccuacaaaacuguccuauacaggaauaccaauuaaacagcuacuaaaaaugaguguaaaaugacaauauggcuuuaucaagugcuuagggucuggaaaaaugcacauauugccuguuauuuauuguuauacuuaaugaauguucuuuugcacgugagaacuguuauaaaagaugucuuuuguacauacuugguacaccaguuggcuuuuuaacccauuagcuguuuucccccaaagguggccuacucuagaugacguuaaaaauacacauuuuccagggacuuauauaaauagucaacugcccuauuauggaaacuuaaaagcgaaggcccugaaauauccagacaguuugaacauaaaccaaaaaugaagugaaucucuagaauugcuguguaauagcgugaguggggagggggucccucaagagagggaacugaccuuuuucuuccucgugggugaccuugaguacacacuuuauuuagucauuaaaagggucaccugaagcuuagagaaugaagauccuacagccuguuaauuuuaucauuguuagaaacucucugccuuuggccugaaaaugguaaaucaccuuucuuagaagauucucauauccagauauucuuaccaaaucagaaucuuuuccagcauuuucuucaaaaaaccacaguucuggguuaaaacacagcagauccuaacuguaauuuuccuuucauguacauuuuagucaucuuuauaauuuuaaaugaaagacaggaacuacauuauuugaaauaaggguuaacccccucuaauuauaagcauuaaucacacacaguuuucucauuucuaaauguuaaauauaaaaugggagcuaucucuucagacacuuuucuguugccuucugugugcggcaggaccuuacuuuuaagcuuaguuugauuuaaaggcugaguuucugcuugcuuggaaugcuugcucuucaaaauauuugcucccuggagagggaaacugaagauggagcuuucacgugacuuuggauugcugaccuggaagacguuugggguaauaggaugggcuagggcaugguuccacugcuuucuguuugaguggggucaggaaaggaaggcggggcucgcugugugcaaacaggaaaacauagucugaagauguuugaagccugagugcacuuucauuugaugccuugcuuuauugcuuaagagaauuuuaaacugccgaauccgcaaaugugcugcagccuauaaugacacauauuuaaaugauuuuugcaucuaaacaaaugcauucacucuuugccugguguguacaauuugaaugacacucgugcucugccuggaaggaacagacguuuuucauuauaaaauucagucaagcagaaaaguagcaaaggaagcagaaauuuccauuuacaucuaugauugaaguuguagugauaaaagaggaugacuaaguugaagaguagccuuguucucauucugcuaucugacaugggaucuugucacuuugguaauaguuuuuaaacuuacauuauugaggaaggcucugaucagaagucucaaauuauacauguucuucaaccuuagauuuuucuggguguuuuguuucaaaagucucaaauuauauauguucuucaaccuuagauuuuucuggguguuuuguuugguuuuuugguuaucuauagauagauuugaguaucucuuuuuuucuuaaaauccguuacuuacuaguaauaaagacuuaagugguagcuuuacgcuccauuaucacagagauucacaguacuuuuuaguuuuuacuugugagccucagcagguguagacagauaccuuaguugccacugauaacauccaguugccacuagaucaagaaaugguucaaaauucuccaggggcauuuucugcuaaagaagaguuggugaucuuccuuuuggaagccuuaauguacuuaaaccuucuuccuuagaaguccagaaauucaauuauuucagcucucuguggagugauaaguccugccaaauugauuuacaauaaugaaacuaagccuuguuuacaaaucuaaguggugauuucuaaguccacagaggcgugguaacagagagagagauucugauuuaucugggggucuauccguguuugaacagauugugugauuuuugaaacaugauucaaaagggauguugauaaauucuaaaauacauuuuuauugaagagcuugaugaaucauguauacuuacuuuauuuguuauucuauuagauauugucuuccucaucccuaggugguguugcuaguacagugacagaauucaaauccuucuuuuuccucugcucuaacagagcuuugugaacucauagcaauauuguaaugccugguaaaagguggugccaguuucaaguacuauauccuaauuacuucauggcuaacucuuguuauuguuaacaauauuguuaacucuuuuguuaaaugcagugacaucuuuuuucuuucucauucucuguguacuuuuugcccuaaauaguucugcaucuuuuaagauacaaguuugcuuuuucuuggagguuuuuauuuggaaaaugccugaaauauauagaccaacauuuguuccuccaaugguuaaauuacauugucucccaaagugaggcauuuuaagucuggacuauacccaggagaaucuaaaagaggcaguuaauaagcucuugaagagcacaguggggugguuguguauuuauugagucucacacuuaggagagaaauaggcuggaccaaaugagccugggcaucaaaagcauguggguggucguuggugauaugugcagugaugagugugugugcugaggguccuagaccaggcuggcagggaaaugaacugaaggcagugaagccuccccugauaacugcagagagugcugcagcauccaggaccucaggaucaugaugaacaagcuguaguggauggaagggagaggaacuaugggaaggaugaguuucuggccagaaagugguuuacuggagugcugugucugaguauuacaugaucugaggaccaugagguccagcuuugggaguauggagaguuugaguggaguagaguuauagucccauggucuucugauucacagacauucaugagcgauaaguaucuauugagaaaguggaagcaugauuuuuaugaccuccucuuguuguggggaaaucgaucaacggggccuauauugguuggguucuacaaccaaauagaauguguucagcaggagucauguuuugggcuccucacaauguucaguguuaguucuguuccuuucucuugcuuccacauaggaaagacuuugacccaaugaggaauuagucauuguccuuuggguacacuuccggaauuugauaaucaguugggcacuugauucuaguacauuugcuaaaaguaauuaauacccugcaauuggaagcaugcagcaagcgacugggaaugcuaagugaaaggucagaauugaaagaguggaggaggcuguugacccuuaggcauggaugauaugucugagugagaaagcaagaagaguagaagacagagccuuacuuuauaaucagaauuaugaaaagaggagccaaugagagggaaagaaugauuggcuugagauagauugguggaaacuggagaagauugaauuuaaagaagaaaagugggccaaguucaguggcccaugccuagaaucccagcaaauugggaggcugaagcuaggagaguugcuugaggccaggaguuugagaucagcuugggcaacguggcgagaccccugucucuacaaaaaauaauuaaaaaaaaaauuagccaggcauguuggcaugugccgguagucccggcuacuuggaaggcugagacaggaagguugucugagcccaggaggcugcagugagcuaugaucacagcacugcacuccagccugguugacagaggguauccccgucucuuuaaaaaaaaaaaaaaaaagagaauguggcagaguagucagagaacuggagggcugagaagagacugauggcauuuguuguucuugaccuugaaagaagaguugcagauuguuggagcaaggccagaugguaauagguuggaaagaacaagugaggggcgugagagugacagucuacaaccccguuaagaaguuaucugugaaaaugccucuuccugucuugauuauagccucccucgcacauggcuuucugaguaugguaugugaaaacagcaugcuguauauuuuuaccuucccauaugaguuaagguuuugguaaugacuugugguucuuuugccucacggaacaccaaccugguugguauuuugucggcaauuaugugguuuuuaaaaagccccguauauaaccuuaauuaauugcgucucuaaaaucuaucaggcuuugaguuuuuuguuuuuuuuuuuuaaauaaggcagaaagaaaggaaaguguuaggagaaagcaaccagugagaauaccuauauuuugaagaaacaaaguagggaauuuagaauuaucucuacuauaucugcuuuuucagcucaucucucgggauacagaggacugaacuaagcuaaaguagguucaagucuaaaggaaaccuuaaauuaauuucuguauuagaauuaaucacacaccuauaaauacaauuuaugauaugagaacugcaacaagagaaauggggggagaugagcaguuugcugaucaauaggguuaaugaugguaacauagaauccuagugauaugccucccauugacuaaaauguaugcguuaagauagcauagcgcauaaaaugguguacugcagucucaguguauucaagcuuauuaugguuucucugccuagguuugugucuuuggcuuuagauuuucucccauaaccccaaccuguccacauucaagucacuacuccuugaaauauauuauugaucucuaaaaucugaugcuaagucugucuugcccaacgguggccacuagccacccauggccauugaauauuugaaaccuggcuaguccaaacuaugcugugaguauaaaaaacccaccagauauuaaaaaguuagucugggagaaaaaaacaaauguagaaugucuuaaugauaauuauuuacauugauugcauguugaaaugaugaaauuuaggauguacuggguuaaaauauauuaauaaaauuaauuuuaccuguuucuuuuuaccuuuuuauguuaauguggcuacaggaaauuuuaaauuagauauguggccucuauuauauuucugugagacaaagcugcuccaagcuguuuugguccagaacuauaucucgguucuuuuguauccuacauggaccugcauagaaugguauuuaguaauacucagcaguagcagagaugaucucuuaucaaauuauguuaaguuuuaauuuuuauucuugucucucacccuaugugcaccucucuggccaggaggcauuuaucauaucaccuuuuaauauuuggaaaucacuugaucugcuugagucauuguguuguuuucaaaucuagaacucuuucuaccuuauuuuguaacuucuauaauuaaacaaaaggcgaaccaggagcagcuuggcucuuagggaugugugaaaaggcgcucaguccuuaaguuggugccaaaagugacaaaucuauaggaugagaugcagguuuauggaagagaagcaugaaaauuuuuauuuuuuaaaaggacacagcaagcuagucaccaaaagacagauacuugauucuacuuauaugcgguaccuuuuugaauuugaagagucaaauucaaaaagauggaaaacagaauggugguuuccagguucuggaggugggggaauggggaguggaggugggggaauggggaguggaggugggggaauggggaguuguuuaauggugugcaggguuuuaguuuagcaagaugaaaacaguucuggagauggaagguagugaugguuguacaacgauaugaaucuacuuaacacuaaacuguauaauuaaaaguggguaagcaaagagugucuuacaaagcaauaacuuguaacuuaaaauuuuuaaaaaccuuaaugagauuaguuguaauggguuaucuuaaguagacccuuacugccggaaggaacagcugaaucacaucacuugggagcuuguuagaaaagcagacucagucccacccuagacuuguccaaucaaaaccugcauuuuaacaaggcccccaggugauucauaggcacuguaaagcuugagaagcccugcuccaaauaucauuucucaaagugugauccaugagccaccugaagcagagccacccugggaaggucuguuuucaggcgcgucccagaacacguaaaucagaucuaggcuguggagcuagggagaagaugaaucugcagacugaucaggaucccaggugauuuugaagcaugguuugaguuugaaaaccccuaaucuggaaagcuuuaacaacuauuacucuuacaauuccaucuuuuaacgaauguuggaauuauuaaauacuuguaacaagaaguccuguuauugauaaaaucaagauaugacuaauagugcagucaaaaagaggcaacaaaaaagcaccuauaacuuaucuuggguugguuaaugaggaagcugucauucaaaauuaguaagacuacuguaacauuucuugggguccugaacauuggaaugagagucgguuuucagaguugagcccaccucugucauuagcuuugugcaaaccucaucaggcucaagauuccucauuuguaaaggggaaugaauucucugaccaguuaguuuacauuccuaagacaagguuaaauuuggaaagcaaagaauuuucgguauauaugugauaauuuugaaauucuugaauuuuuaaaaaauuuaaaugccacauuacuuauauuuuuuucuaaaaaaaagucaaaccaagcgcugucuaguuauuaauagauaccacagaugagaugccugaguugguaagcucuuuuuaauucuaguucuuuucaacuacaauaauuuuauagacuuuuuuuugaaggcuagaauguugauguggaaucaaauagguaugccucuauguaugguagaugcaccugacagggaucacuugacuugaacaugcccugacaaugauccuguguggcaggugcaccugauucugaguucugaguuaagaaauccgggagugggccgggcgggguggccggugccuguaaucccagcacuuugggaggccgaggcagguggaucauuugaggucggaaguccaagaccagccuggccaauguggcaaaaccccgucucuacuaaaaauacaaaaaccagcugggcgugguggcgcaggccuguagucccagcuacuuuggaggcugaggcaggagaauugcuugaacccgggagguggagguugcagugagccaagaucacgccagugcacuccagccugggcgacagaaugagacucuguuucaaacaacagcaacaacaaaacccaaaacaaaaaaacaacaacaaagaaauccaggaguggcuaacccagagagccauuccuuaucuguaaggaacaucugagcccucaucuccuucuguggaacaugggccucgccggggauugagacccuuuguuaugaguuaaguggaaguugccagguggagauuguuagggggaggguguuaaaugagaaugcuguagagaccacaugccuuuugcaagcggcugcgguuccucuguccaacccaccaccacuggacucucuacccuguaugcaagcccccaguaaaacccuaugagacauacgguucacuagcucugggccucuucuggcucuugaaccuggugccauccacauugcagucaguaggaguuuggcaugacaccuuauuaugugaacuuuuauaucaagccauuaaauuuuuuuaaaauagacuuuauauuuuacaacaguuuuaaauuuacaggaaaauugagaggauaguccagagaguucccauaggcuuugcauccaguuuucccuauuguuaacaucuuauauuaauaugguacauuuguugcagucaguaaaccaauuuugauacaugguuauuaacuaaagucuauacuuuauucagauguccuuaguuuuugucuaauguccuuucuguguuccaggaugccauccaggaaggcgcauuauauuuaauugucaggucuccauagccuccuuuccucuuggcuaugacaguuucuuuauacuucucuaguuuuuuaauaaccuuaaagguuuuguauuggucagauaauuuguaggauuccccucugugggaauuuucucaugcuuugccugggguuauugguuuuaagaaggaagaccacagagguaaaaugcccauuucaucacaucauaucaaggguacguguuuaucaacaugauacagcccuguuggcauugaccuugaucaccuggcucagguggugguuguugaguuucuccacuugaaaauuacucgucuucccacuuuaugugcucuacucuuuggaaggaagucaguuugcacagcccacaauuaaggagcagagaauuaugcuucauuuucuugagggcagaguaucuacauaaauuauuuggaauucuucugcgcaggagauuugucucuuuuuuccuauuuauguauucauucauucagucauuuagacucauggauauuuacauuguacuuugauuucuaauccagcacuacuucauaauuuuuauugcucaaauuauuccggcuuuagcuauuagaagcccuuucacuugguuccuaugcucauuugacauagccucuuuuuuuuuuuucuuacaagaugcugcagucucaucuugcauauuuucagcccuaauccuagaaucagcuguuccuccaaggagcccuuguuccuuuuauuggagaguaauguuauuggagaauaguauuaaaaucuggauguuaaggaugcucguugccacuggaguuucuuugcuuuuaagacuucucaguugauagagcaaggcaauguauuuguccauguucacccuuauguuaugcagaucuauaaauauuucuauagcuaacuaguuguauuuauauuaagcuauaauaucuagucuauauuaagcuaaauacaaguucauccggauguuuccuacucuaacguauuaccacauggacacuauaucucuccuccuugguuauguauaaauucucacuccauccaccaucuauguacuuaauuguucaguuucaguauaugugcguagccguaucagaauuguuaacccaggcuggguacaguggcucaugccuguaaucccaauacuuugggaggcugaggcagguggauugcuugagcccaggaauuugagaccagccugggcaacauggcauaaccccaugucuacuaaaaauacaaaaaaauugcuggucaugguagcaugugccuguagucccagcuacccgagaagcugaggugggaggaucaccugagcccaggaagucaaggcugcagugagcugugaucgugccauugcacuccagccugggagacagaguaagacucuuucuuaaaaaaauaaaaaauaaaaaauauaaaaaaauuuguuaacccacaccuauauggaucuuuuuaaaagcugcaagacugcuaacaaauauuuauuuauuuauuuauuuauuuauuuauuugagacagagucucccucugucacccaggcuggagugcaaugacacaaucucagcccacugcaaccucugcuuccccggcucaggcgauucuccugccccagccucccgaguagcuaagauuacaggcacccgccaccaugcccagcuaauuuuguauuuuuaguagagacgggguuucaccauguuagccaggcuggucucgaacuccugaccucaggugauccacuugccucggccucccaaauugcugggauuauaggugugagccaccaugccuggccauaaauacuuauuuuguucccgugguuuuuuuuuucuuuucucuuuuuuaaaguaaauccuuugcacuauuuuuauuauuuuaagaccaguguuauucagagccuggguuaaacacuauucuguguguguguguguguguguguguguguuuguuuguuuguuuguuuuuugagacagagucucgcucugucacccaugcuggagugcaguggugugaucuuggcucacugcaaccuccgccucccugguucgggagauucuucggccucagccucccgaguagcugggacuauaggugcgcgccaacaugcucagcuaauuuuuguauuuuuaguagagacggagugucaccauauuggccaggcugguuucaaacuccugaccuugugauccaccucggccucccaaagugcugggauuacaggcaugagccaccacucccggccagcacuauucugucuuauacucacucugccaucuguguguguauaugguacguaugugaggcuggaucugugcacuuggaaaaguuggagagaugauuuagguaaaacuuuuaguuuucacuucuuuugccuuuuugcuuaucuugauccauuuaguuccuaccaucuggcaaauaguucucaucugaagaaucccaucugucaguucucacuauuauccgguaauaguuacagugaaaugcuggugacggcaacagccacuuuuuaaaaggauguguaauucacccucauguccucuuugagaacccaguaacugcccacacucugaagcuaaaaccauaacaguuuuaucacauggaaaguuuguugagaaauguuuggcuguuucugugaaguaaucgucccgucucuugaguacagaugccucccaggaaaauuuucccagccuauuuguuaaugugaaaguuacaaaagauagcauauaaugagcacauucaagacaaaaaaauuuguggaguaagagucugaaaugguaaaauaaaaaaucacuuaagaaaacauuuaucuguagcugucauuuucauauacacauaucuaguguauacaaguuaguaaguacauaauucucaaaaguucuaccugucuacacaucuacacagaaaaauuaggaaagucuuguccagacuuuuccaucaucuucaguauaaagcaucuucuagcuguuggaauagaaacaagcuagauucuugacuccuuucuauuugauuauuuagaucugaccuucagacgacauccagaaucugagaacacgcaccaccucuacugcucucauccugguccaagucauugucaucucccaccuggauuaaugccagagcccccuuccuggucuucucacuucuagucuugacccccuagggcaagaauaauuagcuuagaaaaccaccccagagccuuccagcauuacucugaguacuggccagaguuggacaauguuuaaggccccgugcagucagcugucccuguccuguccuggcugucacucacucgcuugcccacugaucucuuccacaucauuccuccacgacagcacugaucuccuuguucuucugugaguucaccaggcaugcaucugccucaagacuuuguguaauacuuguugcuuccucuggcuagaauauucuucccuuugauucugaauacuuuguucccucacuuccucaagucuucacugaaaugucauauuuucaaguaggcauucccugaccacccuauuuaaaauuucaccccucagaaaaaacaaacaaaccaccccuuucucugcuuuaucuauguaacauuuauuaccauccaacagacacuguauuuuuaucuguauuuuuuaucgcuuccccgcuaggaucauauaucguuuuaucuguuuuguucacugcuguauucuuagcacugagacauaauuguaaguaugcagugaagaguuaguggauaaaggacaguggcugcaagaggggauuuaggaaacacccccucccagccaggaccagcacucggugcaagaguugaaagaguugaucacucagauucucugcuucuccagucguagggacuccaccccgcuguguugauugcugucauguauucaccccaucauaagcaguacucacauguaaaacaguaccaugucaucucuguggggcuacaaguagguggugauggugcaaugaacauauaaaaccccagugucuucaguaggugcgaaauaggugauuagugaaugaugaagaguagcuguugcuguuuugauuacuaugauuauuauuaugagaaacuacugugguugaugagauagauacuggggagaaggauacuauuaauauaauuuauugagcaacuuuguucugggcacuaguugaguacuuuagggauauuaauucauuuaauucucccaguucugccauuuacucucuaugugaccuggacuguuacauagucucucagucucacccucucuuuuuuuuuuuuuuuuuuuuuuuuuuuuuuuuugagacggagucucgcucuuucgcucagucuggacugcaguggugcuaucuuggcucacugcaaccuccaccucccagguucaagcgauucuccugccucagccuacugaguagcugggauuacaggcaugcaccaccacgccuggcuaauuuuuuuguauuuuuaguagagacgggguuucaccauauuagccagacuggucucgaacuccugaccuugugauccacccgucucggccucccaaagugcugggauuacagacuugagccacugugcccggcccuugccuucucuuauaaagugaaaucauuguagcugcuuuggugugguucugaggacggugagagaagacgcacgugaaguauugagggugguggcaggcacacaguucagaguuacuaacaauacugguguuuuaucuucacaaggcagaucugggcccauagcacaaggaaaccgaggcuuuggcauuuuacaguaauuacauugccagaacauuucccccacuuucuugaaucaucuuuaccucuugagagaugaggaagagagggcacaccucgggcagaaguccaaagaccucaggcauuuuuggccuuucauucccaugauucuggccaacaucauuuuaguccccagcaguucauagaaauauugucuuuuaaucugauauucaaauaaucugugccuugaagaaccuguguauggcucuagaaucuuuuacauuaaucuacucaaccccacucugaugcucaaaacuucagcagucuguuuuuuuuuuauuuuaaugucuuuauuauuauuuuuuuuuuugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccuugugauccgcccgccucggccucccaaagugcugggauuacaggcgugagccaccgcgcccggccuaaugucuuuauuuuaaacauuuauuuuuagagguagggucucucuaaguuaugcaggcuggccucaaauuccugggcucaagugauccucccaccacagccucccaaguagcugggaugacacccccaggugccgccauccuggcagcagagucaguuuugauacaucuuucccuucucauucuucccaaugucauggauugggaaguuacugugguuuuaguugcaguacuuuuuacucugaauucuguuugcuuccuggaauucugucugucuuuugaaaagacaacauaaagaaaucgaaaaauauacuuuaaauuccauagugugggagccucugcuacucgccuguuugauauucauucccauuuuuuccuuucuaaaagaauuccagauuuuuuuuguucagggugacaaugugcucugcugaaaauacuuucacagauucccuugcaggugcaugugaccagaucacaguaauggcacauauggccucaguggaauuugcugaggaguaugucccucccaaguaacagcaaagcuuuauuagaggaaaaaacaacaacagaaaaccuuucaccuuugucuuguuucuccugccuucugucuggaacuuggacacagagucuugaauuucugugaccauaaaacacgaggauaaaaccaacgugcucaggauggcaguacagaaagauaggaauacgcuggucccugauggcaucauggaauaucugcaguggcccuagcuucagugucacuucuuaggugagauacauaauccuaccguguguuuaagccacgguuugacauguggucuauucucugccgcugacugcauucccagcuguucuauauggcuugcuagcuaauuuaagucuaguuuuauugucaaauugaccacauuguagauuauaauauuaaaguacuucacagucuaaaagugaacuacuuuuguaaaagccaaaggaaaugggccaaaugaaccauuuugaacagaguuuaaaugagugaguugaguuaccacucuuggauggagaacuggagaccuggauuuucagucuaguucuucugccaguuggcucugugggcaagucacuugaccugagcucuuuuccucccaucugcaaaaugagguaauuugagcuagacaguccucccaaagaccaccaaagagcuagcagauugaggccugcagacuccuauugaauuugccauccuuguucaccuugccaagacuucauagccaagaagccagacccagauuuuguucauuagcuuugaaaacacccuuucaguuggguguguguguguguguguguguguguggugugugacaugcguuuugaauauaaauugugaauuguuuuagcaagaaaccagguuguauguuucucaauaaacaugcauacuguauauugaugaauuuauccacuugaaauaaauggugccaaauugccuaaaguuugcuguaaacaggaacaugauuucucauuaugauguuuaauuuguuuuagucuuugaucucuuacaucagaauucuguuaagaacucuuuuuaccugaaagaucaaagcaaauaagcagaagcauuuauaaaaauaagguauacguggcuguggagagaaacuccagguauauacgaucauaggcuuuuuaaaauuaauaaacuuuguuuuuaaaaacaaagcaguggaaguucacagcaaguuugaguagaaaguacaguuuccauguaacugcuguccuagcaaagauuuuuaaguacaauauuuuuuaauuaaaaagagaaaauauaaaccgugcuaagccaguuggugaaaaaggcuucauuauacuuuuagcacucuuaacgcuuauuaaaaguuuuuaaaaacagauuuuugugguugaaucgcuuacaauuucugauguguaaccuucuaacauguuucaucaaauuuuaaaaguaauguaagcagugcuguccacugcuaaauuuuauuuuaauguuagaauacaaugagguuucuauuuugccauuaguccugagagcuuauuaaguaaccaguuuuaauccuuuaaaaaaccauucucauuuugagggacacauauuucuuagcuuugugcaauauaagaagcuaagaccaucuuggcaguaucaaaugaaauguuuugcaaguuagaaaguucaguaaccacuuauaaacauaaugaacaauuguuauagucagucuaaugcagaaauacagguguugggggcagggggguggugggugggcagacuugguccacaaguaguaguuugccaaccucuguccuaaacacaaguucaagaauaugguucucuuggauagauuuucugccagaugaaaguaagaguaacauccuuagcuaaugaacuccuaauauccaaggcaacuuuuaauuaauucaggcuuuuaagaaaagcuuguuuaccaacuccucauuaaaaauguucagacuggcuggucgugguggcucaugucuguaaucccggcacuuugggaggcugaggcaggcagauugcuugagccuaggaguucgagaccagccugggcaacauaucuagacccugucucugcaaaaagugaaauaauuagcugggcaugauggugcacagcuguagucccagcuacucaggaggcugaggugggaggauugcaugacccccggaggucgaagcugcagugagccauugauccaaccacuacauuccagccagggugacagagugagaccuugucugaaaacaaacaaacaaaaagauuaaugcaguacauguccuuuuggugaauaaguaaauauguuuugguaacuuuagcuuugcauuauaaucuagucgucagcagauugacuaagggcagauaaaacaagaugauuugguuuugugguuuggcacuuacugucugauuuaugcccccaagaacucuugcaggccaaggucgaguguaucugauaccugcucuggcucuucucacgaacugauuuaguagcuuugggccagcauuagauuuuuuaaacucuuugaccuauuuguacaugacaggcauuuaaucuuuccaguaguuacuugucaaauagaaaagcaucacuucuuaguuuggacauuugcaaauaugacugagcagagcugacagaugaggugggcaucuucaggccauaggguacuucuggccuccuguaaccuagaaaauugggaugccucagauaucagguauucuuccaagcagcuaggguuagucccugaccucagaaacccugagagcccucagaaacccugagaaauccaccugggaaugguguauuuguuuuggaugagauuaccuuuacuuuccauucuccaggucuucuuguguuuuuuguuuuuguuuuguuuuguuuuguuuuauaucauucuauguaaaagagaaaugugguaucauuugcauuaucauguuauuucuuuccuuauaauuuauaucuuaaugcuuaucucuggggcuagguuauaaucuccugaguuagguagccuuagguuucuuggcggagauuccuccccugggaagugagguuuauaaaagaacccgugauguggcccuguggagcugcauggggugugugcucaguacucacugguuucuucccugcaaagugacaccugcagccuuugggguaccaugucucauaauuuuugcauucccugcaacacacacuauacugcuaugggcaucauugaucauuuuaaagauuuaaggaaugacaagauacagugcuuauucuccccuaugauuugcuuagauuuuuaucuaaauaguacuuauugaaauaaguacuucaguaucaugcuacaucuuacauguuugagcuagaaacagacuaaaguuuaaacccuuuuaugagaaugaaaaguuacuuccuuccccuucuuagggcuuuuaaucccucuuuauguugcauuucagaaaaugcccuauagcguacuaugaaagaaagacauucauuccugucuuugcugcuguguggacgaucuguauuccuugcuccgugggaguuguggguuuaugucuauucuugcauguuuugccugaaggaccacagugaccuacuugguggucucccugcuuucaugguuucacuaugcugaucuauccuucacuuaauuauagagucuaucuuaaaaaaaaaaaaaaaaaaaaaaaaacuuuuggccuauguugcuucuuccaaaauggcauccaaaaccuaagccucuuuaaaauuggaguccagcaugcuuccccagugcuacuuccuucuggacucccuuugccacuugcuuucugcuuccacccauauccagaugggcugcaaauaugccuugcugguucuuuacucugucuuugcacaggaggcucccucauuuugaagggucuuuugcuacccauccauccauccauuuggauucuauaauagaguucuugauguuugacagaacuaggccaggaauuguggggguauaauggcaagcaagacagagucuauccuuacguuauggaaguucaauucauuucccauguggcauacuacuucucaccauucagauucaucucgaauauuguuucuucuuugagguuuuucccacugcacccaagauacuggccugacacuuuccuuaucucuauuacagaauuuaacuuguucauucauuaacagauauuuauugccuacuaugugcaagaaucugugcuaaaagcugggaauauugcaguaaacaaaaauuaaguuuacagcuuacauauaaugugguaauuauccaucuuuuaccuucauuagacugaguucauguaggacuuuauguaauaucuuuauaucuucaauaccagaaaugccuagaaauaauuugcauaauauacauuuucuuuaaagauuuaacaaaagucugagggacaguuuucagaauaaacugaauuaaacucucucucucuuauguguguuauguaaacauauauauaaaauacacuuuuggguuuuuugcuuaggaaguagaaaaaugcuaaaauuucuguuacuuacaagcagauuaaaauguccaagaaagaaaaguagggauuuauauugauucugcucaaaugcuuaccuagacaaugucaauauuuauauuuuacuccccuguuguaguagaaugguaauugguucucuaguuaagcagcuuuuuuaggauuaauuuugaagcaagaaauucagauuaauuaagggacaauuucacuugcagcauuuaggcauuauuuuaaccaucaaacuugaaguggcaagaaacggaguugcuuaaggaggccagacguaacauucuaaagguaguagggucuugauuggguugcuuaggcauuaaaaggcuguuuaacuugucuugaagucuaucuuuccuugaugucuucugcgguaagaacacugugauacagauggaaugacgggaagugguuuuccuuucuuucaguuggugaguuuguaagugaugcccuucucguuccugacaagugcaaauucuuacaccaggagaggauggauguuugcgaaacucaucuucacuggcacaccgucgccaaagagguaccagcccauaaauucuuucuuauugcaaagugaagauuuccuggggacgugcuuaauggcauuuuagggguauuuugaggcaacagcuauguugauaaguuauuuaagaaaaaaacccagugcuacuauccguaacccagauuuuaguuuuuagagugauuuuagguucacagcaaaaucgaacagaaaauagaguucccguguacccccuguccccacacaugcgcagccuccccauccaugaauauuuuuaaaaagucaaaaauagggccaguugaacuagauucauuaugugccugugccguguuucgcaacuuaaaaauauaaguugucugugccaugccuuauaacuuaaaaauauaaucucuaauaguuauaacuuuaaaguuuacccuucagauuauuuuuaugcaccuguuguuuucuuuugucauauacaauuuuuuaauaauuuagccuuuuccccuguuaucuauuagugaauacagugguagaacagugaaguagcuuuuuuauaccagccugaaagcuccaguuagaauucaguuucucaguuauaccauccaguuuuauauucagcaggccaugccuaccaucuugauuuuuccacagggugagucugaccgagcacuugguuaaccucugcuuuuggcuaagccaauaaaagauguaagauacuuagcaugaaaaggucacugugugguaagaccaccuucacagcugcuguguccccuugauagguuuccuaauaaauuuauauagguuuauuuguggcaagaucagucuuaggcuaacuagaauuaggcuccuuuaucuagcucauagugcuucacuugagucaauuuugauccccugucccucaccggaacaugucuggagacauuuuuuguuauuacagcuugagggagugguguuacuggcaucugauagugcccagaggccagagauucugcuaaacauccuacagucaacaggauaaccacccgccacccccaagaauuaggcaguccaaaacaucaauagugcugggguugagaaaucugaucuagcuuagcuuaaccauuguaucauagcuuuauagcuguuagacagaaaauaccacugaagauuuaguauuauuuuaugccucuuauaaaauaguauauuuggauccacuguagaauaaaauguuuuuuauguaaaaauguguuuuggagguuuaagagcuugcugaguuuaagaaaacaaaccaaauaauuugaaguccagcuaccuauuugauaaccucauuuuuuauuccuucuguguuuucaaaagaaaaauccuuugucucuaagaaacggaaaugacucccauaaggucaaaauacagucuguaauauuuucauugucuaccuuuaugucuugaauuauucauccuucauuuaucacuaguggaugcucucagaacuuuaugcuaaucuagauuugugcaaauuuagcaaaucccagaaaagcaaaaagacauucaaggagaaaucucuaaugacuguaaguucugauucuuaguggcugcaggggauaauuucuucucuucccaggauuguuacucugaaagugaaccaagagagucagaauuucuaggauaaggcagguccaugugagauaaacuuccaucuguaagggagguaggagugagcuggggaucuaccuggaaugcgcacaauuucuggauacacgaauuaagccagaaggcauuaauucucugguaucuguucaccaguggagacugcuacaucuuauuucccaauuaguuuccauuccaguuguucguauaaaccucuauuauauaacaucguggucuuauuaaauaaauaauaaacaagaauaaaaagaguaccaaaguguaacccaugcuaaaaaaaauccuguuguaaauucacucaaaaagcaaauaaucuuuuccuuugugaaauugguuccuaauauauugggucugcauguugauuauuuuauguggaguuuucuuacaaugaaacacaucuacucuaccacucacuguuuucuccuuacacuuuguagacaugcagugagaagaguaccaacuugcaugacuacggcauguugcugcccugcggaauugacaaguuccgagggguagaguuuguguguugcccacuggcugaagaaagugacaauguggauucugcugaugcggaggaggaugacucggaugucugguggggcggagcagacacagacuaugcagaugggagguaagguggccuuuguguucagccucagagaugcugaaacaucuuguauggaguauuuguauccuguaaauuaaucuuucuguuuaucacugaaaaggucucugcccacucccaucagagucugcuguuaugcaaaaaucugaacuaugaauuuuuauggcauccuguugaauuaauaauaucagucacccaucacagaguuaauuuuaacuauuuaauauuaaacuugggaucaaaaucccacugauaacuaucauagguuacugguaguucuaacagggaguugaaauaauaauggcguucuguuuuggucauuaauuuaaaaauauuuuuaaaugcucucugggauugucagucauuaguuuaaggugaauuuucguuaaagguuugguuugagauuuugggcguucucuguguggauguguaaggguuuuuuuuuggccuuuuaucauuucuuuuccuucauaguggaagucaaaggcauuaauaaaugcuuguuaauuuuuuuuaacuaccuuugauuuguugauuguaaagaaaccuauuuucgccucuuuuucuuagggagcuuagucccguuacuucuuaccugauucucauucuuaacugaaggcaaacaucuauauucaaaucauaaaauuauaaaaugagaaucuuuggguuggaaaugccaucugguucaggcauugauuuuaugcugucucaucccccgaagggugaugauuguaucacuuaucuuauuccuucaguauucucuuagauguucccuagagcuacagauuuccaaacagcacauucaauaggaguuguaaguuuauaaucggcaaacuacaggaugcuuguuuuuuuuucuuuuaauuucugguguaaucugcuacuagggcccccauagaguuuauugucuauaucagcuagaacacugggaccacagucauaaacugaaggauccaggcaaacugggucauaugguuacccccaccaauuacagucuucagugaugaugucacuauccagguugauauucaguugaaaugcuagccagcuccuuccuaguuaccuucauuuacaucccauuucaguaccugaacacagucaugcuuuagacucugaaauuccuuagaaauaguaccauaagguuuauagcuuugauauuccucucugaucaugaucuucccucauaaucaccuccccaguucaggcuuuuaguccauuauccucuuuuucccugccugccuuucuaaucaggauggaaucaauggauaaccauucuuaccuauuccauugaacauccuugacuuggcugaaacccuucacauuuucuaaacauauuuuugucaauucuccauagcuaggaaaaauuaauuucuuucuuuaguugcuucugggauuucuaaaguaucaagucauguaaccuuaccacuuaauuccauuucuuauucaugcuguaacaucagcugggaucuuaauguuacuagaugcaccuaauuaucucugucuugaugaccuaucaucuuccccauagcaguugauccagcccaacuucauucuccuugguucccagcguaacucucucucaugcucuacagaugaccccuccaccgucauccauugugaauuucugcaacaugguaccugacauuugguaggugcccaguacguguuuguugaauaaaccauugaauuuucuccuguacuucagcaacucuuguaccuucuucuaucccuuuguuuccugucuucccuuuuaugauuauguucugcuggacucucaaucaucuccucucccuuucuugcauuuucagucucccucucccccacacccccaggcuucauccacccuccucccagauaauucuuucccauguguuacuaucuuucuacuauguguuuuuaauccuguugacaguugguaggaaauauuugaugguuuauucuaccuguagaaaaguccaaauucucuugcagggcauucagaagucucuuacauggcuucagccugcauuuucagccuuauacauguaugugacucuccuggcauccuaaaaccauugaccuuuucuuucucuaggcuuucauucccaccguucugccccaucugaaauauuuuuccuuuuuuugucaaaugggguuaauguaugauaaagauauuugucaacucuaaagugccacuucuuaugacccgucaaaaucuauauauuuauaaauguucaccugaaaagaugcagccuuuacaagucuuuacaggugccuugcucugcuauacuacccuugcuuuaccuuuuucuuauaagaccauaacuuaucuuccaauuaauuguagucauaucucuuuuuaucuguuagaauccaaacuauaguuuaugugucugguaugucuugcacauagguccucaauaaauauuagacaaaguaaauuguauauuuuaaauuuuuuuucauagcuuuugguaaggacuucaugguccacgauuggauauuguagaaagcuuauccagcccacugcccaggacgacuuugaaugcggaccaacacaaauucauaaacuuucuuaaaacauuaugaaauuuuuuugccuuuuuuuuucuauaggcccuguuauagagccucccaucuuuuagcaaagaacugucuaauacaaauguaaugugagccacauacuuuuucguuuucuuuuuuuaagauggagucucgcucugucacccaggcuggagugcaguggcgugaucucggcucacugcaaccuccaccucccggguucaagcgauucuccugccucagccuccuaaguagcugggauuacagacaugugccagcaugcccagcuaauuuuuuuuuuuuuguacuuuuaguagaggugggguuucaccauguuggccgggcugaucucgaacuccugaccucgucauccaccaaccucagccucccaaagugcugggauuacaggcuugagccaccgugccuggccuuacuuuuucauuuucuaauagacaguuuaaaaauaguaaaaagaaacaggugaauuuaauuuuaacaacauuuuauuuaauccaguauaucugaaauaucaugugaccaauaugaaaaauuuaauaagauaguucacauucuuuuuuuauguuucuuucuuucguaagaagucuuaacacuucuuuuaacauuuaacagcacgucucaauucauacuagccacacacuguguuugauaguuacauguggcuggugacuacuauauuuggacaguguaguuccuggaugacuugaaauuucuuaucacucuuuauuuuuccauuaagacagacgguuuguauaaccuaguaauguuuucuaaggcugagccacugaauuuuuauuauuguuuuuaacuauucuuguuuuuaaaauuuaaaaaaauugguuuggauucaguauaauuaguauaucaggucacuugcaccauuuuauuuuuuaacuucuuuuccuguagcccugcaggcgggcagggcuucuuucauguggacaaaaccagaaagguguugcaucacugauccacacacaaggugggcuccugccaacuggcagccuccuuguuccaggaaccagcccuccuuuugacacuugaaauguaaaaucagaauagaaguuuaacguaccugacuuaaaacaucuucaggggaugcuacgugacaauucuugaagaaggagaaacgagcuaccauuuuccuggaaacaauauuugauucacaguauuuuguuguuugguaguuaaugaggcuuguuuugauagaagaugaguguuuuucuaucgcuaauggggcauuuagagaaacauuccuuguaggaugagcucuguuuuaugaccucauugaaaaagagguaugaaaaagagguaaaucuuuaacauaggcaaaacagguaguguuucagaaauuuauguguaaauuaccgaguauauuuuucuccaguguuguaauggucauauucucagaucaccucaaaauaccuauuuaugcagucuguaauguagcauaauccagacuguuacuaacauuauguagcauaauguuaauaauaauaauuacguacauaauguuaauaauacacagacuccagccaucguggguaagauuuuuuuccaugggaaaauucauuuggaaagcuaacuuguaagacuagccagguaggcagccuagcccuggaggcagagcugcuccucaccuggaacugcagaaucugauugaacccagugguccauggggguugcugaauucguaaagcaaaugaaauguuagaagacccucuaauuguuguagagucacacuuuuccucuugcagaggagguacucacauuuuuuuuaagaaacaaucuuuaauuaucgauguauucuuuuagguuuagguuugcagacacuggugagcgugugcugagagguaacuugauguaucuuucuggauaauuagaugauuuuuuuuuucuauuucuuugaacauuuuuuuuuuaaagagcugcuuaagaucuggaggagugauuccuuuugaccgugucuuauuuucauuaagacuguauaacuuggaagaguuuuuuuuuuucuuuuucuuuuucuuuuuuuuuuaagaugaaguuuuugcucuuguugcccaggcuggaguacaguggugugaucuuggcucacugcaaccucugccuccuggguucaaacgauucuccugacucagcuucccgaguaauugggauuacagguguucaccaccacacccagcuaauuuuuguauuuuuaguagagacaggguuucaccauguuggccagguuaguuaauguuacucucugguuuggggggcagugauauguuuuggcuuuuuucccacccagaucucuucuugaauucccauguguuguggaagggacucggugggaggcaauugaaucaugggggcaagucuuucccaugcuguuccugugaagugaauaagucucacgagaucugaugguuuuaaaaagagggguuccccugcacaaguucucucucuuugccugcugccauacauguaagacaugacuugcuccuccuugccuuccaccgugauugugaggcuuccccagccauguggaacuguaaguccaguuaaaccucuuucuucuguaaauuacccagucucagguaugccuuuaucggcaacaugcaaaugaacuaauacagcucgggguggcuugugugggugcguauggccauguaugcaggugugcgugcauuggaauauacaauuccguauugaacccaguuuaaacuucaucaguucuggugauugcuggagugucacauauggcaagacgucaccuugcccucuaacuacaccagaaaaccaggccagcaccauugacuaucuagauacagugggccguuuauauuauuauuguuucauauuuuuagauuauuugguaaacaauuuacagaacuaagaauaaaggaauagugagaaauaacuauuagcaauuuuaauaagaguuaacauaguaaauauuuuaauuuuacgaagaauuuaaauaugguaaacccacauguuuauucuguauuuucccaguuuugaagguauggauuucugaaaugagcauuauccuuuggaaugcagcuagcugcuaaucaccugccaugcacgaaccugaaauauauccgucuuacaaauacugguucuacauuucaaauacaucucuauuagguucaucauauuucuuggucuuuuuuuuuuauacuugcaauuucauuuaauuauuguaaaaauuuaagauauuuaaaacauugacagcucauaauuuuauugaagagagaauauagccaucuucccucaggaauaaaauguuuucaaguuuggauuuguaaacagcuauuaaaaugaucaagccagucuuuuuuucccccuuuuuuucugcauuaucucuucuaaucaccuuagagagauuccugccuugggcauuuguccacuuccuaaugguaucaaauaaauguguugcacagacauaaaauguguugcauaagcaucauaaaauggcaaggaauacugucacaucauuuuagcaaugaugguuaauguuuuugucacauaauauugagugaugauauccuuccuguugaaugacuaaguggaugagaauaccauauuuccuuuuuauucuuagaaauacauugcucagccgggcgcaguagcucacgccuguaaucccagcacuuugggaggccgaggugggccgaucgccugagguugggaguucgagaccagccugaccaacauggagaaagcccaucccuacuaaaaauacaaaauuagcuaggcgugguggcgcaugccuguaaucccagcuacucgggaggcugaggcaggagaaucaauugaaccagggaggcagagguugcagugagccaagauugcaccaucacacuccagccugggcaauaagagcgaaacuccaccucaaaaaagaaagaaagaaagaaagaaauacauugcucacuugucaauucuugagcuugagaaaauucaucuaggauaucaugugaaggcucauagccuaagguuuuacuuacgugaucaauuucauucuucuucugguuuaucuaauugguaaaaugccuccuucugucaguuguuccuauuugccaauauguggaagaugauuuuugacuauauucagugagucuccagacuucuuuuuaucaugcuuuuuaaagagaugggaccucacucuguugcccagacuugagcgcaguggcuauucacuggugugaguauggugcauuacagcugcaaacuccugggcucaagugauccucaugccucaacaucccaaguagcugggacuaugcagacuuuuuuuaaaccaucuugaaagaugaugcaguacuuugggaacacagcaauaaaaaugugauaauuucccuauugcaucaccuuucuaggcaauuauaucauucuuucaugcucauauuauuuugucuucuuuagcacaguuuuuaaauaguugauggcuaaugaugaaauaauucuucggaugauaaauauuuuguaacauaggaacacaauauaggaaaaagaucgagguucauaccauaucucagacucaugguuaaguacaagcuagaaugaguuuuagucgauuaaauuucuuuuucucuaugaauggauaaagugagaauaucagcccacaaguaguuagaagugcucagaacucaaagguaaaauuguguccaagaccugaugguauucuaaagguuaacagccuauccuacuuaccaagaauuuacauuuauuaugaggccuguacaaccugaugcaggaaaauacuuggcauaauuuucuauaaguuagguaguuaggugcucaacaaguauuugaguugaaucacauuggcauucacaucaaacacauacaccuacgucaucauguuaacuuaagguuaauagugucaccaaaacuaacuggucuuuaaaaaagaaaaacuaggccaggcaugguggcucaugccuguaaucccagcacuuugggaggccgaggcuggcagaucucuugaugucaggaguucaagaccagccuggccaacauggaaaaacccccucucuacuaaaaauacaaaauagccaggcaugguggcaugugccuguaaucccagcuacuggggagacugccagagaaucgcuugaacccaggagguggagguugcagugagcugagaucgcaccacugcacuucagccugggcaacagagcaagacucugucucaaaaaaaaaagaaaagaaaagaaaagaaaaacuaaggaauaucauucuagacaugcaguaauuaaguaaaauugcaucaggagucuaauaacauagcaugaugggucccauguuucauuauuuccaugggcagaagagggauggcuacauuauaaauaaaggaaaauuguaagaauaagaaaagaugaaguaugaaauauuuccaacucaaaaacaaacuguaucugagcaugcagagguacaaaaugucaccuuuuuccuccaguguaaugaagggcacuaaaccucuugagcauuugauauguuccagauacuauauuaaagugauuuuuuuuuuuaggagacagguucuugcugucacacaugcuggagugcaguauugcaaccauagaucaguguaaccuugaacuccugggcucaagugauccuccugccucagccucccaaauggcuaagacuacaaacacauugccaccaugccugccuaauuuauuuugauuuauuuauuuuuuuuguagagacaggggucucacuauguugcccagacuguuuucaaacuccuggccucaagugauccuccugccugggccucccaaaguguugagauuacaggcaugagccaccacgccagaccaaggggugaaaucuugauaacaauaaucaaugcagucaucauaaaacgcuugcacaggcucaauuuguagguggcacagugcuacaucuagucaaaagcaaauuuaauuauggucauugugcucugagaacuuuucucagaaaauaauaaccagaugguauuauagauggugcauuucacaaauacaugauuuguaguuagugaaaacuugucauucaaucauguaauaaauuaugcacaugccggucuuccacuuagcuagugauguugaaacauucauagccuuaccugaugagcucaggcugucaugagaauuuaugucuauucaguacuuugucuuuaaaauuaggugagagagaaagagaggcuguauuugacuauauaucuuuuuauuuguaucucuggaguuacaaguuuuugaauauauaaucuuucagcugccuuucugcauugcauuuugagaaaugauauuaaaugcucaaggaaaaaaaaccuaacaacuuuagagggccgcaaagugaaucauacaaaagauaaauuaaagcuuuaaaucuuugccaguggaugagucaaguaagaguggauuuaaugaaauggcucauggcuuugagaagcagcugucauaaugcuggguuggcagcuuccaggacugugugaggcuuucugacugucuauacugaaauaggagaacucauuugaaaaugacgaauaggagaauagcagaaacuugcauuuucuuuugagggaacuggcugccaguuuugagguccuuauuuagaaaugcucgauuccuguauugaauaaacuuggacuacauguaugucaaaaagaaaagcaaaacacuuuuauagccuuaagcagauuacagauguguggccaaaccaguggggucuguuuuuguuuccaagcaggugauggcuggaagaggagaugccucuguagugcagggcuugaguugcugcugucugagcuacaucuggcaaugagacugugcugcuuacugagaccuaauggcacagguugccccaguaacaggauauugcugaaugagaaauacuguaggauucauuuguaagaguuauuuggaggguuggauuauucagugcuaaggauccuaagcuacugaugcauggacucuuuucuucccuccaguaucuuuuaauuaaacuguacaaauucccuggcuuaaaaauaguaggaaaagaggaagaaaauacagauucuuaugauuuuaacuggucucuggcaauaguacaccgaaacauuaauuucuuguugaaaccaucuggauauuuguaucuucaguguaaaaccccuaauuuagauaggacucuccauugugacauggaaaaauaacccuuuaauuaguuaauuaauuuuacuguggccucaaaaucuacauauuagcauaucaagccaaaaacuguuggcuuuacuugggagccauguggcuuaaacuaguaccaguaacuuaccacaaggaacucagcaaaauuauaaguccauguuuguuuuggaaggaaggcaauuauuacgaaaauaauuuagagauguucaaacuauuuccuuugaguagagguagagagugaacaaaaucugucccaagugggagcuaacuagcuuccuuuuuugcccucccuguuuacaaaguaacacuuuuaguuuacuagguaacauuugcaguauccccaguguuucaauguaaaauuguaggugguagacuaaugccacuuagccaaagccaugaucaccugaauuuuuaauauauauuuuuguauggagugagauacugggagaacagucuucauuagcuuaaacucuagaauguacuguuuguuuguuuguuuguuuguuuguuuugagauagagucucgcucugucacccaggcugcagugcaauggugcaaucucagcucacugcaaccuccccucccaaguucaagugguacuccugccucagucucccgaggauuacaggugccugcuuccacacucagcuuuuuuuuuuuuuuuuuaauggagacggagucucacucuguugcccaggcuggagugcaguggugugauuugggcucacugcaaccucugccucccagguucaagcgauucuccugccuuagccucccgagucgcugggauuacaggugccaaccaccaugccuggcuaauuuuuguauuuuuaguagagacgagguuucaccauguuggucaggcuggucucgaauuccugaccucaagugauccacuggccucggccucccaaagugcugggauuacaggcauaagcuaccaugcccagccaagaauguacaauauuuuuaaagaaaugcgguuuauuaccauaaaauacagguugagcaucccuaauccaaaaucugaaaugcccuaaaauccaaaauguuuugagcacugacaugacagcaaacguagaaaauuaugugacuuuauguguucaauguauacaaacuuccuuucugaaacaaaaauuauuuaaaauguuguauaaaauugccuucaggcuguguguauaagguauuuuugaaacauaaaugaauuuuauguuuauacuugggucccaucuccaacauaucuuauauguauggaaauaucccaaaauuugaaaaaaaucugaaaucugaaacacuucuggucccaggcaguuuggauaaggauuacucaaucuguaaauacaguagcucaaauugauuuuguaaggcagucaaguuauuauuuauaguauuuuaauuuguauuauucuuuuaauauagcaauucauuuuauauauuuauauaaauaaauuuuuugcaauugagcaaauuaaaaaaauuaagugcuuccuucagaucuacauuuuauuuucuauuuguuaucaauuuaauaaguaaaggacacacagaucaucugauuguguugucagacauuugaaggugcaacugaugaauguucacuguuguacuuuguuuugucauguaaauuguuuuaaagagaagugaauguugagcauauaguaggccacacgugccuguggauuggcucauuguuuuaggaauguguaauucuggaaaagauuugccaaggguauucaaaaguauaguuugauauuagaaauuauuugaaaauaaucuuuauagcauagcaccauuuuauuuagaucaauaguaauucaagcaguauacauaauuugcuauuguaagcguagcauauaaccuaaguuuucuuuuacauuugagaccacuguuugcuguuggucgaauuuggucuuccaagauuuuuugcuuagugaccuaauugccagccuuugugaagagcuguuacuuauugucaaaccaggcaguaaggguuugcuuuuaucuuuuuaucaguucuuucaaugcuaguagucaugagauuaauguaguuggauacuaaaauguuaauacguguuagauaacaaacugggaaagagaugaaugacaucaugaaggaaagggcaguauugcacuuacagugauuucaugaugauagaacuaaccugccuaaaaagacauuggguggaaacagaaaccagguguaauagacgcauccaaguagucaaggaaagaaaagacuuguaaguaaauaagauaaucuuugcuucaaaaauaucuucaaagguuuaaaaugugcuuuacccucauauauaaucuuuuugagccuauuucuuuaccucaaacauggggaaaauugcaauaaucuguaucacgguauuugcuuccaaaacgacuaauugguguaaaugcauaucaagccgguaaaguuuacaguggacuuguuuaaaaugcguagauuggaauuguugggggagcaggccagcagcaugggauguuuuuuuuguuuguuuguuuguuuaagacucugucgcccagacuggagugcaguggcacaaucucggcucacugcaaccuccgucuccugaguucaagcaauucuccuaccucagccucccaaguagcugggauuacgggugccugccaccacgcccagcuaguuuuuacauuuuuaguagagacaggguaucaccacguuggccagacuggucucgaacuccugaccucaggugauccgccugccucgggcucccaaagugcugggauuacaggcgugagacaccgcgccagcuggggugauuuuuuucuuagucaaaucacuucucuacccaucaucucacacugucgaauacaaagacucuccuuggggcucaaugacucaucucccaccucugguuugauaaucauggcuauuauaacauguucccuuuuuaauuaguuauuuuaaaauuauuguaggucuuguaaucauaaucaauaauaauacguaauggcuccuuaagcacuucuauccuagauaagguugagaacauuauuaaaauuaguuuugguaguaaucaaguaaugauaauucuuauuuaugaauuuaaauauguaggaguuuuuuuauuuuagggaagcaaaaaggacuagaaaguaugaugucucaugauuagaaaacugcuauaaaaaugaagguagaauugauuugggcuguuuuggacauuuuaaauagaaauuuaaauagguauucaaauagcaaagucauucuacuuuaaaacuucuauacuuuuuuaggaucuucaauuuuauauuuaaauuauauuuuugaaaugguuuuagaagaaauauuguaucuuaaacucuaacuacuaauaaguaagagaagauauaucaaagguuugaucuuuuaucuccuagaauauacuauucauucguuucccauuguacgucauuugaauguuaaugguuagccucaaaugguuuucaacauaauuguauagcuacuauuauuggaaaauuggagccaaggacucauacacauaucagaagugguaaugaagcacuuugguuuuaugaaaauauguuuacaagguagucacaggauagcaauauugcauuuacuguaauacaaugaugguggaacuaagugcaguggaacaggaugcugagaccacaguuaccgcaucucuaagugccucgucuaguuaugguccaaccucagauauaacucauugguguugaaacacaccuagcaacauuuuaagcauagaccguucauuaaaagguaccuuuuuaaaaauuuuuauuuuuaaaaauugacauguaauaauuguacacauuuacaggguacacagugaucagaucagacugaucagcauauucaucucaggcauguaucauuucuuuguguugggaaaauucaauauccugcuucuagcuguuugagauuaugucauauauuacuguuaacuguagucauccuacagugcuguagagcacuagaacuuauuccucuuaucuagcuguaauuugguauccuuuaacaaaucuuucucuauccucaguuucuaccuacccuucccagccuccaucauccucuguucuacucuuuacgucuaugaaaucaacauuuucuagcuucugcauaugagagcaugugguguuuaacuuucuguuuuuggcuuauuucacuuaacauauguccuccaguuccauccauguugcuucaaaugacaggauuuuauucuuuuguauggcuuaauaguauuucauuauacgugcaugcacgcacggacacacacacauacacacacacacacacaucacauuuucuucauccauuagucucuuuggacaucuagguuauuccauaucuuggcuauugugaguagugcugcaguaaauaugggagugcagauaccucuuuuaauauacugauuucucuuccuuuagauaaaugcccaguagugggauugcuggaucguaugguagcucuauuuuuaguuuuuugaggaaucuccauacuauccucaaaugguuguacuagaacagagcuuuuuuaccuuccuuccauuugggaaucuucuuacccaacauguauauuaguaacuuggcuauguauguuccauucucugucucaaauacugugucuaggacaucugcaaucuuuggcuaugaccacgacuguaaagugcaugacgcuuuugcucugucaucaguauuaguugacaggcaaguaagauaguacuucucuucauaaccccuuuaccugcccagcagaauaccaguacagacagacccagaauaucucugggcucaagaauccagacauuuauaggaugggacuuuuaucuauaaaucaccuuaagauuaguaaguucuuagaauugguuaccuuugccauuucucagaagcccuuugucuaguaaccugugugucacugucauuuccagccugucuuuccuacacauuguuuaugcaggcuuuaggagugcccaccccccaguucuaccccccacccccacccuagccuuugugguuuuaauuauccugucuuggcugauuuuguuuuguuuugacauuucauccauuaaauuccugacacuggcuaucucuuuacaauuauuauacuauuuuucuuucuggcucgcucuuccugauugcuguaauccaugcccuugacuuuaaauaccauuuguaaguagacuaggccaagguuuauuucucuaggccagacucuaccuaguuauuucauaggcauaugaauccuaacauguccaaaugagaguucuuaauuccccugcuacccaguccucaaugugguucucucaaagcuauucuaucucaguaaugguccuaugcccucuccuagggauuauugcugagaaccuagaacucaucaucgucucuucugcacauccuaugaauucuggauuuauccacuuaucuccaucuuuuccagcacuaaucuaaacucccauuguuucuugcuggaguuauuuccguauccugcuaaucucugcucucguucucucucccugacacaugcgcugcuuucuucucccacaccaagccauucucuguacagcagccaggauguagaguguuuauuuacauaaagcagauccuggaacccccaaauuuaaguuguguucguggcuuaccaauacgcuuaaaaaccaagugcacagagagaaaacaaugaagccuuauuuggauaugcugaggauaauugauaacggguaacaacuaacaaacacguaguuggugucagguuugaccuccuacauuccuuacagguauuaguguauuugacccagcuccucccuaccuccgcaguaucaccccaugccucucuuucccccgacucuccccugcucagugucacacaagucaauauccccagcuugcuaacccccgggcugacagaucucauugucuauaauggauguuccaaggucccaccuucagccucaguuuuguugccaucuuuccagaaugaauucccuugaucauucuguuuuuuggagacaagguccugcucugucaccuaggcuggagugcaguggcaugaucauggcucacuguagccuugaccucccuggcucuggagauccuccugaguagcugggacuacaggcugcaccuggcuaauuuuuuuuuaauuuuuaguggagacaagaucucacuuuguugcccaggcuugucucaaacuccugaacucaagcaguccucccaccuccgucucccagagugcuagaauuacaggcaugagccaccaugccuggcccugaucauucuuuucugaagaaaacaccccuucuucauuauucucaauccuagcagccuauuuacuuccauucugaaaugaaucacauuuuaguauuuuauugguucguugucguucucuccccccauagaauguaaucucucugaguacagggagcuuaucuuuuucccuuuuggagccucggauccagcagaaugccagacacuuagcagccacuagcauuugaugagugaauggcuuuucauacacaauuuuagacauuguuccugauuggucucucuagucaauaauagauuuaucaaaucuaaucgauaauagauuucuuuuucuuuucuuuuuuucuuuuucuuuuucuuuuuuuuuuugagaagucuugcucugucgcccaggcuggagugcaguggcaugaucuuggcucacugcaggcucugccucccagguucacgccauucuccugccucagccucccaaguaacugggacuauaggcgcccgccaccaugcccagcuauuuuuuguguuuuaguagagaugggguuucacuguguuagccaggauggucucgaucuccuguccucaagauccgcccgccucagccucccagagugcugggauuacaggccugagccaccgugccuggccgauaguagauuucuuuuauugauuagagagacuaaucagcaacaauguuuuaaaauucucacauagaucucugaaugggaaagcagucuugaauuaugcuugcagggagagagaggggaaggaaggaggaggaaugguauaauuagacuucauaaggcuagauuuuguuucuacuuaaauaaugguaucacagugggacauauuauccaugcagaaagugagugggcaucuggucuauuaucuguggucuuucaggaauggcagcucuuuaguuuaaaaaacaacaaagugcagcacuguuuauuuaauggaaauagaaaagcagugccuguguauuaguggcucagauuuuuuuguucuuuguuuucagcugucugcuguaugccucuccagcggggucuuacagaaucucaagucuaccaugaucaaagcugaacccauuagcuccauuucuuaauuccuccuguauccucuguuaccauuaguaacuauucuccaacucaaagcaucagauuccuccucuuacucacucccuucauccccagucaccaguucugugcuguuauuuuauccaaguucucaguaggcuucacgagcaccgccuucacaucccaacugucgcuccuccaccuaucuguccuccaugcuucugcuagcucauguuuguugcaauacaacuaaccuugccacucuucugcuucaggcuuuucuacuaggcucugcaucuagaugaugguccagacuccucagccugugaaacaaagcccuucauaaaagagcagagcuacagcuagucagcucccuuccugcaguccacccccuccuccaccauacugagaauuggcaauuccuguagcacucuuuguaugaguccauuuucacacugcuauaaagauauaaccaagacuggguaguuuauaaaggaaagagguuuaauugacucacaguucugcauggcugaggaggccucaggaaacuuacaaucauggcagaaggggaagcaaacacauccuucuucauaaggcggcaggaaagagaagagcgaggagcagagugggaacagccccuuauaaaacugucagaucuccugagaacucccucacugucacgagaacagcauggggaaaccacucccaugauccaauuccgucccaccaggucuuucucuagacacauggggauuaugaggauuacaauucaagaugagauuugagugaggacacagccaaaccauaucacucuucaucugcuacgggugccauucccuguuucuacaguguccuguuugcuaccuucuuuguagauuucuauucauucaucaugucccaguuuaccuguuaccucuucaacagauuauucuucagucugucccucccaaacuccaccaaugaacauucuuuguucagcccauuauuguuaauaugcacuucacugaaaacacuguuuuaugcuuguuuacaucccaucucugcagggcucugagccuauagucagcaguugggaacuuacuaggcauagcgcccaguaaaggauagcucuuuauauauauauauauauuuuuuuuuuuucuaaaauaauaagccccaagaaaaacauuaccugugaaaaacaaaugauauuuuuauaccauuuucaaaaccuaauagcaauaaaaagaaaagaaaugucauaaguauacauuuaagcuguaguuaaaaacaguaaauaggcacaguauuuaacucuuaucaugugcuguuccaaguguguuauuuacaucauuggcuguucacaccauccccugaggugguuaauauuuccaucccauguuaaagaugaggaaaccaagucacagcagccuaagugacauguucauagucacauuggagcuggcagguggcagcacugagaaugaaacccacguggcugagcucuggaaagucaccauuaaucaccacacuagaccuucucucuaggaucuacauaacuagaacauacaauuaacuggaguauauguaaguguagucguuccuugagaaaggaaaagaauucacaaauuucauagccucaucccuugugcauuuguggcauugugcuaggggugucuauuugauauuugacccuacagauuucucagaugccaaccaaccacagauacuuuaaaaaaagauacuuaauacuuaccaaugcaagaaagugggcuuguuggaagaggaaaaauguuagcucacuaauggaaaaucaacuaaaagucuuaccucuccagaacaugcuuuuccuaaauguuguggcuaacccaagaagcuacaucaucuuuaccuuuaugauacaauuuaaaguacuuuucuacuuacuucaagcccucagagcacagaggcaagggaggccuugggcuauaaacccuguagccugagccacauggcuucuucuccuggacagauaccuggcauauucugccacugaggaucaguggugcagauguaucuguuuucuccuaggaauggggcuccacuuacgaaucuggggcaggacaagguauugcugcauuuuggggagcgugcuggaaggaggagcagaguuuguuguuuuugcuuccugauauggacuggcugugucuccauucaaauaucaacuucaauuauaucucccagaauucccacauguuguggagggacccaggggagguaauugauucaugggggcugaucuucucuguacuauucuugcgauaaugaauaagucucacaagaucucauggguuuaucagggguuucugcuuuugcuucuuccucauuuuucucuugccuuuuccucauuuuucucuugccgccaccauguaagaaaugccuuucaccucccgccaugauucugaggccuccccagccauguggaacuguaagucccauuaaaccucuuuuucuccccaaucuuggguaugucuuuaucagcagcaugaaaacagacugauacacuuccuuaacagaaccaauuauuuuuucccaaaaaagagggggagaagcccagaagcaugcagcuucucucuucuuucuaaggaauaggucuucacaaagugcccccaaaagaaaaggaccaggcuuuucucuuacuuugugacuuuccuagguugcuuuguagccauuuuggacacagaccaccuauagcuguguaguaguucucauguguauggacacaguggaaggagaugccaggcacauaguucuugcugcauugacaccuuuucagggcaucuucuuuuaccaucuucuguagaaacugcaacagcccggccaacuaccagccccagcccaccccuagcuuugcugcuuucauuuucucuguaacacuugucaccuuguaaugugcuaguguaacaucguuguuuuaguuuucuuauaucuuuccuucccuguagaauguaaauaccaggaaggcagggaauuuugucugcuuuauucucugcagcaucccuagacuccagagcagacccuggaacucaaauauuuguuagacagccaaaggucauauacuuccaacucuccacccaaaauauauauggaucacccauccuuaguagcagcuaaaccuuuggacaugaggaauuugcucguucacaguuuucuggccuagcaucugauuaaccaaacuuuuucacauaucaagaauuuaaaaugacuccaaaacuuuuuaugaccuuaggugcuucuccuuaauucuaguugguucauaaagcugucagaacaauaaucugcuuuugauaauauaugacuuuucuugccuccaagauagccuuuaaaaaagcaauuuagccuuuuacuguaauuauauuccaaauuuaagucuugccagaauaucauuuucccccuuuaaacauacuuuuuaugaugccaagauauuuuaaagaaaaguucagauaggaagcauauuuaagaugucaguauaugucucuaaaaucuaagaacauuuuucuacagaguccagaugauaccaucucacccacaaaauuaacauaaauuuuuaguaccauuggauaccauguccauauucagauucucccugaguuccagaaagguccuucacagguuaugcauuucacauccuauccggcaccagggccagcaucuuacauccuuaauucuuaggauucagaauagcacuuuuuauauccugacacugacuugcugaagaagcuguaccaguuuuccuauaaacuguccacuccuuggauuugucuuauaucaugucccagggguauuguuuagauuguugcucuauugcuaggauauucauguuacccuaaguguguacugagauagcagaguaaagagagauugucuuuuaaagguucugcccaggaacugcugguuuacacaaaagcugggcuuuagugcuucucggaucucuuugcuuguuucaguaauuuuuuuuuagaaauucacuaauucacuaacguaaguggggcaggguuuacaggagcauguguugagagaaguugguuugacuuuaaauggucauuuuuacaauccguauuuaggccuuacaggucgcauacaaucucugucacauauugcugucauuuuuacccccuuucuuuucuuuuuauaauccuuuaaaaaaugcaaagcccacccuuagcucacaggauguacaagaacaaguugcggguugcaguuugccaagaccugcucugugccacugcugacuugccauucuuggagcccacuuucuguucuugucagccaauucccuuucaggugcucagguuucccucccuccugucaccgggccuuugcacaugcucuacccacccugccuaguggagagcuaucuuuggccccuggacuucauucacuucggaccuucuuugggucacauuucagucaugccucacuagacaccuggaaucucugccucacuagacacacuagcacucacucuuuugggucuucuggcuguauguaauuguuaucagggcaguaauuuugcauuuauacaggugcugaggucagugucuggccuuuggcuacuugccuugugagccaccuuugcuuuccaguguaccccuagcuccuggcccaguguccagcuucccagcauccauucauguuuucccuggagaccauucugugcccagcagccagagacaucauugcaacuuaaaucucauugagucguuccaguugcuguaagaaauguaaccguacuggguaacacuaugccugucugucuccaccaccagaucuuauacuuccucccucaucugcuacucccuaagcucacuggcccuuuguuguuuuugcugaacgugcuaaucucuuccucacaccugggccuuugcacuugcucuuaccccugccucagccauccaugcacucucuugguuuugccgugcccgacuucagcauuuuuaguucacauggcucuuccguggggcccuucccugaccacccuguuugaaaugcuacccaucccuggcacacaucuaucauagucauucauuagcaauuagccccaucuccuuucccuauaguacuuuuccauaauuuuuuuucuugcucauauuacaccuccccaacuaauagauagauuccaagaaauugagugcuuuaucuucacuaccuggaauaguacuggcacuugguaaagcacagcgaauauuguugauugaauuacuagggguuggcuuagagagguacuuaauggaaugauucaauggaugaaugaaugaaugcauugccacuuuuuugcucauuaucaucaauuuguacauaugccuuucaacucaaauauuuauccauuggcuaaagaaaaaaaauaccugaauccccgugucucugcaguuuacccuuccucacuguuaaaacucagugccuguguaaaauuucauuauauuuuauuuacuucuuauuccacuugugcauuauguggauauuccugccucauccccacagccaccuaucacuuccggccaacucagaugccucuggucgcaacaaucacuucucuguugaauuucugaagcguuuaaucugcaguaugucuguuacucauacagcaguuagugugaauugucucacucagaauaaguauucauuaaauguguaagaaugaugauauagccuaauuucagaucaagauugugauuuauagcucauucuuaaucagcugugucaugacuuuauuuauuuauuccuuuuuuuuuuuuuuuugagacagagucucacucugucacccaggcuggagugcaaugcagcuucugccuccugaguucaagugauucucaugccucagccucccaaguagcugggauuacaggcgugcacccccacguccagcuaauuuuuuguauuuuuaguagagacggaauuucacuauguuggccaggcuggucucgaacuccuggccccaagugaucugccugccucggccccgcaacgugcugggauuacaggcaugagccaccuccucaggccugagucaugaauuuuugguaguccagucaugugguuaucuuccuaaagcuggaggccuuaaaccuagggccccaggugggcuuaugccuuuagcugcaaguaacaagaaacccuuuucaaccuuuuuacugauuuauuuagagagaaguacacauaagagguaaugcaaguaagcaaaguuuuuuaagaccacacaacuagauagccagcauccggaccagaacacagagacuugcuggccccuagaauccucucuccuggccccugccaguuacuggccuuuccccugaguucuauuugccugcaguuugcuuguuuucauauuuaauucaaauagaauuaggugauguguccccuuguguuucgcuucuaacagugccuuuaugcgggagaaguacuggcuauuucuuacuuugcccucccuccccggaaacauuuuccuaauuuaguagcaguaauuucaaaaacugcuuuccuuucggacaaacugacuuauccagccauuguaccuuccaguuuagacucuggcaguuuggagaguugagacagagagaaggagaaccgucuguuuaucuucuugaaaaaaacuacuguauuuucucucucuucugacucugggagccucuagacucuuuuuucccauuuucauauccacagaggaagagucugaaccucuuccugcugagcuuuccccugguugguugcauuucaggaacugacauugguugucuucccucuucccucaucagugcaaguagguuggaucucaugauaguccauauucacauaaccaugagaaucagagcuuucucucugucauuuccucccuguuuaucuguagcaagaagaaaaaaguccgucuuaacagagacugugaaagaauaaauauagacuuuauuguuuuagagcaguuuuagguucacagcaaaauuaggcagaagguacugagauucucccauauacucccuguucauacacuugcacagccucucccauuaucagcgucccccuuagagcgauuuguuacaaucagugaaccuacacugacaccauuauuaucacccaaaguccauaguuuacauuagcauucucucagcauuguuuauucugugaguuuggaaaacugucuaaugacauguacccaccauuguagugucauacugaguacuuuuacuaucccccaaauccucuguguuccuccuguucgacccucucuugccuuuaaccuuuccaagccacugaucuguuacugucuauaauuuugccauuucuagaaugucauauggcuuucuuagaaaauacaaauggugacuuuuuuggcaugacuuuaauaaacagaaaugaaaauuggugugugaaucaaaaucuuucacucuguaaagggacuuaucaggcggcaccugcauguggaauuauaucaaggucagcuuuaguuagaaacagaaggagagucaccuuugugaugucauuucuccuucauccaaguaaaaucucgcaugcugacacauaaaauuuuaucaucagugauuuauuuccucguaggaaugucccuuugaccuuauuaaauucagauacucuggggauggucagcauuuucagaugguucccuuguucuguaaaaauguuuguuauugguguuuaaaagcuguaaaagccacccacuauaaauugauagccacuaaagucugcgaaugugguaugaauguuccacuauguugccaagcguuuauuuuauugugaguuguuauuugauuguuuguaaggaaauuguuuuaugaugcucagcuuuauauuuccauaaacuguuccucccuugcaacuccuuaaacugugaugagcuuuucaaaacaaguccacaggacaacagucuguccagcauuugaagaagugguggaaaagucauuuuuuuccuuucaguguuucuagcuguucaugaaaacugcaguuaaaaguuguaauguuguuguguuuggcauucuuugggaagaugcagcauuauucaaacaaaaccgugugcucuuguuuuaaauaguguccaaaugaauaauugaauucauggacaucuaaauuuaauuccagaaaucaaagcuaugguaauaagaacuuggaccugaguucucuuaggccaaguaauuuaauuccuuagccgguugaacuauuuauuacgugucuccguuccugguuauuaugccaguaaauugcucaggcagaugcagggauggaugaugggcauauaauucacucuuuuucacggcuagacacauaccagaaugcagaucacacuaaacagcuguuuuuacaaacaugguuucuauucagagcuuuaagggccacauccaaguaauaacaaagaagccuggagaaggaaccuggggauacccagggucauguuuucaccaucccaccuggaaacacggugcuguccaaacccuggaugguacacuuggacaucgucauuccagucaugguucaagaucacguguauacaucaugauuuaaagagaauacugguuugauuuuucuuccugacuuucccugaauuuuccacuuaaauuggaaaacagcgcuaguuagugcccaugauuugauugaauaaguaagagaucucaaacacgguaaauuaacugaugacaugcaucaggucaucuuucuuugauucaccaguaauacaacagugagauccuacagaaaaaugcaaaggcagaagcucagggcagcugagcaacuguuaaggauucuuuugaaauguagccccacguaguaaacuuucgugcaauaauuugggcagucaaaaaaaaaagucaguuauuucaccucauuuauuucuacgaggagauaaaggcuuccaacaucugauuuucagugccaguguuuucuguuucucuuuucaccuauuucguccuagucuuguggaaauguuacaauaacugauuaggauuuucucuguauuaacacuucauuuauuaacauaugaguaaguugcuauuaauaaauuauucugcuuaaucaguuucuuuuuauucuuuagccacaugcuaaacuucuucggaugucuucacuuaauauccuuacaucauauuuaaucagaguuagaaaggcguuccacuugggggucauacacauuuuuuugaaacuuuuauaaacgcccuuuauacuauucuuguauccuacguaaucagagucagguguuccauggggaucauacacaucuuuauacaacuuguguaacacaugcuuuaaauccugagguaaucagagaauuccugccauugauggauuaaucucuuuacauaucuuucccuuucacucucagcaaaacuacuuauggcgguccuguuagacuuugaaagccuuucagguuuauggaggagucuuccuuucuauugucguagaucauggaaucauaguguucgcuugucucacguguuuggaaucugauuuccuacauaaugcugugcucucacuacgaguccaaggcuuccuguggcuacaaaucccggguuccuaucacuuuucccaaugaugagcuucuccuuguuggccagaaucagcucugugguaauaauucccuucugcuuucucccucucgcuuuuuuuuuuccuucuggguacauuauaaugucagcauagcagcuuuuaauucuauuacuaugguacuucucgaauagaccugugguaguugccccagaaagguugaaacccccugccacaucuaggucuuucuccuguauugguuuugugaucugaucaaggacaucuauuccucuaguccugcuaggugguauacgauaggcuuuuacuauuagauauucaaaugcugucaaccaugccugccuugacagguacaugauuuccacaaggauuuccuaauaggccuuuuuaauuuuguucuagacaugcccuucuuuugccauccaaauuugcuuauuuuuuacaaacuaugaugcaucagcauguaaauguuuaauaccauaaauauuucugauccucuucccaauuucacugaguuacugguuaucucuugccauuauucucagcauauugcaguggaucucagaauauuuuccccugaccaccagcaucaguauuaccugggaauuugaaaugcacauucucaggccccaccaaggccucaugauucagaaacucuggagcugcauuagaaacugccacaggcaccuggugaucuguguugguuuuuguuuguuuuuaaggagacagugucuuugucucccuggcuggaaugcagugaugcagucauagcucacagcagccucgaacuccugggcucaagcaauccucccgccccagccuucugaguagcuggaacuacaggugcacaccaccaugccuggcugguuuuuguuuguuuuuaaggaggcagugucuuugucucccuagcuggaaugcagugaugcagucauagcucacagcagccucgaacuccugggcucaagcaauccucccgccccagccuucugaguagcuggaacuacaggugcacaccaccaugccuggcuuuuuuuuuuuuuuuuuuuuaauuuuuuuggagacagggucucaccguguggcccaggcuggucucaaacuccuggccucuagguuuuuucccaccucagccuuccacagugcugggauuacaggcaugagccaccacauuuagcagguaggugaucuguguuucaauaagccuuccaggugauucugaugcucacugaaauuugagaaccacugaaauauuugguuuucuacaaaacauaagcaguuaguaaccauaggguacgcaacuaaauaguuccagcaggcaucccugaccacagggcauugcagauuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucaguuucaucuuccaccugugugaguuccagcaggcaucccugaccacagggcauugcagguuuacuuaagucagcuucaucuuccaccuguguguccaguuuaagcucucaguugcaguuuuuaaaccaauuuccaccagcauauacugaguauccgcuaccgugcaaugcguugcggcucuuguaugugcacuaugagaaguaauucccauaauacggcaaacucaguuuugauauccaccaccccacuuuuuauaauggacuacauuuuucagagcaguuuuagguuuacaaagaauucaagcagaaacuacaaaaaguucccucuaccucucacuuccccacuccccaacaguuuccccuggauuaacauuuugccuuaguaugguacguuugaaccaauaucgauacacuauuauuaaccaguauuccuguuuuaacaugagaggcgacuuuuuguguaguauagucucuugguuuugacaaaugcuuaaugcuguguaucuauuauuacuuaugacaguaucgugcagaguaguuucuaaaaauccucucuacuccaccuauucaucccuuccccacucccccugaaccacuggcaaccgcugaucuuuuuauugucuccguaauuuucccuuuuccagaauguccugugguuagacucauggcauccccuuuuagcaacugcagaaacuaagaacuguccccaaggauaaaaauuuuugcagacccacugagcugggauuuauacuuagaccugcugaauugaaguuuuggguguguuucuucucaaauugccaaaauuccauauggacgacuuuucuuuuccuucccugaaauguguuuaauugacuuuuucuguuauuuguguuugccuucacagugaagacaaaguaguagaaguagcagaggaggaagaaguggcugagguggaagaagaagaagccgaugaugacgaggacgaugaggauggugaugagguagaggaagaggcugaggaacccuacgaagaagccacagagagaaccaccagcauugccaccaccaccaccaccaccacagagucuguggaagaggugguucgagguaauccaccauuugcuuggauuccccccacccccaaggaaaagaaagcguaauaccagaguuggaaauauccacccuagcaccacugccuuccccaaucaaaaacauguuuuuuuuuccaaaaggcuucuuaugcuugugaaauuuuuuugguuuaacaagcaaacaauuucaaauaaugugaaaucuuuauuauacaguuuguuuuguaccuuguauaugcugcuuggcaaaucccaaguuaauucuacaagacuccgcccaaccagguagucaucuaauuugacaaacacugaguuaggugacuccuugguauuccuuuggcagugaguguuuguuauauaauauugucuguuaccaccuagacgaugagcuccuugaggguaaggacuugauuuuauucaguauugcacagagugccuggcuuguaguuucgauaaaucuuaguugagugaguaguugugauuagauuucauuaaagaaggagauuugggccaggcacagugccucacaccuguaaucccagcacuuugggaggccgaggcaggcggaucaccugaggccaggaguucaagaccagucuggccaacauggugaaaacccaucucuacuaaaaauacaaaaaugagccaggcgugguggcacgcaccuguaaucccagcuauuugggaggcugagacaggagaauugcuugaacccaggaggcggagguugcagugagcugagaucacaccauugcacuccagccugggugacagagcaagauugucucaaaaaaaaaaaaaaaaaaaaagauuuggugaguaucgcauuauuuuaugcuaugaauuuuaacagaggugauuuauguugaguuuacauuguuuuauugggaaguacggcagugcuuucuucaagaaguaaauauaguauuaaugucuuagacuuucucuauugaauuaauguuuguguugcaaauauugugaacuaaaagaacuaaaggucauacuugucuccaugaaauaaaaacaaacauucaguugauauuaaaugaccaaauguuacagaaacgaguaaacuguuggauugaguuccuuaaagaguaugcauuuguuccuuaaagaguucugcauuucauaucugccaucugcuuggcagauaguaaaagaugcuucuagagcuagauugaaugaauauguacuugacugaauuuuaauguacugcaaauacuuauaaaggucaaccacaaauguuacagcauuuacaaaaaguggcuuucucucacuuuuugcuaaaguuuaaugauuucagauuuauuguucuauuagagcuuaacaugggcuauuuugucucccucaacuauauucauaguugucacuauaguauuuucuucccuuuguugcauuuuuuaccuuauuaagguguaauuuacauauaaguuucauuugcuuuuaaguauauaauucagcggcuuuaagaaauuugccaagcugugcaacuaucaccauaaucuaaucuuagaacauuuucgucacuccaguaagaucacacauacucacucccaguuaagcccucuacucaccucuagccccaagcaacaacuaaucuacuuucugucucuauagauuugcccuuuuuuggacuguuauuauaagugggaucauauaauacauggucuuuuguguccgacuucuuucacuuaacacaguauuuuugagguucuacauuucuuuaacuugagcuuuuaaaauugagauuauucugaauuaaacacucagcguuagcuuaaaauuuauugaaaguuuuacauguucuuugaaaaaaaagaacagagugcaagauggauuaaguuuaucauucccuacuuaaugacaguuucuuacucacuuuagcacauaaguaaaugugcuaguaaaugcgcauuuuguuuaaaccaccauuuuucaaauacugagacaugcuuucucaggguguuuuucauacaacuguuaggaccaacuauggcagaucuggucaaaugaacuuguuagccugaugccuguagcagggaaggacagcuuuucagggcuucucuucucgaaaccuaaaugaagugugaauacaaauuacagcagcuagcagccugcagugggacugaaaguccuuggugaaucuccaucaagcugggcuguuuaauagaaccaguuuagugucccauuuuacuugaaacauuagauuuugagcaccugcuugguacaagccauuuugcuaggccauguggaauggaugaugagcacacacagaccagcuaacccuaguggauguuaaaaucucuuaggaaauagaagucaaagaaguacaaagccaucuguguuguaagaaaugugaacacagaaccugccuccgagaguaagagggaacuucuggauugaucagagaagguuccauggagagcaugacauuugaacuagagccaaaaguguggguggguggugugucuaccaguggauuuugcuguagagucaucaggacuagcaaaacaaauguggugccauggaaaggcauauuuaggagacaggauugguccaauuuaagcuagagcagaugucuuuuagguugggaccaaaauauagagaccuucaaugccaggcuggcaaagaugggcauuaacugcaggugauuaauuaacaaauauuaauucagaagcuacugugcgcugcagauuuuuccaggagacaauaaagagauuuuguuuugaugcuaguacuguugagguaacaggugaacaaggagugacaucaguuaugcaguacaaugagaggaugccacauaaacuuaggcccauauucuagaacaagacaauuugcuugagauaaauuggucucauuaucgucugcauuaguccaguucuuuuugcuugaguuuugcagguaguauuauuugauauuaagacggaacacagagauguuguauuguuuuauuuccuguagaaagacgaaggcaguuaaaagaauuucauaaacaaaacacuccaggcuaaaggcaaaaaagaaaugaaccuuaaaaaauaacaaguuaauaauuuuguuggcaagaagagcaacaaaagcaaccuucugaaagcaagauaccuggucauugagagauagcaacuguuaaugccccagaaauagaggaaucuuuaaugcagguccauucauuccaccucaaacuccugaacaaaagcucuaauugaggcaagucuuccugggaaagggggccuaacagaaacauguuauggucaguugugcccaugcgagauaauuuuuuugugcuuguagcuaauuccaguaaagaaguagauguuuuagaggguaacguuaaaggggucagcugcaaagaguccuuuuccuccuccucacuguuacaaaaggugacuugugguucuucccuaauugagagcaauggcaacgccauaggugauuacucauuuuguaaaacucuaauuacaaguagguugcuucuguguucaacauaaaaauuagaagugacuugcaaagaugagauacugcagggaggcuuacaaucuuguuuucaguguuaguguuucaguaccuggaacaaaaugugauuuacagccauccuuucuaagaaaauugucaucauuaccaacauauugcuacugauaccaguccuuaaugugcuucauaaaaaacucaauaauuucauaacccguuaaaaccggaaagaaauggagggaagaaaaauaagacacuuuuagcguagucauaaucuucucugccauauuguguuagaaucgaugauacccaaaugagaagaugucuguucucugucacugauuccaguagaauaaaauuauuguuuaaaaguaagcacauucgcugcacuccagccugggcaacagagugggacccugucucaaaaaaauaaaaauaaaagugagcacacgauugcaagaucuaucugguuuugggggcuuauugucaucuuugguuguuaaaaaaauacuuggauauuauugguuauuggucuaguggaauaagccauuaccgauuugaguacaacagugguguauuuagauacuugcuccuaauuuucuguucuucaagaagggauuguacuucagaaaccagagauaucaggguaguuuugauugagccauaaauucuaaauucugauugaaauggguauuguaauaaauggcauaaucuuuuauuuaaucuagccaauugugcccuguccagaggaacuggacauuucuuccuuauguuccauuuauucagcaacuauucguuguaccccugcugauggcuaggcucuuugcuacuguggaaggcaucguuggggcagagcagacagcauuuuaccuccugggagacuggcagauuuuugaagccuuuguugcagauauagauuuucacggucaccacucuugcccuuuaauguaauuuaaauuuuuuuuuuuuuuuuuuugacacgggauuuugcuauguuuccuaggcuggauucaaacuccugaguucaaaccucagccucccaaguagccgggaaaacaggccucuugugcuuuaaagcagugauucucugucuuuaaaccuuguaacuaugcugugugguggaaauuuuacuuccccguuuaaagccaagaucucuaaggccaagaauuuuuuuuuuuuuuuuuuuugagauacagucucgcucugucacccaggcuggaguguaguggugcgaucuuggcucacugcaagcucggccucccggguucacaccauucucccgcuucagccucccgaguagcugggacuacaggugccugccacgaugcccggcuaauuuuuuuguauuuuuaguagagucaggguuucaccauguuagccaggauggucucgauuuccugaccucaugaucugcccaccuuggcggcaccccccgccccccgccccccgccccccacaaagugcugggaauacaggccaccaugcguggccgaaaaaaauuuuuuuaauuggccugggcugggcgcaauggcucaugccuauaaucccagcaccuugggaggccgaggcaggcggauaacgaggucaggagauuaaggccauccuggcuaacacggugaaaccccaucuguacuaaagauacaaaaauuagccaggugugguggcaugcgccuguaauccuagcuacacaggaggcugaggcaggagaaucgcuugaaccuaggaggcggagguugcagugagcugagauugugccacugcacuccagccugggcaacagagcgaaacuucgucucaaaaaaagaauaaaauaaauuguccugggucacauaacugguuaagugaugaaaucagaauuuggaccuagauaggccaggauauuucugcuacacucaugucaaaauuacacuuuuuauuuucuuuauaaauacacacaaauucauuucaaccuguguucccuuguaaaugcauauaccuuugauauaggcauauauucaucuauuauuuuacacugugcauuucugaauuuuuagaauuuuuacuugaagugaucaggcuggcgcuguggcucacgccuguaaucccagcacuuugggaggcugaggugagcagaucaccugaggucaggaguuagagaccagccuggccaacauggugaaaccccgucuucacuaaaaauacaaaaaaauuagcuaggcaugguggcgcgugcccauaaucccagcuacucagguggccaaggcaggggaauugcuuggaccugggaugcggagguugcagugagcugagauugcgccacugcacuccagccuggcgacaagagcgagacuccgucucaaaaaaaaaaaauagaaaaaugaucggggguccacaaauaagaguaaugaucaagggucagcaaauuggggccaaaaauagccuguuuuccuguuuucuacacaaaaguuuuauuaggcacagcccaucccauuuguuuaaaaauugucuauggauguuuucauguuuuggaaguagaguugaggaucgcaaaagagauuguuuugccugcaaaacugaaaacauuuacuaucuggccuuuucaguaaaccauuugcuaaccccugauucucacuauaagacggugacugugaaguucuuucuauuucacauacugccauaucaaguugauuucuuuugagguaggguuuguuuuuuuuugguuagagauagacuaguauaguguuugagagaauuuuuaugaccuugggccaguuaaguaaccuguuuuuuauguguguaguguagaugguaauguuaucuugcauguuucuuguaagaaugacuuuagguaacuuauguuaaacgcuuaccaucaugcccaguaaguguucaauuuacaaacucaagcuguccagauucaaaucuuugccuuacaagcuacuaacuguguaaauuuguauaaaucaaauaaccuugaauccucauugcuucuuuuuguaaaauagggauuaauaagaccuauccaauauuuaacuauuuugugaggauuaaauuaauuaauuuauaggaaacacuuugcauaauuccugguauacaguaacugcucaauuaaccuuaguugcucucuuaguuaugguuauaucaucauuccgauccuccauugcauuugaaacauuagcaaacuaauguuuacuacuaaugaggaauguuaaagguaaaccaauaaguugacuuuuaauuauaaaaggcauaaauguaaccuauccauaucuauugguauaauaaagcugauauuuagagagaacauuauguuaugauuaaaagaaacauuucuugcuuaaauuuuuuuugugugaauauacacuguauauugaaauaucugcacuuaaauuuuaaauccagcugaaaauuggauaagauaguauuagaugccacugcauuucaagauagaguuuuauuucuugcagguauuuuaagccuugugggaguucuucuguuaagugaacagauagagacacugauacagauggcucuuucaccgucucaugugaugauaaaagcuaaaagguuugauccgaauauugcuuauauugggcuaagugauugaccuuggcagaauuaaauuauuuuucuucuucuggugacaauuaaucugggagaaguaccauuugauuuauugcuauacauuucaccaauauccacaaggcacuuguagguaccagacauggcauugguugcugggggcacagagauaggaacaaaguggcuugcucagguugcuucuagccauaucugcauuguccuugagagggaugagucucucaggccugccuaggaaggaauuuuggcagcauggagaagagaaagugcucagcccggaacaaaaguuuucaccuacuauguugcagagaaguuggcguaucaguaauuauaaaggaagaauagggauuuacugggugauagagcaccaaauagaaugaaugcaauacauacuugaaguaaaucagaguagcuuguauugaucucaaggggagaagaaacaaagcuuagcuuaauucucaugccucuguuguuacuuguuuguaauggacaugacacuuacaagguauccuauaauucacuaacgggauuuuuacuuaugauuaauauuuaacucuccacaaagcuugggguaaacugugaacuuaacuugcugugaacccgaacaugaacucacauacuucaguuggaggccucaguaguagcaugcuguacaaaaaugaaacuaaagcuccagggaguauuugggaacagggcaaaaggguaauggcuccuccuuauagagcaagccucaggccuuuaccuuuguguuuugaagauggagaggaugcacuucuacucucgcccggguuguagcaugcuugcuaaugaugucaagagaacuagugucagcacugaccauagaugugacagguaacagccuguuauuuugugccccaugucauggcagccauugauuccgagguguuugauacacacuuugauagaggcagagugaagcaggacauggacaagcaucuuuccguguaguuuaauggucucaaucuagaaagcccacucagauaauuagguugcuuaaaaugugaugagacuagggaauagagccauauagaagugugugugagagagaauucagugguuuaguauauucacaaagauacacauuugacaccagccugggcaacauagugagaaccuggcuuuaccaauuaaaaaaaaauagaauagcagaaguaaucagugaaaggcauuuuaauacaauuauaucuagauuuauuaaaaauaaaauuuuaguccaauuuaauuaaaggccagaaacuagauuuuuaaagaauauuagucuuucucauauuuuccccaaaucaguugcuuuaaaaaaaaaaaagugugcagaugccucaggcacaauaacuguacucaacucaagaauuugcaauuaagaaaaaaaaaaaucaaaccucaaagaagaaauccagcaacucagagguucagguucauuuaaacaugcauacauuuacaugggcacacuuuuuuuguuuuguuuuguuuuuaagauggaguuuuuguuugucgcccaggcuggagugcaauggcgcgaucucggcucacugcaaccucugccucccggguucaagugagucuccucucucagccuccugaguagcugggauuacaggcgcacacaaccgcgccuggcuaacuguuguauuuuuaguagagacagguuuucaccauguuggccaggcuggucuugaacuccugaccucaggugauccaccugccuuggccuccuaaagugcuagcauuacaggugugagccacugcaccagcugggugcaccuuuuuguuuguuuguuuuguuuuguuuuguuuuguuuuguuuuguuuuguugacauggagucucagucacccaggcugggauucaguggcacgaucuuggcucacugcaaccuccgucucccagguucaagcaauucucaauucuccugccucagcuucccaaguagcugggacuacaggugugugcaaccacaccuggcuaauuuuuguauuuuugguagagauggguuucaccacguuggccagacuggucucgaacuucugaccucaggugauucacccaccuuggccucccaaagugcuggguuacugguuugagccaccacacccaaccgggcacacguuuuuagccaagccauaggucugauuaaguacagucagauuccuugagcagguuacaaagcuguggauuugaauggagaucuuuaguucccuugcagaacaaugaguuuccaaaagcagaguggcuuacagccuaaccagcugcuucucucagccuuuaaccauuuugcccuccugaaaauucaucuuugguuuccaaccaccucuuccaauaugccugacuuuuugugauucuguuaguagaagaguaaaaagucaaggggaggcaagaaugaaugaaucucauauaaaaaugaugcucaagagaaucccuuaauuuucaagacagcagcccaaauuguaaacauugagacuuuuacaguguuaaaaaaaaaaaaguguuuacaggccaggcaugguaucucacaccuguuaucccagcacuuugggaagcugaggcaggaugaucgccugaccccaggaguuugcaagcagccugggccccauagggagaccaaaaaaaaaaauuguuguuuuggcuguagugucacaggcuuauagucccagcuacucaggaggcugaggugggagggucgcuggagcccaggugaggucaagccugcagugagccgugaucacaccaccacacuccagccuuggugacagugagacccuguccaaaaaaaaaaaagauuaaggcagaggaaauguuaaagguuacgcuauauuuaguugauaauaaugguaagacuguucagguguuuuaacuaugagaguaggguugccucuuucuuaaauuuauauauguucuuauuggguauaauuucuagacagaauaugcaaguaucacagaauauggauggcaauuuuauguugcuugcacgugacuuuagguucuuauguuucaugauaggagcaaagaaaagucuugcuugccaauucuuaugauugcaucuguucuggaaauuuacuagcauuuguuacccaggauuucugaagugcuggugacugcugcccaguagucuuggugggcaaaguuacuaaaaugcaucacgaauccuucugguguuugcuugggcuauggcaggguuucuggaccuuaguacuauugauguuuugggccagauaauuguugcggaugauuguccugugcauuguaggauguuuagcugcaucacuagccucuacucgaugccagcagcacccccaagugaugacaaucaaaaauguccccugggaggaguaggggauagacucucucugguugcaaaacacugggcuaugguguugagaucugcagugaugagcagcuuuagauaugugaacagaagcccaggcgugguggcucacacuuguaaccccagcacuuugggaggcugaggugggcggauuacuugagaucaggaguuugaggccaaccuggccaacauggugaaaccccgucucuacuaaaaauauaaaaauuagccgggcaugaugaugggugccuauaaucccagcuacuugggaggcugaggcaaagaaaucacuugaaccugggagguugagguugcagugagcugagaucgugccauugcacuccagucucggcagacagacugagaugccgucucaaaaauaaauaaauaaaaauaaaaaagugaacagagaaauacccgugcaauacugugucucaucccccaaagacggagucuugcugucgcccaggcuggagugcagugacacgaucucaguucacugcaaucucugccuccaugguucaagcgauucaccugccucugucuccgaguaccugggauuacaggugugccucaccaagaccagcuaaguuuuguguguuuuuuuuguuuuguuguuuuuugcuuuuuuuuuuuuuuuuuuuuuugagacgaagucucacucugucacccaggcuggaaggcaguggcacagucuuggcucacugcaaccucugcugcccagguucaagcgauucucuugccucagccucccaaguagcugggauuacaggcaccugccacugcgcccggcuaauauauuuuuuuuuuuuguaguuuuaguagagacaggguuucaccauguuagccaggcugaucuugaacugcugaccucaagugauccauccaucucggccucccaaagugcuggguuuacaggcaugagccaccaagcccggcuggucucauuuuaauguaagcucuaacuucuguaucacugcuuugcacauuguagauaaccagugaacauuuuuuauuguauaagaaaaaguaaaauaaacaaaaauaugccaaagcaaauaugauaaauacacauuuaguaagguaaaagcaaguauuugauaaaauguguaauguagucuaguagcuuuauuuagaaacagaaaacaacauaaaauguugacuugaaacauugcguaugcauauuugccauguagacagugagauauggagguaaacugcuuuccuaguuuuguuuuguuuuuuuuuuuuuuuguucaaaaggaauucacucuccccuuguccacuguuauaaaauagcaaauggugauuagcaucugugcuguaaccagagacacugcuguucccagcuggaaucuguagguuguuugccugcuagagauugugacaagaagccaguuaacauggagagguguacaugucagucuuccccagaaaaggacaugaaacaguaggaccauccuuccaacccaugaccuacaucuagaggcauucuuuuuuucuuuuuuuuuuuuuaaaccggaacagaaauaucaucuaauucuuucuuuacagagaagugguauaaggaaguacauucuggccaggcacgauggcucaugcuguaaucccagcacuuugggaggccgaggugggugcaucaccugaggucaggaguuugagaccagccuggccaacauggugaaaccccucgcuacuaaaaauacaaaaauuagccgggcgugguggcacacaccuguggucccagcuacucgggaggcugaagcaggagaaucgcuugaacccgggagacggagguugcaguaagccgaguucacuccauuguacucuagccugggugacagagcgagauucgucucaaaaaaaaaaaaagaaaagaaaagaaaaaggaaguauauucuaagcccuugaauugaucuuggcuuucuucauuauuuuuacaaguaaaaauaaaaacuuugauauuucugauguucugggauauuauaggaaugauaccacuugaauucagcuuucuaagaagucugguauuucaauagucuuaauaugaguaagaaaauuaugaucuugguacuggaucuaaggcagagguaucgaagcuguuuuaauguugcuugagauaggacagaacuucagaguaaaauaaauguguauagacaaucuguucaaucuguucaaauuaaguuguugagcuguauauuugaaucuuaagacuacuaauuuuguuguaucugucuuuucccaaauauauguguacuucuuuuaauaagccaaaaccuaugcaacuuuuacuaauucuucccuaacuacuucuuuuggaaaaugauuaaaucuuaugucucacguuuugacauaucuauugcauuuaaaagauaagguugaucaugcugcuucucaaacugagauauccauucgaguuauccaaggcccuuggaaaacaaucguuguugagucuguauggggggccugagucccaggugguguugacucugcugguccaugauccuauuuugaguaguagacucuaguagcgucuccugccuuccauauggugcagauuugcagcauugagacaggaaguaagaaacugaaaaggaaaaccauucuuaccuuugguguuauuguucuugguauauuacagauaccaacaaguaugaggcaauccugagacaucuaccuacugagcuuuucuuuccuuaaauucacaccucaagaccaaggaaaccgaaaaacucuuacagucucccuacauguguucacuugugccccuauuuccugucauuaacaugguaguguagccaacuccugcuagccuguaaaagcuaauuauuacaguauagaggaauuuuguaagccauagccauuaguagcuugaaauaccaauggugggaguauuuauaccauggcaguuggcauacacuguaacucaagaguguucuauuuguuuguuuuucuagacagugccaguuucccagcauacuccugucucucauucaguaagacaaagcacuuccccuuauuuuccaauacaggacaugauaucccgaguuuugagcuucuuguuaauagccuguugcacgcuaaccacgcagcucagugaagagcaaguuuauucccauaacaaacaggaaacaaagguugaggaaaaaccacagugguacccuuuugugaguguucccuaacaccgucacgggaguccugauuagucuaaauacuuuacaaguaaaucuccuucagguggcauuuuauaaacaaucuuucaucauggagagaugagaauugggucagguauaauuagaaugacagauguauuggcuagccugagagaauuaacgcaauucaguaaaaaggcuagccaacugcggauaucuucuaguuacuuccgugacaaauuagcaccauccucuuguacugaagcagugcuuucauuagcaugcacagcuguuugcaucaucuuuguuuguauuucaauccauauuuggagcuuaagugagauuugucauaagacuucaguucaagcuugcuugccuaauuuuacaugcuucuauuuaguaaaauaugauuacuaggucauaaauauuugauaauuuauugccuuauuagaguaauuuucuaaacauguuuuuugacgacugcuugccacuacguacaagcacuugaaaaauguucuuuucuauuaaaaguacaugguuccagaauugggaaaaucacguucuuaaaaaauaaccaguuuucuauuguguuggcuuuuaaaauuuuuucaucaguagaaucaaaugcaaauauugucugcuuauuuuucaacagaauacaaguuugauuuuaauaacuuaggcucaugaaaugucaccacguaguaauacuuagaauuacagcaauaacuuaggcuaaaaaaauaaaguuguuaugaacuacauugagcucagacagauauauguauuauguaaacauuuauauaaaauguauauaaauuguauauuguauuauauaauuauauauuguaauauauaguauauaauauauaauuuauaaauauaauacauaaauuauauuuauaaauuauaaaguuuuuauauaauauauuauaaucuaauauauuauaauuauauuuauaaauuauaacguuuauuugaaauauugaaguuuuguauacuuaguggauuuuaauauuuaugucguuuucauuuuauuccacuguuacauuaaggaaguaacuuauuacaaaaauaaauuauauuugucuuacauuugcccuuuuuacucuacuuaaaauuggagaaaaagaguucaagauagggaauuucugucagaaaggagaaauaguuguauuaugugaaguuuaaguagauauucuuguagaguauggagaaaauaaugcuauaaaauguugccuuuuaaaaaaaaguucagaaaauauaguuccuagcucucucuaaaugacuaguuugauugugacugcuuucccaaaauuuguaaauuuaaaauuuauacaucacauggaauauaguuuuauuucacauacauuccaguaggcugagaauacuugaaauucaaugauuaaaaaugaaauaauaauaaccagcuuugcuuuauucuaaaaccagcuuuauucuuuauuuaccacuuuauuuacagcgaauuauuugcuaaucuguuaacuuugcuucauaagaaggcauuauaauuaucguacauuugaaaguggagauuuucuccccauucugguugccaguuucacaacuguguucauucuaaauuuauuaaaauauguaaaaucagcuuucuaaccuugguuguccacaaagaauuucacuccaauuugaaauaucuauucagaacuaauuuuuugugguugagcauuauuuuuugaacaaugaauugcauaaucauuuuguauaauccagggagcucuggcuuagauucuguauuauuuuguguuauacugauuuuuagaaaauggaauguagcguugacacgagcacaaaucucagcaagggccuaccuuacaaagauaaaaugcguggaguuuuauuagaagcacaugauuuugcuuuguguuucguauacaccagcauuucaguguaguaaauggcauuuugucuugaagagugagcagaguuguuacaaaagaaggcauaaugcuuccuugccagcagaauucagauaagugaauaucagaaaagcuauuugugaucuugaaaguguaagaaauucaacaucaauaaaggauugugguuccuuagauagccauguaagucuuugccuauguuucuaacauuucucuuuaggaaauauucuugcuuuuauuuuucugaacaaauuuucuccauuauuaucucugauauuuacuuugaacagaaagguggauuggaaaucaaaaaauaaguuugauuucaaaaaugauuucaaaauguuaguuuucucaguauuuuacauuuugagaagagaacaaagaaggcagaugaagaguuuuuuguuuuuucuuaaauuuguuuucuuuucaacuuuauuuuuaauugacauaauaauuacauauaguauacauuuugaagauacgguuuuaauuuucacaggaaucuuauuuggguuuaguuauauaaggucuaauuuugcauccucuacauuuaguggcugauuuauaaauuuccacugagugauaauaguaauuaaugugaaacagguuuuuugcugauguuuuuagaaguuucaguagauuaggaaggaagaaauuaugcuauugagaaaaauagaaaauguaaacauaagcauuugaacucucucuugagauauuuuuaucuuccaugaaacuagaugcggcuuauugaagauguguuucaggucucagugcucuaaaacucuucuacuuggugagcaucuugauugguuagaucucuuacuaauaucccauugcuagagagggauguaaaggaaauuuucucaaacugagauuuccaaaucuuccaaucucugagucaaguaaagagacaagguuagaacucuuaggcaaacugaaaaaucaauauuccuauauuaucauuauuuuuuucuuuuuuugacaccaagucucacucugucgcccaggcuggagugcaguggcacuauuuuggcucacugcaauguacgcuucccagguucaagugauuccagugcuucggccucgcgaguaggugagauuauaugugcacgccaccaugcccagcuaauuuuuguauuuuuaguagagacaggguuucgccauguugacuacguuggucuugaacuccugaccucaggugaucugcccaccucggccucccaaagugcugggauuacaggcuugagccaccaugccuggcuuccuauauucauuuuuuuaugugggcuuuuuaaaaucuuuucaauagcaaagacuugacaccaacccaaauguccaucaaugauagacuggauuaagaaaauguggcacauauacaccaugaaauacuaugcagccauaaaaaaggaugaguucacguccuuuguagggacauggaugaagcuggaaaccaucauucucagcagacuaucacaaggacagaaaaccaaacucugcauguucucacucauagguggaaauugaacaaugagaacacuuggacacagggcggggaacaucacacaccagggccuguugggggggugggggguugggggagggaaagcaucaggagaaauaccuaauguaaaugacgaguuuaugggugcagcaaacaacauggcacauguauaccuauguaacaaaccugcacguugugcacauguacccuagaacuuaaaguauaauaaaaaagaaaaaaaauuaaaaaucuuuucuuugagacaauuguagauuuacaugcaguugaaagauuuaauagaggccgggcgcggugccucacgccuguaaucccagcacuuugggaggccaaggcaggcggaucaugaggucaggagaucgagaccauccuggcuaacacagagaaaccccgugucuacuaaaaaaucgaaaaaaauuagccgguguguggcgggugcuuguaaucccagcuacucaggaggcugaggcaggagaauggcgugaaccugggaggcggagcuuggcgaagccugcagugaguggagauagugccacugcauuccagccugggcaacagagcgagacucugucucaaaaaaaaaaaaaaaaaaaaaaaaagaauuaauacaaagagacccugcauagucuucacucaguacaguaucacaacuauuaaauugacauuaaucccuuaacacugcuuuaacccaagucuaugcugcugcuucuccguguucacuucugagaggcacuggccauuucuugugugcuuauucauacuuuguguaaaagcauuagcaucauacaucgcuggugcugacccuacccucagucccagcuucucccagaguaggcuaagauucucuuuucuacuacauggaaaauuguucuggaauaauaaaggguuagcaaaaaagucagagaaaacaaacaguugcauucccuuucccuguaguagaguaggaauauaauuaugagugauagaggauacguuccauuccuuucccaguccucuccgaagucagcuucacugcuguaggaaguugcuguucucauuauuucccugagggaaaguguugggaagugagaguugaggugauggggaaucaggguugcugacaauugggggaauuauaacgagaagcucuuuuucaccaggagagggguugcauguuaagagaaggccuaucugcucauccuccaugucagcagaugagaaccaguuggacaagguagcugucucuuagagauugagaaguaacaaaagcacacugucaguccuguucuuccagccucacguacaucuucuccauacauuauguauuugacauuaaauuaacauacacuguuacacccauuccugaccgcauuaucucagguagccuuuuguauuugaguauugugggaucuguugcuauugcccaugaugcccacuuggacuccaccaaggcagugaaacucuugggggccguucaaagucaagagugccaacugccccuaacaggauugggagaaccaaccaacacuccccgaauagggacuaacucacucuuuucuuggccuuuaugaaaggaaggaguuaaggcucuuacagcuggagacuccagcaagaguuguaggcucaacguguagcuuauacuauuuacuuaauuaacauguaaauggauuuugaguucugaaugcuuguucuaguugauuagggcucauuuagccuggcuucuacgaauuagcuauaacaaaugguuucauagcuguuauagaaugaggcagaagaaaauaaaaugaauguagcauuauguuuaauuagugguauaggaaaauguuaauauaaugccauuuagauucuggacuggggagauugugccuuuaucauaaguaagaaauuguugcuagguuucacauaagggcacauaguuaucaugaaucaucuccuucgaucaucauucuuuuaucccauuacuugacuugcacccauccaaaauucuaccacuuuuauuuaauauauagacucauaaagacaagguuugugcaucugcagagcugugauguucacugcgaggcccguggcacacaucuauaagaagacacauauuugguacucuaagaugauacuuuuuuuuaaugccaaaaugugagggucagcauaaauugccaaggcaugguaaauuuuguugccaaugcucccgugacuauggggugaagggauucugugccucccuugguagcaaugaccacggugcuugcaaucccagugccaauucccggcacagugcaggcucuggaggcacugcugccuugcagucuuauuggaauuaacacugccugaguaagagauuaauaauggguauuguugugucuuagaaacguuaaagagcaugugacaugaauauguacacauuggugaaggagauacagagaaggaaagcaaagugaagcuguagauguuuguuacaacugaagguaagcucugggagcagagaccacugcuggcuauaguugaugggauccacaaugucaauacaaauggggacuaacuauuguuuuacuucccuauacacguugcucuuucaguagaugcaauaaaguacugguaaaaccagagguggcuaccaucacgaugaugucaacaggagggacagucagcacuaagcccagaaggugucaaacacuccgcaggagaaaugcgccaugcaacggacaugaagaugaucugacacucuucacgugguuuucagauggaaacguggcuacgaaagcaucaaccucauuaucauccaucauuaaggccaucucacucaguacugcugcuuucaaaguccacgcucccaaagcaaauuggauuucuguacacaauacucuuacaggaugaaacccaaccaacuuguugacguaaguaucccaucuacuucgcaauuuuauuuaucuuccaaaauuaaaggacuggcacccugauuuauuaaaagugaauugggucuagggaccauauccccucugaguuacugacagagcagcuucuggccugugaagcucaaagccaugccuagaugugauggauccuugucuuugauuggcuaauuagaaucaaucuguugaaggaccaguggcaguggcucacgccuguaaucccagcacuuagagaggcugaggcagguguaucacuugaggccaggaguucaagaccagccuggccuaccuggugaaaccccaucucuacuaaaaauaccaaaaaauuagccaggcgugcugguacaaggguaaucccagcuacuugggaggcugaggcgcaagaaucacuugaacucaggagguagagguugcagugagccaagauugugccacugggcggcagugcaagacccugucucauaaaaagaaaaaaagaaucuguugaauauuccuaacuuggaaguaaugggugaugcguggcuuucaucuuuuagaaagguguuuuuuccucugucaguaaaacuaagaagacaucugugugugcuaaggcgucagucuagcaagggcagggcacaaacccagagagagaauugggcuguuguuucacuuccaauaaaaaugggauauacaugggagguagaguuauaauucuacucaggauugacuuuauacaugcaauuggaugggucacugauugacuuugaggcaaucagggaugagugaaacugaucuuggggaggguggcaagacauguugacagguaagauguguuuuaauguauaacagugcgugguguguauuaaucaguuggaguugauugacugcguuuuauuguuuggaacauuccugcccaagggucagguaaauauacaaaauauacaaauaauacagauuuuuaauacauaaauaucaauuaaguagcauaauuaaauaauacauuguuauaguuguacuuaauguguauguaaauauauacaaauaauacagauuuuuaauauauaaauaucaauuaaauagcagaauuaauaauacguuguuauagauguacuucaugcauauguaauuaaauuauuaauguauaauauauaaauacauauuuuaauauacaaauaaaauggucuuaaaucagaguuaauuuaagaccguuuauauuaguacauaucuuaauauacaaaugaauggucuuaaguuaaugucauugaguauaagucacauuuacagauaugacauguguuuccagauaaagucaauggacagacagcuuccaacacuggaaaacauucaaaauauaugcaauuaauuuuauauuugaguuaaggcaaucauuuauuaaggaaagcaaucagauguuugugagggcuuaaacuuucgcuucauaaccaaagcaguuuccuuacaugaaaguugacuucuuaaaaagagaaguuuauuuuuuaugauggaggauuguugugaugugcagauaccuuccgucauuucauacucaucuaaaagcagccaaaugaucuuuucaccuuuggccggaauccuuuuauugcuaccgaguccugcacucauuaaaccagaugacagugcaugcucugagagguguaaaucucuaguccugguggccaguuaaauuccucaguaaauguuugguagaugcugccuaauaaaccaguccagguugccacugggaggauuaaaagaaguaaacguguauacaugaacagagagacagugccuuuucaugcuaaaugugguuccccacaucuccucugauuagaggugugcucugaacaagccgagacggggccgugccgagcaaugaucucccgcugguacuuugaugugacugaagggaagugugccccauucuuuuacggcggauguggcggcaaccggaacaacuuugacacagaagaguacugcauggccguguguggcagcgccaguaaguggacccuucuucgagccuggccaccuuucgucucucucgccacugacucugcuuuuuguaacagauugauuuuccugguucuugggaaugggccuguugcuaccacuaaccacauuucuguccacuucucuaauugcucagagucuccgcaguauguucaaucaugagcacaccucuccgucuuucccugauaaagcauggccauggauguguucucuuccuagcuguagcacauaugucuugcaauccagagggacuuuugagugcuucucuuuuaaacaaagcuggaguggcuguuuugucuucugcagccagccguuucugcaaaugcauacuuauguguuuguccguguacauauguguucauguuuaugcaugugcacuaccugugcagauacugucuaccacuggaagccuggcugaugcagcuugaguugcauugauaagguguauggcugugaugaauaccuuuaaguugguucauaacaugucuuuuauugugcugaugagggaaugugauugaauugagcucaugcaucucaaaugccggaggguagaagugcccgucuugcccccuccgagcucagcacacagacauuugccaggucaaacuucugcuucuucucuugaaaguagaagaaaacuuuugacuuaacgugagaaacuuucaaugacauaaggcucgaggaacauaauuuuauuuuuuuuguuuuuuuaaagacagggucucauucugucucacaggcuggagugcaauggcgugaucuuggcucacugcaaccuccgccucccggguucaagugauucuccugccucagccuccccagcagcuaggaucacaggcacaugccacugcgcccggcuaauuuuuuguauuuuugguagagacaaggcuucaccauguugaccaggcuggucucgaacuccugaccucaagugauccaccugccuuggccauccaaagugcugggauuacaggcgugagccacugcaccccgccagaacauaauuuucaaagucuuucucuugaacauuaagcuuuucauaauuccgggggauaaaaauaugaagucaugaugacuuaagugcaugaugaaauuuuccccaaagagguaauucucaggagguccaguaccagaugugagacuuccaugucguuaacagacuuccaagugaaauucccaauugugcuuauuuauuuauuuauuuauuuauuuguuguuguuguucaugaguaggaaguaugaacuacucaagaaguaauuauucagcucagcuugauaacuaaaaaugaaacucaauaacuguguauuacuuuuuugagagacuccugccuaauucuccgcuguguugcaaggguggcagccacauuuccugccugagauuccuagggauuauauaaauuguuuugcagcaagaucuuaggauuaagcaaaacaacagaagggccugcaccauuaauacccccacuguaaaggagcccaggaucuaagaggaauguaauggaaaagcuccuguuggucuccugccaucgccagugaaugagaugacugcuucagucccaugugugaacagguguaggaacugauaaccucaagggcuuuuuuuuuuuuuuuuucuggcucugauuggaugauugcagcuucuggaucaaaggacucccuucuucaguuucaaacaaagcagucaauuaggucagguauugcgaacacaauggagaauucuguugccugcagccuuuggaacaaaggccuuuuguuacagugauucucacugguuuagccggugggagagguuuccuggcagauuugcaacuuuuuucucccuuucccuggguggauucauuuucugaaauaucauguauaguuuuugguaauaagagauuuauuugguuuuaauuauuagcagugaugaauuugcuucaagagauuaaaauucucuccaccucaccccaguacugccaucccuucaccuaacacucucucccuuugaucaguuugggcugggagugaccagugggcaccuguccagguguccuggguggcacacaguuugcugaggguuuugcaaaaggucgaugcucccaacagagauguauuagaugaggcuagcuaugccugauuuuagaggggaaaggugacagaauaauguaugaagaaggcaaaggcugaagaucaguuagauggguggacaagaauaaguagagaguauaagccucagcaaacagccagagccgagagccacaugcuguccuaugaaugagugaaauaaauggaguuuuugugaaaaaaugcaucgaagggaauuggggauauuuggcacaaaaggagcaagaaauccucuucuguuaagaaaccuguuguuacucggauauacuaucagagacaaaauauccagcauucucaaauguuaacuucuuacgaaaauagaucuuauguuuauauguucauuuugguuuuguuggagggaccaaaccuaagugagugauuuuguuuguuagguuguuuuuuugucaguggacucgugcauuucagccaucauucccauguuucucuuuuuguuuuuaguuauguucucuuauuuuuuccauagugucccaaaguuuacucaagacuacccaggaaccucuugcccgagauccuguuaaacguacguugucauucaccugagggaagggaagaggggaggaggaugcugcuugguucacauaacuccagcaucaucaccuucuuugcaugguuuuguguuucuugaacaccugucuuaguaaaauguuucuucccauuaccuugcuuguaauuacaucugauuuugccagacagcuugagauguugggcuaagagcaucauugacuaaguuucuucuauuucugaccaauuuccuuuuuauuuagucugguuuuauugaauauuauauggacaacaucauuguauuguauuugccauuacuauuuuauuuccuaaaagcuaucaguguaacugagagcaggcuuagccucucacugcuuuugcagaacugaagaacaagggcuaggugcaguggaaggaaagugacuuuacuuagcaaagcuagcaauggggaaaugguccaggcuccugccucaaagcaaccaucucaaauuuuggauuaaaaaacaaaggcuuaaaaaggggagcuuggaaugcagggcaugaaggaggggugaggaggugcugcuauacaggacuuguuccaaagacuugaguuauuauccaguucgguaagugggcuggcgcaucccgcacaaucggguuguaaauuaacugcagccuugaggugaucuccugaugagggagaauucugaaggugccuaagucagucaguggaacuucuaagcaagcauuaauaauuuuaauaauaauuauaagcguaauuagauaauggaagcgcugugcagggagugccuggugggaagaaagagagcaaagguuaccauuucauuacuaaaacuggaaggaaaagaaaggaagaaagaucuuuaaaauagaguacucgguuacaucaagaugccaugauuuaacaagagacuauaauacauaaguaacuuguuuccucagaaaaaguacuuaauauucaugguauuguaguacauggacuaauucguacacgcagauuucaauuuauguguguuauaagacccgguuucaacuuuagacaugaagggucacuuuuagacauuaggaaccccucuuucuccucucccagaaggcauaaugguagguuagaggugcucaccuuuugacuaggaaguagagaaagagccuccuauaaagaaaugcauuguccagccacugcaggccuuacuuacagugucuuauguuuuguuuuuauuucaguuguaauaucagacgaguuuaguuuuaaaaugugguuuuaguacucauauuugaauuuggauuccauccagaaauagauuuauccaguguuagguuagggaugauauaugccauuuaugcuuaugauugcuggaagaagaggcacaauuucaguuguaacuuagauauuuuauaauuagcauuuguguacauuauccugaaaaaaaaaaacccucaucucaaaacugaugaagccaguuaucuuuuuuaaagaugauaaauuauagaugaaggauuagguauuuuaaaaaagacugcauccuaaacuauaaaguuuuuuaauggccuccauaaaauauucagaauaauucacauuauguauaacuuuugaaggaugugguuuguacugcugcaacauaaacguuucuuuugcuguugugaaaaaagcauuuuucucuaaaaacacuguaaguacagcaaguggguugacagacuaggaaaaagcucuagcuauuccacuauaguguugacauagguacgcauguugaguugcauuguaccgagcauuuucacagaucauuuaauuuuucuucagaacacuuugugggcauuuuccucauuccuuuuguacauacgagaaaaaaugaggcuucaagagcuuagugacuugucccaagccaucgaacauggcaggaccaggcuuugaaacccaaaaugacguuuuggccgcacuccacaccaaauggcuaagcauugguucugacauuguuuugccgguuagugaaaucacauuugcgauucagaagcacauuuuaagaauacagaaaacagugaaaagaggaugaagaauguuaacauuuuuuccuaaaugccaugaauagagcacgcaucaguaaauuaaaugucuuucccauucuuuuauaaaacagugauuauuuuucucuuguuucauuuuagcauuuauaagaauucuauuuuuccauuuuuaauaacugauggaaacaagcaucauugucugauaaauuuauuuucaugcuguacacguaacuaccacuuucaucauccacuguuccaaacagauacugaaagucucuuuuguaauuuucuccuucccaguaauuuucuccaucuacuugcaguguauuugggauccugacaccuuuccauucuaggaggaugaagugcuuugggcagcuauauuuucuugucugccuacagagacuauucaaucacagcaagugaaggguuuugcagugcuaguacaaacagacaaggaaaaaaacauauaauuucuaguuauuuauagccugugcagcuauguggucuuauuuauagcaaacugcacauuugauuugaaaaagucauggucaucuggaggucaaauucagauggcagacucaauucagagaaaaggagcugaacuagaagguaagcaagccuguuagacugggcaacuuggacuugacuuugcuccuucaacaaucuagagccaguuggaugauauuucugcacaaaggugguugguuuuacagguugcucagucuaagcugcuucuagucaaauaacaaaugugaaaggagauagaaaaagcucuucaguugaacugauaaaagauuacacuuagggagaaaauguaugaugguuugcauuauaaaaacaauaauuugccauaaaucaggcauuucuagguuucaaacuuuugucauaaaaaccaauuuugagcauugcaauuuuagggacauauuuuauuguuguuauuuuaaauaaaaaucuaaaccacaaauauaaggcugagagcuuucauuuuauucgugaacauaggaauucaaaucauuaaaaaaaaacccuuucucauuugggauaaagaaucuuacgagagcugaguuaauuucugacauuaguuuugcaccugcccauuuggguuuaggacagugcaaaagguuucacauuuaaucuucaaaauauaguauuuguagacaauaaaauuauauaaauauuuguggauucauuuauauuuuaaauaugagagugugaccauuuuuuccuggugcugucuccaucagacugcaucccaaaaggcaaacagaccaacuccuuaauggcauuuaaucucucaaagagcaucaugccaauuuuuagucagcagauugcaccaugugaucuggccaaagugugucccaucucaggcuccuucauuugcgcugacaugugguacaaacaacuaaaccaagguuucucaaccucagcacuauuaacauuuugauucaaauaauuaauuuuuaggagucuguccuaggcauauggguguuuagcaguaccccugaccccuacccacuaaaugccauuaacacaacuccagcugugauaacuaaaaaugucucuagacauugcuaaaugugcccagggggucacauucugguugagaauccuguucuagaguaguaguuuccccacaucugacucagagauagaacucuccugguguaaacacguguacuuuccacaaauuugggggcauguugaaauguuagaaugucagcaucauccaauucucgacagauguuugaaauugaauuuguuagacuauuguccaagcucucaauauuugcaagguaaaguggaaguugcuguugcuguccugacuauaguauugaaggucucguaguuuuccugcucuaauguaagcuacuguggcagcagaagagaaaccagcaaaucccuuaguuugaagucauugguucaccuaugcaccaccccuuucuccucucuguuucaucuuaguuuccuagaaucccaggauaugcuggaggacaaccaucuguagagauguccuauagucuugcuacacagguuauuuguacuuuaggauuauguuugauggccuuauaguuugugcagagguguaggccugaccccaugcaggauugagggagggaaaaagauugauuucuaggcacaucagaaugguccagaugacaugaaacagacugguacacuuacagagaauaugaaaagaauuggaacuuaacaagucaggccccaaguuccauccccagguuccaaguuuguugccgcagaagcucauaauuuucaaaucguagaaaacucacaccacgcagccuuucaauggaauaugccaccuuaaccccagggucguuguaaagacaggagccauaagacagaagucugaaugccuaggccauuuaaucuuuggccaaauuugaacuauuguucuuaaucacacuauucuuguucuuuucacugugcaguagcaaauguuaguucccauuagcacauucugcaauaccauuggaacuaaaacugccaaauuagauuaggcaaccugggauuacacuuugcuccccaaccaaccuagggagggagaacaauuuuaaagcauuaaaagaugugauggugaauuaaacuaccugucacgucagugccaguauauucuaucagauuaacaagugugaaaagcuaaaucuuugguaucuggaaaugcuuagauaggaagaauggcuuuuucuucaaagccauaauaauuagagaugacccuaaaauugaaaggaacuggauugcuuagcaacucagcauuuuuuaaaaagaagggccaucuacuuugaauacagguuaaauaucucuucucuaaaaugggaccagaagugcuucagauuuuggauuucggaauauugauguauucaugaugaaauaacaugaaauucauuuauguuucauguacaccuuauacaaaagucugaagauaauuuuauacaauuuuuuuuuuuuuuugagauggagucucgcucuguugcccaggcuggagugcaguggcgugaucucggcucacugcaaccucugccuccuggguucaagagaucccccugucucagccucccaaguagcuggaaugaaugacaggcgccugccaccacacacagcuaauuuuuguguuuuuuaguagagauaggguuucaccauguuggccaggcuggucuugaacuccugaccugaagugauccaccagcuucggccucccgaaguacuucgauuacacgugugagccaccacgcuuggccuauacaguauuuuugauaauuuuguucaugaaacaaaguuucuguacguugcacugugagagaacaaagguguugcuaucccagccaccaugaugucaugucagugcucaaaaauuaucagauuuuggagcauuucagauucucagauuagagauguucuaccugugguaaaagaauguucauuaugucucugcucuguuguuuagcuauuugccaaaagaggguaaguggaucguuuaauaaaguggucagcaaauauuuuucauacaaggccagauuauagauauuuuaggcuuuguagaucaugcaguuugucauaacuacuuaacuaugcagugguagcaugaaagcaacaauagacaauaaguaaacaaauagacaaggcuguguuccgauaauacuacuuuuauaaaaguagccagcagcugggugcaguggcucacgccuguaaucccagcacuuugggaggccgaggcgggcagaucaccugaggucaggaauucgagaccagccuggccaacauggcgaaaccccaucucugcuaaaaacacaaaaacuagcugggcguggugaugggcgccuguaaucccaccuacucaggaggcugaggcaggagaaucacuugaacccgggaggcagagguugcagugagcugagaucacaccaucgcacuccagccugggggacaagagcgagacuucaucucaagggggaaaaaaaagguagccagcaagcugauccuugguuuaauacagcagguuuuuuuauuuuuauuuuuauuuuuuuuccaauagcuuuggggauacaagugguuuuaguuacggggaugaaguguauaguggugaugucugagaguuuaguguccccauuucacugaguaguguacauuguacccaauacguaguuuuuuaucccucuccuccuucccacucuuccucauucugagucuccaauguccauuaugccacucuaugccuuugcauaaucauagcuuagcucccaauuuauaagggaauacauacuguauuuccauuccugauuacuucacuuagaauaauggccuccaccuccauccaaguugcugcaaaagacuuuuauuuugugguuuuucuggccuacuaguauuccgugguauauauacaccacauuuucuuuaucccucauugguugaugggcacuuagguugguuccguaucuuugcaguugugaacugugcagcaguuauuuuugaccccaggaugugcgaggccagguauuuugagagacaccagcaaaggaaucugaguacuggcuaucaauaccugauaauuuuauuaaugaguugagacccagauaugccguagagguaaauaaccauauaaaggaaauauagaaguguaggagaagauugcucuggaaggcugggguaaaaugaaaucagcuuuauccuuaagaccuccauagagguuaacuguaccaucuccuuuuacugcuacaguuuauaugaaacuggacaauauugaagauuuugacuuuucgaacucaucuauugaguguugagcagcuaugacagguuauuucuuuaugugccuccauuaacgaagucaagaauagcuucugacaaauugacaaaaaacaauaaccuaagguuaacccauucuggacgccaguuauugcuauugcuucacauauauuuuuuagauucaaacuugagguugcuuuuaaguuuuagugugaugugcugaauagagaauagauguuaauaaaaaaauaaugccagcauucguuccuucacauucaguucauauauuugaaaaaauucccaugucaguauguguccauggacauaaaaaagaaauguagcuugacuagaguaaacacaucauagauuauauuuuuauuaccuuauguccaugugaugcauugauaguguucuccaccaacuaugauugcacugacuauaaaauuguaauacaagggcauauuagggggagaaugccuuuguuuuuucuuuuguuguuauuuuguuuuuaagagagucugguauuacacuggaggaucacaaacuguauuuucuuguuauaaauggcuccucuaucuuggacuuaaugguuaggauaaauauuugaauguagaaugcguuaggaguuuuaacuauuuuugaaauuaggaaaauggagagacacuuuuuuuuuuuuuagagacacuuuuuuuuuaaguuauaauaagcauggcacucggaaagcucugccauguuucaagauuaaaguuucacaugaacgcuaacaaguuuauauuucacucauauauaaaugauccuccuugucuccuuuccuaaauuauagccaucucaaaugacaacauugcugggucgguaucaaauagcauuuucaaugauaaggcaaugauuuauauaggucuuaauuuguuuuaaucuucuguuaccaaggcuguagagauaaauugcuuuucugcugaugaaaggagacuaacccaauuuucuuguuagaaucuaauauuaauauaucgacugaaugccauucauaagccuugguuuagggaaacauucagccuucuggccuguuggagauggccacggucauugcuguuugaaggugggucauuucuucuuuuguguccugaguccauugugacuguaaaauuaugggucaccccagaagccugaggaaacaaaugcauaucaaaaugauaggggcaaucuuucacagugccuuuaauuuugaccccacauucuuauaugaaugugaaguaccacauuaguaugaauaugaaauggagugcuccgcaaugauuacaaaaucagaacuaaaaugagggaaaucagugcauguacaguucaacuuaauggauuauccucuaaggagucuucagacaggcuaggagagugacgucugccucauccugaagauauuagcagguuuuccccuguuuuaaaguaacuucccuucaaaugcuaacaguuuucucagaggaaacacagguauggaaaauguuucguuggugucuuggccccagugauggaggagcauuuugugauaggaacguugggugcagcaucgccauuuaugaauaaacugaaagcuaaccuguguuacuucaccccagaaaacagagcucuggcagguauugagaauagaucacagugugaaguggcaguauugugacaagcaugcguguaucaguauuaaaauugaaaugagcccucacgcacaugugaaagcaguuucucccguuuucauauucaguucccugagguaauacagcauuuuggugugagagaaagaagggaaucugacccuucucgugugggaagggggcugagggcaacaaccuccugugacagccacccugguccaagccaccuucaucuuugucuccuuuuuuuuuuuuuuuuuuuuugagacagaguuucgcuguuaucacccaggcuggggugcaauggcacaaucuuggcucaccacaacuuccgccucccggguucaagcaauucuccugccucagccucccgaguagcugggauuacaggcgccugccaccacgcccagcuaauuuuaguauuuuuaguagagacagaguuucuccauguuggucaggcuggucucaaacuccugaccucaggugaucugcccgccucagacucccaaagugcugggauuacaggcgugagccacugcacccagccugucuuuuccucuuaaaagaucuuccuucuacuuuugucccauagcagccagagugauccuucaacaaaacgccccaucacauauacucccccucaaacagcccacgcuggucccucagaauccuuacuguggcuuuaaggcuguacaugaugucccccauuucuucccugccucucccacuacuuccucucuugcuucuuuagcucuggccaugcgggucucguggaauuugccagccagcuucaacucuuagggcuuccgugcuaguuuugucaucugccugccauguccuuccagcagccagcugggaagaucugaaugucaccuccucacuuaagacucugccuggucgcucacuuacugcggucuaccuuuccccucuccccucagcucucccgauccuucugaacucugcucuguuuuucuuuuuccucuuuuucuccauaauacaaaucacauauuaacaauaugacuuacuggcuuuuaaaaaauucuugugguaauuguuucuuucccuagaauauaauuccaccaggaucagggccuucauguuuuucucauugguuucucccaugugccucacauauaauaagggcugcaauguuggugggcuggaggaauaaaagaaugaacaggcgcacuaaaggcaggauaguuuguccaugucagagcugcugucucagcugcuuugauaccucugacuucccaggguggcaaagaauaaggauguggcuuauguagaaggcguuagucauccaaaaugccacuguauauuuggaagcaaauauucaccuugaagcagugauguacuaggaauuagaacugcuuuucuguuacauuuuuucauuuguuaugaguguuuagauacacaugaucacuauuaaaaggaagggagguaauagccuauauauccuaccaugccccucaaggcucuguuaggagacuaaaauacaaaggucauuuaaaaaguuaaaagcuuaugcaugugauguugguauugcugcuaaugacuaggcaucuagaggucaaaaccuagagcuaaggauauugaacccuguguuuugucucguuuuaagucuagguuuuuguggaggggggaacauaccuagccagcuugcuugcagaaggcaugagugagcaggcugaaggagggacccaaggccagaacguccuccauauucuagcuccaugggcucuuucacuugaucccugcuuuaugacccaacuucuguugaaggauuugccagauaguguuuggggcaggaacagcuguuucauagaaaacaagccaacggacaucauaacaaagcauaugguuguuuugccaaguugugcugcucauuaacaaaacaaaacaacaaaaacccuuuacagugccccagcauguggauggauuggcccuuuacuacucuaaaaauuagcuuuacagccuuuuuauggcuuacccaaucuuaacagacuuuauuuguguguguuuagggaugcaaauggguauguuaaaugauaguguuuugccucuacgcaauaaaauaggguaauuuuuucuucccauguauuaaacgagaacacagaacaugccuagcauggugggcucugaugaaaagaggcuguuaucauuuggccaacauggaaauccuagccuuuauuuauuuauuuauuugagacggagugccaacauggaaauccuagccuuuauuuauuuguuuguuuguuuguuugagacggaguuucgcucuuguagcccagacuggggugcacuggcaugaucucggcucaccgcaaccuccgccucccagguucaagcgauucuccugccucagccucccaaguagcugggauuacaggcaugcgccaccacacccugcuaauuuuuuuauuuuauuuuauuuuaguagagacgggguuucuccauguugaucaggcuggucucaaacuuccguccaccucggccucccaaagugcugggauuacaggugugagccaccccauccggccgaaauccuagccuuuaucagagguuccguggaaucucagaggucugugagcaggauaaacugcuuuaugguaguuuaaaaugcaaaaccagaaauaaacccuccuaaagccaguuuguuuccacuuucuaagugguuacagugaccuguguuuuaaguaccuuaaauauaucagugaccugcugauauacagcuuccuguuuccucuguguccugugacauauccugacauuccuugagccccacucccuucccaaaaggaaguaccuugaugggugaggacauagggcacacgugucucuggccuucuguggacauaaucacaaaaugguagucaguccuaugaauuuaaucucuuuaggauauaaggauauucacgaaauagaaguugagcucucuggacauacuccaccuuaaaauugcucucuccuuccgggauccucaccagcugcagagcaguaguaaugaacuauuaaauucauuuaacaauaucagcauaugcuauccuucucugcuugacuagacaguaaucuggcuugcugguugguaugaauauaggauaauuucacucacacuaauugagauggggaguuuguaugaauggcugaaaaauuugaguuaaagauaaaaagagacacagcuuccucaacuaugggaaauaacugggacuguuaacaaagauuuacuugaagagaaauuguauugcucaggguucuccagagaaacaggaccaauaggauauauauguauaggaagagauugauucugcagaauugacucacacaacaauuauggaggcuaagucccacaaucuguugucugcaaguuggagacccaggagagcuggugguaugauuuaguccaaaucuaaaggccugagaaccagggaagacaaugguguaaauuucaguccagggagaagagaagaccaauauccugacucaggcagccaggaaauaaaaagggugaacugcuccauccucugcccuuuuguuuucagacccucagcagaucgggugauuccugcccauguugaggagggugauuuacuuuacugagugcaccaauuccgaugcuaaucucauccagaagcacccucacaaagacacucagaaacaauguuuaaucugggcaccuugcggcccaaucaaguuggcacagaaaauuaauuaccacagaaauauuucuggauucaauggauuaaguugguaauauaguauucauauucauuuccacgugccuaaaaagaagguuuuuauccuuuuuaauauccucaguccuauuaaacauaccucacauucauguuccaugguuauucucuuauuauguugcuaagugcauuucuacuuaggccaaucugauuauagugauucagauuauaguguuuaucuucuuuccuuuauacaguagacaguguucgcaaaccauaggagcugaaaaaauuuccuucuuauauaguaaguuuuaugauuccaguuuuccaaaggggugcuuauguuaugguuauaacaguuacagccagaugacuaucuucaucagcagguauaaccccaaauauuuauacauuuucauuuguuucaaacauaaaauaugguuugccuaaacaugucauucugccagauuggacuaugcaaaagaauguuacuguuuuauuuucugcuuuuacuuuaacuuguucucauuugagcucuaccaguuaagaugagaagaugacuaaagcuagggaagcacauuuuaaaugcuaaauaccauguucauuucaaguugggaacuugaaaugcaaguauuuuuaacuuaaucauuaaguuaaagucaguaagaacgugguauuuagcauuuauucauuuuaacuuaaugauuaaguuaaaaauacuugcauauugguuugcuugaagcuauggagaaaaacauuuaccuuuuuuccaaaaaggucuuaauauucaaaauuauuguuucaaucuuacaaauuaacaauuuacuuauuuuugauacuuucggccuuuuuuaugugggcuacaccuaacauuuuuugaaaaauacauacugcuuuuccuguagguugcacuuugugauccuguguguaauucauuuucagugguucuauuuuauuuauuuuuuguuaguuuguauuuucuuuuguuucuuuuucucaauuuuuaaaauuuuaaaacuuguccuuuucuuuuuuuucuuuauuauugcacucuucuaccaaaacauuuucaguggcuuugaauaaaaguaucagaacuuucccgugguuagcauuagcucugagauuugaacaggauguauuaagcagaggaggagggaaggccacuaacauguaugagcuccacugugugucacccucucugccggaugacuuacaugugguaugguaucucauuuucccagcucuccuaucauguccugcggcauguuaucaccacuugauaaaaaaauugaaacauggagugcuuaaguuuccugccccaggucacagcugaucugaaaaagaaaugggauucaaauccaaaugugcuuaauugcaaauccccacaugacucuuuccuuccuuccuuccuucccccguugcugccaauguaagaaggaacaccacucccucauuugcuacagagaagacaggggcagcuguguaaaggcaccaggaauaugcccugccuccuuccuuccacuugaaagcaacaucuggauagacacucaacugcuuuuauuuuuugaaaaaugauuauuaaucaggauugaaguggagggaaaaaaucaaaacgaauguuucuuuuuaaaaugaaagauacuguuuaauuauuuaacagccuuccgguuuuaguuaauaucuuugaagacuuuggauuaagauuccagacauuuucuugaaggauguagaaaacguauuuaacuucaaguuuaguuucaaaaugacuuagcuaucaauucuucucauugaaguccucuuugagauauuauaucccaaauguaauacacagguaauaauucaauaggaauacuuggaacauuggugauauuugaauaaccuuuugaaugaaacaauugauuugaucucaaaagauagugaaaacgucucauuuuguuuuuuauguuaaauaugcuuccucuuaagucaaaauucuuuuuucuuuuugcuuuuaagcucauaaauacucugaauucucacuaaucuuuuggaaaauugcuuguauagguauuauaauucacuuggcucaugaguuacauaauauagcaguauauguugcaauucaaauauugcuuagcaguauuaguugaauucaaaauagaaaucacuuucuuuuugacaacuagcauaaugaauucauugacuauugucaaauuuaugaagacagaaaaguccuuuugugauucaaaaauguguuuauugauguuuauauaucuuuugucguguuuccauacugucucaugaagguugucuucguaauucaguuaucuaaauacaucauacauuuaccuuuucccuggggugccguuauucuacaacaggcuaauuacagauaucugugguuucugcaggagucuuaguguaugauauugaugauaucaucauuuacuuucaaaauugcaaaauaguaauuuaggaaagcauggggauuuggaaaaacaugucuucagcaccaacuguuuuugcucuuugcaugcuuguuucguaaagaacucuaaugcuauaauugcaaaauggaccauuuuaaagauuuuuccuucauucuguacuugggaguggugaaagacauccuuacugugcugcacagugucucaugguguucucuuaaacagcauuaacgucuuguaugcgcugcuuuacuaaauucucuguucugagaaauaacugaaaauacggcuuucuauuaaacgaguggauuauucuguuguuguuggcuuuuuuuucucaaaccuccuucucuucuacuuuauaguuccuacaacagcagccaguaccccugaugccguugacaaguaucucgagacaccuggggaugagaaugaacaugcccauuuccagaaagccaaagagaggcuugaggccaagcaccgagagagaaugucccagguaagucuggcucuuccaucauucagcccuacgauauugggaaaccugagcuugccucugccucagucuccccacaggccugcuggcuuuaucaagaucuuuaaagauguaaaguucuaauuuuaaauguuuacugugugggcacaguuuguggguuuuuugcauccuccgugaacaugcugccuaggaaggauccagguauaguuggauuuuguaagcacaaauuaaaugaugucuguaacauucucucuggcgaagaaagguacuuggcauuauuauucuguguauauguaguaccuguaaucaacauguuguaaauuaaaauccaucaaaaugcucuuuaguaaagaugagguuuuguauuaaaucccagacuguuauaauugugaaccuacgauuguuuacagucuguaaaaucauagagacuuaaaacugagcugaaccauagugauuauuucaucuagucuccuaagugauacauaguggaauagagguucgagagaguggcuucccauuuuagcacaaagcaaaaucagugagccagagacaacauuuagaauccaggccuuucuugcuccuaguacaguacuccuuucauuauacuuugcugaaaaaaaaaaaaaaaaaaaaaaccuguuuugguuugguuuguuuuuuuuuagcagguccuuaauuaagcaaauuaaaaaauaacuuaugucuaaaacauggcuaauccauauauacuaucaacuacaauugaagcuaugucugcuaccaggcacuggauguuguauuggaguuugauaauauggaggauuuuagcccuugcucagauuccucauucauucauucauucaaucaacaaauauggacuuauuauuuuccagucacuuuucugauuuguagucuacaaaccuaggagugaauguggggggaaaagaaguaggacauaaaagugaaugaauaaagaucucagguuaaaguaagccauucauuuuuaguguuaauauucuguggcaaauaucagaagauaggagaaauuuuugucuuagcacagaugcuuaaucucuugagagacauuaaaugcaauuuaugaauuagacugcugcguauuuucuaagaucacagucagucuuuaguagacaauuaaucuuuccuguaauuucugaucugggucccugcugaccccaggaagauuccucccucccagggccaaaugaauggccccugagcaugucuuucccaugcaaaccagucaaucaaaagcuccuuacucccaaccaccuucuuauacucugggccacuauucaccugcucuaaucaccccaggaccagguaccagaccacuagggacaaccucaugccccaucaccauuauuugaacuaaucaguccuaaacccgccuacccugcuucgcucauucuuuccaugaaaaccacaauaaaaggcucuugcucauguuuuccccuccugaccaacccuggugcuucccauaugacccugcauguaguggcauguaccggcuucuugggagcugaguaacaaacugucuuuuccaugauaaucaucuccugaccucuuggccucaccugaauaauaagaaaaucuacccuugaaaacauaaaacuaauaguuuaucuagaaagguacaacacagguacuguuuuuuguuuguuuguuuuguuuuuuguuuguuuguuuugccuuaagaugaauaacaauacuuggaucuacuuugguauaauaacauaaagaggaaaaaagccuuauaaucacaguacuuuuggcucuggaauauaaugugcaguucuaguggcugcccacgaugaaaaccuaacagcuaauugaacuagaaagcuagccacagggaauuauuaaguuuucaccugaugccaagaaaaucagaucuuuccuuaggaaagacacaggcacuguucggaaagcauuggaggacuaugaaucauacuuauugccacugaaauguccucauuugaauuuacauccuaucucccuucuuuaugaagcuuucagaggcuuccugugcccucacaaauccacuucugggcacaugaagucguaaaaaaagaacaaugacaaaaauaaacaccgaaugcucagcuugucauuuucagcgccuaccacuguacccugacucuggucuuccuaccaccucuuccuucucaacugcuacccuugcuuucuguacagcguuaagcugcuguucugaucaggccacucugcucaucgucuguucaucucaucuugggcuucccuuugcccuuggcauugaguucuucuggaaaugcccucccacucuucuucacgcugacacaucucacccauuccuuacaccccacuucauacucagaaugagacaggcagucauugcucuuaccuuucauuuaauucuaaauauuugcuccccgguuuuguuagugauuucuggacacaccugcauuaucuuuccaagcuggauagaaaccuugagaccucaagucaugaagccugcuaccugcauucaucguggacccacuguagcauuuuuuuuaauguguguuuuuuuaauccuggauuuuuucuccuaguauaucuuguucauuuuugaccuuauuaagaaaacuuauuucaaauucucuguuaguuuuagaugugacaggucuucuuuaaaauaauaauuuaacuuuuagcacaucuguguaacuugugacuuaguucaugauuuuguagauuuuguucaucuuuuagucaucagauauaucugauauaaccuaagagauguugucccagagcagagaauguugucuacuagauuccaguggucauaggaaugugagacaccugaaaucaauauguaucuucauagucuguggugcugaaaucuagggacuuuucaacuuuaaacuugccugccucuuaaaucucuacuuaguaguagucauuuucucugcaugaaacagccaagucuuugaagauugauaaauccaaaugaaauugauaccuuugugccugcaguggaaaauugcuuuauaagaauccauagagccacugcaagggccagguccugagaauuuuaaauuuuaaaaauugugcgguuuuuuaaauuaaguuuuauuguaguuuuuguuauauguuuucuuacaaauacagaggauuuuggaauuuuuucauauuuugguuuguuguugccauuguggaguauaacucuaaaccuguagauuuuuguugcuaaaccuguagauuuuuguugcuauaugucgugacuagcaucuagucaaauagaaaucuacagcugaaccaugugugagcacuuuuauuacuuauaaacuuacuacuuuuaguauaugcuuaaaaugaaguccuucaaauugaaagcugacccaacucauagguuuuuauuucuuaucuuuuuuggagauggagucuugcucugucacccagcuggagugcaguggcacaaucuagacucacugcaaccuccaacucccugguucaagcgauucuccugccucagccuccccaguaacugggauuacaggcacgugccaccacgccgagcuaauuuuuguauuuuuaguagagacaggguuucaccauguuggccaggauggucucgaucuccugaccuugugauccacccgccugggccucccaaagugcugggauuauaggcaugagccacugugccuggccuagguuuuuauuuuuaagauaagcagcaacauuuuaagagcgccccuuucuccugucacuaaauauaaauaaacuuagcucaccuaaugaauuuuuuauuuuauaauaaaaaauuggguaccacaggguacaaaaacaugaucuuuagagccacagagaucuugguuuauauucuucccucucccuuuuuuaccugcauagccucgagcugguaccuuaaccugguucguaaaaugggauggcccuggcuaaucucacaagcuguugugaggaaucaauuaaauuagauagauuuuguaaagcucuuaauacagggucagcaguaaugcuacuuguuaucagucccacagugaaauucacuguucacagggagauggucagccuacauauaguguguauucauuugcaguagagucuuagugggauggugcaggugauuuguuuauuuguggggguauaggauauuguuaaauuguucugaaaaucaaaaugugaguuaauuucuauaguaaugcuuauuugcaacucauuagcuaaauaaaucucuuuaauuauuucauggauucccccagcuuaaagcuuaaaguccaguuucuuaaaguguaugagguaaaauggaaaaaauguaaauguaauaugggaaaucaguucucacauugcaguagaacauugaacuucuaucucaaacuaauuuugagauuccuugcuugaagaauuguugguagaguaccaccacugugaacauucccaaagcaggaaauugaaauauuuauauugcaaggcuuaucucaucuauaaagcaaagauggucuuccauuucccccuugcccacagguucccuuuauuaacgugguagaagcaccaaagcagaugggacaauauguuucuuuucuuccauguucuauucuuguucauugcagcagggcauuugucccaauuuugcugugaaccuugagauuauuuuugauaugcuuuucaaguguaaugaaauauuuauuccaucuuguuuccuccaugguuuuacaaaaacaacaagaagaagcuaauugccuaucauauacaaagaaugaaugccaauggacaauaaaaucuguaauuaggaacccacauggugauuugauauaguauugucucauagaagucuucuaucuauaguuauuuauuccaagccucuuuuucuuucccaucuugaaguauguuagaagagucuauuccuuaaggcuaaguaccuacaaaaaacaggcucuuauaauacaguaaucaaguuuucucaugcuuugggaguacacagaguaugcaaguacacaucuggcaccaaaccaauauuuuguuuccuugaucuuucuucauuuuaccuaguucagaguugcacuucaaacaaauucuacuugucauacacuugaaaaggcagcuguaggugguaggaaguuaauauuuucuuugaacaacauacagaggugcagacuuuuacuuuuuguaucagguuaaugagugaacuucucucagggaaauccaggugaacaucaaaguugagagcaggaagcauugauuuccuacaaaacacauucaccugauaucuuagucaguuuguguugcuauaauagaauaccccagccuggauaaucuguaaagaaaaagaaguuuaaaauucggcucucaguuuugcagguggggaaguccaagaacauggugcuggcaucuguugaggacuuccuugcuguaucauauaugguggaaggaagaagggcaagaggagggcaaaacugaguuuuauaacaacccacuucucacaauaacaaacccacuccccccauaaugauacuaauuuacucaugaggacagagacugaaucaccucuuacaggacuuaccccucaacauuguugcacuggggauuaaguuuccaacacaugcuuuuuagggguuacauucaaaccauagcaguugguuacuaaauuagugcuacuuguaaaaaaauacauguuugcugcauucagaauauuacauguuuucuuggaguuuuuggaaggacuuagcguaauccuugcuguucaugacuuagguuggcaagcucaaagggccuuaauuccccaucaguucuuuaaagggggauaggucuuaggauauuagacagcagaagucuucuuuuucuucccccauuauguacugcuuuuuggcauuguauucaugacacacacacacauaaaaugucauauuuucuuuaaagucaaaauauacaguuuaaaaugguuucaguugcuuucauaagagaguaaaacuuagguguucaguuuaauauuggaagaccuuguucaguuaaugugugccuuccaugaauaguugguauuuguucacaucaaaucaaaugacugucaguucucgggguaaaaaaagaccaaccuugacucaaaaagcuauauuccugcaauaaauaugaacauuuauguuuaauauacugcugugauuaauuauuuauauccuagugggaggucaaauauucuucagauaggaagggguauguaauaaauuuuuuaaauaucuaaaaugacaaaaauagaggaaaaacauaaucauccauccuauuaagucuguauucaaaggaugaacugaugauuuuaaauucaaauguuuccuuaauuuauaggucaugagagaaugggaagaggcagaacgucaagcaaagaacuugccuaaagcugauaagaaggcaguuauccagguaaaaccugaacccauuuccuaccaaacaucacaugccagcagucuuuuuaaugagugucugcagguuuaccuuuaucugccagcaccucacgugugauuguucauagucccaugaacuucagcuguucuuaaucauugucuaguaauugaguuguuuaaauccugccuuauauuugcucccaauuauuucaaguuauaauucauugccauaaaacucacauuguaacuugcaaucuacuuuuuauuaauaauacaucuuuucagucaccacaaucuucugcugcuucucccuccagcaaaaauuaugagaauuugaauuuuugauggaaaccagucucaaaauuaccuuaaguaaaccaacaguuuauuauggucaauuacuugagguacuguuaguaagagagggauuuuuuuuuaauauguaauauaagaguuucaagagugcauauauuuauccaaaguuauuagucaaaucagccuucagagagccuaugaaauacugauuuucaaugagaaaguagguuugaugaggguuggagagugcaagaaagugaaguaagcuauaaaacguagaauuagucaauguuggaaugacuaugcagucuuuaggauacuuuuuagcacuagaagaaaauggaauaggaugucuuuuuuagaagacuugaaauugcugcuucauccuacuuauucaguccccauggacauauguguuuaugauggcagcauuuccaggagaaaguggaaucuuuggaacaggaagcagccaacgagagacagcagcugguggagacacacauggccagaguggaagccaugcucaaugaccgccgccgccuggcccuggagaacuacaucaccgcucugcaggcuguuccuccucggguaggucucgcugcagccgaguucacacuucaggucacagcacagacaguaaggguggggcacugggaacuggaagccauacaaaaagaaugaggagaaaugccuugagcacuguuauucagagguucaaccccuguccauuccaucuugaaggucaaagggucacagggcagcuaccuccacaaggucaucucuacacagcagguacucacacuuccccacagagcagccagacaggacucccagggacucacauugcaagcccugacuugauuuaauauuccugagguggugacaauugauggcauaguucaaguucgaacacaaaagcuggaaggaugucuuccagucccuucaggcugcuguaacagaauaccauagacuggguaccuuaucagcaacagaaguuuauuucucacaguugcagaggcugagaaguccaagaucaagacaucagcauacuugguugucuggugaaaguuugcuuccugguucauagaacuuaaauuuuguuuaucuuuuauuuauuuuauuuuuguuuuuguuuguauuuugcuguauccucauaugguggaaugggcaagagagcucucugggcccucuuuuauaaggguacuaaugucaaucuugaaggcucugcccucaugccuaauugucucccaaagcuuucacccucaaauagcaucacacuguggcuuagguuucaacauaugaauugggggugggagagacacaaacauucagaccauggcaaaggauuuuagaaguaaccuugcccagcccccucaucauguaaguauaauaauauaacuaaggucaaggaaaguugagauuuggcugaguuguaagaauuuuuaguggaccagaaagaauuagaacucaaauuuccaucucagagcaguggccauauucucuguggggaagcauuugucagucaugacauuagcaaugaugagacuuauucaugguuuucagugaucauugccccaaaaaggcauguugagugguacaggcauagauguguucaccggcauucugugggagagcuuacuuggaauggaaggaacuuucugagcaugaguguguaacuuauguccacuuguucuuuuuuuuuuuuuuuuuuuuuaaaugagauggagucucacucugucacccaggcuggagugcaguggugcaaucucagcucacugcaacuucugucuccuggguuuaagcaauucucaugccucagccucccaaguaccuaggauuacaggugagccacgacacccagcuaauuuuuguauuuuaguagagacaggguuucaacauguuggccaggcugaucucgaacuccugaccucaggugauccacccaccucggccucccacagugcugggauuacaggcgugaaccaccaugcccagccauuuguucuuucuguuugucauugagcaagggauauugaaagcucugccugugauuguggaccgggccauuuuucuaaacagugcuaucaguuuuuauuuuguauaguuugaggcuguguuuuuaggcguguaaauguuccaggcuguuaggcccuccuugagccucuucuuaugaaaugaucuuuuuauccuuuguaauguuuugcuccaaaaucuacuuuaauauuaauaaagcuauuccagcuuucuuuugauuaauauuaauguggugcauuuuuccauccuuauacucuuauugaccuuguuugucuuuauauuugaaguguauuuuuuguaggcagcauguaauugggucuugcguuuuccuuuggauugggaagaccauguacacugaaugagguuauggauaugguugucacugaaucugucaucuugauauuuguuugcuauuuguccagucuguuccuuguucuucuuuuuuccucuuuuuuuuuuggauuaauuagaaauuuuuuaugauucuauuuuaucucuuuuguugguuuguaaguuacaacuaguuuguuauuuuacugguuuaucuccuuuguggguuuauaaguuauaacuaguuuguuauuuuacugguugcuuuaggcuuauagaaaacauucuaaacuugucacgaugauguuaugucaguucaaaugauauuauaccacuccacagacaguacuuuacaaaaguacuuccauuuuucaucucucucucucucuguaagcgguuguugucauacuuuuuccuuacuacauuguugauguuuuucuuuaaacaguuauuuuuuaaugaguuguaaauuuaaaaaaaaaacaacauguuuacccaugaagucaucauuuugggugcuguaaacucuuugcgcagauccagcugguaucauuuuccuucugccugagagauuuccuuuaaaaugucuuagagacugggcuugguggcuuguaccugcaaucccagcaacucaggagguugagauaggagaucacuugaacccaggaguucgagacugcagugagcugugauugcaugacuguacucccaucugggugacaaagggcauccugucucuuuaaaaaaaaaaguuugagugcacauaaguuggugaugaaaucuuuguuuggcuuugaccaaaaaugucccuuuuauaccuuugguuuugaaaaauauuuuugcuggguaaaaaauacuggauugagguuucucuuucacugccugaaagaugauacucugcugucuuauuuguguugauaucuuuaucuuuauuucucuaaaaauaacaugucuuuuuuuucuguuuuuacaguuuucucuauaucacugguuuuuaacaauuuaauuuugauaugccaugguaucauucagucugcccuuaauuccaucuggccguuuuucaucuuaucaccucacauacuguaguuguuguauauagaaauuuaaccugggcuacccccaacacccauaauaucgucuguaucuuaacuuuugaaccuauggaauacaguuauuauaugaaaacuguuuaaauauccauguuugcuaauucuaacaucucugucaacuuugaaucaauuuugauugcuuauuauuacauguggcauuucccuguaucauuuuaugccucauaauuuuuuauuaaaugucggacgcugaauuuaaaccuguugaaugcuagguguuuuuguaauauucuugagcuuuuuucugucacauaguugaguuacuuggaaacaguuugauccuuuugagcuuugcauuuuuagauuuguuaggugggauagaagcaguuaucagccuaggacuaguuauuccuuacuagugaggcaagacccuucucagucaucuaccaugaauguuaaguuuucucaccugacucgugggaagaggcauuauuccugucccugugugaacaccaagcacuguuaaugcuaauucuuuuuggugauuuucccccuggcuucaguuucuuucacaugcauguacccaucauuacucagcuauauucucagggaucacucugcacaucucuggauucucuuuuggagcaacucucuccucaccaauacccuguccugugaauuacaacuaccuugaucucuccacacacuucauguccuccacuccacgaguccucuaggcucuguguggguuuccccaccugaaaccaugaccuggaaauucagggccaugaguuuggcagcuguaaguccucauuuguuuccccuuuucaggaaucaguguccuucaccugaugucuaaugucuugcagaaauguuguuuaugccaggugugguggcucacgccuguaaucccagcacuuugggaggccaaggcgggcggaucacgaggucaagagaucaagaccauccuggccaacauggugaaccccgucucuacuaaaaauacaaaaaauuagccaggugugguggcgcacaccuguagucccagcuacucaggaggcugaggcaggagaaucaccugaaccugggaggcagagguugcagugagccgagauugugccacugcacuccaguguggugacagagcaagacuccaucucaaaaaaaaaaaagaaacgcuguuuguauaugaauauauuguccaguuauuggugguucaggcaggaggguaaauccaguucuucucacucaaucuuggcuggaauuguuugugcauuuuaugcaacuuaaccagaaagucacccauuugcaccgauuuuccucaccauuuugauuuuucuuucuauggauaaaguuacagugcacagaaagccaugaggagccguuaaagagcucguggcauucuuccaagacguaagauacuauuuacccuguucuaccgaugauaucacugcaaccucgggagauggagcggcugguucagggugacacugcugggaagggagaggguagagccgcgagucacuguggugccuucucacuagaacgagcuuccucucuaaacaaagagcuuuugaaaaagaauauucauauuagcguuuucauuuucuauuugccaaaauucucuaucuuagcaaggcacuugucaggaaauuuuuuuuuauaucucugcagaacaaaaguuccuugguuccucucuuuuuuggagaacacgcuuucaggagaggagccgugugaucauuugccagagaaggauaggcuggugggugcugagaccagaaucuuuauagcagaaacuugugaagcguuccagcugaaaguccaaucucuaaaguaagaucuuugcuaaauggacauugaugggacuaaaaauaagcugagggcugaauggaggcuuuaacaaauguacauuuaaacucucaguuuagucucaucagccaucacaggaaaggcaguggcaagaauguuugccgaagugucaucuuuuaucaaaggggauaauuuuagagugguuguaaucgugcuuauugugggccuccgcauugcuucauauggaauuaggcaacauguucauuugaaaaaaaaauuaaaaacuggauuaggaagaaauauuuuacugucaaaaaucagaucacuguuguugauugaucuaaggauuccuguuaaauucuuaacucggauuuauuuauuuauuuauuuauuuucucucucucucucucuuucucuguuucucuuucucuccugccuuccuuccuucccucccucccuccuuccuucuucccuuccuuuccuuuccuuuccuuuucucuuccccuccccucuucucuucucuaaucuucucuuuucuuuucucuuuucuuuucuuuucuuuuguuuucuuuucuuuucuuuucagggucuugcucuuucacccaggcuggcaugcagugguccagucguagcucacugcagccccaaccuccugggcucaagcaauccuuuugccucagccucaugagaguugggucuacagaagcuccaccauguguggcuaauuuuuaaaaaauuuuuguaaagacagggucucgcuguguuacccaggcuagucuugaacuucuggccucaagcgauccuuucaccucggcuuuuuaaagugcugauauuacaggcaugagccaccaugacucaccuuuaaaucuuuccuuuguaauaaaauguggcuggguggucacaggccuggagucuagggggcauuacuugccauuuuuguuaaguuaccaucuuuagguguucauuuaaguuuuaauguuguauggcuugaccuggcacuuaggucugcacuuuggcaggcacaagaaaauuguaaauaccuucuuuuuuuuuuuuuuuuuuuuuuuuuugagacagagucuugcuuugucgcccaggcuggagugcaguggcgugaucuuggcucacugcaagcuccgccuucuggguucacaccauucuccagccucagccucucaaguagcugggacuacaggcacccgccaccaugccuggcuaauguuuuuuuuuuuuuguauuuuuaguagagacgggcuuucaccguguuagccagguuggucuggaucuccugaccucgugauccgccagccuccgccucccaaagugcugagauugcaggcguaauuaaaugccuucuugaggacuuuuauaccuuccucuugaagacauaaauccagagcuuacuggugguugucugaaaaagaucacaucuuguaauaggagucauacauaaauauuucugagaucucccucauacuuaaccaccgugccuggaaaaugcagacaacuguauucaguaaaugguauuugaauauaaguaaaucaaaagugucguuuccauagauucuguagauguuaccacuuagaauaauuaccugucuaacccuuaacaaauucuaccguauauucucagacuuugcaaacacgggauuccaaaacaauguggauuguuuucaguuucuuugaagcucagauuuaaaucauacuuuuacucaguuuuuaaaccuaaacguggaaguguuaugagauguuguuuuugugcagcuagaauuccuuguucuacuaaugaauuucauuuccugagucccugugucugaguauacuguauguuucaaauuucugauuuaguuauguaccuauaggcaaauacacugaauggucaaccuaaaaaugcauuguuugacucauauuuagagucauacauauauaggcacauguauuuaaaauaaauacuuuaggcuagaugugguggcucacagcuguaaucccagcauuuugggaggcugaggugggaggaucccuugagcccaggaauuugagaccacccuaggcaacauagaaaggcccuaucucuacaaaaaaaaaaaaaaaaaaagauuuuuuuaauuagccaggcaugauggugcgcgccuguagucgcagcuacucuggaggcugaggugugagugugaaccaggaagucaaggcugcagugagcugugauggugccacugcacuccagccuggaugacaaagcaagacgcuguuccaaaauuaaaaguuaaaaaaugagauaaauacuugaaauauuacaauuauuaaaauaguuguuuuccccaugggaaaaaaaaguugagcagagcugugucuuugcacucagaaaaaacucuuacucuguugaaggcuagugacucuucuaaacaccaaccccuucaccuuuuuacuuuccuuagacuuucuuuggaaaaucaaggaguuagcacuuuuucccccuggaagaauuaaaugccucuccagaacugcagcacaggagguuaacuucuaccaccuuuggaggccugcaagcuaccagauuaaauacuuaaagcuaagcauucaucauuucuuaaccugcccucuacagucaugcacuuccugcuuuuuacuuugucagggcucguacucaaacuauucauagcuucaugaaacaggaacuaaaugcugucugagccuuuccccuuguaacucucagcguucugcuuauccuucauagacagaagaugaugauauguccugacuguugaagagaaauuagacuuaaugugauccuguacaguuaaaccaaaggccagauagggauuuuuuauuucaaucaacuuucuauuguaggccuagguuuggaaaaccuuagcacccccuaauuuguaagacuugaacuguuuuaaagauaagggauacacagccaaagcuuucuuuguaauucugagauuuuugguguuuuuacagauacuuagucuaaaucuuucaucagacaguuaucaugauuauuauucugacuucaacaacugcauuuucuaaagggaagugagaauuaggaaacauuuuccuguacaucuguuuaucuaucccaguuguguuguuuggauuuuuucagugucuuaacgauugaaaccaucuuauccauacugaaauucauuucaugcuucuaucugcugcuucacauucaggcuaucaguuuaauugagcaaaaaaaaaauguuggcaguuucuauagcaucggcauccuucuuugguuucucauuuuugaaugguucagccacauguuaaauuuugcugagaucucuggaaacuucuucacauaauucuuugauagaacaugaauucugugagacucuucauuaaagagcacgguuucaucacuaaguugagauuuugcucaaggcuauuugguaaauuccagcagaagagcaauaaauguucaacaagaaacagccgucauuggagauaacaaggguagacauuaaugggagguuugucacagguaaacaggugauggcaugagaagguuuaaaccaccucauaaauaaauuuuucgccacuauaugauguggauuacaacuaaaccaaacuuuaaccaauguggguguugguguaccuuucuuuucuaaagcaaaaaagaaauugugguacuaaacuugagcuuuuauaugauaccgcuaauugcccuucacccaacaaaccaauuauuucuacccaucacuuuucguugcaaaagaaauuaucuuauaaaauauauguauauagcauauaucuccaaagcaaauaugggacaucuguaccucaauguaacugauaguaaguuaaaaauuauuugcugaguucuugguauguggacagaugaauauuauaauguuuaaggcauuccaccagcagguuuugaauuuaaccaaaauuuuaugaagcuaaucagaauggaauuaaaaguugaaagacugccaggccaaaaagaucaucuuucagaaaaguaaauaauugcucuauacuuacauauuuauuauuuauuuguucaccauccguuuauuuuuaguugaguucuguauacauuggugagcaaagggggacucauuagcuugggcacuccuaagggcaaacccaauaacagauagugaaugggaaggaaaaugagagaauuagcauuuagugaacaaaaucuuauaaacuaugcugaaugguauacaugcucuuucaguaaagccacucaguacuauuacuucccuaccuucugaauguuuaccaaguucgauaaaaucuugcuacauacaaaugggaaguauguaacaagagauacuagugguuucuggguuuaauuaaguuacauagaacauuaagaaguauguugggaaggcauuagcuuaaaagcugucuuuugccacugaggccauauucaucacccagauucccuccacaguggagcacugcucagucacugccuucagaaugcaaauaggucuucacaggaugcuauuaaaacccauagcaccguaugguuuuacgcucugcuuucuuccagcaaaccuacguauuuuaauguuaauauauauguucauuuuaucuuugagaaugaaaauguauuaugaaaauauaaauauuuaguuuuuguagacaaauagcacauuuaaagauccaguaguuauucaccugccugguaugacugauagagaacagauggguagcaaagaauccucacccuggaaacauguacgcauacacacgcaaacacaaucucgcauaagcuuuaagggguucauucauuuugugaagguugaccauggauaccaguuuaaagaugccaggugauguuuggcuuuuaaguaucaucaccuugaguuuccuuauauaaauguuuuaauaucaacaaaaaacucagaauuucuaauaggucauaacacugccuagguaugggaagaggagaggguaaaauuaaaagaaaugcaaauguacuuuucuuugaauaggcuaaccaguuagaggauguaugaagcaggaccaccauaguccaaguaugaauaugcaaaauuaaagcagauugcuguaaaucucucuuaaaaagucaagaauaugucacaguuggcauuuuucggaugaucagaccguuugacaaaucucugcaaggguccgaguuagucgaacauaucuuuugcuuaugauuucagcaacacugugcgcuuugccuucuggguuguauuacuaauucuguucaucauuaaguguacacauguuucacuguuugacuaaacaaagcuugaagacauacaaguccaaacauuuucuguccuuucuguauucccaggucagaagaucuuagcucuuuauccauucugugcuagaguuugucugaaagcaugaaucaugggguuguguugggugcuaaauuucaguucuauaugcugccuucacuaauuuaugacuguggucugaacaaccaaaauaaauuauuucugagaacuagcaaaauacccuggaaaaaauuuaugaaaccuaccagauuuguaaaaaggucagccaggcgugguggcucaugccuguaaucccagcacuuugggaggccaaggcggguggaucaccugaggucgggaguucaagaccagccggaccaacauggagaaacccugucucuacuaaaaauacaaaauuagcugggcaugguggcgcaugccuguaaucccagcuacucgggaggcugaggcaggagaaucgcuugaacccggguugcagugaggggagaucaccccauuguacuccagccuguauaacaagagugaaacuccgucucagaaaaaaaaaaaaaaaaaagaaaagaaaaaaggucacuaagugaugagagaauuaaaaccacuccuauuuucuaccuuuuauaacauaaacucuugucuuuacuucccagguuugccaucuuuauaaccuguaacuaggagcaagugauuuaauaaagggauuccuccuauuccgucugcaaauuggaguuaauuuuucuccucuuucugcaauuucuguuguuuuagcuuuuguuagccauaauuagaaaaucaaaaggauucauugaaaguugagacaaaauugugaaguaggaagaugucuuccuccguaagaggagaaagauuguuagaggaaguacauggaggcuuuggugacacaucccuaugaggaagugaucugcuuccacgggaaggagagaacagaugauagaugacuccuagaugcuccugcgucauguucaguacaaaaucagagccgcaucagcaaaccggauacccugggaaggaacauugggauaacuccuuggccauaaacaaaaguuuugcucuggccuuaugacuaaguggauuaauagagauuaguuguucaauauccuuccaucuaauggauccauauuguuaaaacuuaagaaacaccaaagggggagagugugagaaucuacugccauuuucuccauugcuucauucaagacuucuguguccaccuuggcaugggauuaucauuugcccuuuuauacucaccuuaaacuacaaagaucauuuguuugccuuucugaagaaaggaagguggauaaauuuugcaggagacuuuaaaaauucagcucaacuccuggcauuaaagacaauaaagguggugauucagagguccccauggcaguuuccccaaauauuacguuuaacuaagaucaucucaagcacagagagacuuaacucucuaaagugugauuuuuaaaccugcacacggaaauuuucuacauuuuauaugcucaagauuucuugaaauccaggguguaaaacugugaaaauaauaguucugaaccuauuuaugaaagcaggagagaauugcuuuguucaguuuuggaaaccaccagggugcaauuuaaugcuccaggagaggguuuucugugaccuggaaagguuggggugauucccguacagugagucauuuacuuccuucuuggcaggauuaugcccagggcuuuuaaacgcucuugacacuucacugccuuccauaagaaacggguuuagggcacaagugucuauuaugauaagaugccagauuucuagaucaagcauaaagcuguggagugggacaauaggacuuaauaauuuuaauacacuucccacgugaacugucaaguaauaagcuacauauucagacgugacuggcauugagucauccugccauuagucaaauguaugagacuuuucccaagucccagcaacaccaaauuugagaaaucguauaaaagaaaaaugaaaaaguaaauacgucuaagaaauggggaaaucaauaaaaaauguacuagcaccaggggcgguggcucacgccuguaaucccagcacuuugggaggccgaggcagguggaucaccugaggucaggaguuugagaccagccuauccaacauagugaaacccuucucuacuaaaaauacaaaaauuaggucggugugagggugcacgccuguaaucccagcugaacucaagaggcuggggcaagagaauugcuugaacccaggagguggagguugcagugaguugagguggaggugcaccacugcacuccagccugggcgacagagugagacuccaucuccaaaaccguguuagcuuuuaucaggaaaggccauuaaauuuucuucaauauuaccuacaucaauuugacaucaaacuauaagaacacaauaugugagauguuuugaaauuaaugaaaugaaucuucucuuugagacgaguuugugcacgcuaugaaguccauuaaauauuuucugggaagaguucccaguuaaaacuacuuucuaaaguacccaagcacacuauauagauacaucaaguagguuuauuaaugucaguauuucggugaaaauugggaaggccacuauucugaguagagagguguuuguuuucuacuugaagacuaugaaggauauucugcacuacugggccuauuucugaaauuguaucuagcugcaaguuacucauuaauuuaauuaacaaauauuuauuagcaaccaaauuguggcaggaacugugccuagagguagaaauacauuacgcucuuguuuccagagaggaaaaugaguaauguucuaaaauguaaaucuuauguuucucuuuccucuugcuguaaaugaugucuaagccauuucgguggugccuguucuuaauccuuuaauaaauuauuuugaaugauuuuuuaaaaggcagugugauugugaggugaguuuaguacaaauuaaaaaaugucacaucaguugcaaacagacagcacauaauuaugagcuaaacacuguuucagaaacaguagugacaauaaauaggauucgguauaauuaguccuccugggacagaucucuuccucuguucuuugccauauauuuuaauaaugagauuagccaucuaaugccaauauaaccagacuguaguauuaauacacagaaaaauuauugcuaguaacagaagauuuaaagacaugagggugauccggauuauaugccugcagguuaaaaaaaaaaaauguuucuuaaacucucuuuaucaauauccuuuucgugagccacugaauucuuuuguuuuucugaucauaugaauaacccgucuuaaguaugaauauugugacaauaguaauagcaauuacuuuaagagaauauguuucuauagagauaacagagggguuuuucccuaccauuccuguaugaagguuucuguguuuuuaauuaaaauuuuaagaaauucaucuuugucuuagcauaauaaaauaaaccucacuagacaaucaggacaccuuguuauucuuagauacauuauuauagcucaagaaauaacaaauguuaagccuggaggauuuguauuuuggccaaaaguugugagggcaauuauuuauuuauuugagugaaauaugcaggaaucauauaucaaaaggagggaggucuuuuuuuuaaccucaacaaaaauauaaaaguauagggaacuguuaucuaugugaacccagcaaaucugagacaggucucaguuaauuuagaaaguuuauuuugcccugguugaggaugcaccugugacacggccucaggaaguccugaugacaugugcccaaagugguuggggcacagcuuaguguuaugcauuuuuagggagacaugaggcaucagucaauacauauaagaaguacauugguuuggucuggaaaggcgagacagcuugaaacaaaaagcaggaagacucgaaguggggaggggccuucuaggucagagauaggugagaugaacaguugcauucuuuugaguuucugauuagccucuccaggguagacaaucagggugauuggcucuaagcaguucccagcuagacuuuucccuuuagcuuagugauuugggggccccaagaauuauuuucuuuuuacaccuguguuuuuucuuucuuaacuaaaaauaguauuuguuucugagggauagagauaacuaccauuuuauuugguaugauuuauuugccuaccguccaacaaagaagguaaucugauuuuguuuucauuuccaagcaugauuccuagagauguguuuagguggccaaaucaaugaagcagaacccugcaaauucauuuauugggagauauccuaaggucuuccugaauuaucugauguucccaggcuuugcuuauccaauaggcauuaggaagaaaaggcuuguguuuauguagaugcacacaaaaugcgcaucucagcuuacauaaacagugaagggguuucccaggucucauuaucccuggaggagcugaggccuggggaguccucagagccuccuuugcuacucuguuauuguggcaggccaaaucucacuaaugcaggccuccguaacagcuguuuccguacugacugagugguucaguuaaauacuaaaagcuaaaaaaaagccagcgcccuuauacagaggcuggaauguaacaaaagcccaccaagaguuuugccuaggccuuuccuggcaaaaccaaggaauucuuaacaggacccauuuaggauuaacaaguuuuacugggagucugaagaaacucuacaggccuccaagaacaaguuuacuggaggucugcaggaacuccucaaaccucccugauuuagcaggagacaagauaagaguaaucaccccagcaccuagacccauuuagauuaaguaaauuuacugagacuccagaggaaggucuucaggacucagaccuuaguuauggauuaaagaaguuaaucacuucugucaugagaugaaugcacacuuacacguagacauacagcuuagaaggcauauaaguucuggaaacuuuguaauuuugaguuggucuggcacuaauuuccaggccaucucccuguaaaagguuacaaaaauaaaaacucucuuccucccaguucaucugcaucucguuauugggcugugagguauaguagcccaacccucaguucaguccgggaacauuauuaucaaacucuggggauuuucaggauaaguuaggaauauauuuugaaggagaauggcaguauuaaaugagaucagcaauugaaaacaugugaauacauucaccauuuaauuacccaucucaauagaagauaaggaugaauuuagcacuagaaaccaugaaugucacaaaagccuaacuuuaauaccuugaaucacuuuccaguaauccuaauccuuuauccacauggauagaggacauuccuaucuugcucuuucuucuccccacacauuagcuuaauaauuagcuaaauaauuucaugcauuagcuaaggaauaauggaacuccagaaaccuaggacaguaauugagagacugaacaagcuaaaucugaaccuucugcacaauuaaaggagcugauguuagcauggcccacagaauauuaccugcacuuguaaaaacuagaaagucaggcaaguacuccuggaacagacugucuuuucuaaccaugcacuuauuucuuuguuuuuaacuuuguuuuuguuuguuuguuuuugagacggagucucguccugucgcccaggcuguagugcagugguggaaucucaggucacugcaagcuccgccucccagguucaaacaauucuccugccucagccucccgaguagcugggacuacaggcgcccaccaccaugccuugcuaauuuuuguauuuuuaguagagaugggguuucaccauguuggccaggcuggucuggaacuccugaccucgugaccugcccgccucggccucccaaagugcugggauuacaggcgugagccacggcgccuggccuguuuuuaacuucguaaguugcuuuguagaacuaucuuaaacuuggucuauuuuagauucuccuugaagggccagaucacaaagugauuaggagaaggaggcucuggagccaagacagugagacuaacccauucuucaaaucuaacacuaacuagcuguguaaccauugggccagggauguagccuauguaaccacaaucuccuuugugcuucaugccucaccaauaagguggggagagcugcuaugacucugucauagggcugagacgaagauuugaugaguuaccagcaaaaagcauuuaauauacugucucauucagaagcagucaauacacauugaacucuuauuacuuagaggaaagaaaggggucgaugauuuauagauaaggccugagugaaagaaauaaauguguauugaguaucagcaauggacuacgcaucauucuggguaacuaucacugaacacauuuaaucugcaaauacuaucugaaagauacugccaucugaauugcauaggugggaaaagucaaggcuuuugugcuuauuuuuaaauguauguuaacaugaauaauuaauuggccgugcacuggucgcacgccuguaauccuagcacuuugggaggccaaggcgggcagaucacgaggucaggagauggagaccauccuggcuaacauggcgaaaccccgucucuacuaaaaauacaaaaaaauuagcugagcaugguggcacgugccuguagucccagcuacucaggagacugaggcaggagaaucacuugaacccaggaggcggagguugcagugagccaagaucacgccacugcacuccagccugggagacagggcgagauuccaucucaaagaauaauaauaauaauaauuagugggaauauaugcuguuuguugugauaggagaagaaaaggggagauccagauguuggucaucagaaaugaccugcaucuucucuaaauugaaauuuagcuugaaguaguaaugccaaggccagccuggggccauggcauccugguguaccugcuuguuggugacaguccuuuuaggacaaaauaucuuacaaaaacauucauagaugacuaacuggaaaaaaagaaguuaugaugaaaagcaauucuuacuguuuuuguuuuuuguuuuuuguuuuuuuuaauuaaaagacaggcaguuauucucuuucccaggcuugaguacagucgugcaaucagggcucacuacagccucaaccuccuggguucaaauaauccuccugaccaagcuucccaaguagcuggaacugcaggcaugugucacugcaccuagcuaauuuuuaaaauuuucuuguagagacagguucuuguaauguuguccaggcuggucucaaacucuuggcugcaagugauccuccugccucagacucccaaagcaauccuuacuuuuuuaauugaagugcuuuuuuuuuuucuuauuuaaacucuuaaaaauucaucccauuuucuucaaaacaauaaauccuuuacaagggagaaaaaugaaauagagcaacuaagaaagcauccaugaaggccaggaaggaacaucaugguuaaaugcgauuagucacagccccuucugucuccagucuuggaugaauaaugguaacagaacuagagagauuucuaagaccuuggugcuuaauaacaagcaagcaucgagggugguugugcaagauccugaucacacaacucugcauaucaaauauccuucacaaucaacaagagucagccuuuaaucucugauguuuucaaauguucuuuuuuuuuaauucacauguauaaccuauccucuuuucaauauauagagauauagcuuaucagucauuaccucuuuuacuacuuuucuucugagauuuaaaaggucauccucugauuuguaaauucaaccagauuucacaguucagaugagaguuguaauaaguugccaagaacuguugcaagcugugauggcugucuuucuggggauuauagagaagcacauuucuuuuaggaaaaaagaaggcagaugagcccaaguuguuuuauuuuuauuguguauauguauuuguuuucucaaguacaguagcauggccucuguggcaggcauucaccaagcaaauacagagcacccucugggucaagcacuguguuauugggguuccaaauaaagaaaaaagaccaaauccagcccuguggaucucacauuaaagaggggaguaagaaucauagauaauuuaaugaguuagguacauuaauggggauuugcacaguauuucauaggagcacagaaaaaggguaccucguuccaccugagauggcagggagauggcuccuaaguuaacuaagcaaaaggggaaggagaggcacaucccauaggauauggauaacacaacaaaagcuccauuaccacccgccccaccaccacacacaccaucucuggaauaaauuuuguaccuuccaacugguuuucaggguacucaugacacauggguuaauaauagcuagguuugcccaaaugaccaaaauucuauucccaacaugaauuuucacaacugguuuuuuuguuuguuuguuuuaaugaagaagaaauguuguguuuuuggaaaucaucuuacaaaaucauguaguggaaugcauauagugaugaaauuguugaagaccagggaaucuuuguccuuaguuuuuauuaggauggauguuuucagguaaaacuaaaauaaaaaugaaauggaaccaauuagaaagaaaauaggagcacuuaagacgaaauguaauuguugcugaaagaauuagaaucugauagcuuagaaagaacuuaauuaaauuucagaguaaaauaaauacaguuuagcaauggccuuucuccuagaaaaauauaaugucucuuacaguucaguuacuccuuggcuuacaaaauagugguuaaauuuccuguuuuucucauuuugauuucguauguuacauguuacuggugaugggauuaucugugugacauuaccucuggucuucaaaauguacacguagcaauguagucucacauaugccccuugggugcgaaaagagaaggaccuaacuuaaccugacagaccucaaaucuguucucuuucuauagcagaguacuccuauuuaaaaagaaaauguugaguaaggaggacagucaucauauaugucgagaauguuaaaugcucuuguggaagugaaaagcagccgaucuaaguaauuacccauuaagaaaggaguaggagaaauguuuagaaggcagaccugcaaaaaggugacucacaguacguucacaugaccggaugcauuaguggaaccucuaacccaucgccaauggaagaagcaguguuuugcacaaacuugaaaaagaguuuuucauuuuccucccacagccucgucacguguucaauaugcuaaagaaguauguccgcgcagaacagaaggacagacagcacacccuaaagcauuucgagcaugugcgcaugguggaucccaagaaagccgcucagauccggucccagguaagcgugggguauaaucaucuucugcagcuuugacaauccaggauucuugcuucuuggguuggugacaggaucccacgcauucuccgagcaccuauagguguuuucccuauggcaagagcucuuuaacuucugguaaauucuaaaagcuugucuuagagcaauaugugguuuggcauuuucugaguuaugaaaauaacaaauguaaaaaucuuagucuacugcuaacugauugcuaaggaacugauuaaaaccaaugacuaaaaugagaaaaacaaaaguuguauaaacuaaaaucuugaaaacugguucaacugaaguauggcaggcaaucauaaaccuacuggaauguugagauuucaugugagccuaaaugaagcccaguaauaauguauuuuauacuccccgguucccaaaggcugaaaacugggaucuaccuuaggaaaugugaaauuuuacauuuucuugaaugaaagaguuaaauauauauagcaugaaauagccaaucaaauugaaauacguuguuuucuagggggaaauuugcaaagaaauguauuuaggcaugaggguccuguuaagagagccucaguauuaggaaucagagguggcagagguagccuuuuuaauuggcuguuauaagcauacaagauaaugguaaguuucaagaucaagucuuaaaccugagcucaaaaaguuagagaacagaaauaggagaacaagaaaaauaaaguugcccuuucaguucaaccuuuuuaacaguagcaguguuuugucaguuuucuuuuggaaguuuguaucuaccugcagugcuugguaagaaaaauaaccugggcgacagagcgagacuccgucucaaaaaaaaaagaaaaaaagaaagaaaaagaaccauuccuacccccagacauuguugaccuggaguugucauccuuugaugcagguuaugacacaccuccgugugauuuaugagcgcaugaaucagucucucucccugcucuacaacgugccugcaguggccgaggagauucaggaugaaguugguaaguaagcuguucuuuugaugcugcacauggacauguauuuucccccagaggaaaauugaggaagugaguuaucuguuugaggaauauggaaguuaauagaacagcuugccuuuuacgaugaaacugucaggcuggaacuagcuuacuagccuuagcaauugaaucaguucuuaccucuccauacuuguaagacuggaggaaugucgccugacuuaggguauaguuuuguaauaauuggacacuuguuauugaauuauacguggcagcauuuuuucuaauuugcccaaucuuguuauggcucucaaauuaugaugcuuugguacuuuacaauuaauggggaaaaaaacucauucuucaucuuuugagugucacgauuguuccaucuuacaaaugaaaaagcucaaacuuaaaauuugaguaacuuacuggccugugucacaugcauuauaaguagcacagccaaaacacauaacugugacuugugacuuugagguuauuguuauauucaguaagucacaauucucuuugauggcugagcagggaagccaugaguguucucugaaccacaucauuguuuaaacuuaaaagauagugggcuauuaaacuuauauucugaaauaauuguacucucacaagaacuuggaaaaauaguacagagaggucucaugcauccaucacccacaugccucaccagugacaucuuacguaacuauaguccauuaucaaaaccaggaaacugaccuugugugcccacugucuuuuaugucccuaguuuuccuaaugacuaaugauuucauuuaagaucucucauuucuguuucucuuggaaagagaaucaaauaccacaugagucucugucagcugccaaaaugcccauaacuguuuaacuuacuucacaaagguacauagaugacgauuauguuggugcaucuuucaauauaagcauauguaccuauacuggagauuuaguguguagucuaccaacauauaagcaauauguaucuggcauauccuuccccauaaagaauccuacccuuuguuaauuggguuggaaauagauacagguuaucaucuggaaucagagcacccaggauguuguagauggauguacccauuacaguaaguccgacuuugaagugccugaaacaccgcucaagggaacagcuggcccucacuuuuucccauuuuaugccaguguuauucugcucauucuuuccugauuuauguggccuuguaaauauuguuuguauugcugugaaauauuuggcaugugucaagugaugauguucuguucaguacugcacauuaauggacggaaucugaaauuauacuuugagcuacauaacuugcagaagaaacuucauaugucagggaggugcagugucccagaacuuugggaggccaaggugagcagaucaccugaggccaggaguucgaaaccagccuggccaacauggugaaacccccucucuaauuuaaaaaagaagagaaaaaaagcaacuucauagugugccaagcuuuuguucagaaggagcaacucaguguugagcaagaauuuaugaagauaguggagguggaguuuuuagucuacaccaugaauugagaacagagaucuccaauuaauuuuucacuguaucaaguuucuuuagcaaacaaauauacuuuucagguauacuuggagaauagacaucaguaaggaaccuuuaaaauacuauguauuaaauaaguguaaagaaguucuccaaaaaguuguagaagguacaaaaugaaauaauuuaucagucuuaaugaacugaagcuaaaaucuucuagaaaacaugguuuguuuguuuguuuguuuguuuuuuacagcuaucuuaagccuguuuucacaugugacuucaguugaaguggcauagguaauaacuauagggaaauaagccauuacaaaggacuaaaaaguugaugaccaauauuccacccucacccagcaauuauuguugacucuuuauaauuaaauuauuagaacuuuuuauuuggcacuauacuacugaaaacauuagccacuaauuagucacacuuccacagaacagauggugguucagauaucuugaauauuacgaaaugcccaagaauagggcagcacaauaaacuucaaaucucaguaccagggaggauauuuagauaacuaguaucauggaaucuuuuucuguaaaaagaaaaaaaaaaacagccauuagguuggauuaagaacauauuagggggugcagcacaccaacauggcacauguauacauauguaacagaccugcacguugugcacauguacccucaaacuuaaaguauaauaaaaauaaagaacauauuacguaugugcucuuaauguguguguguguguguguguguguguguguguguauguauguaauaugcucucaauccacccauuaguuggguuuuuuuaaguaaugacauauauaucauucuaaauauaccagaugccacauucugaaagauaaucuuuuuuaaaaaccuuucauuuggaauccugggugcuuccauuuuuaaaugacuguucucuauagaaagagaaguuugcaauaacgaacccuguacacuaucugagcugcuagugucaaagcuacagaagugguuugcuggggagaauagcuuuucuggguugaaccuaguugucaucuauaguccuuuuucauuugaaggaacauuuaaaacaauacgucccuuuuuaguaggaauauaguugaaacuucaagauuggccaggggugcuaauugcuuaagccaaauguuauuagagguuccucauguuauucuuuuuacuuuuguauguguuuaaaauuucucauaauaaaaaguguugcuuuuagcuuacuuucuaaauagguucuucauagauuuuuuuuccagguuaugucuuguagucguucuaauauucucugauuaaaugcuuugucauuagucugaguugcauuuauuugcuauuucuguauauaaucaaauuuuagauuuggagucaguucaguacaaauagcauacuaaaauucagagacacuggcaaaaggagaaaauuuuaaagucccuaaaaaugcaugccuuuuguauagaaguuugugcuuauaaauacaagcaauuaggaugugcuuaaugcagucaaacaucuguagagagauacaaugguuuaauuaaauaaugguaacaguugcuuuauggauaagagguuuucaccagucuggggaacugccaguaucuuuagugggagagguauaucugcuucaguaaauuaugcuuccaauuagaauucucuuuuaugggugaaaaugaggaagaauggagucaugcugagaagaaggaaugcuaucggugaaggggaaaauugacauuaaauuugugagcaguaaacugugaccagagcauaggguucaucaugcuugugaguucuggcccuggccuuguaucuuccauugugcuucccugaggcauccugucuguucaugcuacuuucccacuaacuucagugaaucccaaauucaugggucuagccacagccagcguacugaaucccagugccauauuccagaccccaaauaucccaugugccucugaaccugcaaucaauguguauaacacucauguccuucuggaaauuuacuuguuuuacacacucuauucugaguucucuugguuggccuaaacuauccaugaugccuuccucucccucacccauuauuucuuauuaguugcaaguucuguauauuuggccuucuguguucaugugaaaucucugcacauccccuacuuaccugagauccuguccucucaucagugucauuagacucccagccagucacccuaccucuuaucucacauuggcccccucccacuucaauuccuccuuuucggaacuaugcaaguucccuuaaaaacaaaagacaaaacaaaaaaaacagcugcaggccggcggcaguggaucaccugaggucaggaguucaagaccagcguggccaacauggugaaaccccaucucuacuaaaaauagaaagauuagccaggcaugguggcaggcaccuguaauucccaguuacucaggaggcugaggcaggagaaucacuugaacucgggaggcagagguugcagugagccaagauugcacuauugcacuccagccugggcgucaagagcaaaacuccgucuccaaaaaaaaaaaaaaagaaaaaaaaaaagcugcuugugguuuuuccuugcuugaaaaguugcaccuuucaagauucaaguaaaaugcccaaguccuauaaacccuuucuaauuugcauagagaacggagaaaagagcuggcauuugagugacaaccauguaaccaacuaaugagugccucuuugugauaaugcugauggucacauucuuucuuuaugaauguuccccguugagguacaggaccgccauauagagauguggcaguggcaggugguuuaggguaagaguggagacugauaauuuuauucuacaucccacucaaggagccaagcccucuggcauugugcacacccacuggaagugggcuguucuugcauuucacacaaaggcagcauaugggcuagugaagauacucggaaauucagugauagcauccccaguuuacaguugaagaaauugaacuuugaaccuaagagaguuugccaacuugcccagcccagauaguaaagugaugaaagugggguggaagccaagaccugccagaaguccaaaaucuguguucuuucugcugccuauuuuccucucugaaguggaauuuuccccuacuuaaccucaaugugaaagcacuggguauccaccuccaauaccauacucuaacuuggaguaaauuauuuguuuauaucucuacuaacccuccauccugugaacucuuccagauauauguuggucauccuugccuccucaagauccagcaaggacccugguacuuuuuagauauuaguaauuauaaauauaagguugaagccaguccccaggauaaaaaggcagaugcuccuuaacuuggacugaugaagugggcuccuccguaacccuaaagaccugaccaaaacuccuuccuugacaucuagcguaagcaccacacaaaacaaauuucuuuccuaggccacagcauccucuaaagcugugauugaucaagcuaacuaaauggaugugguuggccaagauaacaaagcauaaaucaggguucugaggaccuuuauuaauaaaauuuuacaacaugguccuucuuuguaccaugacccucugcuauuuggucaucuacuugauuuaauugugcuguccuguuugaccgccaaccacagucugaagcuauucccaugacaaauaagugugaauuuucaaguguccuguuguguuauaaaaggcccguguuuuauuuuauaauuucauauuuuuuucauucaauuuuaauuauuaugugcaaguucccaggcucagucauuuauuaauguuuuuauuuuuuaaaaaguuauuuucaggcagauuaugaagauuucuugcaaagaauggccucaggcauuguuuguauagagauaaaaucuccucuuuuaaaucacuauguaggucuucauuaauauuuuuucauucaacaaacgauggaaucauuauuucagugaaacuauggcuccucuucaguguucauauucugcuuuaauuauuuauuaauccuucaaaagggcagaaucccuucauccuuucaaccuuugcuuugucaaauuguuacuuaaaaaugaugguguuuucuuuguccuuuguaaucuuccuuaaaucucugcuaaaaggauucuauucuacucuuuguauuggcacugagguuauuuaucaaagugugcuucucuuugcagcuaccucaaggcuaaaaauguagcucuuuucagagauggcuguuuuacagaaugcuauaauaaccaauuuaugagaaaggcaguaggaaauaaagagggaacaaaggcauaauuguuucauacccauuuuuuuucuucuagcauucaaaauuaauaaaaacaugaauuauuauaaaccagaugcgggaaagaucucuggcugaauaaauccauagugaauggggcaggauugaaagauauggcggggaaucaagaaauucgcaauaaugaaaggaugcuuauuuuuuauuacaauuuuacuguggccucuugauaaaauguuccacucuucaggaaaaaugcagcaugguuauuucaaagacaguguuuccauauucuguuucuaauaagccuguugauuuggggguuuaguggguccaaaguagacuagguuuaaaauagaauauuuauagcacuucccagcccaacaaaauagaaauuuaauguuauugagaauuucaaguauccuuauguguaauuguuagucaaggaugaacaucaaaaaaaaaaaaucauaacagcaaauagagagcugucacuuuguucuuauaagaacauaggugugacuuuguuuuucauaagaaaugacuuuuaaauguauauagauuuaaugguuuacagcugacuuaaguauuuggacauaagaacuuuuuuuuuuuuuuuuuuuuugagauggagucuugcucagucacccaggcuggagugcaguggcgugaucucggcucacugcaaccuccgccucccggguucaagugauucuccugccucagccucccaaguagcugagacuacagacgugugccaccacaccuggcuaauuuuuuuguauuuuuaguagagacaggguuucaccauguuggccaagcuggucucgaacuccugaucucagguggucugcccaucuuggccccccaaaaugcugggaauacaggcgugagcccccacaucuggccaagaacauuuauacauauuaucaacaaccaaagccuuguucccccauugguuucauaauagucucagagcuccuuauucauauuuucccuaguguuauuaaguaacagacaugaggccuguaaguuuagcugccugugucuaaauguauaucuuugacccaagacaauuucucuuucaaaauagaaccacucauuuauaaaugaaaaugcuuugucaaaugaauggcaaaguacgguauacuauuaagacagccuccuaguuuucugacauuuggacugccauguugaaaugucuccacacagcaagauacaaaugugugaaugccaguacacuucauaccuuagguccccaacuggucugucugcagacuugagguuacagaccugcaggugucgaacucaccccauaguggugguuaguagagugcuuuguauacguuuagcucucuaugccuuuuuugguugugauauuagguaagcucucuuuuucuugcuuuggagcuuaauuauggaaucuguaaauauagugcauaugucauccagaugaucuguggaagucauugauaaugaccuuuaaaaauucacauguaauacagcauccguuuuccugaaugauuuuuauaguuuuaccauuggcaaacagauacuuucuuuuauguauuucuacuccauaauuuuaggaaaaaguaaauccuuuuagcuacauuaaaaagaauacacuuucuaggaauaaugaauguaaaaaaaguuuccuuuuuuaaaaaaauauugcgcucucuaccauucuggcagacaaauuguugaccuuaauauguauaauucagugcaguauauugaucuuguuuauugugcuccaaauggacgcuggcagaaauuugaggaauuaaauaucaaccacaguguuuucuucaugcgauugcaaugguuuguuauggauuauuuuguucaguucaaauaaaugauguacguucagauucuuugcccaauuuuuuaauuggguuguuuaccuuacuuucuuaauuuuauuuuuauuuuuauuuuuauuuuuauuuuuggagacagagucccgcucugucacccgggcugaagugaagcggcaugaucucaguucacugcaaccuccgccuuacggauucaagcgauucucgugccucagccuccccaguaguugggauuacaggcacaugccaccacauccagcuaauuuuuguauuuuuaguagagacaggguuuuaccauguuucccaggcuggucucaaacuccugagcucaggcaaccugcccaccucggccuuccaaagugcuaggauuacaggcgugagccacugcacucggccugcuguuauuauugaguuguaagaauuuuuauauauucuggauacuauuaaauucuuaucaaauacauuauuuggaaauauuuuacccauucuguagguuguauuuucacuuccuuaauaggauccuuuugacacacaaaaauuuucaauuuagaagucuauuuuaucaguuuuuucuuuuguggcaguuacuaugguaugguaucuaggaaaccauuguccgaaacaagguuacaacgauuuauaccuguuaccuucuaagaguuuuguaguuuuagcucuuacaguuaaaucuuugauucauuuuaauuuucauauauggugugagguagagguuugacuuuauucuuuugcauauaaauauccagugucccagcaccauuuguugaaaaagacuauucuugccaggugcaguggcucaugccuguaauuccagcauuuugggaggccaaggugggcagaugacuugagcccagaaguucaagaccagaaugggaaacauggcaagaccacauuucuacaaaaaaauuauccaggcaugauaacaucuauuuguagucccagcuacucaggaggcuguggugggaggaucuccugagccugggguggcugaggcugcagugagccuugaucacgccaccugggcaauagagcaagacccugucucaaaaaaaggaagaaaaagacuauuauuucccccauugaauggucuuggcacuauuacacaaaaucaauuguccauagauaauauggguuuauuucuuaauucuuaguucuuuucuuugaucugugugccugugcuuacuguaguaccacacuguuuugauuauuguagcuuuguaguaaauuuugaaaucagcaagugugaguccguuaucuuuguucuucuuuuucaauauuacuuugaguauccggagucucuugcauuacaacaugaauuuuaagaucuuccucacccccugcccccacuaccauuucugcaaaaaaaaaaaaaaaaaaaaaagugcggauugcauuggaucuguagaucauuuuggggaauauuuauauauaauguuaaugagguuuuaaacaacacuuuuaucuacuagaacugauauuugccucgaaaugauuccaccuugagccccauucaggaacguuaguauuuuagaaguagcaagagaacugauuuagcaugcuaucaucuuuuacuccaaauuuuggugagauuccagagaaauuauuugugagcuuuuccuuaagccaugaugacugacaugucaguaguuuuugucuguuuuuaugccauucuuuuauuuuugugcaugugugggcaccucaaccaaauggauggagccugaggcauggucucccacgccaaagucugccguuucuuuugaugauccaaugcaguuccaaagcuauuuucucaacucaccagcucguuuguauggcccuguaauuugaaacaaaaucuaaaaagaaauccaaauuaaaaugauugggaagugaagucagaccacagugguggcuguggaacuacuuccuggcauggaacacuagagcagauguguccugcuuuuuuuguagagucuugggaacaaccaaugauuuuagacuggaacaagggcugguuauucuguuuuucacaagcaucugccuucaagguucauuuuuuaaaagaggaggggaaaaaaaucagugauguuugccacccugaguauggagaugaauccaaauugagauuaauuuugaaauauguuucccgaauuuugagauuaauuuugaaauauguuuccacaaacacuaacugggaaugacaugaguuuguuucaugugagacggaguuuggaagacauguuaauuugcuuguugguguucaacucagaaacaaauuuugcauguauuuucugaguaagugccauuauuaguuaacaguuuuccugccguaugcacuaugggcugcuuuagaaaguaaaucauagaagguuaguuauaauaucucaucaaaaauaguggauccaucuauuaaccgguuccaaguuaugagacguguccaaaggaauguugacuuggugugcaccuaaacacuauuugugaagaggcuuuggacuucgagcaugaaacggggucagagggucaaggccagggcguuacuuaauuucagcuccuguugauggauucauugacuucagauagugcguuuaaaaaagccuguuuaauguguuugucuuuugauaauuauuauguauuuacauaugcuccuaaaagcaugaguuaaaucuuauuucuuugaaacagugcuuggcaacaacuuguauugucuuguacaugccuuuugugucuuugcuuuugguugggggggggcauugaaauuugucugcccauccccugagggcagauacugagguguggaccuaugucuucagcuuccuguauagcauugaaguugcuauagcugcauguucucuaaaauuuuuauacaugcgauuuaauuguuaaagcuuaugauuuuuaaguauaguauucugauagcaaauagauuuugucaaauaaaaacuaacuuuaucaucaccacugagauaucacuagguauauggcuuaguucucagucaccacuuuuauuuguaaggaagucuuagaaguuuucacaaguguauaugugauagacugggcacaguggcucacgccuguaaucccagcacuuugggaggccgagucaggcaggaguucgagaccagccuggccaacauggcaaaacccugucucuacuaaaaauaaaaaaauuagccgggcaugguggcacaugccuguaaucccagcuacucgggaggcugagguuggagaauugaaccuaggaggcagaggcuguagugagcugagauccugccacuucacccuagccagggcaacagaacgagacuccaucucaaaagagaaaaaaaaaaaaaagcugggugcggugcucacgccuguaaucccagcacuuugggaggccgaggugggcagaucaccugaggucaggaguucgagaucagccucaacauggagaaaccccgucucuacuaaaaauacaaaauuauccaggcgugguggugcaugccuguaaucccagcuacuuaggaggcugaggcaggagaauugcuugaaccugggaggcagagguuguggugagcugagaucgcgccauugcaguccagccugggcaacaagagcgaaacuccaucucaaaaaaaaagaaguauauauaugaugcuugcuuuagcagcacauauacuaaaauuagaaugauuaaagagauuaaccuggccccugcacaaggaugacaugcaaauuuuguaaaguguuuuauauggaacuuuacuuacaugagguaccuaggguaguaaauucauagauacagaaaguagaaugcugauugccaggggcugagaggaugagggacuguggaguuaguguuuaaagggcacagagguucaauuuggcaauauugaaaauaguucaguggggaagauggauggccgugaugcaucguccaucacauugcacagcaucgugaaauauacuuaauacccugagcguuacacuuaaaaugguuaaaacaguaagauuuauguuauauauauuuaccaugauaggauauauauauguauauucauaucauucgccauugugaauagcaaggagauugaagaaauaaggacacaggaucuucaauaaauauguauuaaaugcuucccauguuccacauucuuugucauugccagacacgucacagguauaagggcccaaucuuuguuacucaaauaauuuagaauaauuuagaauuugcuuggggagacuuuggauaaacaguuaagaagcuguauccauuagguaaagggacauugcuugcugcgucucguagcauuugguagucucguuagacagccguucuuacuccuaucguuugcugaaauuuauuagcaaaggaaagaaucuuaguuuucagcucguucagccgcaugauuucauaggcucaggaaaaccauguaauaugcccaaggucagacgugaugaauaagacuaaagacugaaucuauuccagugucucuguguccagugauacuuacuuacugcuguugccaaguuaaacaaaacuggguuugcagagcuguuuauucaccuucagcaucuuuucauugaaaaugcgguagauagaagaaaugucccucuuuuagcauuuguaccucaguaauaagaugcuucccaagcucaaagacuccacacccuuaaauauguaagucaguguuaagauauuuaaagagaacaugaauaucagcuacauugugcauguugcaggaauuuuauauuauuuuguaucuucugcuuagaagucauaagccagcccaugaaccaugccaacaaacauaccuucuuccaugugauuauugcagccagauuuuucagugcaggacaagcaaaguuuucucugaaagcaugagauaauaauucucagccaggucuucgccauuugcaagggaucagacauaagaguuuuuagcucuguugauguuaauagcuagagccccuguuagcagauggcauguuaguggccuguugcugcuggcuauuaaaucauacacauuggccaggcacggucggucacaccaguaaucccagcacuuugggaggcugaggcgcacagaucacaaggucaggaguuugagagcagccugaccaacauggugaaaccccaucucuacuaaaaauaaaaaacuaggcaggcauggcggcacaugccuauaaucccagcuacucaggaggcugaagcaggagaaucacuugagcccgggaggcgaagguugcagugagccgagaucacgccacugcacuccagccugggcgacagagcgagacuccgucucaaaaauaaauaaauaaaaauauuaaaaguaaaugauacacaucaugagaucaucucccaaggcagcagagaauuuugcguauuuuuuucuuaguuuauauuguugcaacagaguaauucuucuugaucacagacuuugcuuuuuuuguuguuauuguuucuaaguuucacuugauccucaaaauaaccugagacagacaaaacagauagguuuucccauuaaucuccuucaugagucugacuuugccagccaggcugaucuuauauccauagcccuggaugcauuuauuuauguuauuccaucugccuauaaugcccauccccaaucuuggccuauuacaugugucuaacauuacuuugauguguacaugucagugaauuaccacuuaacugauuguuagcuuuuugagaguauguaucaaaucucaugugcauuuguguguccugaaacaaauuauuagguauaaaguauguauugcaaauaccaugcccagggaauauuucagagcugugguucuccaagugugguccuuagucuagcaacaucagcaucgccuggcaucaccugggaacuuguuggaaaagcacauuccaugaucccaccccugaccuccugaaucagcaaagcuagggauggggcugagcaaucuguauuuuaucaagcuguccaggugacauugauaaaugcuaaacuuugcgaauuacugauuuagagacuaaucaacucauuaaaaaguuaauaaauaggugagaauccauuguagcaccccagucaccuaugcuauuaucuucuaaauucacauuauacaaauuguaugccacaaaaauguuuaaggugaaaacccaaaggaauugaugcauuggauuaauucacaaaaauuuaacagcugcaauucauagaaaaaaaaugcaugcauaucugauaauuaguuguagauuaaaaggugaacaacuucuuauuauuaauacccaaugaaaauguaauuuuuuaaaaauuauggccaauugguaguuuuuuaaaaaucuguuaugccuugucaugauaaggauaggugaaaaggaacuuucauaaacuauugcuaaguauaugggugaaaccuuuuagacuauuugggucuaccuaauaaauuaaaauguucagucuuuucuaauuuuagcaccguauuucuacagauacacuggcauaucuguggagaggggcacuucugcuugucaccugauaucccuuacuacuacuaauauuuuuauaagcauuauuaccuuuaaaaucauguuaaaggguaaaugaugugcaacagacucaguuuccccuucucugacuccuguuuaguuuacaucucuuuucucucucucauuugggggcucaauacccuuaagauuauagagaaauugcaguagguaauguuggcuggaaaugcuaacuuguaagaaacuuggguggaaaugguuuaagccaucagccuaaacgaucagugaaaaugucagacauucuccgcuuucuucuuccaagauacuauacucuacuguggccuuagaguucuuaauuccuauauaauucugauuaaaaaggaaggagaugcuccuaauauaccuugcuguuguccccuccuguucauuaggguagcugaugucagucaaaauaaagucuagaaauucuugaguacuuuuuuuuuuuguaauauacugagaaugcuugaagcaaacuaaccaaauuuaaguguuuuaaggauauuaacaguaacaggagagccccucgauuuucugcuaagaaucaaccugaacaguuuccagacugcugguuggcaaugucaguaucaugagaaaaacugaaaaaauaagaaacuuuagagaaaaagaggaaucagugcaggcuaggggaaugaacuugguaauccaguagucuuucccugccagcauuuugauugauaagcuaagugucugcuuuuucucaucccuuauuuuuuggcaggaaaccaguauuuugauacuugaaugccuucuuucuaucuuaagggagaagccuucuuaaacuucaagugugaaguagauccuuuagguauaggaugaaaaauuaagugggacuauuugugaauuacuaaaucgcaaccauuaaagaaacuaaugcccuaauuagccugucuuuugacagacauggcauccauauguaagucuaauauuguaugcaaaugugagacagguuuugcuuucuagaucucuuugaugugaaaggaaaagcuggcuuccuggcuuccuucccauguucuguauggaccugccuucauccugcugccaacagcuccucaagggaacaugaaaguggaauuaaacccuccugguuuucagauucagaauccugggugauuaaguggcuugaucaaaaucagaaacugugaaagugcuaaaaauggucaaggcccaaggaguuccucauguguggucaaaagccuuucagaaaucaaagugugucuuuaaauaccuggggugcaaaaaucagauguuuuuuauuuaaagaaaaauagguauauuagagcagaacugggggcccucuguaggagccugagucuggguguuuacugucgucuaaggccuuguuaaugugggcuugaggcuucggaauccacgaacaggggaagcuagcgucucucgcugacuccaguccuagcucgagcuuuccauacugcccuacgugacuucugcacuuuugugccaucagccaguagacugagaaaaguaucugguauuugucggugucuucgguuuagcugcuuuaaguccuuggauggaaaaggcugauugucauccugaaaucauugucuccuaauguguaauuggggccaagugaagcacaguaauuuagaggaauucuaguuaaaaauacagauucuugggcucuaccucagaccuacagagaucugcauuuuucuuauucccccaggugauccuuuaaacauucagagguuuuuaaaacucaugcuuauaugcaauaacaaaaauauaaggauucuuagaaacuuguuauauuugucuugaacaugggaugacagacauugucauuuucauugaaaaaaaaaaugaagcagagacucagaauguauuuagagacaacucuaaauacauucuggcagagccuaacuacuggauugcagagauccucccugcuucccccaguccccaucuauaaacuggccaugugaauuucuagugguguucacuuccaaaguggugauuuuauaaaauauuacaaugaagcauuauuaaccucaagaaguucagaugcauagagaguuuauuuggguguggcagcauuaguggcuagguuuuauuuauccaagauaagacuucuuauuagcuaugaaaagggauuggcauaaacugcuuauuaauguccauuaacuguaucuaaagggaauaaacaguauaaaaggccaggcaugguggcucacaccuguaauccuagcccuaugggaggcugaggcaggaggaucauuugagcccaggaguuuaagaccagccugggcaacauggggagacccuguuucuacaaaaagucaaaaaaauaauaagcuggguuuagggguacacaccuguaaucccagcuagucaggaggcugugguuggaggaucacuugagcccaggaguuggagguugcagugaggccuggcggcaccacuacacuccaggcugggugacagagggacgaccuuaucucaaaacaaacaaaaacaaaaaacuguauaagcauaagaugggcuugagucacaaaauucugccuuucauaacuuucccccauuugcuguuugauuugcuguuucagaaauugugaaccuacuucucuacuuauagaacauuuaccucccucuuagauucuucccuuucuaucauugauacugacauucugcuuaaagaauuauccauuuaggcucucuucaaauccaaagugauauuauuuuauuuuaauaagagaugaaagggaaaauugacaaaaugugccuggaguugucagcauuguaaaugauggacuguaaaagcuucgucuuggaagauugucagagagccuagugccagcucaaaaaguguggucuuuuuagagaauugacagaaauguuacaaagaaaacaugugcugaauaccaacuccaggugcgaauccugagaagcaacucacucuauucugcaguaggagaugaauuuugcagguuauacagcagagcaauuuaaacucccuuguuucuuaaaguauauccuauagugacuugggauggaagucauauacuauccccuuuuuuguuccuucaaaguaaauacaccacagagcuggagaugucccagacacagggggaagcuguuuggauuuuucccacugccuguaaugaagcaagauagggaggaagaacuugggaacuugcguggcaaauggucaaguaaagaaaaagaaaagcuuuuucuuuacuugaccauuugucacaugugcuuucaaauccugaacugagucacaucugaaauaaaucacuuccuugucauuuccaugaaaggggcaguacaagaaauuccuugcacaucccuggugagccccuuguuacucucagauucagcuauugccuucaggaaaaaaagaaaaagaagccgaagaaagaaagaaaacagaauccucuagaaaaagcuauucugaccugugcucuuucuuuugucugagugugacuagauaaaugcauuagucugcuagggcugccauaacaaaauaccaaaauaccacagacugaauccuucaacaacagaaauuauuuuucucaugcuucuggaggcuggaaguccaagaucaagguaccagcaggucgguuucugaggaggccucucuuccuugauuuacaaauggccaccuacgcaucauguccucacauggucuuucucagagagaaagagaggugucucuuccucuucuucuuuuguuuuguugagacagaguuucgcucuuguugcccaggcuggagugcaauggcacgaucuuggcucacugcaaccuccaccuccuggguucaagcgauucucgugccucagccucccgaguagcugagauuacaggcaugccuggcuaauuuuguauuuuuaguagagacaggguuucuccauguuggucaggcuggucucgaacucucgaccucaggugauccaccugccuugcccucccaaaguucugggauuacaggcgugagccccgcacccggccuccuccuuuucuuauaaggacaccuguccuauuggaucagagucacacccccaugaccucauuuaaccuuaauuaucucuuuaaaggucugaucuccaaaggucccuugaggguuagggcuuugauacaugaauuuucaggggcacacaguucgauccauagcaguuggcuuauucauacuuuggguagauccucuucaucguuccucagcuacugucuauuuagugcacagcuucuuuauccuaaagcuagucaggggaggcauggaagguauuauuucuccuguuucugcaccuaaggcauuaaaacgagguuguggucuggcagccuaaacucggccuugaugaacuucaaauccuagaccuccuugguaugugaagugcauacacuuguauggagggauuugacagguuuuuuuuuuuuuuuuuuuuuugagacagagucucacucuguugcccaggcuggaaugcaguggcacgaucucggcucacuacagccuccgccucccgguuucaaaugauucuccugccucagccuccugaguagcugggauuauaggcgcgcaccaccacacccagcuaauuuuuguauuuuuaguagagacgggguuucaguauguugaucgggcuggucucgaauuccugaccuuguaauccacucgccucggccucgcaaaguguugggauuacaggugugagccaccgcgcccagcccagauuuuuuuaaauuaguuuuuaguguauccacacuguuaaagcagguggauacugcuggauaguauaacaaaguauagugugacaaacccauaaccaagcauuguuagcuauauuuucucaugucuugagccaaaaggucacaguuaaccuaauguugcuacuaaacacucauaccauaaaacauucuauuccagucuuccagauuuuacacaagaauaaaaugaaaacuuuuagacuacuggagauuuuuuuuuaaauacacaauuuguugaaugugaacgcuaaauugaaauugacaugcuaaguuuuauagauuacuucagcugcccugacuucaguaaauuuaguugugacacagguacaacagcugacuucuuucuggcauuagagguggugauguuucgucacucuggaguuaguaaaaccugaaacccgccaggcauuugacacacaguuugcugccagggacagcucagcuucuggcuuauuggagaggaaaugaccuaaccucuguguuuacaaaguguuugaaacugaggcccuuccacuuccuugcugaguguaaggguugaccuggcauccaaaauccccaugaucuucucaggauaagucaugcagccauugguggucaagaaaggauuuguucccuguggaagggcauuggaagaggaacagagcugaaacacacggguguucagagggaaaacaucucugcacuuaagagggcuagauuagacuauuagacuauuaucauagagcucgugauucaucuccuuuguuuaauuccagccuugaguaaaggacucacuaagaaaccacauucggccggguguuguggcucacgccuguaaucccaacacuuugggagaccgaggcagauggaucacaaggucaggaguucaagaccagccuggccaauauggugaaaccccgucucaacuaaaaauacaaaaauuagucggggaugguugcgggcgccuguagucucagcuacucgggaggcugaggcaggagaauugcuugaaccugggaggaagagguuacagugagccgagaucacgcuacugcauuccagccuggugacuggagcgagacuccaucucaaaaaaaaagaaaccacauucuauuccaguauauuuauuauaaccagaaauucuugucuuaucagcaaauagcuaauauucacuuacaugggcaguguauuagauuccuagggcugcuggaaccaguuaccacaaaccgcauggccgaaaccaacagaaauauacucucauuaucucauuauucuagagguuagaaguccuaaagcaagguguugccagggccacacugccucuuacagcucuaggggagaaucuguuucaugccuuucgcuugcucuagugcugcugccagcccuugauauuccuuugguugguacaugcaccccuccaaucuccaccucugucuucacaugguguuacuccccaugucucuguuucugugucuucucuaauaugauuaagggcccacccuucuccauugugaccucaaucuuauaucugcaaagacccuguuuccaaguaaggcuguauucuuagguguaggcauuaggacuucaacauauauuuugggggaaaauucaacccauaaugcgguuauguuuuuauuuuccuugacuuuuaagaaugugaacuauugucaaauuuuuucaaccacuaucaaauuuaaaucuaagaacuacaugucuuaaauuuaugaccucuucauuaaaaaaaaaauaauaacauuuaauugguaccaaaacgugaaagaguuuaaugcuuugcauuugcuugaggcugauuaaugaguaaaugugucaacuguggcuguuuuaauuagccaggguuaauuaauguuuaccacacuuggaagaugaaaaggcauguauaaaugcucuauaaugugaaucauuuuuuaauuuguuguugaagcuuauaguguagccaaguaaggauugcuuacaucauacuuacaaagggagguucauuaauggauacaaauacacaguuugauagaagaagcaagaccuaguauuuaauuaucagcaaggugacuaauuuacaguaaucuacuguauauuuaaaaauagcuaggagaaccuaauuugaaaguuucuagcguaaagaagacaggcugggcacgauggcuuacaccuauagucccagcacuugggaaggccgaggugggaaaaucacuugaccccagcaauucaagacuagccagggcaucauagugagaccccaucucuacaaaacaaauauuuaaaaauuagccaggugugauggugcaugccuguagacccagcugcucuggaggcugaggugagaagaucacuugagcccagcaguucaagguucaagugagcuaugaucacaucacugcacuccagccugagugacagagagagacccuuccucaaagcaaaaagaaaagaaaaacauuuaagugauggauaucccauuauacugauuugaucuuuccaaauuauaugaauauauuaaguuuucucauauaaucugaaaauaugcacaucuauuauguaucaauaaaaaauaaaauuuuaaaaauguaaaaaacgauguuggagcacuaugguacuuaacguagaggcucugacuuuugagguacauucauuaccuguuacugaaguugaguaugcuuuaauauuguauguuuagaaaagguaguuacauuuuuaaaucugauuguguaagaagaaaagaguagaaauguuuggggccaagucaauaauuauuuaguauaucauaauuugagaugaaauguguuuuuuuuuuucuuuuuuaguuucaaguugaaacauuuuaagaacagauaaggaaaggcuaacugugcugagaugaaaauaacauuuuuaaaguaacuaucuuaaagaaaauacauuucuagaauuuuguguaaauuuucaacaaagacucagaagccuggaugaggucuugugccaagacuggaaaguguggggauuagaaaaaguuugaagagauuguugugagauccucucguaugaggccugaagcuguacauccauggaaagcaguuaccccaggcgggaaaacagguuauccauucucgagugaguggccgggugggaaauaguccaucaugucgaauggaucguacuuuccagcaccaagauuugugguucucuaggugaauaagaugacaccccuucacuucacuucacuucaccauugucugcauggaguacguaucuaaaaacaaauuagcaaaaagguugggucuacuuuacuuuucaucuccuacacuauuuucuucuuuguucucggcaggaaaagaugaaguugcauuuuauuauuaucucauaggauucuuauucuaaaaugauuugauuuaaaacccauugcacuuuauuuggauaaaaaaugcuucacucucuaguucuuaacaauaacaccagccugauuuuauuacguuaagcacugcaauuagacaauacaaagaauuugcagcaacaacauguuauuuuaucauggguggaacuguucauugucuagcagaauuuauuaccagauaaaucccuuuuggggaaucuaauguggauguuuuuuucaaagcgccuguggaguucugcuaguauugggaacguuuccauuuucauucugaugcuucccugugggcuguuucagcauagaagugagcucucuggguccauguuuccauuggcuccacccaauauucugaaagauugcaacucaacauguguaaacagaaccuuucucccccauauuuucucuuuucguagauuaaacucaggucaagaauuagaaguuuauccuccaccccgauagcaucucgcccuaucccaaauaccgccaccaaaaugcccacuguuuuuccuugggccaguuccugaaauaucuuucuggcuguaucacucuugugugcauccuuaucggcuaugcuuuuggccauuuuuuacugcugacuuugucugguuagucuuuuauaaucuccaggcuucuccuccauccuuuuuuuacaguuuaccuguucaugaagcgcaggucacuugacccguagaauucccauaggcugggauuuugcuaauugcauacucaugguauaggucaguguauuccucugcccucuguaucccacaaacugaaagccucuuggcuaagcugcuucccuuuucacuucccuuguaccacagcagccagaagagucacagauccugggcagcuuguccucugugccucgguacaugcacuuguaucugcuaggacaaugaucucuuucccuggggccccacuguaauaucacuagucacaucccuaaagcccaggcuuguuucuuugucauucugucgguaucccuaccauaacacuuguaauaguaauuauuuuuaugcccaucuuuucuucugaaccaugagcccuucaagugaaaagaaauugaugaaguuauuucuagcacuccccuggaaaaaggaaggcaggcagggagggaggggcucacuaguuuaugauaaagugguuugauuuucuugguugcagauuauuucuuuuaaagugacucuuuucagcuucucucacuccugugcaucgugaaugcucuccugaagacagacgcuuuccauucauuuccaagccccccaugugaagugcuuucuguugccaggcuugguuuccccacacguuguuaaagaaguuaaagaagcuugugaauaagcuaaagcagaggagaaagaaccauugcuauaucuagaauuguucaccagaaagcaaguuuuguguuaaagaaaacacgaguaggccacugugcagaagugcuuacaggguuugugugcuuuuuaaaaucugcauaaauaaacauuucaaaugagcuaucauauauacaaggaugaugugcugucugugggaaaaggacccaauccuguguugugauuuuacauauauauauauauauaauuugugcuauuacacacuugccugauccccuuauaauuaucugcauaagucuuuuuaggcucuuugaaugaaauucacuauguauggauguugaaaaucauccuuucuaccaugagcucaucagacuugcuaaccaauucuuugcauccuuugaaguauaaaauuccaucaauucagcauguaucaacaugaaucaauuagaaugcacuuucuucacagcauggcggaguuuuugcuggcugccgggagcggcacuguuucccaauucauucauuugcuugggcccgccccaggauccuucuuaucccggucagauagacuucucucaugagcuugagagacggggcuggucacacaggacacggcuuuagggacacgacucacugaaacuacaaaaugagugcugcucuuagaguuguacccacagccugcacagcuguuauggcaaugcugugggcaagucuugcuacggcccauucuccucccucccuuguccuguuggaagguucagguuggagcugaaauucaguccagcacgcagcuggacaagccaugucuccuguaugugacucacuccccagagaaagcaucauguggacuaguaagggcuuggcuuuaucagaagcaaaggagagguuuacaucucuucuugcucucucuuaguggguucagagcuccagcagaaaaaaugggacacuguggauugaucuccagaaaaccccaaaaccagcacugaaggcuccaggagauuaugccuuuagauuguauacaggcaccagaaugacuuuugccuuuauaaaaaugcgugcaagagcaugaaaacuaauauuugaggaauuuuuuuuucucacuguacuuucugguccucacugaaagcauuggcaguuuuaaaaaaugaaaugugauacuguuauagacguagcaaaccucacguuucauuuuuuccaauucauucuauaucuaggaacuuacuuagaaggagaaacaaacuguacccagaaaaaggaaugaaacuggagaauucuuccucaugauuccucuguguccucaggccuaauuauccucauuccaaagacucuccauugccucaauaacuucgaaaaauuuacucuccuuaagcauagucauaaaaauugcauaguaaagugauaaagagacgaaaauaaugcuguaagaauaaaaccauuaaaaaaaaaccacuacucuugauuauuucugcuguuagaauuguaaaugaauucucauuccuuuuuucuacauuuuuggcaugaaauuuauguuacucuuauaauuaguaaaaacauuauauuuuauuaauaaaagaagacucacagugaagucauaacauaugcugcagagguuagacucuucaagucagauuugaagagagaauuucacguaacaaucaccuugaaaugucuucaggucagccaucaaaguacacaucucucaaccagccaggcagccaguuuuuccuccagcaugugaagagugaagagauagcuguuucuuggcuuaaagaccauaugaaauaauugacuuauguuuaaaagauaugagggaucaggccgggugcaguggcucaugccuguaaucccagcacuuugggaggccgaggcggguggaucacaagguuagaagaucgagaccaucccggccaacauggugaaacccugucucuacuaaaaauacaaaaacuagccgggcguagugaugcgcgccuguaaucccagcuacucaggaggccgagguugccaugagccgagauuacgccucugcaguccaaccuggugacagagcaagacucugucuccaguuaaaaaaaaaaaaaaggcaucaaaauuacauucacuucuauuuuuauuuuuguuuguagaagacaugcaguuuguaucacauuaaugggcauaugauguaauuucacuauaaaucgaaccagaggaagacauccaaauauguauaaauuaaagcugacaaugccuacaguacuaaacuuuuuguuuuaguauaauuggagacuuagaaaaguucuaaaaauauauuuaaaaauuuuuaaaggaaguugcagacauaauggcccuuuacaccuaaauacuucacuguacguuuccucaaaacaagaagauauguguguguguguuuguguguguguguuguaaucuuaauacagcaucuuucagagauuauuucuguaguauauaaacuugguuuuuuuguuuguuuguuuguuuguuuguuuguuuugagauggagucucgcucugucgcccaggcuggagugcaguggcacaaucuuggcucgcugcaagcuccgccucccagguucacaccauucuccugccucagccuccugaguagcugggacuacaggcgccugcaccaugcccggcuaauuuuuguauuuuuaguagagacgcgauuucaccucguuagccaggauggugucgaucuccugaccucgugaaccgcccaccucagccucccaaaaugcugggauuacaggcgugagccaccgcgccuggccauaaaguuguuuuuuagucucuacuuuaaguuccugacaacccaggcaggaccaagacucccuaauguaguuggaaaucagaucagcacauuggcacaaguucuacagguaaacgggaaaaaggagcccuacaaucugcuuuuagaugccagggagccuggcuggucuuuaucuugauuacugacugaugccacugguaggucuaaguucuuugaucuaugauguuugaaagccaaaaggaaauguguuuuaaaggaaaagggacuucuucuguacccucagucuaagccagacaagugauauuucaggaaaaugucccuagcaauaaggaauauuuucacaaaugaugugaagcuuuguuugugucccuuccagggcaguuuguuaccauaaggggacaaagcaugcuucauuuaaacauguguggccaggaaacuguuauuuuuaaacaaaaauaaaccccgauuuagacauguagucugaguuuuaacucugggagauuuucaagauugauaguguagcuaaaaauaacugaccuaauuuucuggaggucaagauaaaaacuggauuuaugguacagcauuuacuuugugauaauauguguauaaauucuuccccaaguuggaaaauguggccgcgucauacagggcuguaucucucuugaccauugaagugccuaggucgcuacacuacaauuugacuuagaguuggugaaacuucuggccauucacguagccaucguauucauccugagaaagggaaaccuaaagacuugggagaguguucugggaggaaagugcuauugagaaugggcuguccaagcaaagugacaggcaggccucacuuagcuagaagagggagcuuuucagcccugcuccaccaucaggaaucuccgugaccuuggacuacugcuuuaaucucuuuuauccuggcuucuaaaagauaccgucgaauucauucuuuuucaaaccuaucaaaaauuugaaauguaugaaaaagagggugcuugugaugauagauggguuuaugcuuccuuuuuuuuuuuuuuuuuuuuuuuuuugagacggagucucacucuguugcccagacuggagugcaguggcgcgaucucggcucacugcaagcuccgccuccgggguucacaccauucuccugccucagccucccgaguagcugggacuacagugccaccaccacaucuggcuaauuuuuuuuguauuuucaguaaagaugggguuucaccauguuagccaggaugcucucgaucuccugaccucaugauuccaaagugcugggauuacaggcgugauaugcuucuuuaauauuaguuucuaauccaaguaauauagccauguccucuauaaaauggaacuuuucauggaacagugagaagguugcauuaggaauugggauacuuggguucagauuucaguucugccacuugcuaguuuuaaguauacuucucaggauggaugucaguuuguucaacugucagugggaguagugaucccacuaaggaagauuauugugguuaucaaaucagcagauggguaugaaaaggccaugagugcaguucucaugguuaugaaggugucauaacuggcauagucccaucacaguauggcuuuggcaucgcagauggcuguagcauauaugcuaaucagaacaucccuaccguccuuaaagaucucauggguucucucccaaaucagcugcuccaccgaccuacaaguaaguccaugcuucuuuaguauauuuacucacuagugaaggcccgucugcuaaaagugucuucaguaggggagagcugcucuuuucugggaaacccagcaaugaaguuuguccugugaugcccucuacacuuacugaccuguuuccugagaacuucccguaacaaaugguccagggaagaaggaagucugugaccagucuuuccuuuccuguggcuuucugguucagaaaugugacccugaugauaagaaacuucaaggcaugacucugguguuuuggcaauauuccccuggcaguauuguuucuuggcucacacucaucucaugccuugcuuuguuugcuuuguuuuugagaauuguuuuuuuguuuguuguuuguuuuugguuuuggcuugugagacagagccuugcucuguugcccaggauggcgugcaguuggcacaaucucggcucacugcagccuccaccucccggguucaagcaauucuccugccucagccuccugaauaauggggauuacaggcacacaccaccgugccuggcuaauuuuuguauuuuuuuaguagagacggguuucaccauguuggccaggcuggucuugaacuccugaccucaagugaaccacccaccucggccucccaaagugcugggguuacaggcgugagccaccacgcccagccauuauguuuguuuuucuuucaugaagggauaaccgaggcuguugugugguggugucuugguacagcucguggcuguggucagugugguggaggguaggucuucucagaugguaacaugcaugagagucaccuggggaucacauuaacaugcagauucugauucccuggaucugggugggaccugagguucugcaugucuaacaaacucccagagaacacccauguagcaagaguacagacaaaaggauucaaagcgaagggacugcaagaaccauggaaccagccucccacgauuuugcggaugacgaacccgagccuuggggaguuucagaggccauggagagaugaaguauaauaaacagcauagcaguuguauguugagccaagaaucagacaugcacagaacugcugauuggaaaauuaaaucuguuucucauagcccugguguggcaaaaugccuagcuggaagugggugaccgcuugauuuacagugggccuccuggguagggaaaauuaguccaucccauuuacagcuacuuccaaugcagcugugucaggggagagagaagaaaggacauggaagagagcguagagguaugaucuucaguccuuucaggcaggcacauaaguaaauuuuuauuuaaaagauaagaauuggucauaugcgaaucuccuguuagauaagauuaaaaacaaauuuccauuuuguggagaaguugcagauaaauauuuuuccaugggauccaaaagaaucaaaaaggaaagaaaauaguaauagcaguggagguucgauccuagacagaagaaaauccagcaagccgagggacuucauauucucacugguguccaaaucagagcuuuuuuuuuuuuucuuuguuuacuuuaaguucugggauacaugugcugagcaugcagguuuguuacauagguauacaugugccuuggugguuugcugcacccaucaacccgucaucuagguuuuaacuccgcaugcauuagguauuuguccuaaugcucucccuccccuuucaccccaccccuggacaggcccugguguaugaugucccccucccuguguccauguguucucauuguucagcucccacuuaugagugagaacaugaguguuuggguuucugguccuauguuaguuugcugaggaugauggccuccagcuucauccauggcccugcaaaggacaugaacucaaccuuuuuuuuuuuccuuuuuuuuuuuuuuuuguauuugcaaauucaaaucuuuuuuuuuuuuuauuauacuuuaaguuuuaggguacaugugacauugugcagcuuaguuacauauguauacaugugccaugcuggcgcugcacccacuaacucgucaucuagcauuagguauaucucccaaugcuaucccuccccccuccccccaccccaccacaguccccagagugugauauuccccuuccuguguccaugugaucuccauuguucaauucccaccuaugagugagaauaugcgguguuugguuuuuuguucuugcgauaguuuacugagaaugaugguuuccaguuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaauugcgacacugacuuccacaaugguugaacuaguuuacagucccaccaacaguguaaaaguguuccuauuucuccacauccucuccagcaccuguuguuuccugacuuuuuaaugaucgccauucuaacuggugugagaugauaucucauagugguuuugauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuuguccauuuuggcuuuuguugccauugcuuuugguguuuuggacgugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagguaugcggcguuauuucugagggcucuguucuguuccauugaucuauaucucuguuuugguaccaguaccaugcuguuucgguuacuguagccuuguaguauaguuugaagucagguagugugaugccuccagcuucguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcaguugguuuguaguucuccuuuaagagguccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcguaucagcuuaaggagauuuugggcugagacaaugggguuuucuagauaaacaaucaugucgucugcaaacagggacaauuugacuuccucuuuuccuaauugaauaccuuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuaccuuuauugauuugcguauauugaaccaagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaaccaucugguccuggacucuuuuugguugguaaacuauugauuauugccacaauuucagcuccuguuauuggucuauucagagauucaacuucuuccugguuuagucuugggagaguguaugugucgaggaauguauccauuucuucuagauuuucuaguuuauuuguguagagguuuuuguaguauucucugaugguaguuuguauuucugugggaucgguggugauauccccuuuaucauuuuuuaucgugucuauuugauucuccucuuuuucuuuauuagucuugcuagcggucuaucaauuuuguugauccuuucaaaaaaccagcuccuggauucauugauuuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucaguuuccauguaguugagcggcuuugagugagauuauuaauccugaguucuaguuugauugcacuguggucggagagauaguuuguuauaauuucuguucuuuuacauuugcugaggagaguuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauguuuaggauaguuagcuccucuuguugaauugaucccuuuaccauuauguaauggccuucuuugucucuuuugaucuuuguugguuuaacgucuguuuuaucagagacuaggauugcaaccccugccuuuuuuuguuuuccauuugcuugguagaucuuccuccauccuuuuauuuugagccugugugugucucugcacaugagauggguuuccugaauacagcacacugaugggucuugacucuuuauccaacuugccagucugugucuuuuaauugcagaauuuaguccauuuacauuuaaaguuaauacuguuaugugugaauuugauccugucauuaugauguuagcuggugauuuugcucauuaguugaugcaguuucuuccuagucuugauggucuuuacauuuuggcaugauuuugcagcggcugguaccgguuguuccuuugcauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacaauuacgugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccgcaucacuuucagguacaccaaucagacguagauuuggucuuuucacauagucccauauuucuuggaggcuuugcucauuucuuuuuauucguuuuucucuaaacuucccuucucgcuucauuucauucauuucaucuuccauugcugauacccuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguucuuuggaggaggagaggcacucugcguuuuagaguuuccaguuuuucuguucuguuuuuuccccaucuuugugguuuuaucuacuuuuggucuuugaugauggugauguacagauggguuuucgguguggauguccuuucuguuuguuaguuuuccuucuaacagacaggacccucagcugcaggucuguuggaauacccugcagugugaggugucagugugccccugcugggggugccucccaguuaggcugcucgggggucaggggucagggaccacuugaggaggcagucugccguucucagaucuccagcugcgugcugggagaaccacugcucucuucaaagcugucagacagggacauuuaagucugcagagguuacugcugucuuuuuguuugucugugcccugcccccagagguggagccuacagaggcaagcaggccuccuugagcuguggugggcuccacccaguucgagcuucccggcugcuuuguuuaccuaagcaagccugggcaauggcgggcuccccucccccagccucgcugccgccuugcaguuugaucucagacugcugugcuagcaaucagcgcgauuccgugggcguaggacccuccgagccaggugugggauauagucucguggugcgccguuucuuaagccggucugaaaagcgcaauauucgggugggagugacccgauuuuccaggugcgucugucaccccuuucuuugacucagaaagggaacucccugaccccuugcgcuucccaggugaggcaaugccucgcccugcuucggcucgcgcacggugcacgcacccacuggccugcgcccacugucuggcacucccuagugagaugaacccgguaucucagauggaaaugcggaaaucacccgucuucugcgucgcucacgcugggagcuguagaccggagcuguuccuauucggccaucuuggcucccaccucccgaacucauccuuuuuuauggcugcauaguauuccaugguguauaugugccacauuuucuuuauccagucuaucguugauggacauuuugguugguuccaagucuuugcuauuguaaauagugcuacaguaaacauaugugugcaugugucuuuacaguagaaugauuuauaauccuuuggguauauucccaguaaugggauugcugggucaaaugguauuucuaguucuauauccuugcagaaucuccucacugucuuccacaacgguugaacuaacacucucaccaacaguguaaaagcgugccuauuucuccgcauccucgccagcaucuguuguugccagacuuuuuaaugaucaccaucccaacuggugugagaugguaucucauugugguuuugauuugcauuucucuaaugaccagugaugaugagcuuuuuuuuuuuuuuucauauguuuguuggccacauacaugucuuguuuugagaagugucuguucauauccuuugcccacuuuuugaugggguuguuuuucuuuuuuuucugguaaauuuguuuaaguuccuuguagauucuggauauuagaccuuugucagauggauagauucagaucagagcuuuaacagccagacuuuacagggaaaaggcugaguggcaccuccuuuauaugaagaaaauguucuucuccaacccacuuguguucaguggauggaagaagcuguucaguaauuauaacugacacuuguaacacauaacugauugauuuaaugcccauaaauuuuauuuucuuuaaucguaagaugugaccguuaaauucuuagaagacauuuggcuaguggauuaauaauuaaaagaauauuggaugaauucaucugcuuccuauucagcaguucuuuuauuuauaaggcuauuuuucucaaaaugaaugaucaugaauaucuaagaaaaaacaaaauauuuagcuguuugaagaugaaauuauuaucuuuugauguuguuuucuuuaaaguguuuacaaugauaacuaagugguagggcuucuucccucuguuacucuaaguaugccucguauacauccucaaagcauuuuuuuuuuuuuuuuuuuuggagacagagucuuacucgguugccuaggcuggagugcaguggcaugaucucagcucacugcaaccucugucucccagguuuaagcaauucucccgccuuagccucccaaguaggugggauuacaggcguccgccaccaugcacggcuaauuuuuguauuuuuaguagagacgggguuucaccaaguuagccaggcugcucuugaacuccugaccucgugauccacccaccucggccucccaaagugcuagauuacagacgugagccaccacgccuggccaccucgaagcauuuguaaaagagcaaggugaugggguucauuagguguuugguauuugaaauuaaauaccucuguuauugaugaagccauauuuuaaauauuaucaccacuaaacucaguuaaauauuuccacuguuaacuacaagguucaaaugcuuggauauuauagaagauauuugacuucaaagauaaacgcuacaauuuugggucauaacaaauagcuuuuagaaggggaaaaaauaagucuugggaggaaaauaagcagucucuuaguuuaauauagcgguuggcaaauauagaugcuuaaaaguucugaaaauccccauugcaggccaucagaguguuguaauuaaguauuaaauuaauucagauaaaaggauaauccaucagggccacuaauguaguggaagugugguuucggugugauuagucucaccauggaagucaaagaaagucccacucagaaugaacaaugaaagaaucauauuugucucuggguauuuugucauaggcucaauugcccagugccaguguguaagccacugguaaaauccugagcccuuagucaugucuacagguagcuggcugccuuagacauuuuaugaugacgaaauugaauuccacuucugauaaugguaauccaucaugucuaccucuuuuuuucucuuaaaacuacacugacggccaggcgcaguggcucccgccucaucccagcacuuugggaggccaaggcaggcagaucgccugaggucaggaguuugagaccagccuggccaacauggagaaacucugucucuacuaaaaacauaaaaacuauccggucaugguagugugugccuguaaucacaguacucgggacugaggcaggagaaucgcuugaacccaggaggcagagguucguuguucugaaugacauagccaggggugguuauuucuaaauuuucuguguugaauuaagauaggaauguggauuucuuccuauuuugaacaacgaccaaaaaaaaaaaacgaaggcuaaguguguuucacucugcuaaaaauguaccuuuucuugaaucugucacuuuuucacuuacauuuucugaaaaugaauauaauuaaccaccauggggcucagcaugcugguggccauuuggaggaacuuuucuaccaacaguguaacagagaaaagagaaaaggguacuacagcguaccucaaccuccccugacuguucugugaaguacaaguguaagauuucucacugugaucuuuugcuccucugccuuuuuacugccaagggcuaagaugggcacagggcccuuuccagcugccccugccugagaaaugcuuauuugaugaccaaaagcaauaaccauuccauaggacuaacggugauuaagucagcuuacaaauccacaaggguggaagagacugcuaaagauauuggaacagacaugcuuaauaaugccuaauuucuacagcuacuuuugugauaauacgagaggcugaaauagauaggggcugaacaugggaaggcugguguuaugaagcccaggacuuggauuucagcacuggugcuuacuggccauugggucuugaagagauugguuccuuucucccagccucagucuccuugucccaucagauuaauaaugccugccuugggagaggagagucauacaggagagggcauuugagcugggcucuaaagaguucaaauaacguagaugagcagagaugggcuuccaagauagcaggaauagaaaacaaaagugucagaauggguaugcauggucuuuugugggaauaccccaagcuauuuagccugagagagaggugugguguagacagcuggagcugugaguuccauggcuagaaauacggggugggcccagaccacagagggccuucagcaucuggcaaaggaguuggaauuaauucgguagaaaaugaagacccacugaaacaaagagggagccauucuugugugucaggaacuaagauuucaggaaccaaacguaaaauaaaaaccagcagggagaccauugucucagucgguuugugcuguuaucaugauaccagagacuggguaauuuauaaacaaacaauagaaauacuacaauucuggaggcugagaagcccaggaucaagccgggugcaguggcucacgccuguaaucccagcacuuugggaagccgaggcgggcggaucacgaagucaggagauggagaccauccuggcuaacacggugaaaccccgucucuacuaaaacuacaaaaaauuagccgggcgugguggcgggcgccuguagucccagcuacucgggaggcugaggcaggagaauggcgucaacccgggaggcggagcuugcagugagccgagauugcgccacugcacuccagccugggcgacagagcaagacuccgucucaaaaaaaaaaaaaaaaaaaaaaggcgccuuguggcugcauccuccagaggcagcaaaaacuguucucacauggcagaugcacauaaaggggccugugcugguuuccucuagcccuuuuagaaggcaguaguccauucgggggcacgggguggaacugucaugacuugauuuccagaagaccccaucucucacuacuaccacaguggagauuuaaguuucaacacaugacuuugggggacauucagaccauagcaagcagugaggagacuaucguaauuauccaggcgaaaaguaaucauauuccuaggggcggugagggugguguggaaaagcaagcaggaaauggcugagagaauucagaaauagaaugcaaaaggauuugucgguagugugaguacuggacacgaagaaauacagggaguccuggauggcucugaaggauucaagccugugacugggagggagaaugguucugccaugauuagaaaacaggaaagguggaagggaaagccagggaccuugaguacaguuguguaccuaccaagugcauggaucaggagggagcccuaaguugguaucuccagcaaacuguuggaaauauacaaauuugagugggagggagaagucaaagcuggggaaguacauuucagauucacccaaagguaggagaucuuuagaguuucaagagucgaugggauuuccaaaggggagaauuguagaaagagauggaaagagauacaagaagaaaaugacagggaugaagagaggagaaaaaaagaguaaaaagaguuauucagagaugucacagggaagaagauaaguacuguguaugcgaaacagugagaacauuuccaaauaaaggacaugguaagugauaguagauaccacagacccaagaacagcguagccccuggggaguucaagagcuuucucgcuggcaaagguuauuuccugucaagaugaauguguaugcaccaauaauuauuaguauuccagaauauccucucuuuagcauaguaagugcuuaacagucacaagcaaaagauuuauauaaaagaaaugcucauuuaauuuauuuaaucagacauuggcuaaguuauuagccgcuaccuauggcuuuguaaaacaugaaaaaguuggaggaaaucuaaugagggucuuuuaucuguaagggaaaggucaucaugggcaucaaguauugaauuuuagaaacggugccacagugaauagggauauauuauaacucagauuagacuucaaaaggacuaauuugcuugggacuuccaucauuuaaaaucacuugcaauaaaacugacuacaugaaaagauauuaaucacaagcuuuaaugcuauuccaucaaauuauuuuaauggguauauuugaacagaauuuuaauuuuucagauacauuuuuugucaauagaaaagagaauuugaaagaugauuguaaaauguuacaaaucaaauuuaaauccugaucuuauuuucauuuucucuagcaauaaaacuaaccagugaugugucugaaauauauacuacagcaaacucuugacacagcuaugauuggaaaaugagacauuuugguuaaucaaauauuauuguuaauagugcagugcugucugucggucucuaauuuguaaaaaucagagaaaaacauggugaaucuuuggugacauaagagaagacucacaaaucuucauauccuggggucaguuuuuaaagcaguaauuacacaugauacaagauuauauucuaagcucucuuuuuccaguaagaaaagauaagucaaugauguuccauaaagcugauucuuguuuaaucaauuuuuaaaguggggggguaggcggcacugacagcauucuuuggaaagggaagcaacagaggagaaaggcaggauauuuggugucugcucacauugggaaauacggggagccaggggugguuaaguccagagaaggcuggaugucugucugcagggcuacaucuggaagggcaagggaacaguuuccuuguugccucagagcauaggucaugcagcacaagaggagcauuuaggaaaugcagauuuuuuuucaaggcaagacagugaaaacuauucaagaagguagcaaacuacuggcccuuuaaugcuuuucuuauccuugcaagugugcaaggcaagacaggagauugucuguugucuuucagcuugaaugagauugugccucacuuacugccgccacaccaaagccuggcguuuauuccugugcgaucauuguauacuagggacgucuaacugugucaggaggaaauggcagcugagccccuguggccuuucaccucuagcagugccacgcugcagcacauuggccggcugccaugcuccugccugcaguccugccagcagcucuugugagcugcgacuuugcauaaguagcuugaaugccaugugccucaguuuucacaucuguaaaagggagaugauaaugguaccuaugucauggcucuaaacgcgaucaugcacgugaaagcaguugaagucuugccuggcagaaguaaaugguggcugcugcugcugcugcuguugugauuguuguuacucaccaaagagaugguuuuguuugguuuagaugagcugcuucagaaagagcaaaacuauucagaugacgucuuggccaacaugauuagugaaccaaggaucaguuacggaaacgaugcucucaugccaucuuugaccgaaacgaaaaccaccguggagcuccuucccgugaauggagaguucagccuggacgaucuccagccguggcauucuuuuggggcugacucugugccagccaacacagaaaacgaagguaagaguccccugagccagcaagggcguucugggagguauauauacacauacauaacgugugugcaagagagagaguuaucuuuuguauguucuugaguggugaauuuuuuuugauguagucauaaauauuuucauuauaauuuuacuuuaaaaaguaaauacuaggaguuacuaugucauuaaaauaauauaucuguguaaauuauucuuuauauuuuuuaugcugcaaagcauguaaacugccaauuguuggaaaagacaacaacuccauuguauagguggcaaaacaaaaugguaaugauuuacauaacauuugcagguaaagggccucuuguuucgcacauguccagguuugcauucuagggaauauuauccuucgagugaacacucccggacgaaggggagccacaguguauuauugaagaggcaguucuucacaaggaaaauguguggcaauaacauucuucuaauuuuuauuuuccaguuccucuucuuaauauaaaaugguacauuauauaacaaaaguggauacauaaagagcauguacuguauaucauauuauuauguuuaugacuuuuucaaaugaggaaauggaggcaccaggagacuaaguucuuaagugaugacuuuugguaggaauuuuuuagaaauguuuuuuaacugugagguauauuguucccucuggaauggaagcacaaaauucaacuuguguuuaugacguaaugaccuagaaugccaccuuccaaaaaagcagauagauagugaaauaaggaaaaauuacaguuuaccaacagagaggaguuuugagggccugcagagaugcagauuugacaggcaccaaaguagucuucacuggcuacuuauucuuacaugaaauuucagauugaauuaaauguuaaaggcaaagauagagaacuacauauaaauaaaauuuaauuuugcuuaagacuuaauuuguguuuagaaaauuaaauuuaaggcagcugccaaaauuaaggagcacauugcucuaaauguuuuuuccuuugguaccucagagaaguaagauucuucucuaucaacaaauuugagcaguagauggcauccuuuuucacagggauuucuuagcagaaacaccuguucaggcaagaauaucuuucagcuucuuuuaucuuuuucuacauguucagaaguauacaauuacacacaaacaccuugauuucuagauacaaauaacauguuuuuuaagaacacaacagcacuuuaccugauuuucuuuaucaaagcagcaaauguugauggagauuucauauuuauaauauaccuuauaggccaggcaucgugggucacgccuguaaucgcaggacuuagggaggcugaggugggcagaucgcaaggucaggagaucgagaccauccuggcuaacauggugaaaccccgucuguacuaaaaauacaaaaaaaaguuagccgggcgugguggcgggcaccuguagucccagcuacucgggaggcugaggcaggagaauggcaugaacccgggaggcggacguggccagugagcugagaucacaccacugcacuccagccugggugacagagcgagacuuuaaauuuaaaaaaaauaaauaaauaaaguaaaaaauauauauaccuuauaacaugcaauuaguacuaaaucuaaauauaauauuagaccuuaaguguacuggacaaguuuuuucuaaagaaccauugcagaaaauauauagacuauuuucacaaugugaaucaucaccccaaauuuguuuccuuaauuugaaaaagggcaccuuacaguaauagcaaacagcauguuacugacaauguaaaaauaauuaaaacuuuaccauuuaugaaaauaauucuuaaucacauagaagaaaacaauuuuagggacaguucauuaucaaagaccuggaaaacuguccuguuaaauguauugagugcagauuguuuuguuucuuuacagguagauagauuuuggucauugaagguccucuucauucagucucuaaugagaauuuuuagugaaaaauguccgaucucauuuuguaaauugaaugcacgcuaaauuugcucuuuuacuaacagcauaccuuguugcaucagccuuaggagaaaaucugcgugcacacgugugaauguacacacacacacauacacugugaacccuugguaauugccaggauguccauuugagcaaagcccuugauuaaguacuucuggauacuugacaaacacgcagcuauuacauugccuaggucucaugaaaagagcugauauucuuguuggaugauucuguuugaacaguagaaucugguauaacaauuuugggaggcaauagaacuugcagugucagagucuugaguugcaguacucuucauuaucagucccaacauugacauauauauauugauuauagcaaacaauuuaaaaagccacuuaagcaauuuuuuuuuuuuuuuuuuuuuuugagacggagucucgcucugucgcccaggcuggcuggagugcaguggcgcgaucucagcucacugcaaacucugccucccagguucaugccauuuucuugcuucagccucccgaguagcugggacuauagguacccgccaccacgcccggcuaauuuuuuguauuuuuacuagagauaggguuucaccguguuagccaggauggucucgaucuccugaccucgugauccgcccgccucagccucccaaagugcugggauuacaggcaugagccacggcgcccggccccaauugguuuuuaaauaaaauagacggccaucaucucauaggauauuaaauacuaccccauaccccugaacuccugaaugauacagacccgaguuuaaauuccagcccugcuaugugcuucugagcaaguuacuuagccucucuggcugcuuccucgucuguaaaauaagguugacaauaauuccuaacucagagguauaguaugagcauuaaauaagaaggcauaaaaaagcucuuagcaaaauuccuggaacguaguaaaugucagugguagcuuuuuuuuuuuuuaauggagccaggaucuuauuagagagacuuuaucagccugucucaagaugaaucaccuuauggccucaacaauguauccuuaaaauaaugaauauaauaagccauauaaugagauacaguccuaaagccgucucucuucuaacaccgucucccaccucuccccagaaacuuguuagucuuucuuuguacagacaugugcacacacacacacauacacccaacuacugaaaauaucuaaaauucucaaaggauuuccuuuuguucuucaugcaguccucauuaucauaguuucaaaugcuuaccaaaaauuuguuguuuuucuuaagaacaaucagugaaauccagaggagguucugaugcccauuuuuuaaauuuacauugaagaaaauaagcauaucagaguuuuccaaugugcugugauuugccuuaacaauuuuuuauucuuugguuuucacauccacaaaaccuaaaugaauggcuaggcugaaaugaagcuguuguuacagaauugugcucacagaucgugaaaugaucuggcuggaagcauuagcguugaugacauuuguguuuguucuacuuuuuccugacugccugagaagggcagccacaaagagcagcauagcaugcagugacugccagcaagucuuuguggccaacagucugccucuuuguagauaauaccuagauauaauauguagauaaaauaauauuuuuaaagagacaaagcaggucuuauaagacuuguauggauguauuugcaaaaugugaagcugccuucuaguauauuuuuaacuagcuuuauagaggcaaugaggaagccaauuuaaauguugaaauuuagauuaaauaaauauuucauuaaacuuacaaaccaguucuugucagccucuuaucuauauguaaaacugguguacugcugauuccucauuaccuuuggccugguagagaguuuguacaaggcagcacgguuaauaguugagguuuauuacaaagaauaccagaaguaacagacucaaaaaucccagaggucugaccauucuguuucucuccucuuacagcaaaggauuugauucaaagcuacugagagcaagagaauaacucauuucugcuuacauuuuauuuuaacucuauuaaaaguuaaagcuaagauaauguauuucuuguuuuuaaauuacuaaacagccaauguaagauguuuuuuagcacuucauugaugaaguuacugucugguuaaguaaaggucaauuggaaaaauuggaaaguauuugcaguggauugggaaauaacacacuacuuuguuuuguugguguguauucuuuuuuuucggcaaugauaucauaauugccuuuuaaaaaacuuuuaaugucugcucccugagcuacuuauuuuuugagcauuaauuuauacuaaaucagcuucaaucuuuuaaagcagauuaggguuuaugucacugaaacuaguuuuguuuaaucuuccuaaaaaauaggguuaggguuuuauuauuguuuuuaaauaauacaugccuauuuaaaaaaauagaagaagaagaagaagagcggggagaggcagagaaacuuauaggacaauaucauuuguaaguuucuuucacauaaguauacgcauuugaacccuggaaaaaccauuuacuuugugacacaacugaaguucagaaagaaugugauuagccccagaucacagagaaaguaaguggugacauuagcaguggcccgugggacuaccagcuccucagccugcauuuaaaccacagguacacuuaacuuacugccccgaguugcauauacauuuucuaauaacguaacuauugauguaugugcucaccaccacuucaagguacgcguuugcccucgugcauguggucuguuguguucuuaacugcaguugaagcacuauugggucccucaucaucaggaaauucucacaaaguacaaugaccuuucaacuaacugcauuuuacaaggaguaauacaguuacucauuacagguugcugcaaauaggaaaaaaaaugaaguauagaaaaaccaaaccucauugucgaaauguauuugggaguugcagaaggaagugaacuaugucuuccucuaaugcacuagugaaauacuagagaauagucacucucgcaucaguaguuacuauggaauauuuaaucauaggauauuuaaucagugcaguucuguaguaucugguagggucucaaacaggcuuuaaagguuacuuauuuguuccucaccauaauuagaagaugcagauguuaacauuucuguuuccauauggagaaacagccacagaaguggcgcaucccaaggccacagacauuguaaauguugggcccaggccugggauuagaugccucacccuccuuuugacuccaccaugcugccagucucuacaugagaaaggaccaaauuuuuauuucauccaaauauccuagugcucccggaaauauuuucuuauauuuuggagacuuggcuuacugccacuuuuuuucucccucacuguuucuauuaacauguggcauccaaaaucgauuuggacugagaaucccaccuuugaaugccuggccugugugcaucaguaagcuggaugguuuugcugaaauuguuagaagccauuucaucgagcacaccgugucuccuucagcaccugugcucacuuugucuuaccuuuuucccuuuacacuugccaccuuaccaaagcagcuucccccugcaccuaccuccguggcuucauuuacccuaugaccauuauuaauccuaaaaacuucacuuuuguccccauuccuuguuucuucaaacgccagcguaaaacaaggaaguauuuucugagcaucagaagugcuuuggaaaggucagaugauggugaggaauaucaugcuguccacacugcuuucuuugggucggacccagaacacauaaaaagggaaaauugugaacaauggcaaauauaaaaugaaauauccucauuucacacguuucagcuguaugucaucugucaaauggaagccagccuuuuugaaaaagugagaaaaagacugcgguuucccucuucugcccucauacuaaggacaaauuugauucacucacuaaauggcagauuauauaguaaaacuuugcucuccugauaaauucauauuugcacuuccccuggaaauuuaacagaguccuuuuguaguuaauuaacuguaaaauaagauaagauugggcaguuguaaaaggaaguaucuuuaagguuuucugcuaggcugggaauauuuuauuucuaaucaaaagccaagaaacuaucucuaaacuagcucagagggaaauccacccuccccaccccucuucuuugauguugcugcguauccuggugagggcuuuuauuagaaaacuaaggagcaggacuggcacaucaauagcgauaagccauuuaaaguggugccccuccugguccucgaugcucgggauuaacucacugugguucuuuucuggcugcuccuuuuuuguaacuuguuuauugcauaugcuuuuuucccugcucgacuauguuugggagccacgacuuaccaucuugauuugucuuguuugcuuucugugucccuugcuuccugugcccaguugagccuguugaugcccgcccugcugccgaccgaggacugaccacucgaccagguaucagaaccgcuugacuugugccucuccgcaucuugggccuaagcucgagcagacguugucuccuuucugcauuuuaagccucucucaauuguacuuacugcagaguagaauuugaagugaccuuagaaaccaaacuuuuaaaaauuccccuugacuauuccuuacucuucauuucccaaguuccgagugaaaugauuuuuuuuguuucugagcuuucccuuugaaaccuaaaagagagcccuuccaaauuuggguuuuuuuuuuucuuuuuucuuuaaaacaaacaaaacaaaacaaaaacagagacgauuauauacagccuguccuuaaaaacagaagcccagauagauguagacucucaggugaugacuuggauaccagugugaacaucucuccuuucuuguuugguguccagauggguaauuuucuaacugaacugggcucaaacuucaaucaguuacugaaguagacaugauuuccugaaaauaccagaauugguuucuuuccagagcccaaaauacaucuucuguuuuguggguuguauguacuuauucucaaugaguggcuaaaguaacacaacagauguggaugcauaauuuugcacauaagcccuuuuuuuauguauuacuuaaaaaucccauuaacacugaaauagacacuucuuuuuuuacaguuucacaaacauuaagaagaaacacauuuuuauuuuaugaauaaugucauagcacagcagaagcauauaugugccuggugucuacucuaugaacaaccucacccaacugauaguagccagugcuuucagugaaucaaaaagaggaagaaaguuauugaauugacaaauuuguguauuccagggagauuuuaaucccaaauaacacauacuuuuccauauuuauuuucuucuuuauccucauaauguccccaggcgauagucaaagaacagggaauuaacuuucuuugaagauauuaauacacagaggucaaccuuugcugccugguucagauacagucagcagcagaccaggagacccacccugucccucacacuuccaccacaggcucgagccaugacugccuccaagcacggucacugaugaagacugagagucugccuguggcaucuucaugccuuuaugcugugauuaacaguggcagcagagacaguagugugacacgucuugacagcuggucucguugauuuaugaauuucugucuguaggcuuuuaaggggaacuuaaauuauagugagucagagacaguuucaguucuucuaauguccuccuuauugucaaugucauguaagggaaucucaaggagccaggaguugacauuccuguucugcucagccaacuuguaaggccucgggcugagggucaguucaguucuaauugcaaccacagccagcucagguuggucauuugccuugggacuuuuuucauggugcuucucuuuaaaagacaugcucuucaucuacaagcauaaaauguaacuuagaaagcgcucauucgacucauucaauuuuaucaaauuucuacauugggccaggagagccuauauguuacuauugaaacauccaggaccaggugacacuaccagucaauguuuuuuucuuuuuuaaaaaaauuguuuuuugauuuuuuuuuuuuuuuuuugagauggagucucgcugugucccccaggcuggaguggaguggcacgaucucaacucacugcaaccucugccucggggguucaagcaauucuugugccccagccucucaaguagcugggacuacagaugcgccccaccaugcccagcuaauuuuuuuguauuuucaguagagacgggauuucaccauguuggccaggcuggucucgaacuacugaccucaggugauccacccaccucggcaucccaaagugcugggauuacaggcauaagcaccaugcccggccuauucuuuuaaaaaaaauuuuuuuuaaucuaaaucuaacaaaaaggacaccuccaaacgcugucaaacaaaaacaguguguuuuaaaggaagagcuagagaauaguuaaugguauuacacuggugggagaaaaccauccaaaaccuuucucauaacaguaagaauaugaugucacuuggggauuucacaaagaucaauccacuaaauucuuucuagguuugaaagaaauuaaacgguagggucccugcucucaggagcuugagguauaauagaaggaauuuugcauauuuggaaacaugagauggaauuuggaagacaaggaaauacaaagcaacauuaagugcuaacaagaauguucugugaugggaggagauggaguacuaacccaggggcauguuaaguagagaacuuacuggagaugggcuuccagagagguuaugaaagauuugaggcaccuggauuggcaaagaagaagggaacaauucuauucagaagagaggguggccuaagccaagcuuccuuucauacacagcguaggcuuggguugcccaguaagauggcuaaaguugagaaagaaugcucagauaugaagugaggaagauucuaguuaagguuugucuaugaauagcaguauuuacugcacauguauuaagccaugcguguguucuguuuuugugcuuguaguaaguuuaucaaacauuugggcuaauuuccccguguuuuguagcauagcuuugguucuucuucacauuuuagagaccacccacuugagucuaaugugccgaauuauaucuuuagccuuuccaaacuuagaaagccuucccaagauugucaugccguucaagugauggcauuguuuuugaauaaucacuguuguccucagaaacaaguuaaaaaaagguuuuuguuuuucccccacccagugcuuuauaaucaugacugaggaaaauggcuucuccuuaacucucauaucuaaaaaaacagaauaugguagcuuccagcaugcagugucaaguagggaccauuguaauaacaguggugauuugggggcauaguggccauuauagcuccuccuccuggcuuacuuccaaagaaaaaauagacucugaaggacuaauuauacaguuugaccagaauaaaaaagaaaaacacauuagcgagcucuucacauaggguagaaagcuacccuuucuguuacaauucaucaccacccuucugcaguccaaauaaagggaaaccagguccuugacccgagccaugcaagaggugucaugaaggacauaccucccuuagcccccacaugaacaaaaggcucuguccacucaucaugacuuacaggaagagagagcuggagucaccagggcuuagggugaaaucagcacaacucaagaaagaccucuaaguaagccugcaaaccaaggucccugccauuuauuugaaacuacucaucacauuuuauuacaugcauuaucaccuuauuaugaauauuucccuaugugccagcuuacugauuuugucuuuuaguaagauuugcuuaauguaaaaagucuucccuagaugacuauucaugcuaaacaaacaugaacuauuauagcaagagcucuucugccaagagcuucucaaacuauugagcuguaaacaugaauuuaucugucaugcugacuugauaauaugaauuuuuuuuuuuggaccaccaaaaguauucacaguaucauuucaaaaguagugugggcuuguaaaguuuuuaguggagagcucuugguuuuguuuuuuuuuuuuuuuuuuuuuuaaaacaggauuugucucuguuuccaggcuggagaacaguggcaugauaccagcucacugcaacccccauuuccugggcuaaagcuauccucccaccuaaguuucccaugcagcugggauuacagggaugugccaccacaccuggcucauuuuuguauuuuuaguagagacagaguuuugccauauuggcuaggcuggucucgaacuccugaguucaaacuguuugcccgccucagccucccaaaggcugggauuacaggcaugagucacugcaccuggccgagagcucauucuuuuuuuuuuuuuuuuugagauggagucucacucugucgcccaggcuggagugcaguggcacgaaucucggcucacugcaagcucugccuccuggguucacaccauucuccugccuaagccucuaguagcugggacuacaggugccugccaccacguccggcuaauuuuuuguauuuuuaguagagacgggguuucaccauggucuugaucucuugaccucgugauccucccgccucggccucccaaagugcugggauuacaggugugagccacugugcccggccagagcucauucuuuacuuuuauuuuucaguauaaauauuuggcuccaaaaucuaaaagggaagacucuucaaacuguucaagaaaguuuucuuaaaaaucucagaaauauaguucuaaccuauuguguugcuagaucuuuuauuuauuuauuuauuuuuggagacagagucucauucugucacccaggcuggagugcaguggcacaaucucagcucacugcaaccuccaccugccggguucaagcgauucuuaugccucagccuucuggaguagcugggauuacaggcacccgccaccacaccuggcuaauuuuuuuuuuuuuuuuuuuuuuuuuuuuuuuguauuuuuaguagagacaggguuucaccauguugaccaggcuggucucaaacuccugaccucaagugauccacccagcuuggccucccaaagugcugggauuacaggcgugagccaccgugcuuggcacguugccagaucuuaauaacagaaaaggagugagcucuaaagaaaucacugguuauauaaggaucucagauuuaaaagggcuauagaaagauuaaaauauacagccagugagaauuaagagaguuuuagcaucacuacccuauaaaaauaagugucagaaagguucguuucagcagaaugaguugaaacuuaaccaaaaaauacuuaacaauauuaaaguaagaaaauaaauaagaauagagaacucugugggucucguagcaagaaguuggggguugaggguuaggucauugagaggaccagaguuaaagaaugagaaagggaaacugucccacuuccauugugccuuuuaugucuauauuaaagagaaugaacuucugaugaaaggaaauuaaagcccgagauagaucaacaugagaaaagaaagcccuagcccauuaguuaccuauugcuacguagcaaauaacgcgagaauuuagcagcuuaaaacaacaagcauuaguuucuuacaguuuuuauaggucaggauuugggaugugguuuagcuggaugguucuggcacaguguccgucaugugguugcaguuaagacacugccugagcuaaagucaucugaagguuugauuggaccuggugggucuguuuccaacguggcucacucacgucacuguuacuaagagaccucaguaucuuaccaugugaacucuguaaugcugcuugagcgucccuacaacauggcaucucgcaccccugcaccaagagguccaggaaagagauuaaggaaguuuuagugccuuuuuuggcccagucucagaagucauacaccaucacuucuaucaugcucuguucacuagagcaagucacuacaucccgaccacauucgaaggaagggaaucaaguucucccucuugaaggaaggaguaucagcaaauuuguggauauauuuuaaacuaugacaucuugcuacccaaguccaaguucuuaugacccagaccaacugcaggcuaagagaacuugaaggggaaguagcaccauugccuguggucuuuguggaaagcugggaagguagggauaggaaaaugaaguucugaauagcaaaaaggagagaagauagcuucacaaucuguaagccagguauagagugacauugauugugggucucuuuucaaauagguuaucaaguggaagcuuuuugaacaauuggaugaggaaauggugcuaggucacaaccagcguggauuuccuagguuuugucagauuauccuuaccuucuccuuguauaggcugugcucuuagacuggcacaucauaugcuguggacauugugcuuuucagugucagcaagaugugucacaaguuucccagaaucucguagacaagauugaaagagugauuaggccaagagcaggaagugaauuccccugggagccaaaggaauugggaauguguagcccaaguaagacaagaaccagcaggaacaugccucuccuuagggucgugauaccuguucaagguuuuaauguggaagggaggauuaggcuugcucuguguugaaucaggcucaaaggauggaaguuacagggaagcugauucuggcuucauguaaaaaaaggacaguuugggcaggcaaaucuaucaaaaaauggagggaaauugauacauuccucuauguucaaacaggaacugacaaucugccccugggugggaacacgguagagaagaugacuucaaaagcccuuuucauccuaaaauucugauguuugauaauuaaauguuauagcauggacacugacauuuacauuuuuuacuuauguuuuugguuuuuaaaugacucugcauuuuguuuuaagcuucaaauuauuauuugaauaaugaaauucaucagaacaauuaguguuaagaaucauauagcaauuuauagaaaaggaagaguucguagguuauaaauucuguuaguugcuaagaagcauuuuuaaaauuauguacuauagcucuuuauucagcagacgaaccaauuacaaucuguguaacuagaacacuugacuaaaauuauauaauuuuuacaacgcuucacugcauagauacaugaacauaauuuauuuguaauuggaacaaagccccaaaguagcaguuuuguucuaccagguaauuaaugcucauuuuuaaagccuuuuauuauuauuucugaaguaaugagugcacauggaaaaagacacauaauaggcuaaacaauaagcccguaagccaagccaacauauuccaggaacaaauccuugccaaccucucaaccaggauuuaacuucugcuuuucccccauuuucaaaaauuauagcauguauuuaaaggcagcagaagccuuacuuucagguuucccuuacccuuucauuucuuuuuguucaaaauagguaguaauugaaguuuuaaauauaggguaucauuuuucuuuaagagucauuuaucaauuuucuucuaacuucaggccuagaaagaaguuuuggguaggcuuugucuuacaguguuauuauuuaugaguaaaacuaauugguuguccugcauacuuuaauuaugauguaauacagguucuggguugacaaauaucaagacggaggagaucucugaagugaagauggaugcagaauuccgacaugacucaggauaugaaguucaucaucaaaaauugguacguaaaauaauuuaccucuuuccacuacuguuugucuugccaaaugaccuauuaacucugguucauccugugcuagaaaucaaauuaaggaaaagauaaaaauacaaugcuugccuauaggauuaccaugaaaacaugaagaaaauaaauaggcuaggcugagcgcaguggcucaagccuguaaucccagcacuuugggaggccaaggcggguggaucacgaggucagaaauucgagaccagccuggccaauauggugaaaccccaucucuacuaaaaauacaaaaaagauuagcugggugugguggcaaacaccuguagucccagcugcuggggaggcugacgcaggagacuugcuugaacccaggagguggagguugcagugagcugagaucgugccuaggcgacagagcgagacuccaucccaaaaaaaaaaaagaaaagaaagaggcuguauguauaguucuuucagacuacaaggcagcaaaguucgugcaugacucgggacuuaaaguggaauuaauuucaauauagcagccacuuugacuuccacuguguuuucugggaaaauagguuuacaauagguuuauuugaaggaucaaacacaugcauacacugcuugguuuuacagaacacuuuauguggcuuaaauucacauccggaacugucuuccuuuacccauucauuucucccccagcucuuucuuuucauucccuccccuaccucccaugauuuaacuucucuugcaagaguaagaucauggagugagcaggaccccaugauguucccgauaguguuauucaucaaaagguuugugcaaagaagacagcagcuuccuuuucagaugaaaucacuuuuccccccuaauguuagaauuggaguaaaucaaaaagccacaucuccuuuguggucagcucuaguaguuauauaaaauccuuuaccaaaagcuuagaaauggagauaaaucaaaucguggauuauguuaggguuccaucuuaucaguaggugcaguaagaggguuaaauuaaugaagacgacaauuuuaucacauucagugguggacagaaaaaugguaagaaaauuuccauagcaauaauacuuaaaguuaucucaggcacuucuuuuguuuuguuuugugugugugugugugugaguguuacuuuuuuccaagcagaaaaugucuuuucaauauucauaaaguugauaaauccuaguauuaaucucuaaaagaaacaccuccaaauuauuauuuaugccuuacuugacuccaaauaauuguagcaaauaaaaaacugacuugggauuuggauuugcauucuuaacucccauaguucuuuuuuuguagaaagacauuuagcuuuuugaagcaugguuuucauuggcaagauaaucuaguaucaguuguuauaagaucaggguuucucuugaugaggcuguugcugaagagguuaauaaaaacuggggaaccacuaaagaguugaagaguuggugggguagaaagcugacgauuaauguacagauuugcauuugucggggccuggggccugugucauauaagcccauccccacaauuacacuaacgccuauaaugcgacagugacuaauggcagcggcagcaauuaggagaaucagcucccucuacuggacuaguuaagauaauguauuauaauuagugcaaugaauauuacaaaauuacaguauuuucuuaaaggcacaggcauauguccagacuuguauuuauuccugauuaccucacacuaguauauuagcuaauuaaugauuugcuuuucauaaaaauguugagcuagcauauuuguuuaguaaagggaauaauuaugaacaauuucucauuuuguuauaaaccacgaguaaaacacuuuuagaaguugcuucauuugcuauauuuuauauugccuuuccagauugcuaguauguuaguuucagcuuagaaaaaucagucauuugacuaccuugaggcuaaauugaaagaauuuuuuagggagguacaggcauaccuuggaaauuucagaacaccacaauaaaacaaauuuugcaacaaaaugucacacaaauuuuuuggcuucccaguacauauaaaaguuauguuggccaggcacgguggcucaugccuguaaucccagcacuuugggaggccaaggcagguggaucacaaggucaggaggucgagagcauccuggccaacauggugaaaugccaucucuacuaaaaauacaaaaauuagcugcauaugguggcaugugccuguagucccagcuacucgggaggcugaggcaagagaaucucuugaucccaggaggcagagguugcagugagccgagaucgcacuccagccugggcaacaagagcaagacucugucucaaaaaaaaaaaaaaguuuguauuuacacuauacucuagucuguuacaugugcaauagcauuaugucuaaaaaaaaaaaaagccauguauauacuuuacuuuuauuaguaaaauauuuuauuacuaaaaaugcuaaugaucaucugagucuucagcaaguccuaaucuuuuugcucguggagaaucuugccuugauguucacugcugcaggcuaauccaggugguggcugcugagguuugugguggcuguggcaauuuccuaaaauaagacaauaaugaaguuugcugcaucgauugacucuuccuuucacaaaaagaugucucuguagcaugugaugcuguuugauagcauuuugcucacaguagaacagcuuucaaaauuggagucagucuucgcaaaucuagccacugcuucaucgaguuuaugugauauccuaaauccuuuguugucauuucaacaguguucauagcaucuucaccaagaguagauuccauugcaagaaaccacuuucuuugcucauccauaagagguaacuccucauccauucaaguuugaucaugagaugguagcaguucagucaugucuuuaggcuccacuucuaauucuaguucucuuguuauuuccaccacaucugcugugacauccuuuacugaagucuugaacuccucaaagucacccaugagaguuggaaucauugucuuccaaacucccguuauugcugauguuuugaucucccauggaucacagauguucuuaauggcaucuggaauggugaauccuuuuuagaagguuugcaguuuacuuugcccagauccauuagaggaaucgcuaucuauggcagugaauagcccuacaaaauauauuugaaauauauuuugaaauaauaagaggcugaaauaauaagacuugaaaguugauccacaggcugcagaauggauguuguguuagcaggcaugaaaacaacaguaaucucccuguaccuguccuucagagcucuugggugacuaggugcuuuguuagugagcaguaauauuuugaaaugagucuuuucugagcaguaggucucaacaguggguuuaaaauauucaguaaaccaugcuguuaagagaugugcugucaucccaguuuuguuccauuuauagagcaugggcacaguagauuuagaauaauucuuaagcgcccuaggacuuuuacaauggucagucuuggcuucaaaaacaaagucgccagcugcauuagccccuaacaagagagucagcuuguucuuugaagcuuugaaggcaggacuucucucuagugaugaaaguccuagauggcauuuucuuccaaauaagucuguuucaucuccacugaaaaucuguuauuuaguguagccaccuucaucaggagucuuaucuagaucuucuggauaacuuauugcagcuucuacaucagcacuugcugcuucaccuugcacuucuguguuauggagauggcuucuucccuuaaaccucaugaaaucaaccucucccaacuuuuuuuucuucugcagcuucuucaccucucucauccuucauagaauugaagacaguugugggccuuguucuugauuaggcuuuggccuaagagaauguugugguugguuugaucuuccauccagacaacuaaaaguuuucuccguaucagcaauaaggcuguuuugcuuuaucauuugugugcucacuggaguagcacuuuuaaucuccuucaagagcuuuucuuugcauucacaacuuggcuaacuggcacaagaaucuuggcuuucaauaugccuugcccacuaagcuuaauuauuucuagcuuuugcuuuaaagugagagaccugugacucuuccuuucacuugaauacuuaagaggccacuguaggguuauuuacuggcccacuuucaauauuguugucucucaagggauagggagccugggaguugaggggguggaguggccaguuuggggggcagacagaacacacacaacauuuauugauuuaguuugcugucuuuaugggcauguuucaugacacuccaaaacaauuaaaauaguaacaucaaaggccacugaucacagaucaccaaacagauauaauaauuuuuaauguuugaauauuuaaauaauuaccaaaaugugacacagacaugaagugaaccuguguucacuguuggaaaaauggcaccaauagacuuguucgaugcaggguuaccagaaaccuuuuuguuuuuuuuuuuuaaauacuaucuguaagcacuacuguacaauaaagcuauguaugccuguauuuucauuaaguugcagagcaaacgugguaauauuuagcuuuaguuuuacuucaucuggcauaagaucaacuccuuauauaacaagaugauaaaaguuguggugugcuucuauaauuucauucaaguagauaaaguugaaaaauaaugacuugcuuuuauaaacaguaugaagcaauguagugcaguaaaugaaauuuuauuccuucuuuacaauguucucaaaauuauuuuuauguuuaauccaaauaaagagcaagaauaaagcaacauuucagauuuugguuucuggagacaauaguuagaaagcaugaguuaugagugacuuaaaauucuuguugccuguacuucacuuugaaauaacauuaugcuuuaaaaagcauuacacugcuaaagguuaauuagaauucugcagaauuacuauagcuaaaaguagguaacaagauaucuuuuuuucuauuguuuaacuccuuuguuucagaaugccuauuccugugcauuaaaagugucccuccaaggaaauuaggacaucugcagaguugaaaaacaccuaagucucagucacuuagagucacacaucagggcucagagugcuaugacuaggaaaaugcugaccuccuuucauuaguaugaucgugccuuuccagcuuuugauagauccaagcgcuaucuucccaccacucaccaaauguuccaccugucaaaggguuucaggucccugcagacuucgguuuugaccuguggggaaaguagacuuccucgaacuggggaagccacauguuguacauccuucuauaaacuaugauuaucauucuuaguaggaaaauaugugauuucuuuuuuuuuuuuuuuuuuuaaaguaagcaucaaauauuugaccaaccaguugggcagagaauauacugaaacuuuuuauauaaccucauccaaauguccccugcauuuaagaaaugaaauucuucuaauugcguuuauaaauuguaaauuauauugcauuuagaaauuaaaauucuuuuucuuaauuuguuuucaagguguucuuugcagaagauguggguucaaacaaaggugcaaucauuggacucauggugggcgguguugucauagcgacagugaucgucaucaccuuggugaugcugaagaagaaacaguacacauccauucaucauggugugguggagguagguaaacuugacugcauguuuccaagugggaauuaagacuaugagagaauuaggcuuagcuuuuugcuaagaacuagcuaaguaucucuuuuaaaaaacgaaucagugugcuuccaugaugcuuggguuacaguuguucuuucuuguuuugguuuucauucauugcaacuuaccgugaauauucugcucaagguauugagaguguguguuguuaucucaacuuacaauuuguguugaaguuaucaaaauaauacaaaugauaaugcaugacuuuaaaaaagcaugauuacucuuagacuuuuuuuuuucaaacacaagcaacaaaaaccaguacaagaaguuaaaaauaaaaauagaaguaggaaguugcuuuuuccaaaaaaacuaaacauguuuauucuuggauuucuuuugucuuaaauagucuggccucucaauacaaccagguaauaguaaauaaugugacuuuucagugcagacucuuaccuuuaaaguuucucaggaaaucacacuauaccaaauggcccaccaaaacauacaugauuguuauuugagaguucugcaaccuauuacccugcacuuccaccugaaauaucuuaguuucaaggugcuauacuaaaacaagaaagagagaaagaaaauuuacgaauaaguuauuuuuaugcauuugaaaugccauuuggaugggggaaaaaguguuaaaaucucacaguauaugcaacuuuuuaggaaacugucuugcagagaguauaguguaaacauaacuuuuauaugcacagggaaacugaaaaauuugugugacauuuaauugcgauauuuuaagaguuauggaauuuuuagagcugaaagauuuauugaugaugaccaaucaaauugaucuucucaucuuguagaugagggaacugaggccgagacagaaggguucaaauuaugcaaggucaagcucagaguccagauuuccccucauauuccccauugcuuuuuuuuuuuuuuuuugagacagucucgcgcuguugcccaggcuggaucuuggcucacugcaaccucugccuccuggguucaagcaauucucuugucucagcuuccugaguagcugggacuaugggcacacgccaccaugcccggcuaauuuuuguuuuuaguagagacaggguuucaccauauuggucaggcuggucucgaacuccugaccucaggugauccacccgccuuggcuucccaaagugcugggauuacaggcgugagccaccgcgucuggcccccauugcuuuuuccaucagagaaaaguccagguguuucuagggaguugaagauuccacuauccccaaggaaaugggcucuaaaccauucuugauuagaagaggacaggcagaguuuaaauaaaugaaauuuguggugaagccagaaauuucauuuugcucagcaauuaaaaccucugcagacuacaacagaagcugcugauggaaauugggguggagccucauuuccccauucauacugacguggaugagcagugugaggaaggaaaccaagagaacagcaggcagcaggguggaaaggaacggacugacccauagaucagagugugagcacauaaaagcaaugaccccacugucauguuuggccauugcaccuuuugugauaguaucuaagcuuaugucccucaaaacaguguaagauagguuuucauuaguaucagcuuauuucauuucugcucaaauuaauuuuuaaaaaaauuuaauuccauauuugagcaaauaaagaugucuucauacuugaguaauucaagaccccuuuuuugcugcuguuguuguuuugguuuuuuucaugguuuuguuguuuucuuuuguuguuguuguuucuuuguuuuuugagauggagucuugcucuuucacccaggcuggagugcaguggcaugaucuccgcucacugcaaccuccaccucccagguucaagcgauucuccuaccucacucucagccuccugaguaacugggauuacaggggcauaccaccacgccuggcuaauuuuuguauuuuuaguagagacaggguuuugccauguuggccaggcuggucuugaauuccuggccucaagugauccgcccuccccaaccucccaaggugcugggauuacaggcaugagccaccaugccuggccuucaagagcacuuuuuaguuuauuuaauauaauucucuuuguugccggucuguccguugaaguugccuucuuugaugccagaggccaaagacuuggcuuccucgggcuuccauaacaaaguaacacagauggguggauuaagcaacagaaauuuacccucucacauuucuggaguguaagaucaagguaucagccagguugguuccuccccaggcaucucuccuugguuugcagaugccugucugcucccuguaucuucacaugaccuucacucuguuuuucugcuguguccuaaccucuuccuacaaggacaccagucauaguggauuaggaucaacccugaugaccuuguuuaacuuuaauaaccucuucgacccuaucugcaaauacagucacagguggagguacuggcagcuuaggacuucaacauaugaauucuagggggacacguuuuagcccguaacagaccccagugaugcugagcauaaaagcaaggccuccaccuggagcuccuuccccuggcugugcgugagaccagguccuaccucagaccuaaggaaaaagaauccccaaauaggaggcugcgaaucugaguguugaaaauuuccccaaaugaaugagaugugcagucggauuugagaaucccugacacaucauuuuaacacuccuuccuuuuaguucuccgcgcaagccucagggaguggaaaaugguaucucucaccucccagauaaccgguugccuuuuaagugcucuuccagcugccugaauuaaaacgcucuuuuuuuagucaguuuaccaagcagugucucauuggacuuaaaaugucagaggagaaguugacacuuugacccagauucugacauuaauuuuuaagccaggagguauccuugcaggagcaaaaucgggaaggauggcuguucagcucuucucuccucauuuugcugucuacuggagagcaacuggaagccuuucuagaugaggggcuccaccucauucguguuuguuuuguuuauuuccucucagcuccuuccccucaagaccuuugugacuguccuuccugaaagcagcccucugugcagccccauagugugucuguacagcaauguugaaauagaccacauuccgcuuuucuguccucaaaaaagauguaguuuagcugggaugguagaaccugaacacagggaguugcaacccagccuagggauguucccaggugagagagcacggugggcuuucagagcaccauuuuucuuagcauuccagcgucugcacccacagaagugaugcuucugcaacauccucuuccuaccuuaacaggcacucucacccucaaguacauggaaauaccuuuauuuccggcucuggcuaaccuucauuaaucaguaacccuacuucaguaagaacaaaaaugaguacaucaauauuuccaguuggacucaccucagucacucaggacagaauaccauuguacuuacauaccaucgugccugaagaagucaugaugaaagcuuugguuuccaggagauuuuuuguuuuuagagugaaaaaugcccgcagaagaucacagagauaggaacccuaggaaaaaaacuccugagaacaaauguauaaaugaaacaagccuagaacagucacauaccacuucacacuggagagaacguucugagaaauguggcauggggcgguuugaucgcugugcaaacaucauaaaguacauguacauaaaucuagaugguauagccugcuacacaccugggcuacacaccuacaacuauugcuccuaggcuccacaccugugcagcauauugcugcacugaauacuauagacaguuguaacacacuggcagggauuugcguaucuaaacaaacuagaaaagguacaguaaaaaauacgguauuauggggccaccaucauauguuuggucugucguggacuaaaaugucauuauguggcccauaacuguauuuuuauugguagaguuguuagcauuuggaaaugagcacuugcuaguuguuguuuuuuuuuuuuuuuuuuuuuuucaaauaagcaggaaauauugacuuacugaauuuacuuagccauaaggccagagagucacucugugagccauuggccacgcuuucccaaggagguaacugugccuuauuggugcuucaagcagugaagcaauagcccuuuauuauuaccacuccccaaaugugcccuccaugucagaauagcccucugguggcuggaaaucucagcacuagcugaauuaaccaccuugcuccuguuuuaggacguuccugcaaagcccacuaaucccaggaucuguuuaguagcaagcgguacuuuucuacauucacauacauagacacuggauauuuaaaaauacguauuguagcucuuucugcuacucuccccagacaugucaccuuuaauaaggagaaguugggggcacagcuucucuuuauuauaggaugugaaaaaguuuuccucucacagaucugaucacuugaacaccagaagucuccccgcccccaccuccugguuaucucauuaaugaucuaaauaagaagagaguuccuuuuauuuggcuuuuauggagguauggcauaugacuuuuucuaaguaauaugcugucacacuggugacuguauaaaaagauguccuuagagguccuuucuucccggccagaagcugacccaccaggauacagacgcacugacguuggcauuguagaguaguuggagagaguggucagguugaauggaaagccacgauaaggaaaagugagggggggugcagaaccuaggaguggcuuacagugagcagcaggaagagaaauuggaagaucaaaggaaagcaucaaaaaugaucacaggccaggcgugguggcucacaccuguaaucccagcauuuggggaggccaaggcagguggaucacuugaggcuaggaguucgaguccagccuggccaacauggugagacccugucucuaauaaaaauacaaaaaauuagccaggcgugguggcaugcgccuguagucgcagcuacucaggaggcugaggcaggagaaucgcuugaacccaggagauggaggcugcagugagccaaaaucacgccacugcacuccagccugggugacagagcaagacugucuuaaaaaaaaaaaaaauuaugaagggauagcaaaggaguuccugaaccugccugaagaauugcuugauguuggccauaaacauagucaacugccuucuaguuauauauaacuauagagagauggcaucaaaauuaggaaaacaagcaucuauacaacuagguagcaggcaguuacugggagguuacgagggauaagucacuagcuugaaaacuuccuauuuucuuugcuuuuauuuuuuuuuuccgcagacuuguggcuccuuugaugugucacacuauuguuguauuguucgccuuaguucccuuacccuccuuuacucgucugguccaucucaaugacaggauucugucguuuggccugacucagucccuuguauaaaaggacaucuauuaauccacauccugcugguuacuguacauaauaaaauguaaacgugguguuuccugccucuccuccaagcucacacacccgcauguaaauacucuaggggcaauaggaggagaccuagaaacuaaggucacccaaauagaaucuugucccugcaggcggauagcugagcucuaaauuacucuggauacagugaaggacuaaaugguuccaaugaaucaaguucagggagaaaagggucaggggguauggagguuagccaaagagugucaaacguucuccucaaagcuauuuuagaacaaggcuggucaggcuauuugggcucagcucuuuucagcgugugucauaggcagcagccaguugaagccaugccaccaugcagugcagggguccaggucucaggaaggugcagcguaccgagagucacaugaagaccucagaucauuuccugcugcuguguaauccaggcagucugggaagagaaugaauauucagugguuguauguaugugugucuucaucccagcaagugacagauguuccugcccaguuggaaaauggaaauucugacuucauugucuuaucauuccuuccagaacaagcaccaugggcucaaacccucccuggcucugcuuuaagggaaauaauauugugucugugcagaggcccugucugcacagggucgugguagggcuggccuucacaugguggcccaugccacugcuguagcuuagccaugaggaagagauuggugagccugcuggagaggaaggcuacccuuacuuggugcuccuccuuuauccauagacaugaguacucagauuuucgcaucuagcuuucaaggggcuggagauuaaagauccaauccauacuccuuggaugcccuuuugucaagauaaucccuucuucuguagcuccuaagcccucuaaggucugagggccaagcugccccauggcaggaauggcaaaauguagcuguccucucaguggcaaaagguaauaggauuaucaaguagcaaaacagaagccaagaaaagacaggagaguuagaggucuggauugugcaccagccuuggagccucgcaucucuagcagggcacucuuaagcguuaggcuuuggaguuugaagaggagauaaaccuaucaaauugccagguguuccccugcccuugaugcaugcaaaugauuguugacagccagugugaugguagaugugccuccuggaagaaauaaaaguauaauauuccaacaaucaagcagcauuguggcuuuuuucuacaaucagaaacauagcagcuuugugcuugaucuccuaagcaagauaauuuuuuuuaaccugggcauucuuugaguucucaguuucgaggugauggggagcaaaaaugaugcccaaguucaaauggcguacugcugcagauaggcugucuccuggcacacagauuuacagagugaaugaaaucucucauucauuggugcuaaucuuuaaccaugguuuuuaacuuacaaguuggaggcuaauuacacaguuaccaguuaaagccaggugaccucauuuguugacaacagugcacagcaaaggaaagaggagaggauaaggaaaauaucugugauuugcucccagaaggacagugaagcugagcauccauuugagcagaguccucugaguacuggccuuggucagagcuuguuggugggagugugcuaaggggagaugccuaggucugucauuggaguaagcugaggguuuggaugcaggggaacucaggcagcucugagccacagggugguagaugggagggauucacaguggcgcacagucucuuccauaaauggaaacguaagaaucggggcacauggccauggcggcucaugccuguaguccuagugcuacuuuaggaggccgagguaggcggaucaccugaggucaguuugagaccagcauggccaacauggugaaaccccaucucuacuaaaaauacaaaaauuagccaggcguaguggcgggugccuguaaucccagcuacucgggaggcugaggcaggagaaucacuugaaccugggaggcagagguugcagugagccgagauugccugggcaacaagagcaagacuccaacucaaaaaaaaugggcacauaauggauggaacauucugucccaagggaugagggagcuguauaucuaccuauuccagcugccuugggauuagccacugguagucauuccaccucacucccagacugaaaagagucaaucacuucaugaaguggggcuauccgaagggaccacaggggaccugauuauacugacagauuuauuuuuauuuauuuacuuuuuuugagacagagucucccucuguugcccaggccggagugcaguggcacgaucuuggcucacugcagccucagccuccuggguucaagcaguucuucugccucagccucuggaguagcugggacuacaggcacgugcuacugugccuggcuaaauuuuuuuguauuuuuguuaaagaugggguuucacuauguuggccaggcgugucucaaacucccgaccucgugauccacccgccuuggccucccaaaagggcugggauuuugagccaccucaccuggccuuuuuuuucuuggagauggagucucacucugucucccaggcuggagugcaguggcacaaucuuggcucacugcaaacuccaccccccaaguucaagccauucuccugccuccgccuguggagcagcugggauuacaggcgugcaccaccacgccuggcuaauuuuuguauuuuuaguagagacaagguuucaccauguuggccaggcuggucucaaacuccugaccucaagugacgcacccaccucaggcucccaaagugcugggauuacaggagugagccacugcacccggccauauugacagaucuuuuagucugaauuguuaucagccaguguggucuagucaugacauaucuagcuccaucucgagaccucaugucuuacugcugacacuacauccucgcugguacuuuuucuuccuuggcuucaggggcauugcuguguaggcucagauccaugccagaugggguguguagggggaaaagcugcauaagggaggaaugucacuuggcaacacucaacaagggggaaugggccugcaguauucucccagagaugaaugagcagcccauucuaggaaauaucccuuugaaggaauaucuucucuaugguacauccaaacuuuucucuggaaaacaugccucuucauucugaugacuuucuauuuauucucuucaucuuaccaugguuuuacaaaagaggaauuuuaacauacucauucagcagaguuaaggaccuccucucuucugcgaacggggagagguauaacaaauauaguaaaacaagaacagccacugcccacguuguagggguaaguacccugcccaaccugcagacaguaaaugccacacacagcucuaacagugacagggggagaaaaacgucuucaguuacuggccugaccuuagagguaaagcaacauauuaacagagagggucugauuuuaaacuuugagcugaacauacuucuauaguaucuuaauucucaguuuuuaaaaaauuacaucaucuagaauggcgucguccuugcucuuccuuuuuucuugugccaaauaauagcccccuuugguauauguuauuguuuuaauugauucucaaaccucuccuuaacauuuuaacaaacauaaaauuugauagaaaugggcuagacuaaauucagcaguccaggaaaucgaguauuuuucuacacagauuugagugucacccaagauacaguauacuuugcugaaucucccuccaugauacucuugugguuuuaucuauuuuaccaaaacacuuccacguaaaacaggcuuccguugacucuguuuguccuuuauggacccaacaggggaggaaaaaauaccauugcacuggguuuauccacuuacuguggaguuggggaaccagaaacaaccacuggacacguugcaagcgcgucaagguuuccaccgccaccugguggcuagauggagcacagcaucuguguaacuggugggcaaaggcguucugcuccaagaugucaaagugggggagaaaauuauggguguucugcaaucuuggcaaaagaagaguacuguacuccuuaucuuuuuacugcuucuccauguucacccuuaaaagauugauuuuuauuuuuuacucagcucuccucuuguuuuucagguugacgccgcugucaccccagaggagcgccaccuguccaagaugcagcagaacggcuacgaaaauccaaccuacaaguucuuugagcagaugcagaacuagacccccgccacagcagccucugaaguuggacagcaaaaccauugcuucacuacccaucgguguccauuuauagaauaaugugggaagaaacaaacccguuuuaugauuuacucauuaucgccuuuugacagcugugcuguaacacaaguagaugccugaacuugaauuaauccacacaucaguaauguauucuaucucucuuuacauuuuggucucuauacuacauuauuaauggguuuuguguacuguaaagaauuuagcuguaucaaacuagugcaugaauagauucucuccugauuauuuaucacauagccccuuagccaguuguauauuauucuugugguuugugacccaauuaaguccuacuuuacauaugcuuuaagaaucgaugggggaugcuucaugugaacgugggaguucagcugcuucucuugccuaaguauuccuuuccugaucacuaugcauuuuaaaguuaaacauuuuuaaguauuucagaugcuuuagagagauuuuuuuuccaugacugcauuuuacuguacagauugcugcuucugcuauauuugugauauaggaauuaagaggauacacacguuuguuucuucgugccuguuuuaugugcacacauuaggcauugagacuucaagcuuuucuuuuuuuguccacguaucuuugggucuuugauaaagaaaagaaucccuguucauuguaagcacuuuuacggggcggguggggaggggugcucugcuggucuucaauuaccaagaauucuccaaaacaauuuucugcaggaugauuguacagaaucauugcuuaugacaugaucgcuuucuacacuguauuacauaaauaaauuaaauaaaauaaccccgggcaagacuuuucuuugaaggaugacuacagacauuaaauaaucgaaguaauuuuggguggggagaagaggcagauucaauuuucuuuaaccagucugaaguuucauuuaugauacaaaagaagaugaaaauggaaguggcaauauaaggggaugaggaaggcaugccuggacaaacccuucuuuuaagaugugucuucaauuuguauaaaaugguguuuucauguaaauaaauacauucuuggaggagca

SEQ ID NO: 192645 - RNA, 13606 nt, Homo sapiens
uuaaacaaaacugguuuuauuucauaagauguuuagagacaggcaauggcugguguugggucagcagcucaacaauguggcaacuggcaucuucgugguucucuuggcccuucgucgugguucaaauaacuccuccagcuccagucaucacuuugguguuuauggcaguaagggggggaggagguggccuagcugcauauguaucuuuaaucaggaaguaaaaguuuucccagaauucccaaggccaaagcuguguccugaggccacugagaguuguuaguugcaacagaggcugaaaggggagcaauuagcuuuucuggguucuuuagugaaggcagguaagggagaaggggguugggaauggcuggcaaauuggagcaccaacauuaccuuuauggauaauuucuuuuucaaaaugggcagcugauaugugaagaaauaucuaacaacaauuuuaagguuguaauuugaaacucaguucugcuuucaaucaugacauuuuuaacagaugcauuucagcuauacuauuuuuucuugugccccacuccccaacauucuagaauggaacuaaaauaaaauuacuuaaucuuucaagaaaaagugggaaaaaaaaaucaaaaggccaacaguggcaagauacuuucaacuacucuugaugucauuguccuucuacaccaaagaacaucuggaaaacauccccacauccuuugguguuuaagaacugauagagcugaccaaaguccaugugguuuccccuggcuccauuaacacugaacacuuuuucuucaaaaauggaaaauuuccuuugucuuuccguuucaucauuuguaccaucaaaaggaaugucuucucgauggcgaauuaaaauucucuuccaguuuaauuuucugagucugaaaagaaauuuccaaaguaaacauuuucaaaauguauauucuagagcauuuaaaacagaaguuauaaaacagauuuaucaaugccuuuuccuagaaguagucuacuuuuuaaaauguuuauaacuuuuacuuauugauuuaguagaggcaggucuugcuauguugcucaugcugguuucaaacuccuggcugcaagugauacucuggccucagccucccaaagugcugggauuacaggugugagucauacacaccccguccaagaagucuacuuuuaucucacagggauuuauuuuaaucaaauaugauucuggucauaaucucaucucugaacucauuuguugcccuuacuacagccauguaucaguaguuuagaaauguaggaauuacugaaucccaaacuacuauggaccuucucagaaauucauuuaguauaucaguagagaaaugagacuaguggcaauucuaaugcuucuagaaagcuccuuacuucacaggguauacaguuugcagcaucacuaaaaugagggaaggaccagauccauggaaguggauggggucauagugucuggggcaggagcucaauucauucagugcauauuuacagaaugucuccuacaugcacuugucaggugacggggaaaaugcugacuacaugugauuucugccauauccaucaacuugagauugaauccccauaaagacacaaccccugggacauacuuaucuccacaucucuaauagucauguguugcuuaacaacggggauacauucugagaaauguaucuuuaggcuauuuuguuguuguaccaccacgacagaguguacuuacacaaaccuagaugguacuuuuuuugcauuuauauuuuuucauauagaaaaccaaaugucccagcaccauuacugaauaucauucugauauucaauagugggaagaucaagugccauauaucagguuucuauaugugcuccauuauaaucuuauggcaucacuguuuuauguguuguccacuguugaccaaaacgucacuaggcagcacaugacuguaucuuguuuaguauuaacauuauugacaugacuucauauacauauguaaaagcaaaccuugaccagaauucuucacaggcacuuugugggccuuccacacaaacaacaccagguuuuccaggcaugcuaaacccagacagggaaagcuccuuugcccacucuagaauauucuuucuuuugcauuuguuauagauaugauggcuguagauccagagucucgugaagaugaggucaacugacuggacugugcuuccuguggugggugaagaugaaguaucucugcugacauagccagaggcguguucucuaacccacucuguggcauucaguauacaaacaucuccaugacaauguuuuugcaggaaugcagucagaucuguguucagcugagucugcugggaucuacucaauaauacugaucuaauagaaaagauacaagaaaaauauugucuuggaacagaaaacaaauucgagaauugcuuuuauucucagauuaauuuugaccuccaaaguuggccagagcuucuguaacguaccugacaguaauuucaggcagaacugccggguauuuaaagggaagaauacaggccagagaaaacaucgccugauuaaagagaagaagaaaaagugcacuaaccaauguuuuaagucucaacauguuucaaucccucuaaaagcaaaacugaauuaccauuuuuucgucagauacauccagguucauauugauaguaaaguagacuuuugaagaucgccccuccauugucuucuuuucaauacaaucuuucaguucugcuacagccagcuggucauucacuaugagcucauucucaccagggaacauacuggcuagcaggucuaacucagcaagcugggccuccgccugcuccaucucaaucauuuuuggacauguguaaguuucuaaggagguaaagauaagagagacaauuuacauaugcaaucuuggaagaaaugaauacaucaacauguguacuuacuaaaauuguacuugguuucuucauaaauuguacaauuuaauuagucucuuucccuauuacucuacuuucagauauaauaugcuaaguccuaugcuaagaccagccugagcaacauacugagaccaucuauaaaaaaacaaacacaaaaaaacucuuaauaguaaguagacaccacauucuucugugucuagauaguugaguggacaacuugagcuaccauaaugggcaauuucaucaaaguaaaccaauuauguagucaaaaagcuguaucaauaauguagccagaagagaggauaugacugguuacacuggaaaccuagaaugaacaaagucagucagagaguuugguuacguggauggucaauuucuucuuuuuaaguaaauauuaauguuuauuagguuuuuuugagacagggucuagcucugucaccacagcuggagugcaguggcaugauccccgcucacugcaaccucaaccucccacgcccaagcaauccucccaccucagacuucugaguagcuaggaccacagguaugcacugccacgcccggcuucauuuuuuauuuguagaaacaaggucuugcuauguuguccagacuggucuugaccuccugggcucaagcaauccuccugccuuggccucccaaagugcuagcauuacagguaugagccacugugcauggcauuuauuaguuuuuuuuuuuuuuuuuuugaaacggagucucgcucugucacccaggcuguagugcaguggcgcaaucuugguucacugcaagcuccaccucggcgcguucacgccauucuccugccucagccucccaaauagcugggacuacaggcgcccaacaccacacccgguuaauuuuuuguauuuuuaguagagaugggguuucaccguguuagccaggauggucuugaucuccugaccucaugauccgcccgccucggccucccaaagugcugggauuacaggugugagccacugcgcccggccuauuuauuaguuuuuaagaagcagaggaacauaaagagaaaauaaguguuaauuguccuguagcuuaagucaccccuguuaacauuaaaacaucuuaagcauuauacauauauauaugugaaaaaugcugguauaauguauaaauauguacaaugugagauauauacaguauacauauuuaaauccaaaggggauaauauauacuuuuuccuccuauuuccuaucucccuccccaccaaauauauuuuguagaucuauucacugucaacauauagugaucuaccucauucuuuguaacugucggcuguuauacugaaucauguagauaugccauaacuuauuuaauucuuuaccuauugauggacacuuggguuguuuccacauuuuuacuaauaugaacaauccuauaaugcaaggucuuuuuauauauauaguaugguaaacugaauacuguguauucaauaauaaacuuacagagguggauuguuguaucaacauguacauuuuaaauuuugauagauauugccaaguuacuuuccagaaaguugccauacagaacagaaauuuacaauuguacucaguccccugcuucuuuucuuuaaaagaaaauucuuaauacauaguuccuuuuggccuagcacgguggcucacaccuguaaucccaccacuuggggaggccaaggaggguggauagcuugaguccaggaguuuuagaucagccuggguaacauaacgaaacccugucucuacuaaaaaauacaacaaaauuacccggguguguuggugcgugccugaagucccagcuacuugggaggcugagacagaaucacuggaaccugggagucagagguugcagugaguugagaucgugccauugcacuccagccugggcaaaaagagugaaacuccgucucaaaaaauaaaaauaaaaaaaaaaaaccaaaaaaaacccucucccucucccucucccgucuccccauggucucccucucccucucuuuccacggucucccucugauuccgagccgaagcuggacgguacugcugccaucucggcucacugcaaccucccugccugauucuccugccucagccugccgagugccugcgauugcaggcgcgcgccgccaccccugacugguuuucguauuuuuuugguggagacgggguuucgcuguguuggccgggcuggucuccagcuccuaaccgcgagugauccgccagccucggccucccgagaugcggggauugcagacggagucugguucacucagugcucaauggugcccaggcuggagugcaguggcgugaucucggcucgcuacaaccuccaccucccagcagccugccuuggccucccaaagugccgagauugcagccucugcccggccgccaccccgucugggaagugaggagcgucucugcccggccacccaucgucugggaugugaggagccccucugccuggcugccuagucuggaaagugaggagcgucucugcccagccgcccugccaucuaggaagugaggagcgccucuucccagccgccaucccaugugggaagugaggagcgucucugcccggccgcccaucgucugagauguggggagcaccucugcccugccgccccguccgggaugcgaggagcgucucugcccggccacccggucugagaagugaggagacccucugccuggcaaccaccccgucugagaagugaggagccccuccgcccggcagccgcugggucugagaagugaggagccccuccgcccagcagccaccccgucugggaagugaggagcgucucuacccggcagccaccucguccggaagggaggugggggggggucagccccccgcccggccagccgccccuuccgggagggagguggggggggucagccccccacccggccagccgccccguccgggagggaggugggggggucagccccccgcccggccagccgccccguccgggaggugaggggcgccucugcccggccgccccuacugggaagugaggagccccucugcccggccagccgccccguccgggagggaggugggggggucagccccccgcccggccagccgccccgucugggaggugaggggcgccucugcccggccgccccuacugggaagugaggagccccucugcccggccagccgccccguccgggagggagguuggggggucagccccccgccuggccagccgccccauccgggagggaggugggggggucagcccccgacccggccagccgcgccguccgggagggaggugggggggucagccccccgcccggccagccgcccuguccgggaggugaggggcgccucugcccggccgccccuacugggaagugaggagccccucugcccggccagccgccccguccgggagggagguuggggggucagccccccgcccggccagccgccccguccgggagggagguggggguggucagcccccccccgggaggugaggggcgccucugcccggccgccccuacugggaagugaggagccccucugcccggccaccacccggucugggugguguacccaacagcucacugagaacgggccaugaugacaauggcgguuuuguggaauagaaaggggggaaagguggggaaaagauugagaaaucggaugguugcugugucuguguagaaagagguagacaugggagacuuuucauuuuguucuguacuaagaaaaauucuucugccuugggauccuguagaucugugaccuuacccccaacccugugcucucugaaacaugugcuguauccacucaggguugaauggauuaagggcggugcaagaugugcuuuguuaaacagaugcuugaaggcagcaugcuccuuaagagucaucaccacucccuaaucucaaguacccagggacacaaacacugcggaaggccgcaggguccucugccuaggaaaaccagagaccuuuguucacuuguuuaucugcugaccuucccuccacuauuguccugugaccaugcccaaucccccucugcgagaaacacccaagaaugaucaauuaaaaaaaaaaaagucuucuauuuucuauuuggaauacauuuucaauuucugcauuuaaauauuugauccaucugggauauacuucacuuuaaaaggugacggaaguuuccagcuuauuuuuuuuuuccaguuaacuagccauuuuuaccaguacaucuuauaauaaauuugaaauguuucuuucaacauauguuaagugccuauauguauuugagucuuuuucuggauucuccauuuuguuauauugaucugucuauaauaucauguccuaauacucuuuuuuuuuuuuuuuuugagacagagucucacucugucacccaggcuggagugcaguggugcgauuauagcucguugcagccucgaacuccuaggcucaagcaauccuccugucucagccucccaaguaucugggacuacagucaugcuaccaccauacccagcuaacuaauacucaacucuugaaaucacuaugauggguuaguaaauugcuccuacucugucucuucauagccaucacucuucuuuucuagaauucuuuuuugguauuuccuggcuuuucucacauauaaacauuagaauaauuuuguuaaguuuugaaaacaagaaaaaaugguaauugcauugaaauuaaagauuaggccuggcgcgguagcucacgccuguaaucccaacacuuugggaggcagaggcgggcggaucaugaggucaggagauccagaccauccuggcuaacacagugaaaccccaccucuacuaaaaacacaaaaaauuagccgggcgugguggccggcgccuguagucccagcuacucgggaggcugaggcaggagaauggcgugaacucgggaggcggagcuugcagugagccgagaucgcgccacugcacuccagccugggcgacagagugagacuccgucucaaaaaaaaaaaaaaaaaagaaauuaaagauuaauacagaaaaagacgauauguuuauaacguagaauuuucccuucaguaguuuuuuuaauagcuuuaaugagguauaauuuauaugccauaccauacuacugccaagcaagaucuuuaaaauguuagcaucccuuaagguuugguugaggacaucuuuaucuucucuauugucucaugguaccaaguauuacugaauauuaaauguucacaauucucaaauucuuaggauguuccaaauucucgagccccauauuuguaaauuuaacuauaucuguauauuucuauuggauguuauauuaguucauuuucuguuacgauaacagacuaccugagacuggguaguuuacgaugaagagaaauuuauuuggcuuauuguucuggaagcagggaaauccaagagaauggugccugcauuuugcaagggcauucuuacugagucaucccauggcggaaggcagagggcaagagagaaugagagcaagugcaagagagaugaaggggccaaaugcaugcuuuuaucaggaacccacucccacaauaacuaacccacuccugcaguaacaccauuaauccauuugugagggcccuguucuuugggaacuuuuucaacccugccuucuuucucuucuucugaaaugcugaugacaggaauguuacauuuuuuguuauaucccugcauaucacuuaaucaccucugaaaggucccaccacucaacucuauugcuuugggauaaagcuucuaacacaugaacuuuggggcacacauuaaaccacagcagagaccaucucagucuuaacaguccuaaaauaggucuaaauggccuggcgcaguggcucacgccuguaaucccagcacuuugggaggccaaggcaggcagaucaugaggucaggagaucaagaccauccuggcuaacauggugaaaccccaucucuacuaaaaauacaaaaaauuagccgggcgugguggcgggcaccuguagucccagcuacucaggaggcugaggcaggagaauggcgugaacccaggaggcagagcuuucagugagccgagauacagccacugcacuccagccugggcggcagagcgagacuccuucuaaaaauaaaaaaauaaaaauaaauaaaguaaaauaaaauaggucuaaauuauauuucuuuaauaauaauucuuuuauuauuucuuuucuguuuagagaaccuauuuuaaccauucuuuuaggauaggucugcuggugacaaaucuccuagauuuccuucaucuuagaaugucuugauuuccccuucauuucugcagaauauuuucacuggaugcaguauucuggcuuaacagguuuuuacuuucaacaauugaaaaaugcugugccucuucaccuagccucucuggugacugaugagaaaucacucucauuugaauuguuuuccuuuacagauaagguucauuuuugucacuaauuuuaagaauuuuucauugucuuugguuuucagaaguuugauuaugaugcguuuuuuuuuuuuuuuuuuuuuuugagaugggagucucacuuugucacccaggcuggaguacaauggugcaaucuuggcuuauugcaaccuccaccucccagguucaagcaauucuccugccucagccuccugcguagcugggauuacaggcgcacaccacuacgcccagcuaauuuuuguauuuuuaguagagaugggguuucaccauguugggcaggcuggucucgaaauccugaccuugugauccacccgcguuggccucccaaagugcugugauuacaggugugagccgccacaccuagucuuuuuuuuuuuuuuuuuugagauggaguuuugcucuuguugcccaggcuggagugcaauggcacaaucuuggcucaccacaaccuccgccuccuggguucaagugauucucuugccucagccucccgaauagcugggauuacagguguucgccaccacgcccagcuaauuuuuuguauuuuuaguagagaaaggguuuuaucauguuggccaggcuggucucaaacuccugaccucaggugaucuaccuacccuggccuuccaaagugcugggauuacaggcgugagccaccaugcccagccccauaugguuuagguauuuauccuagacaaaagcaauccuaauuaggcgagagacuauaugggcacaauucuuauuugugacuucucagagucuuaaacugugaauuuccaagagggguguucaguauucugucugacuccagaacauguuuuuccaggccaaaugacauuagcccuccucuccacagaacagagcaggauuccuuauuuugccauguaguuaccugaauuuaaguaguuuaaauauaagcauuuaaaguaucauaaaagaugguggguagccuugauaauauuuauacauauauuaacauauauuuauuaauaugucuauucauguuuaauuugaaguuuuccucuucuaauaacuguuggaacugcaaauauuccucccuccuuuaaucgcaauguuuucuuuuguuuuuuuuccgauuuuuuauuuauuuauuuuuuugagacggaguuucgcucuuguugcccaggcuggagugaaauggugcaaucucggcucacugcaaucuccaccucccagguucaagcgauucuccugccucagccucccaaguagcuaggauuacaggcaugcgccaccacacccagcuaauuuuuuguauuuaguagagauggaguuacaccaugucaguugggcuagucucaaacucccgaccucaggugauucacccgccuuggccucccagagugcugggauuacaggcaugagccacugcucccggccuuuuuuuuuuuaaacaaaauccucauacauacuuaaaaucccuggacuuauuggaauuccauauacauauuugcuggucuguuuuggaguugagaaacauaaaaaacaacuacuugggugguuauuagaggaaaugguuuacuuuguuuuuuuguuggcguggcucuguuaccaguguuuuuggauucuauuaccagauugccaaggugcgacuccuggcucugccacuuaccaacugcaggaccuuaggcaaguggcuuaauuuaucugugcuuuagucuccccaacuccauaacugggaugagaggguugcugugaugauuagaugagaauuuguggaaagugccuggcaacaguaaauuuuauaugcgugcuugcuacuauuauuauuaauuaaaaaaaccuuuuuuuuugagacagggucuagcucugucacccaggccagagugcagagucggcucacuacaaccucugcuuucuggguuuuuuaguagagacgggguuucaccacguuggccaggcuggucucgaacuccugccgucaugauccacccgcccugggcucccaaagugcugggauuacaggcaugagccaccguguccggcugcuuauuacuauuauuauuauuggucaucauuucaacaaauguuucucaagcacuuacguucaagcacuggcacuaagauaacaaugaaugaaaguaauaaaacaacucuacuggugggaggauaccaugacaucaaaaacaaauuuauacgcccagcccaggugcggugguggcucacgccuguaaucccagcacuuugggaggaugaggugggcggaucaccuaaggucaggaguuugagaccagccuggccaacaugaugaaaccccaucucuacuaaaaauacaaaaauuagccagguguggucgcccacgccuguagucccagcuacuagggaggcugaggcaggagaaucgcuugaacuggggaggcggagguugcagugagcuaagaucauaccucugcacuccagccagagcaacagagcaagacugucucaaaaaaaaacaaaaaagaauuuuuguacccagugaauaacugcuaugaagaaaccugaaaaagaaaacaaggauaagggaaacaaugaggcagcaggggugagacugcacacagcauugucaggaaaggccuuucuccuaaggugacuguagggaagagacuuuaaggaacugaaaaaggaggccauguguuuuucuuggccaagaguguucaagggaaagcgaacagcauauucaaaggccuugaggaaggagggugcuagaacagcuggccagagcacagugagcugaggacacggggaauagaagaguuuaguaaggaaauguggggcaguuuauguugggacuaguaaagcauggccagaauuuugaauuuuaucccgacugacauguaagagcuacaagagagguuugacuuaugaagauccccacacuugcugcuauggagaaaagugaaaggaaaaguggggugaccagauauagacaccgcaauaacuagggagagaugaugguggcuuugauaggauuauaguggucaaguuggugagcuucagguucuggauacaugcagagaacagaggcaacaggauuuacagaugaauuacaugagacacggaagaaugacuccggggcuuuaagguacugaaaguauggaucugccauuuauuuagacguugauggucauggggagcugaagcuugguuuuagacacaaguaaugaagugccuacuaagacaccuguuaaauagagaggucuagcaggcaguuagauguauaguuuugaagucuacgagagacucagcuagauauauaaucuugggagucaacacuuauuuggaacuauauauuuguuuaaagucucccagggagugaguaaaguugggagagggugcuauugaauuggagguaucgaagaugaaaugggauuagcaaagaagaacgggacggagggacucuugaacggacaacuacgggagugaugucacaggucauuuaucugccaaauuauuuucgcuuaagagauuucaguccuuccaaaaaacccucaagauaauuuuaugauucaagauuucagcgaaugcuguaagauaauagacuguggccgggcgcgauugcucacgccuguaaucccagcacuuugggaggcagaggaagggggacugcuugagcccaggaguucaagaucagccuggguaacauaguaagagcucgccuuuauuauuuuuuuaaaaaauaaaauauauuuaagagaacgcagacugaaacuugagauuucugaguggaauaauaucuuuuccuugcagauuuuuuuuugaagaacagagcaggguaccccgcgacccaagccaagacgcucucaggaagaaagcccagcacgcagccgcccucgcacccugauugcccccggggcgagguccccggcuggagcagggcugcagaagccgggaagcaacgccgaggaccgagccgaccgaugggcgcaugcagugaggggaaccggggccgccaugccgggcacguucccaaaggguugcacugggcgcugcagcgugggaaacccccguggcggucaccacuggcgcuagcugaggcgagacucaccuugagccguggcccccucacugcuguaacccggguuccauggcugcauggacagcucaauuuucaucagaagggagccucaaaauucuagcauacugcgacccaaaacuuacaaaccgccucagcuggcgaccuaccggaaaaaaaaaaaaaa

SEQ ID NO: 192646 - RNA, 10847 nt, Homo sapiens
gcggcgguuuuuuuucccauggcgcucuggggcgcgggcgauuuguagguaauggcaggcguucggucacugagguguagcagaggaugcgcuggcggcugugagugcggcgacaagggcaaaugcagcgacuccucgcuguugggcaagagacucuccgaagacucgagccgccaccagcuguugcagaagugggcgagcauguggagcuccaugagcgaagacgcgucgguggccgacauggagagggcgcagcuggaggaggaggcggcggcugcggaggagaggccgcugguguuccugugcuccggcugccggcggccgcugggcgacucgcugagcuggguggccagccaggaggacaccaacugcauccugcuucgcugucaguugggucgagccgggcagggggggcguggggucgccuucuuccaggggugccgcgcgugggcggcccgggaggaggcgggggcuccuuggggcugcccagggacuuuaagagcaaaaagucugagagugugagcuguggcaggaaaaggggaggagggucaccccuccacuuuggcucucgggcgguggguucuuuucugggguccccgaucccagaagagcagugguugaaucagcaucaucgugagcauuacucagaaacaaagggcgacaaagaauaacacuuuuaaagacccuaaaaaaagagaaacaaauggucaacuagacuguaagcacuugaggugcagccaguacuauuacuccccauagaaauuagcaggcuguugguguaucagcggaugccucuacagccuccagugauagagccgcagaguugacggaacacagugcuauagggaagaaagggaaggaaacuugcaauaaaagcaccaacaaccccaugaaaacuggcgaggaaggaggauguagcaaaagaguucagaagaaggcaggaauuaguuucuaauccugguucuagcaguuaccucuuaccucuguuguuccacuguucccucauuuugauguuuuugcaguauuuagggauaaagugguucacauauuuuuuaugaauugguguaagaauggcuguuguuuuuggauugugauuuuucaagaugaaguuuuuucugucuuugaaugccguaaauguuccgauggcaguaauucaccaccggcuuaucgacguuucuggaacguuuuccuugguguaauacugggaauaaaggagcacaccaguguccaguaguuaacugaaaguugagauuaacucuuugcaccuaucaaaaucaaaccaggccgagcgcggugccucaggccuguaaucccagcacuuugggaggccgaagugggcggaucacgagauccggagauugagaccauccuugccaacauggugaaugaaaccccaucucuacuaaaaauacaaaaauuccagaucagccucgccaaaauaaaaaauuagccgggcaugguggugugcgccuguaauccuagccacuccggaggcugaggcaggagaaucacuugaacccgggaggcggagguugcagugggccgagauugcgccacugcacuccagccuggagacagagcgagacaacgucucaaaaaagaaaaaaaagaaaaaagcagauuuuugguuagguaggaaaagcucuuuguuugaaugagauucccuuguuuacauguuuuuaaggaauaacguguuugauguuacaucuuucauuuuauuuguuuguuucgauagaguguauuuuuugccaugugggcucuuuucguuguuuugcguuacuuauagaaagacuguuuuuguuauuuaauuuuuauaacaauagcuuuuaaauuuaaaacauaguucuaaaauaguaguuuaaaauuuaaagaacuauacauuuuuugauuuaucagauuuagauaauaggauuuaacaccuccccacaccccccaguaaagacaaauaaaugaacucggauucauuuccauuccuuccuuacccaauuugaauuaguuuaauuauuuucauuuugucaagguuuauacauuuacauucuguacauuuacauucuguucuguagcuauaacagccuaacuaugauuuuuuaaaauaggauuauuuauuuaauagguuuuuuuuuaauaggguuauaguggguuaacagcccucuguugcccagguuggaguacaguggcgcaaucauagcucacuguauguaaccuugaacgccugcucaaacuauccucccggcucagcuucccaaguagcuugggacuacagauacacacuaacaccuggcuaaucuuuaaauuuuuuguagagacagagucuugcuauguugcucaggcugaucucaaacuccuggccccaagcaauccccugcuucggccuccuaaagugcugggaguacagaugugaguuacagcacccaauccuauaaaguuuauauaaauuguuuucccaacuccaguacucauuaacauaaaaaagcuucuuaauagcuuuuucauuccugaauuguuugauuaaucauuagugcuccccacguccacaucuccaagaaaauuucaaguuuaugugcuagaaaauauuuuccuuuuuuuuuuuuuuuuuuuuuuuuuugagacagagucucacuguguugcccaggcuggagugcaguggugcagucucagcucacugcaagcuccaccucccggguucacgcuauucuccugccucagccuccugaguagcugggacugcaggcucccgccaccacaccccgcuaauuuuuuuguaucuuuaguagagacgggguuucaccauguuagccaggauggucucgaucuccugaccucaugauccgccugccucggccucccaaagugcugggauuauuuuccuguauuuauaagugaaugcuagcuuggcugcagguacaguucuuggucacgcucuuugcuuuugacaggugcugagcagcuggugcaaaagccuugagacugguuaaagagaauaaagauaagauuuagggaggaaggaagagaucagaaacugcaaggcguuguagucuguucuaaagaguaguaaucuguucuagugaguacguuauuaugcuagcuuaggcaggggaguaaugugaccccgcauuuucuuuggagaaagcauugaaggaggaacaaguauggaaguggggagguuagugaagagccagggcaguaguccaggcaagagguggugcuggugguuugggggcuggagugaaguuugugagguagaauugaugggauggaucaguggaguagauacaggggagcaggaugaggagacaaagaaucaaggaugacacccugguuucugauuucagcaagcagguagauggaguuggaguuuaccgaguuaagguagacuguaggaggccgugaaaucaagagucuguuuuggccauuuuaggucagaugucccuucuucauuucucuucacccucuacccuguccuuuaguguuuccuagagcuggauucuuugggaauguuugcugcugccucugaaguccagcagugaccucuguccaagucauuguucaaguaaaagauguguggcugggauccugaggacccucucaguuacuuuuagagaaaugggcccuguguuugaaaucuggagauauauguguuggcuguuugcaucuuccuagguuuggaacccaauuucacuaucuggcagauaauucuuugcagugugugauuugagguucuacuuguuccaaguuuacuguggaaugaauuuuccccucuaauuuuagccauucuauuaauguuagugguuuucagggaaagggaggaaauaaccuuuuaaaauuuuucuuaaauuuuuauuuaaaaauuuuuuuuuagagauggagucucguuauguuguccaggcugaccucgaacuccuggccccaagccauucucucaccuuggccucccaaaggguugggaugacaggugugagucccugcgccugguuggaaauaacucuuauucugcuaucuuuucccagaagaccccaguacauuuaguuuuaaaccgcucuuuuguguguuugacuuugggcuuauuuuuuguccuccgaguucuaaaaaguuggauuagaaacucucugucugcagguauguuauaacgaacuacauuaauaaauuauuguuacuuucucuguuucuagguguuuccuguaauguuucuguggauaaggaacagaagcuauccaaacgugaaaaggaaaaugguuggugaguaaaacuguauuuauaugaauauguuagagaauuuucuuuaauaaaaaucuuuaaaaggucauuacuaguaguaagauuacuugggauaaaacuuuucaugauaguaaaaaaaucagucguucgcauauaucaguucuuuuuuuugcuuuuucuauauccuguuuuagaaaggaauauguuaguucuugagugguuguggucaccuuuagauauugaaaaguuagaguuucuagauuucuaaaagcauaugcugacauucccuuuuuggaucuuugggcuuggugcugaagaaaaucaaaaauaaaaauagaaaaagaaggucgggcacgguggcucacgccuguaaucccagcacuuucggaggccaaggugggcagaucaccggggggucaggaauucgagaccagccuggccaacauggcaaaaccccgucuccacuaaaaauacacaaauuagccgggcaugguggugcgggccuguaaucccaccuacucaagaggcugagacaggagaaucacuagaacuacggagguggagguugcagugagccaagaucgccagugcacugcagccugggcaacagagaaagacuccgucucaaaaaaaaaaaaaaaaaaaaaaaaaaagaagaaaaggaaauaccuauauuauaaaaucucaauguuaaagggugccuuaggcuaaugcugcccaacuuucucauguuauggcacacacauaaaaugcugcugucacacacacagccuauugggguaaacagacaaggcuguuuguggcaagagcaaacaacacaggagcuccagcaaucugaagcccuguguggccacuuuaaggguagaggggacaaauaucuugccauaccugccacccaugugccauagugacgccugagcaaacugagugggaagcgcugcccuauauaauuguugcugcaaauguaaacuguaucuuacacuugcguaugaaauaacuuuaggugguacacaguuaaacaaaaauuaauuauguguauauuuuaauguguauuaaaaauacuggcuuuucauuuuuagugaugcuagaguauccuaucaaauaaaguauauuucaauuuaaaaaaaauuacucugugcacuuaugaccaaauaccuccugaugaccccuccucccaauaccaucacauuaggagcuaccauuucaacuuauacaugugguaggggacagaaacauucaauacuuagucgcuccuaaaacccuuucgauuucuugagugauggggugauaaggguaucuuuuguuaccauguuuggucuuaguccccaguucugacagaagagcuucuaagaugcuuggaaucucuggagugauaauaaugucguuuuuaauccuaaugaggugacuguggcuggggggcuucuauguagcuucaggauugggggccagaaggaccaaggcaugauuagaggguuggaaguuuuggcccuaccccaaccucuucuccuaccuccaucgagggcagaggggcuagagauuaucagcaaugguguaauuaaucaugccuguguuauaaaaccuccaaaaaacccauggguuuuagagaacuuccagauuggugaauaugagaugccgggagggugguguaccuagaaaggucuuggaagcucugugucccccuucuguaaccuuugcccuauguaucucuuccauaaaagugaaaaaaaaaaaaaaagaaaaaaaguuucuccauuuaagauaaauuaguaauaguacagaugguuuguggaugugacagaaauuguggugccggcaugcaggccauaaaaauuuggaaaacccaccucagaucauuucucauuugguaguugaagaaaguuaggcccagggaggcuagaacuuugcuaaggucacaggacuaauuagcaguaagagcuaggaugaugcuuguuacccuuccuuacugccuucgaagugcucuuucuucuccacuuucuagcucuagcucuagccauuuugauaucaccaucauuuuuguccuauuuguguaccagguaccaacugugcuauuacauacuaaauuuuuaaaauuaaaucaacucaaaauuuuuauuuaaauuugucuuaaaaggauuguuuuuacuaucauaaauacauacuugccauaacuagaaaguaacucugaagauaauuacagugaaaacaaauguuauuaguucuagcugagauguuguugccuggcugguucucugccugaggucuguucuguuacuauuaaaagauuugcgacuaugagacaagugucaaagacagucuagcaccaaaccgagacuuucuucuuuuuucuaaucaggauugauagagaauucacucucuuugauccagaguuauuaauacuguuuguaucaccuaaacccaucgauuagacugccuucaguugucuuggacuucacuaggguugugugcugcacacucccguguugcuuugggaugcuugugaauuuuuugauaccugccugagccuuucugcugauggucagcaagagcacugugggcuuuagaaauauguugugaaggugccagugcuguuuucucuguuaagucugacuuuguccuuuguugaggaucuuaacaaucggauuauuccuugucuaacaucaccuuacgauuauuggcacugccuucucaauguuacuguucaaugaaaggggugaaugcuggccaaauucuugccaacugugaaagcggaaaguugcugccuuaauacuagcuaccaucucuucauugcuccacaagaugauucuagaagugugaauggguuuguuccuauuuuuggugguguuuagguugauuuugauaacucgggauaaaacagucuuauucauggcucaguggauuuggggaguucaagccucugguuucucugaguguccuuucuuggcugaugacauuagauauuaguuugcagucuugguaauggugugaggcggucuuauaaugguaaugagguuugauauauagcauggagguuuaccuguucacugugaguaauuuaagugggauuuaccgacaugcuuuuuauuucucauauaaacauuuaaacaagcuggcuggguauggugacuccugccaguaaucucacauuugggaggccaagguggaggauugcuugaggcuaggaguucgagaccagccugggcaacauagcgagacuauuucuacuauaaaacuaaaauauagaagcuuauaaaagcccguagacacuuaauauguaaucaguggcauacuauccagcuaaucacaucaucagugagaauucaugacuuaaucagauggugauccauuuuguucuuuguuccauauguugcuguaauaauuaacagugucucaguaucuguaaguaaacaaugauguagucuauaaucugugagucuuggguagcucccuuuugcuugauagcaggaauggauauuuagugauuacaaguguuucacauacugaguaggaguuagaauacuuuuguaauaaaaaucguuugugguguauguuuuacuacugugaucacuacuagauuuaaaucucuaguuaucauuuugcuauguguuggaaugguaauuuuaguauauuuauagaaugguaaauuuggaugggucaguucaacaaggcguuugggagacacuggauucuaagccagguuuuaaggagacaugaauaggcuuugggggaggguauauucaaguguguggaaccugaguugagagguaacuagaaugaagaaacaauuacauggguugucaucuaacuuuagagacuuuuuuuuuauuaagccaagcaguauuaccuuccacuagagcagaguuugguaaacuauggcccauggggcgggcacccauuugugaauacgaguuuauuggaacacagguuauucaguuaguauugucuauaggugcuuccguuuuacaauggcagaggugaguagugacagacaccagauggcuggcgaggcuaaaauauuuauucuccacuuuguuacauuaguaccagauggaggaauuuauauucuagaaaaacaccaccucaauauucucucuugucacuuuuuuguaugucccuugucauuugauacuuaaggcaucguggcugucuuuacauuuuuauuguaaauaucuuacuaucauuuuuuccuauccuuuauguaugaccuaguguggucagaauagcauacuugagaaacugagguguuuauggauuuuaacagugagauuuuuauuauaaugaguugcugcuucguuuccuaaagcaagacauuucuuuauugcagcguccuugagacuuugugcugcgcggggugcucacucaaucuuggcuacguguacagaugcacgcccaagaaucuugauuacaagagagacuuguuuugccucaguguugaagccauugaaagguaaguuugauauauaaauguuuaccucacaacugguguuucagaaaguuaaggcacggaauugucagaacuaaaucaauacuguuugguuaaauauauuuucaaguaaugauuucuaacaagccaguaauuuuuuuuuuuuuugcuuugaccuccuucuuuauuugguauuggaaaagucagacacucuaaauuguaggagaaaacacugugagaaaauuuuuggaauaaaaguauauucaguuguuuuuaaaaauugaaaguaguucaguaggauauugcccccugcccccagcuuuuuauuuuuauuuauuuuaaaacuuauuuuuuuaagauauggggucucacucugucgcccaggcuggagugcagugcuguggucauagcuuucugcauccuugaacuccugggcuccagcgauccuccugccucagccucccaaguagcuaagacuacaggcauauugcccggggucuuguguugcccaggcugguuucaaacuccuagccucagaugauccuucugucucagccuccugaauagcugggaacaagugcaugccaccacacccagcuuguauuuuaaccuuguaccguacuucaguuauguuuuaggguccucugaaaagcaaauugugucagaagauaaagagcuuuuuaaucuugaaagcagaguugaaauagaaaagucucuaacacagguaauuuuauucuguacauuuuauaucuuuguaugaacaguuugucagugaagaagugcucccccacaaacgauaauucucauaacgucaucuguguugauugcaggaagagugugcuuauuucauuucaguuguuaguaaaguugauuuuuggggaacucaaaagcuaaagcuuaaucaacaaaauaaugaggaagacaugucaugucaaaaucaaaacuauauauuaaaacacugcaaagcuagaaauacaucuuugauucaaaucaguauuuuguuugauucaauucuugugguauaaauagccuuguuguuggauguuaacauuuucucauugccagauaggugagauggugaugauuguauaaaagagauguagauuauagguugagaacuacuguugauagaauuaugcuuuauuuuuaaaaaauuuaugccucuaaauaguuuuguuaaacacugaauaucuaccuuguaauguaugacauauccaaaauugcauuaaguguauaucuuaauuauauuuaaccauguauaauuuuuaauuauauguguguuucuuuauuuuuuuauuuuuuaaauucaauagauggaagaugucuugaaagcauuacaaaugaagcugugggaggccgaauccaaauuguccuuugccacuuguaaaagcugaacucuagucuguguccuccauucugcccccgcccuuccuccccuuauuuguuaaaugaagcaacauagugagacgucgucucuacaaaaaaaaaaagaaaaaaaaaauuagccaggcaugcgaaacgcugaggugggaggaucagaugagcuugggagguugaggcugcagugagccuuggucaugccacuacuguguucuagucugggcaacagagugagaccuucucucaaaaaaaaaacccaaaauuguagaauuacuucuauagcuauauuuuaugauaaagaagugauuguuucucaaaaucgcauuuuaaagacguuuuaugguacuuguuggaauugggacuuaggaguuuugauuuugauaagaaacugggauaauuuucugaacuuuuuuuccucuguaucacauuuauuuacuauuuuuaaaaacuuugacauuuaacacuugggacaacauuuauuauaaaugauaagaaaaaucuuagagguuugucuacccacagugucauggaaucuucucugaaaacuaauccauaaaguucccuggagaaauuggucagaaugaucugucagaaccauuugaaaacuugcucaagagcaguugcuuauauauaguaggauuuuacuuuuuccugcuuauguacuacuauaugcuuaaaaaaccuggaggaauacuuaccaaagaggaguaaccaucucugagggugggauucugggggaauuuuuguuuuuuucuguuuucuauaaugugaaacuuuuguaguauguauuuuucuaauugaagagaauaaagauuaaaacaaagugcuuuaa

SEQ ID NO: 192647 - RNA, 30849 nt, Homo sapiens
aucuccgcugguucccggaagccgccgcggacaagcucucccgggcgcgggcgggggucgugugcuuggaggaagccgcggaacccccagcguccguccauggcguggagccuugggagcuggcuggguggcugccugcuggugucaggugagggguccgcggggagggggcgcgcuugggaaccgggaggccccgcgagaugccgccccugaucccaucccugggcgcccugcaagugacuuaagagccuucggggccucgggagagaagaugcaaacgccacggccggcugcugagacgcaacuaggcugcugcugccgucgauucuguaacaggagaaagccccauccgcgcccggauuacagaccgucugggcccuaaacucagggggagacucccggcgucuuuugauucccuguccuccugcagcucucugcuggcgggcgucuaaauaaaguagcuuccccaaaagacccaagaucccaccguggcugucaucugacccuucuggagacuaucaguucaaguggaggcccccaccaguccccgagugcccugacagcccucccugaccccaagucugcccccucagugccagcccucccuacagaugugccucccaucacccgcugcaccuccccuccuuccgguucaggcccgagcacccugaaaucuggauucugucccccagcgccccagcuccauggcuucuaaaccuaaauccauugaaaccuuuucuguccucuaaauugacugccuagguuccaauaacaccauggucaccuccuuccuuucucaugaacucuucccuggccuuccgggauaccccuccgguuucccgcccugucaggcugucucugcuugggacccuccugcucugucagguuucuauguagcuaauugugaugcccaaggccuuuucucuccuucccuggcacuguuccuuugggggauuucagccaaacccuggcauuaaacacgggcuauaggcccaugacucgcacauuuauaucucucuugguaccaguugggugauggguggugguuuauuauagucuucuacuuuucuacuugcauguagguuucaaauuuucuuuucuuucuuucuucuuccguuuuuuuuuuuguuuguuuguuuuuuuguuuuuuuguuuuuuuuugagacaggguuuugcucuguugcuguggcccaggcuggagugcaguggcuugaucuugccucacugccaccuccgccucccggguucaagcgauuuuccucccucagccucccgaguagcuggaauuacaggugugugccacuacgccuggcuaauuuuuguauuuuuauuggagaugggguuucgccauguuggccaggcuggucucgaacuccugaccucaggugauucaccuuccucagccucccaaagagcugggauuacaggcgcgagccaccaugccuggccagguuucgaauuuucuauuaaaagguuugaaaauaauuucugucucuagcccacaucucuucuuggugugaccucugggcucauucaucuggcugucucccugacauuccuacuucagccucucuccagcaucuccaaccuaaugcagcucaaaugggacucgugaguuccccagcugagcuccaaucggggcaccagcugcuuaagcccaaaauggacauugaccucagcuuuuaugcaucaaauguaucaggaagucuccaguuuguuuuuacgucuggaaauauaucugaaauccaugugcccacccuacccccucauagcuuucugccaccagacaaauccaaggcuccuuugucuguccccauuuuacuccugccccuccagaaauuucuccucacggcuguucaaagaaaaucuagacuccucagcacagccaaccugucucucccucccucacccacguggccuuugaagacauggagccauagaggagaaccaagugcuggaugugggcuuuuucaugggcaucuguuuugaggagaaaaguuguaaauguuuuugucuuauuuucauagcauugggaaugguaccaccucccgaaaaugucagaaugaauucuguuaauuucaagaacauucuacagugggagucaccugcuuuugccaaagggaaccugacuuucacagcucaguaccuaaggugggucuggccucacuauuggcaggaacgcaccggaggagccagcccugggcuggucacuggguugggccacaggaggaagggagucugacuacggucaccgugugacugugacaacccucagggagccucccugccagccuuuugcugucugggaaauucucguggccaccuuuucucuuuuagguuuucuaguugugaugguugacgauuugacuguuaaucacagggcugcuggcagauacagacauuuuaucaugcguauguagauauaaucagccauagugguaaccucaugcugugcccaucccagcuuguuugucacaguugauauauuuuaaaagaaaaauaccacugcugucaucucuagguaugaguaguauugcuggaagucagcaauguugaguggaugcuacccaagaaacugagauaugcaaagcggucaggaagccccuugcuaccauauaucaccuguuccccuccaauggauuauaacaucaugccccagugccaugcgcgaugcacauaauuugcauaaugagugcucaguuucuccgugguuccauccugaaauuaaaaguaagacagcuacugacuguuaaaaaccccauucucggacaacagcaggggcugugaaggaagagugagugucacccuagacggucaucucaguggugaucugaacgcccucuaccucuccugccugucaguguuucccuacgccuggugaaggaagucagugccagcacucccuuggcagccugccaccauacgccacaugcuggacugcaggugacacaccuuuaggccaggcgcaaacagcagcaggaggcccaaggcugacaagccaacacaccugcuuucugugugacucagaaacauacgaagauagacaaguccuucagugaggcaggaggaaauuucuucccagauccagcugucauuucacaaaaauccccaaggccugcuacaucagagaagaaguagaaaggugaauaagauaguccucgucugugcauugcuggcuuuuguuuuuuaacuuuuaguucaaaauaauuccagacuaacagaacauuucaaaauuuuaaguagaauacaaagaauuuccaaauagccuacaaucagauucaccaauuuuuuuuuuuuuuuuuuuuuuuaugagacggagucucgcucugucacccaggcuggagugcaguggcgcgaucucggcucacugcaaccucugccucucggguucacgccauucuccugccucagccucccgaguagaugggaguacaggcucccaccaccaugcccagcuaauuuuuuguauuuuuaguagagacgggguuucaccguguuagccaggauggucacuaucuccugaccucaugauccacccaccucggcuucccgaagugcugggauuacaggcgugagccaccacgcccggcccagguucaccaauuuuuaauguuggucacauucucucccuuccucucucucucucaugcccuuugugcuguaauauuucacuguguauuucacaagaacaaggauaaucucuuacaucacauaguacagugagaagcucaggaacuuuuacauucauaaaauacuuguaucuaauuuacaguccauaguccaguacugucagcugucccaaggauugaaggagggcauacucuauaauuaauuuuuuuccugaugugcauuuucuaguacugauuggcuuuaucauuugcuuucugugcugucucuacucagucugaauagccacggagauuuuacuguggaaaauuaaauuucuucucugucugucugucucccuguaguuuuucuuguucugugcugugcuuuuggguuuguuuguuuguuuuucuuuuuuuuuuuuuugagacggagucucgcucuguugcccaggcuggagugcaguagcgcgaucucaucucacugcaaccuccgccucccggguucacgccauucuccugccucagccucccgaguagcugggacuacaggcgcccgccaccacgcccggcuaauuuuuuuuaguagagacacuguuucaccguguuacccaggauggucuugaucuccugaccucgugauccacccgccuuggcuucccaaagugcugggauuacaggcgugagccaccgcgcccagccuuuuuuuuuuuuuuucuuugagacagggucucacucugucaccaaggcuggagugcagugguacgaccucugcucacugcagccuccaccuccuggguucaagcgauucuccugccucagccuccugaguagcugggacuacaagcacaugccaccgugcccaacugauuuuuguacuucuagcagagaugggguuucaccauguuggccgagcuggucuugaacuccuggccucaagugauccaccugccucagucucccaaagagcugggauuacaggcgugagcuaccacacccagcccaugccaugccuuuuugccauuauagucgaggcacuuggcuuugcauguuuaucuuuuauguuagcgaucccaaugacuucaugaagugacuucaugaggguauccacaccuggguuccaggucucccccgcguggaacuacagagugaguauggcaugugcuggagaaaacaaaauaugugcuggccguguccuuggggaagauauuugaucccuaaagaugugauugccucauguggcucuacaaaagaguuguuuagaguuuagcaugagcaauugcacagcacaaacucucuguuguuugcgugcauuggggcagggcguccagagccgggggcacuucagaggauguacuggugauuuuaauauaaaaacauccaaaacaauuagauguaaauaugaggaaugggucauauuaccuauuuaaugcggggagaaguauuuguacaugcaauaaaaauaaccuagugaaggccaggcgcgguggcucaugcccguaaucccagcacuuugggaggccgagguggguggaucaccugagaucaggaguucgagaccagccuuaccaacauggcaaaaccccaucuuuacuaaaaauacaaaauuagccggguaugguggugcauaccuguagucccagcuacucagaaggcugaggcaggagaaucacuugaacccaggaggcagagauugcagcaagcugagauugcaccauugcacuccagccugggugacagagugagacuccaucucaaaaaaaaaaaaaaccuagugaaaaagauguuauugcaaaacaacuuuugaaauacugcacaugcuggacaauugaugcauuaguuuaaaagaaggaaaugggccaguaaucccaguacuuuggggggccaagguaggauaaucauuugaggccaggaguucaagaccagccugggcaacauagcagccucuugucucuacaauuuuuuuuuuuaauuagcuggacuugaguuggaaagaaggaaggcggaagggaagaaagaagguagggaggaaaaaaaauauggccacaugugagaaaacccccuuaaugaaaugaccgcuggauuuuccaaaugaugggauguuaagcagccgugaagaaaugguugauugacaaauauuugugguauauuaagugaaaaaauagcaugaucccaaugaucucuaucuacuuuuugcaagggauuuuucuagguaucacuaagaaugcugugagaugugaugugcuaccuuagacuaugaagucaaacagaucugaguucaguugggcagauuucuuaggcucuccacgccugaccccuguguacuuaauaaauguuggcuguuguuauuuuuaucaccaucacuuucaucaucacuucugggagcaaccaaauugguuuuggcaccagaagaugucuugggggaccaaucagauagcuccucacuuuuuuauuuuauuuuauaaauuuuuaaauuaaauuaaauuaaauuuuuugagacagugucacucuguugcccaggcuggagugcaguggugcaaucacgucucacugcagccuccaccucccaggcucaagcgagcuucccuccuuagccuacugaguagcugggacuacaggcgcaugccaccauacccaaauaauuuuuuuauuuuuuguagagacaaggacucaccacguuguccaggcuguucucaaacuccugggcucaagugauccucugccucggccucccagagugcugggauuauaggcgugagccacugagccgggccagcuccucacuuuuugcaggaugagagccugggcuuccuuugaucacguggagccaauuacaccuccuuggcuguugcgagcuuagauucaggagauuguauuucccuagcauccaacaggcauguccaaaugucaucucuuuucuuccacuucacuuucugucauguucccuuuagcgguugcugucggggcugguguucugacugagacugaugaauuguuuuauaauuuuuccagaguaauugcaaugauagucauuuauaggacaggacagucacgggucacuuaacaacugggguagauucugagaaaugcaucauuagacaguuuugcugugugaacgucaugcaguguacuugcacaaaccuagaugguguagccucguauacaccuaggcuaugugguuuagccuauugccccaggcuguaaaccuguacagcauguuacuguacugagugcuguaggcaaucguaacacaaugguauuuguauacaggcauaucacagagauaaggcaguuuugguuccagacuaacacaauaaagcuaaaaccacaauagagugagucacaugaauuuuuuuguuucccggugcaucuaaaaauuauguuuauacuguaguccauuaagugugugauagcguuaugucuaaaaaaaugugcacagcuuaauuuuaaaauauuuacuugcggaaaaaugguagcaaucaucagagccuucagcaagucauaauccuuuugcucguggagcaucuugccuugauauggauggcugcugacugaucaggguagugguugcugaguugcagugacugugacaauuucuugaaauaagaugacaaugaagucugcugcaucaacuaacucuuccuuucaugacagauuucucuguagcaugagaugcuguucgguagcauuuuacucacagaagaacuucuuucaaaauuggaauccuuucaaacccugcuaucaacuaaguuuauguaauauucuaaauccuuuguugucauuucaacaauguucauagcaucuucaccaggaauaaauuccaucucaagaaaccacuuucuuugcucacucauuagaaacaacucuucaucuguucaacuuuuaucaugagauuggagcaauucagucgcaucuucggguuccgcuucuaauucuaguuaucuugcuguuuucaccacaucugcaguuacuuccuccacugaagucuugaaccccuuaaagucaucuaugaggguuggaaucagcuucuuccaaaccccuguuaauguuauauuuugaccuccuccuaugaaucaccaguguucuuaauggcauuuugaauggugaauccuuucugggagguuuucaauuuaccuugcccagauccaucagagaaaucacuaucuauggcagcuauaacuuuacaaaauauauuucuuuauuuuauuuuauuucauuuuauuuuauuuuuuaagauggagucucacucuguugcccaggcugaagugcagugguaugaucucagaucacugcugccuccaccucccagguucaagugauucuccugccucagcuucccaaguagugacaccacaccaggcuaauuuuuguauuuuuuuuuuaguaaagucaggguuucaccauguuggccaggcuggucucgaacuccugaccucaagugauuugcccgccuuggccucccaaagugcucagauuacaggcaugagccacugugcccagcuucaaaauauauuucuuaaauaauaagauuugaaagucgaaauaacuccuugacccaugggcuacagaauggauguuguguuagcaggcaugaaaacagcauuaauuuccuuuuaaaucuccaucagaguucuuggggaaccagguacauugucaaugagagguaauauuuugagagaaaacuuuuuauccugagcaguaggucuuaauacugggcuuaaaauauucaguaaaccaugcuguaaacagaugugccguccuccaggcuuuguugcuccauuuguagagcacaggcagaguagauuuggcauaauucuuaagagcucucugauuuucaaaaugguaauccaguguuggcuucaacuuaaagucaccagcuacauuagcccuuaacaagagucagccuguucuuugaagcuuugaagccaggcauugacuucuccucuguaacuaugaaaguccuagaugacaucuuaauagaagguuguuucaucuacauuaaaaaucuguuguuuagaguauccaccuucaucauuuuagcuagauuuuagcuagaucuucuggauaacuugcugcagcuucuacaugggcacuugcugcuucaccuugcacuuuuauauuauggagauggcuucuguccuuaaaccuuaugaaccaaccucugcuaacuuccaacuuuucuuuuuuuuuuuuuuuuuuuuugagauggagucucgcucuguugcccaagcuggaauacagugacacaaucucggcuuauugcaaccucugccucccggguucaagugauucuccugccucaaccuccugaguagcugagauuacaggugcaugccaccaugcccggcuaauuuuuuuguauuuuuaguagaggugggguuucaccauguuggucaggcuggucuugaacuccugaccugaugauccgcccaccucagacucacaaagugcugggauuacaggcgugagccaccacacccagccccaacuuuucuucugcaguuuccucaccucuuuaagccuucacagaauuggaguguuagggucuugcuguggauuagacuuuggcuuaagggaaugguguggcugguuugaucuucuauccagaccacugagacuuucugcauauuuucaauaaggcuguuuuacuuucuuauuauuaauguguucacuggaguagcacuuuaaauuuccuucaacaacuuuuccuuugcauucacaacuuggcuaacuguuuggcccaaggggccuguuguggccugcaauaugccuuccucacuaagcuuaauccuuugcagcuuuuggaauagggaugcccgaggagaaggagagaggcaggagaguggacaguggguggagaagucagaacacucacaacaucuauugauuaauuucacugucuuauauaggugugguucaugguaccccaaaacaauuacaacaguaacaucaaagaucacugaucacagaucaccauaacacauauaaucaugaugaaaaguuuugaaauauugcgagaauuaccaaaaugugacauaaagacaugaagugagcaugugcuguuggaaaaauggcaccaauagacuugcucaaugcaggguugcugcagaccuucgauuuguaaaaugcaauaucugugaaguacaguaaagcaaaucacaauaaaaugagguaugucuacaucuaaauguauuuaaacauagaaaagguacaguaaaaauacaguaucauuaucuuagggcaucaacguuguauauguggucugucaucuaccgaaaugucauuaugcagcacaugacuuuauugaaaaucauuguaauaucuuuauuuugguaaauuuuuguaaaucaaugucucauaaaucacaugccccuguuuucaaaaauacguaaucaaggaagcaagcuuucuuggucaaguaugcugaauacucaaccccuuggagaggcacguagucauuaagauguucaagucucugagaaguucuguuuugaagacacguauuucuauguuuaacacaguuuccacucccgcgccgccccccccuccaaauuaaguaccagucagccucagggagacugaagccagaacucuccugauugaccuaucuuuuugauuguguaguuauaggauauuccaagauaaaugcaugaauacuaccuugacggaaugugauuucucaagucuuuccaaguauggugaccacaccuugagagucagggcugaauuugcagaugagcauucagacuggguaaacaucaccuucuguccuguggaugacaguaagccauuuuguuuucccuuuuuuuguaaugucaucaucuugccuuguuuuuuuccacauugguugguccaucaacaagaauucuuugagggcccacaaauggauggccuugcacaaggagcuuaaggaauauaauaaagagaguuguaucccuaaagaauucaugggagagacagaaaaagauaggcauaucaucaaugcaacaauuaaauauaaaucuaacaccuucagugccucaaggaugugacuauguuggggcccgugcuguugaggagaaguucuggaaggauucuuguggugaauuuucugggagaaagucaguauggaauuaugacuuaaacaaagaaacauaacgugauaggcaaaagaaugaaggcagauguagagauggaaaauaugaugcggacagccggcuugcccagagcgaaggacagagggagggauagggcugauggcagguggguugggucagacugguuggucagcaucaaaaauuguucccagguuagguggagauugcagugagccgagaucacgccacugcacuccagccugggcaauagagugagacuuggucucaaaaaaaaaaaaaauauuguucccagguuagauuuggagggucauggugaccaccagaguccccuaaauaugagaugagcauauuuagaauaucaggaauugaaaacuaauuaaaccauauauuagcaauugagagaguaaagaagauuagagguuaaaagaaccuaauucacaaaauucacauacagcccuucaaaacucacauagagaaaagcacuaaaagaauugucucuggcuaggcaugguggcucacgucuaugaucccaacacuuugggaggcugaggugguggaucacuugagcccaggaauuuucuuuuuuucuuucuuucuuucuuuuuuuuuuuuuuuuuuuuugagacaaagucucacucugacacccaggcugaagugcaguggcgcgaucucagaucacugcaaacugccuccaggguucaaaugauucucgugccucagccuccugaguagcugggacuucaagugccugucacuaugcccagcuaaauuuuuuuguauuuuuaguagagacggggucucaccauguuggccaggcuggucuugaacuccugaccuuaagugauccaccugccucagccucccaaagugcugggauuacagacaugaaccaccacacuuguccuugagcccaggaauuuaagaccagccugggcaacauggugaaacccugucucuacaaaaaacaaaaaaaauaccaaaaaaaaaaaaaaaaaaaaauuagccaggcaugguggagugugcuuguagucccagcuacuugggaggcugaggugggagagucaucugagccugggaagucaaggcugcagugagccauuaucacaccacugcacuccagcagccugggugaccagagugaagucuuaucucaaaaaaagaagugucucuauauggggaguggucuuuaugccggucccugcucuggacccccaugaccccuacaguuacauccucccugguagagaaugaugcuaggaugccuuucuucccuuucccaauuccaucccaagccuggguaaaaacgucuuacuuuuggaaucauaaauuaucaaaguuagauuauauuuucuaaugguaccuuuacaaaaacaaaggaaagaugaacagaaaaguaaguuucacaauaguuaaaaguacaaguuuuugcuccuauaauugcuaacuggcuuaccagguccuaacuugucccaaauccuguuagcucccauccauggaaguucccuuuagagccuagguacaacacgguuaagcagcuugucaaaaagucauacaggucaugaguggcugagcaaggauucagacccaggcucuugcuucugugcucuuagcaacuacuacccaauauuggagauuugccucuugaagucuauguauuuuagugauaggaaaguguuuccaggcaucaugcauaaccuauuuauacuugcuuuggcaaaguauuccaacaaguuuucuugucugguuuucagacgagcacuuuagaaugauggaagcagguccauuaacagcccugaaaaaguaacagcagccaaagaagaauacaggacauaacucaaacaccaugauugccuggaaccauuuaugaaucauucuauaguuauuauugaguacaucuguguaacagcugcauucugagcacugaagcuacaacaaugaacgagacaaaauaccucauggagcauauaugugcuaaucaggaauacagauaauaaauaaauagauacauauuacaugacagguagugacuaugguucuuaagaagacugaagcaaggcaauaggacagaaaguaaugggagcugcacuucuacauagaaugguaagauacagucucucugaggaaguagcauuugagcagagacccauaugaagugaaggagccagccacaugaauaucuaguaaaagagcauucagaagggaaacagcuuuagacauuguuggaaauauauaugguuaauuauauauguuaaacauguaaagguggccacuaaaaauaauagagaugccaucuguagcuuccauccugaaaaaggaaauaaaauucaagccaacaaaaagcaggaauaaaagaggagaagacaccaaaaacauaaaauagaaauuuaaaaagaaauccuuauagaaaauacaaaauagcguagcuggaauaauuccaaauguaucagaaaccacaauaaacauaaguggacuaaacuucauuaagaaagacaaagauuaucagauuuuuuaaaagaaacuaaauccaacuacccuucuuagccaugucaaucaaugucaugacaauaguauaucaaagcaguguacuuccguggacuaauuguucugcaugguuaugaaaaauuaauguugaaguuuuuaaaaugugauuuuugauugucauuuugcuuguucuucugcuuagccauuauuggacccccuggaaugcaaguagaaguacuugcugauucuuuacauaugcguuucuuagccccuaaaauugagaaugaauacgaaacuuggacuaugaagaauguguauaacucauggacuuauaaugugcaauacuggaaaaacgguacugaugaaaagguaagguuggcuaauugcauuucagagguaguaggcuuucauauucuuugcagaaucuugcaagguggcagcaccuuauggacugguccucuguaagccaagagcuucccagacugagggguuacugguaucucuggcucaagcuucccagacuccuaagggauauguguagagcagacuuucaggacaaagucugcacagugacagcagaccuuucccucccugaagggcagcugcaggggaaggcacaguugagucagaguuagcuaagggaacuuggagcuggcugaauuaggugaucagcaaauugacaacugucccaugacaucaaccccugugucccacacacaccgcaaaucagggacguccguggucaagacagccccuuguugcucuauucuucaggggacaauuucuuuaaaaacaugggcuuggagucaaaagaucugaucggaauaucacccgugccaccaugugccauuggucacuuucuugaccccagccuccucaagucugcaaaaugggcauaauaacuuacuuuauuaauaaaacaaggauaauaaccuacuucguaagauuguuggggaauuuaaugaaauaauagaaaauauaaacucaucccauugccuggaaugauguauauauggucaguacaucaguacaugagguuuccuuccucuuugcuagacauguuaagguuauuuuuauucauccuuggucaagguuuauucugacaccuaaugcuucugagcugaaugccauucaugguccuaaacugacauauauauguuauguaugucauauuacauauauguuaucccuuccacauuaaauguugauuuuaccacuuaauucucaaaguguuugggaagaagggaucacccauguuuauuaucuuaggaaugauguaguuaaauuuauauacacacacugcauagcccaaaaaaucucaaguuaauuuuuuuccccaaaaaauguuccauuaaaugaugcagugucuuaguccuuuccugcugccacaacaaaauaccacagacuagguaacuuauaaacacuagaaauuuauuucucacaguucugcaggcugggaaguccaagaucaaggcaccagcagauucagugucuggugagcacuggcgugcucugccuccuagaugguggaaggcaaagggcaaggauguaaacagcucccuugcugcucuuuucuaaggucaccaauggcauucaggaaggcucugcccucauuauuuaaucacuucugaaaaccuccaccucugaguccuaucauagugacaguuaaguuucagcauaugaauucugauacucacaaucacugaucaaaugcaggcaucucugcuaagcccugggguauaaagauaagagcagauugcuccccuccgggagcuagcaacagaccucaauuaaggaucuaguuuuacagugagcagggucaggugccuccugaggcaagugugaaugcaaacuccacuuacuguuuagcuucuuuucucacacaugcccacaacaugggcaucugguuacacauuuguccucucucuucggccaguuguguggcaaccuucugugugacuuaccgaguguggaaaggcugccugcugcacugcuccucucacaggugccugugaugccaccaauacagguuuuuuggggguuuuuuugaggcagagucacagucugucguugcccaggcuggaaagcagcggugcgaucucagcuuacugcaaccuccgccuccuggguucaagcaauucuccugccucagccucccaaguagcugugauuacaggcaucugccaccacaccccgcuaauuuuucuaucaauacaggcuuauaugguuccccucuagaauguagagauuccugaggcggugccagacuaggucccuaaacucacagcaugaagggcuuuugagaauucuuucuuccuguugggagaaagugagaagauaaaaccagaaguugcccagacgugaaagggcagaaaaagccccagcagggauugagaaggucccucuacuacuaugccaccaccuuaccugcuugccucugaguuuaaucuuugaaaaaauuugcauuguaagguuuuagaggcacuggacuucuggaacugcaagcccgccauuuuuuucaguuguugcuuugauuugcuuuuggucuuuuaauuuacuuauuagaaguuaaaccauuuucuucauauauuccauaagucuaauccaauuauugaccuccaugggcuuagcuccucaugcaguagaggcauauaggcaugcugucaacgaccccaaccccaaaaaagaacuaaccaauugcgacugggugugguggcucacaccuguaaucccagcacuuugagaggccaaggugggcagaucaccugaggucaggaguucaagacaagccuggccaacauggcaaaaccccgucucuacaaaaauacaaaaaaaaauuagcugagugugguagugugcaccuguauucucagcuacucgggaggcugaggcaggagaauugcuugagccuggcaacggagguugcagugagccaugaucgugccacugcacuccagccuggacgacaagagugaaacuccaucucaaaaaaaauaauaauuaaaagaccaguuuauuuuauuuauuuauuuacuuuuuucuuuauuucugagacaaagucucgcucugucaccgaggcuggagugcaguguggggugauccuggcucacugcaacuuccaccucccaaguucaagcgauucucgugcgccaccacgcccggcuaauuuuuuguauauuuaguagagaugggguuuugccauguugacuaggcuggucucaaacuccucagucccccaaagugcugugauuacaggcacgagccaacacacccggccugcuuuaucuuuuuuaaaaaagaagugauggcuugugugucauuuaagcuggagaauucaggaaccaaaaugguuugugggcaccacugucaguccuugaugcacccccugaguggccucagggucccugaacugagaggagcaccugcuaccugcuccuuccuauuuuaagucuaaaacggcuauuaucacugauaaaugugaaaaaaaaaaagguggugcccuuccacugcuuagucauguucuuauuuuugucuccauuacuaguuucaaauuacuccccaguaugacuuugagguccucagaaaccuggagccauggacaacuuauuguguucaaguucgaggguuucuuccugaucggaacaaagcuggggaauggagugagccugucugugagcaaacaacccaugacgguaagcccugagaugcaccuccgcuaagcauccuaaacagcuuuauagacaccugcccuagacaugauugcauccaacucaaauuccagcucaguucagaaaucuaucgcccugacauuaucucucagcccugacugcucagcuucaugcuaggaaggagaccacacccgcuucugaggcagcucauucacucuuagaucaaaggaguugcuagaaaccuuuucugucugguggagcgaggucugccuccaugagccccccuuggcaguacuuauucuaccaucccaggcucccuaaagcaaggcucaucaguccucccaagaccaccagcagagcucaagcccugucacauaccccaaaggucuuuccuccccaggcggcacaucuccagccacugccgacaugugaugggaagcaagugucaggaaaucugaccacgguccucagccagugcugccugauucagggccccuuauaugcaggaauccaggaugucaacacaguccuucacacaccauauggaucacuucuagcuuggaggaaggaacgggagaaggaaagagagaagguucccaugggccuaaacacugcauauuuaugugcagacacauugcaguugcauguuggugaaaacugaggcccaggugucugcauacaaacagcaggccuuccuauaauuuaaagauguuggugaaggguucagcaagcucagacaauggaaggaugaaacauggcaugcggcaugcaguuugaucaaaaagaaaaacaugucugccggacgugguggcucacgccuguaauccuaacacuuugagaggccgaggcgggcggaucaccugaggucaggaguuugagaccagccuggccaaaauggcaaaacccugucucuaccaaaaaugcaaaauuuagccaggugugguggcgcacaccuguaaucccagcuacuugggaggcugaggugggagaaucguuugaacccaggaggcagaggcugcagugagcugaggucaugccacugcacuccagccuaagcaauaagagugagacccugccucaaaaaaaaaaaaaaaagaaaagaaaacauuucaaauagcuugcaaauaccaguaaucacccaugaacugacaaaauccaaacauuuuacaaaacaaaaggguaugagccauugaaaaccugcuuucaucaaacaccauuuucauuuuuucuuaaaacacaccuaucccauuuaaaucccacaaguuuucaaugagagcauuagaaggaucuucucccauuuuacaaacuagaacaugaagguucagagagugaugcacuuuggauguugcccucauccagaucucacgcugaaauguaauccccagugcuggagguggcgccuggugggaggugacgggaucaugggggcccauuucucaugaauggcuuaucaccauccccuuggugcuguccucccgagagugagugacuuccugagagaccuggcgguuuaaaaguauguggcaucuugcucucucuugcccccacuuagcuuuccaccaugauugggagcuucuagaggcuuccccagaaacagauaccgcuaugcuuccuguacagccugcagauucaugagcuaauucauccucuuuucuuuauaaauuacccaguuuuaguuauuuguuuauuuguuuuuuggauggagucucacucuguugccuaggcuggagugcaguggcucgaucuuggcacaaccuccgccuccuggguucaagcaauucuacugccucagccuccugaauagcugggauuacagugcccaccaccacacccagcuaauuuuuuuauuuuuaguagagagugggguuucgccauauuggccaggcuggucucgaacuccugaccucaagugauccacccaccucagccucccaaagugcugggguuacagguaugagccaccaugcccagccauccaguuuuaguuauuucuuuauagcagugcaaaaacagccuaaaacagagagguuaaguaacuugcccaaaugcuaguaaaugaaaaggaucaaccagaacacaggcucauucaucuaagcccagguuauguuuccuguaacuuacuaccuauagauuaauuccauagguaaacugaggcaccguguccuuguggauaaaacaggaaagaguagucugccucaugguguggucagaugaaucugaaacaaguuagagaacuuuacacggaggauguagauuaguagauucucccacaguucacaaccuaugcagagcaggguccucucuccugcccccuguggaacucuccaucuggggugaguaacaaaagcauuccuugaaucaugucaccaucacccagauguguccuuguuuaagaugcuaagaugccccaguuugagacaccaggagacccaagcacugccccagagguucauuacccaaaauaaaauaacagggcggggcccauggaucccuguuugaaugagucuccgggcgccaaauuagagaacuaccgaaauauuaauggaaggauggauggaugaguaggagccuggaacuuucucaagaccugggaugucaaaucccaaggagaccucacguguccagcugugguguggacugggggccgcuccagccagcucacugccguaugacccuggaaucaccaagagcagacucacauguuugagcugaacaugcuggaagugugggccagacggcaccgcuucugggcuccggugcaugaaacaaacaagaaccaagaacugggauaaggagugcugaaacccgcaaggacaggagcuggggagaugggaggccgccugcgggaaugaaagcacaagagaacgagggccaugggguugggggcggcacaagugcucagguccuuccagccgcuucccucauacagaugccacuuccaucccucagacguuuaaggagugugcacugugagccacgcacugugacaagcaccaugucgugccagcaggugacugcacuugcuguagcuccagggucaugugcugugucagggcucuuugaucccugugucccuuuaaaacgacaugaucuucaugggcaguguuuguucucuuggccccucucagagccaaaugcugugcucgugagggcggugcugguuggcaggggaugggcacagagaaaucagguggccagggcagcuggaggagggaccuggagccgaacaaggggagcugggaccacgagcaacccaggugacauccuggacucugucaaagauaagcaaagcaggacgcuaauuaaagcagucaaaacauuuuauucaguaaugacuggaguugggaaaagggccgaguuccauuuacucagagguguuuuaaagggagaacgagggccggggcaggaggaucgcuugaacccaggaguucgagaccagccuggccaaaauagugggacccccaucucuauaaaauauuuuaaaaauuagcugggcauggugacacaugccugucgucccagcuacccaggaggcugaggugggaggaucacuugaguccuggaagucaaggcugcagugagcuguguuugcacuacuguacuccagccuggacaacagaacaagacucuaucucaaaaaugaaaauaaauaaaaggagaaugagggaguagaaagaaagaaugcguggggaguugagcagaaucagggaagugaaaaaaauuuuaaaucagcuaaggggaugggucagugccgugaggcccucugugucugugaaccgguguuuaucaaggcuaggcuucuacccucccacagagacagggagacagaggcccuguacuuccugaugauuucaaaagaauggcucgcagaucauugagaaaaauaucccugcguugugggagauacauacaugucucaaagggacagaggaaggauucaccacuauaagcccuuuuuaauaaaugcucuccgaaagagaggucaaggccucgcaucaggggcugggaagaacaaaugguaaguuccuuaggcagccuuggguuuuuccagacaggaauucaaggguguggccuuggccugcuagaagcuaugcugggguuuggccaagucucuuagugcagggguuuguuuguuuuggcuuugguuuugguuuuugaggcgggguuucacucugucgcccaguuuggagugcagugguacaaucauagcucacuaucacagccucgaccucccaggcucaagcgacccucccaccucagccuuucaaauugcugggacuacaggugucugccaucauacccagcuaauuuuuaaaaaauuuuuuuuguuguagagaaggggucucacuauguugcccagacuggucucaaacuccugggcucaagugauccucccaccucggccucccaaagugcugggguuacaggugugagccaccacaccuggcuuagugcagggguuuggauagaguuguucacgcagaguuucuguuuuucucaauauagaacgagauggugccuguguuuaacucaggcucagguguccaggggaguaucacuugcugugucaaggcagaagugguauauccagaccugggaggcccauugcuacacugccaguaguagguacaguggaucagaauucuugcuuguuauucuuuugauguaugucagcaauaauuccagaaaccaaacuuuggagaagauaggaaaagggugaaacucuucaaaaaccucuggguccuccaaccaguugcuguuucugagacgucccccaagauaaacguacaggcucuguuuucagggauugugaugguuaaaaugcucuugggaucacugugacccgaccugugacaagaauguaacaugcccauuaccccuggcagaaacgguccccuccuggaugguggccgucauccucauggccucggucuucauggucugccuggcacuccucggcugcuucgccuugcuguggugcguuuacaagaagacaaaguacgccuucuccccuaggaauucucuuccacagcaccugaaagagguagguaggauggagugagauguggauuugaaaaccuugaucggaaagagcuuuccuuucuaguuagggcugcccaauuccagacaacauguuuuccaggaaaacacacacgcgcgcgcgcacacacacacacacacacacacagacacgccucuugugugcugguccauucucuuguaaccaugucaggugaaggaacagccccgaggaaaggggcgcgggguuguccaguaucccucucugcaccuagggcaucgcuccuucuccagccuucacugcccaaagccccaggucccugaggagcaaaggugaugguucuagggcaggaggggaaaaacagagcucaguguggaagaaagagaaaacuggaggcuaaaugccaggaaaucaccagagggagagaaugggaggaaagaaaggaacauuuccaguuuuggaauauacgagagcgauugaaauucuggguaguguuuccuggacuuuaggaaggcuauuuguaaaaggguuaggaagaagaaacaaugcaccugacuaaugauaacaggacugaagaagcccuaagaaaugaaacucuggauagucacugacacuagagaaugaaaagauuccaagcccggacccaaaggaacuaucuuuggucucauuucccaggaagcagacucuaagauagagauuuguauucaaaaggcuugauggggaacauccuugggaauaauacccuaaaggagugaagguagccagauguggcagagagagguugagcugucacacagccacaacagaggccucagccaaucccauguggccucucgagcugggguggcccuuuagagauguccuaagcugaggcaagagggaugggcgugugaacuccacauuggccaugcgcuggaugugggcuacucccaggaaggggcccuaagcuagggugagaggugagacagcagcagccaggagcuaggagcacgagugccucauuccugaaggcaccacagccuccauuacagucaccccugggaccacuuggaucuacuggaagcagcuccuccaggaucugaguugaucucguuuccuggggaggguuacaggaggaagaugaguggaaugcacuccagcccccaccgcugcugcuggugucgggaccacaaaggaaugcuugugggcuggcuccuuccuccgcugcccugagggcccgcucuccucucccgggaggagccugugcuguaggggcugcugaccugauugggugacccagcccucaucccagaaagcacugagccuccgguccccaagcccaucucaggcaauggccugucccugcacuugucaauuugcugucaaaaucgggcaggggagucccaggaggugcccagugacucuggcggguacccacugugauacaguggugacuucucucuugccugccagucucuuggccugaggagguggcuuaaaguuuaucgggccuuguuucauguccccugguagaaaugcucccacucugggaaccuucuagaccaggugucagcaaacuuuuucuuaaagggccagguaaaaaauauuuuagaaggccaggcacaguggcuuaugccuguaagccuagcacuuugggaggcugaaguggguggaucaccuaaggucaggagaucgagaccauccuggcuaacauggugaaaccccgucucuacuaaaaauacaaaaaauuagccaggcgugguggcgggcgccuguagucccagcuccucgggaggcugaggcaggagaauggcgugaacccgggaggcggagcuggcagugagccaagaucgcgccacugcacucuaaccugggcaacagagcgagacuccgucucaaaaaaaaaaaauacaaaaauacaaaaauuaacccggcaugcuggcgcaugccuguaaucccagcuacucgggagacugaggcaggagaaucgcuugaacucgggagguggaaguugcagugaucccucacaccacugcacuccacccugagcaacagagcgagacuccaucucaaaauuuaaaaaauuuuaaaauuuauauauauauauuugagguucuguuggcaagaaauaaaaaucaaaauuauguagucacuuauauaaccacuuaaauauaaucauuuaaaaauccgaaagccaugugaaaaaacaagugguaggccggaucugccccgugggccuuuguuugcuggcccugcccuagacccacagagccucaaaucacaaggccagggagcagcgguuuccccaguaggucacugggcaugaugagggugaacagggccacuccugcccugcgcuugcuuccugacgcagguguuccaccugcuggggacacagccccacaugauuguuggucuugggugcaugccaggggcuggaggacaaugccuugcccucaccaggugucaucuccaagcuggcgccuccccugcacuuucaacaggccgcuccguccuucuuccagucuggcagcugcuggguggugcagggugggauacgaccaggggggucccgccuucacugucagugggcccauuggucuggcaccaugugauacggcgucucuacuaguuugucggggcugcuguagcaaaguagcacucguugcgcagcuguaacaacgggaauugauucucucacgguucucgaggccagacguccaaaaucaaggugucacuaggaugguuuccuuggaggcugugagggaggaucugucccaggccucuacccuaacuucugaggguugcuggcgaucuuuggcguuccuuggcuucuagaggcaucacccagucucugccuugaucuucacaagccuucucccuaugugagugucuguguccacauugccccuccuuuauacagacaccagucacgggaggagggcucacccugcuccacuauacccucauucuaacuuaacugauccccucugcagcaacccuaucuccaaauacagucacauucugagguagagggauuaggacauaugaauuucuuuuuuuuuuggagacggagucucacucugucacccaggcuggaguggaguggcaugauuucggcucagugcaagcuccgccuccuggguucaagugauucuccugccucagccucccaaguagcugggauuacaggugcccuccaccacgcccggcuaauuuuuguguuuuuaguagagacaggguuuccccauguuggccaggcuggucucaaacuccugaccucaagugaucugcccgcccuggccucccaaagugcugggauuacaggcgugagccacagcgccuggcccagaacaugaauuuuguaggaacagaauucaacaccuaacaggauccucuaccaggagagaaaacaccugugaaaccuugggaauccugacaggcccugcaggacacgaacagcaaaucacuccuaaacuaaagguuagcuccagccaggaugcaccacugccccuuccagaguggugcaagagucgacgucaucagcuugcuaccagguggcuggucagucuccucggggaaugccgucauaucaggggcucagcauugaucucugucgcaggcagguuggacauuccacagcagugguggcuacccagccgugggagugggagccccuucuuucaggcccacgcgcagccuccaucccugccaccacggcugcuguguucaugagcccugugccauguacaggugaccaguggcagaggcuggcugacauccacuggcugugucaucaugucucccuggcugucugcugucuaugauacaugcucucagugggaguuaauaugggaugcagaaaucuccacgcuccagcuacucccucagguccauccuucuucccaaacguccuugucccuaaccuuccagucuuccuuccccagggccccugaccaccaggcuugucacuaaccccugccugggaucccacagcuggccugaucuugggcugcuuuucuuuccacauaaaggugaugaucagacccacggcccaaagcucugcccguggggacacuuucucccugguuggggcugaagugcagcagcgggccacuuucggugugugcccacauaccaugcuaaccuugccaugaaaccaggccggccuuuccuccuacuucugcuaggcauaauuacccaucccccuuuauggucaucaugugagcagacacagacacggugcgacagggguagaggggacaggaguccgagccaccugcauguggccaacaugcacccucugaccccaucucaggaccuacugggucucaggccucaugauggucacuucugggcagcaccaucaccucgcgucccucgucagaagcucugucucugccgggaccccauagcgucccaggagcugcuuuuucaaacagaguacaauuaucugcugcagauggccccgccugaccccagaacucucguaucuauguugugacuuuccucuugggauuugccauaaacuccacccagcaucuuuucccaccccagacacuucaaggauaugcgaagucacacauuccccagguuggauucacaggccgucccugguggguaauguaccaguccugaggugugcauagggcugcaggcugcacggcccauaccuucugcagggcccuuuccugccuggggccccuccgugccagcagccuccugugugguuugauaaacauauuggaacagucaguauuccuaggcguggaacaugcugccuccagaacccugaggccuccacagcacaaugcuuccuuccuaguggugggaggggcaagauacaauaauugguccuuuaaagaggauguccuggcaugccccacugcaaggguccccucaaauaucacagauguggcaggucccugaaucucuacagggugaguuucucacccucugcagugugugugccucaccaaugccuugccacuucuuggcgugucugguccuauuaauguauuguugugauagcuaauaucaggcccuuguccccgcaccaccagucagcugaugcaggcugccucuggcaagggcacagagccuugaccgaggcaacugccuucugggaagggcacagccuagaaagggacucagcugugagccauuucagccuccgauauuccuggaggcugggggaacaagcgccuccuccacaaaagggaucugggcaacauagcacugcaucuacccucgauggcaaguggggcacaggaccauaggcaaguguuucagagcgacuagaacccccuacagagagugccaggccgagcaugguggcucacaccuauaaucccagcacuuugggaagccaaggcuggcagaucacuugaggucugaaguucgagaccagccuggccaacauggugaaacccugucucuacuaaaaauacaaaaauuagccacgccuguaaucccagcuacucaggaggcugaggcacaagaaucucuugaacccgggaggcugagguugcagugagcagagaucgcgccaccgcacuccagccugggcgacagagugagacucgaucucaaaaaaaaaaaaaaaguaccaaggagacugcagcaccagcaugaacuaagaauccucuaugagcuuuugagaagccacagcugcagcaggaagaacaaagaaugagggugggcccuuugcuuggguaaaagguguuguguuaacugagaaccaaaaggaaacaaaauuauucaccugcuauuuuugcuucuggcuucaccaucagagaaacuggucagacaggaaagaacagacggaaugaacgguagaggggccugcuggcauaagcucucaccuccgaggcuagaagacuuugcagacuugaccguggagccagccccuguaagaucugagaaaucagagaugggaguggagggugcuggagaagggccaggcaacuacggagcaguucgagguccucacaucacgacuuucuccagcuugacucauaaugauagaauccauuaaccaggauccagaggaucauuucgaguucagggagauuugcuaggaauggagacuuugaguuaaaaaagcacuagggagguucauccuacacugaucuauugagccagccaccaguuugugugugugugugugugugcguguguguguguguguguccaaccgggagacucagcugauacugcuuccuugagauuuaauacaccuuccuuugaucucuccuguccccauuaucccaggaaaauccagaguagcuuccaguccauucucauuaauccacuggauccaaaguuuagagagguuccccuucccuccagccuccuuccuggcccaacagaggagcaccccaccacccuccaucagcugcucaaaacccacaagggaaaaaucccuacagguccaugccaggagguaguggagcuacccucagguuccauuaagucauaccagaaggcugaguguagaaaugacauuaagagggguuccaucuguagggaaaggguucaagaugcaaagcuuuacagaagguucuccgucuaauugugaagauuaagagcacugguggaccuaggaagaugaagaauggagagugggaaaccagcagagauuucaggaaauguauaggggcaucuucaucguucaaagcaccggagagacaaagauuauuagacuguggucccugcccuuaaggagcccuggcuacaggugacacaaacugagaagaguuggugucuauuaaaagugagaaggcagcucugucugauagagcauauugcaagccauguguguuuuagauuugcuaguagccacauuuuuaaaaaguccaaagauugggccgggugcgguggcucacgccuguaaucccagcauuuugggaggccaaggugggcagaucacgaggucaggagaucgagaccauccuagcuaacgcugugaaacccugucucuacuaaaaauauuagccaggcaagguggugggcgccuauagucccagcuacucgggaggcugaggcaggggaguggcgugaacccgagagguggagguuccagugagcugagaucgcaccacugcacuccagccugggugacagagcaagacuccgucugaaaaaaaaaaaaaaaaaaaaaguccaaagauuggccgggcaugguggcucacaccuguaauccugacacuuugggaggcugagacagguugaucaccugagaucaggaguucaagaccagccuggccagcguggugaaaccccaucucuacuaaaaauacaaaaauuagccaggcaugguggcgggcaccuguagucccagcuacucaggaggcugagggaggagaaucucuggaaccugggaggcaaagguugcagugagccaaaacugugccacugcacuccagcccagacgacagagcgagacuccaucucaaaaaaaaaaaaaaaaaaaucuucguuuguauagcagugaguauccccacuuguaaaaaaauaaaauaaaaauaaauaauaaaucaaaagaugccagaggccguggcucacgccuguaaucccagcacuuugggaggccaagguggguggaucagcugaggucaggaguucaagaccagccuggccaacauggugaaaucccaucuguacuaaaaauacaaaaauuagcuggcgugguagcacaugccuguaaucucagcuacuugggaggcugaggcaggagaauugcuugaaccugagagguggagguugcagugagcugagaucgugccacugcacuccagccugggugacagagcaagacucugucucaaaaaaauaaaauaaacauuaaaaauaaauaaauaaaauaaaauagauuuuccagccaggaguucugugaaaaaaucuuuguaaacccagaaaaagaaauggagaaaauugaucauuaacuguccucuuucccuccacaguuuuugggccauccucaucauaacacacuucuguuuuucuccuuuccauugucggaugagaaugauguuuuugacaagcuaagugucauugcagaagacucugagagcggcaagcagaauccuggugacagcugcagccucgggaccccgccugggcaggggccccaaagcuaggcucugagaaggaaacacacucggcugggcacagugacguacuccaucucacaucugccucagugagggaucagggcagcaaacaagggccaagaccaucugagccagccccacaucuagaacucccagacccuggacuuagccaccagagagcuacauuuuaaaggcugucuuggcaaaaauacuccauuugggaacucacugccuuauaaaggcuuucaugauguuuucagaaguuggccacugagaguguaauuuucagccuuuuauaucacuaaaauaagaucauguuuuaauugugagaaacagggccgagcacaguggcucacgccuguaauaccagcaccuuagaggucgaggcaggcggaucacuugaggucaggaguucaagaccagccuggccaauauggugaaacccagucucuacuaaaaauacaaaaauuagcuaggcaugauggcgcaugccuauaaucccagcuacucgagugccugaggcaggagaauugcaugaacccgggaggaggaggaggagguugcagugagccgagauagcggcacugcacuccagccugggugacaaagugagacuccaucucaaaaaaaaaaaaaaaaaaaauugugagaaacagaaauacuuaaaaugaggaauaagaauggagauguuacaucugguagauguaacauucuaccagauuauggauggacugaucugaaaaucgaccucaacucaaggguggucagcucaaugcuacacagagcacggacuuuuggauucuuugcaguacuuugaauuuauuuuucuaccuauauauguuuuauaugcugcuggugcuccauuaaaguuuuacucuguguugc

SEQ ID NO: 192648 - RNA, 34915 nt, Homo sapiens
aggcggcgcgugcguagaggggcggugagagcuaagaggggcagcgcgugugcagaggggcggugugacuuaggacggggcgauggcggcugagaggagcugcgcgugcgcgaacauguaacuggugggaucugcggcggcucccagaugauggucguccuccugggcgcgacgacccuagugcucgucgccguggcgccauggguguuguccgcagccgcaggugagaggcggggaggagagucuuggcgcagggcgggagguagggcacgcagcugggcuacgggggcggcgaugcuguugggggcgacagacgcccagucugggaaaccuucgguccacuuugccgcgccaaagauuaaacccgaccugggcucgcaaaucaaccaggagaaagugguguucuggguccucucuugccgcuugccuguggccguguacggguccucgggagcgcccgggucccacccccgugaaauggcggugccagagcuuugugucgaguuugauucuuuccgggaaaguaccgcggcuccgcuggucuguuugauaauaaacaaaacauuucccgaaaugcauuuccucaaucuggugaauaggcgcccagucccacgggggagugagcuaaguguggccaggauuucucugcccucaggauucauacaggccaauaaaaaaugacagucggagugacugaagcauaauugucaguucucgagguuuacuaagccugcuucagggcgcauccgggaaaaacgugagccacaaacacgucugugacugguuuuccagagguuuucaggagguggggcaggaaggcaguaaggcaaauaguucugugagaauuuaguuagugcccaagaaaucuguauuuuaagauaccaugagugucuugaagagaaaaagagaguaaagggagucaguuaugcagaugccucuggguagauggagucuugacuuuguuuugcaccugagaagauaagcuuguaauugacauggucaguguggaaggccugaacuaguuuuucagauuaacuuuggaaugccauuuguugagaggagagguccauucacauuguuggggggcuuagaauuuuauuuuugguuuacuuaacuaccuacuuuuuucccaaagaaauaaucauguucaaaacucaaugaaauguuaucucaaugagauuguaauguugcucagucuuucagaagucauaaaaauagucauacuuuuuaaacuaguaaaugcaauucuaggacccaagacuaagaaaacuguccaaaauaugggaagacauuuuuauuuauacuuuuuuuuuuuuuuuuuugagacagccuguugcccaggcuggugugcagaggcgugaucucagcucacugcaaccucugccucccagguucaggcgauucuccugccucagccucuugaguagcuggaauuacaggugcacgccaccacauccggcuauuuuuuguauuucuaguagagaugggguuuugccauguuggccaggcuggucucgaacuccugaccucaaacaauccacuucagccucccaaagugcugggauuacaggugugagccaccacgcccgaucuauuuauguuuuagacuuuaguuuuaggaacuagacuuagguuguagaccugaaguuacaguuggcauccccuuguuuaugggagaccagcaaagaauugacuuaugaaugaucugucaggguagcccuucgcagauggcugagucuuuuuauccuuccuuggggauuuggcugaagcauaaugcuaguaacagccauucguuuggaagaggguguugcagucacuuggccucugggcuuaacuaacuucccuuuugcguaagaaaguugggagagguccugagauuuuuuuuuuucuuuuacaaaaauaauaaaagaaaaauacaaaggcagggcgucaccaggcuaauuugcugaaauucuucauacuuacuugggaugcaugggggaauggcaacuauuacaagguugauagagagugagagguaauuuuguagugaggagggguacccaaagagaaucagggcuagcaucccagugcaggaguccagguggucugugagccugcaagugaguucaaaauacuuuaccuguuggcuuaggaaaccauauaccugugugguacaugauauccuauuucucaaacuuuuccacaaauauguaguauacuuuuccuaggauguggguacuaggguccuggugcaucccauaguaauuucuuugaagucuuuuguuuaugaaaaacuugcauuaaacucauguuugguuugaugugaaaaaagcuuucccagaauuuucauauaaaauugacauuccaggagggugugcauuaagaaauuaauuuaaaauuagguuagcggacagguggcaagauauaauuuauaggcauuuaucauuucuuaagcucuuagcugugugccaggcaguaaucuaaguguuuuaaagguauaaacucauuaagcuuucagagcaguguagauacuguuaugcuuaguuaacagacaaggaaacugagcaacggagagaucaaguaacuugccugaggcuguauaggccaguccguggaggagugggaagucaaauccugagucuggacuaauagccuuggggcuuaaccagacuagacuguuuucccaaaggccaaacaauuuaaauuccugauuguccacuuguauguuaagggccuaauuaucaguaucuuucaguuaacugugagcccaaaaauaucugagaccggucugaaaucaacuuagaaaguuuauuuugccaagguuaaggaugcauucaugacacagccucaagagguccuggccacaugugcccaagguggucaagguccagcuugcuuuuauacauuuuagggagacauaucaaucaguacaucuaagauguacauuugauugguucgaucuggaaaggcaggacaacucaaagcaaggcuuccaggucauagguagauuuaaagauuuucugauugguaauugguugaaaucaauggaaaggaaugucugggauguccuaagggguuguggagaccaaaauuuuaucaugcagaucaagcuuguccaacccacagcccacuggccgcgugcagcccaugauggcuuugaaugcaguccaacacaaauucguaaacuuucuuaaaacaugagggguuuuuguuuuguuuguuuucuuucuguuuuuuuguuuguuuguuuuuagcucaucagauauuguuaguguauuuuguguguggcccaagacaguuguucuuccaguguggcccacggaagccaaaaagaguggacacccuugaugcagaugaggccugcagauagcaggcuucagagagaauagauuguaacuguuucuugugaaacuuaacgucuguguuguuguuaauggugguuagcuuuuucugaauuccagaagagaggaggguauaaugaggcauauccaaaccucacuucgcaucauggccugaaguaguuuuucagguuagcuuuggaaugcccuuggucaggagaagggguccauucugaugguugggggacuuagaauuuuauuuuugguuuacguaacuaucuacuuuuuccccaaaaaaaaucauguugaaaacucaagaccuuaaguuuacagcucaagcugauccugaaaguuaucucagugagauuguaauguugcucagucuuucagaaguuguauaaauguaccuuuuagccuaguaaaugcaauucuaggacucuagauuaagaaaacuauccaaaauaugggaagacauuuacuuacauauuuguacagauaucuauauuuggauuuaugucagacuuaaagauauaguaaaccauuuuggucgugaaaaugaaugugaaagguugaaagcaaccaaaauuauaaaugcauuauauauauauuagauuaaauguccauuuauacauuuacaugugggguaauuaauuguuaauauacuaauauaaaacauuuuaauauacuaguaaauuaauauauuguauguuaauguuacauaacaauuuaugaaaaaauuauuaaaaggagauugccaauaauaauagagcaaaaucugugaaaacuaaaauccuguuuaauaacuuuauuuccaagccccuguccauuuaucagucaguuauuuguuggucuuccaaaugccaacaugccuguaacuucagggucuccuucuuuuagcaguaaaggauuuuuuuucucccugaggaaaucacuagcuguacccuauaacauuuucuauucuugucucaaggcccaaaauuacuagaauuauaauauucugcacaagauauuguaaauacuacaaaugccaucagaucuuuuguuaaacucuguaaacccaguugcuacccuuuggcugcauagaaucuauaaauucuaacaaauggaugagaaccaaguuaagaauucuagagugggauaaggggaugugauguauucuauucagggaugaaguuuuagagacuccaaguaugaaacagaaaauugaggauggggagaccugauggguaccacauuaaguuuaaaaaaaaaaaaaguguuuucucagcugucuccccuuuugaccccauacuauaagaucuaacuggaaagagcaagaagcugucucaguuaagaaaguucuauacaagaaccccugugguagaacaagucuacaacaagauaacaugauugccccaaggcagaaguaaaagaaauauuguaggaaccauaaaugaauuuaaaagcugaucuuuuaaaaaauauauaacuuaucaaagugagagaucaguccuuuaugauauuuaaggaguuccugugaaugcaccauuaugcuggauacucugaaaaaaugcaaaucaaguaugaagcgauauaaauucugcccuuaaggaacuugcaaucuaguuggagauuuauguuuaacacaaagaagcaguuuuuacaaauacuucuuuugaggauucugggaagauggcagaguagaaagcaccaggaaucugucuccucaccuagacaagaauuguacuggcagaaucugauguaacuauuuuggaacucuggagucuauugcaggcuugcaacuuccaggggacagacuuagaugguaaauugcaguuaauuuuggucuauuugagcucuuaguacaguagcagcuacccaucuuccaccucucaacccuuagcagacagcugugcacguuauuagagcaaucugcacacaacuuacaggaaucaggugggcaaaaagaaacacaccauccagauaucugggaucugugcucuugauuggucauugcuccuucucgucacaaaagcgcaaagagaugggcgguuguuguuguuacaccuuacucauuguuacaacccccuccccacucacuccccugccccauggauuuaaagggcuagaaaucucccucugcuucauuuuucucuuucacuuuugggagccggauauuaaagacuaggacauuuaaaaacaacugcauuuauggggaaaauuagaaagucacuguacauaccuagggaaaggcucaggagagaccuuaaguuuauagcucaagcugauccuuggcacaggauuaacaacaauuacacagcaauuaaacaaagcaaacacacacacacacaauguagucugggagagugauguuagcaagauggccaacuagaagccccuucugcucauccccucauaagacagccagaacaacaaauaaacaacuacauuuuagcaaacuuaacuaagagugcuagagugcaucaaagaaguaacagaaauccuagugagcagagaaaagugggauggccacauggagaaugggaggaaaugccaggauuccuaggaucaucugggaacgaggaggaacuucuuccuauggcaaggagauaaacaagaagaucccagcuacaccaugggcaccaacagaucucaccacugggguuccuuagaguccagacagcaacuaagccaagcugaggaagcugccuagagucugcacagcuguguucccuccagagaaggagccaacacugugcuccaccugcuguggcccacacagcuacugugccacuccaccuuggaacuggaacuacuucuggagugugucuugcuucggggacuuguagccauggcuuccuuucaucugaaccacgccaggcugguggcucaacaucccuaagcuaaacuuuaagcagcuguuacacccuucccuguggagucaagcagagguggaacuacuccaccuacuccuaccccacugcccuugggcuagagcugaagcaguauccuauuuccugggaacacacuaccuuggccacccagagcagucaugcaccccugugccuaagcugaagugguauacggcauuccagggaaacagggccugaaccacccagagcagucacacuccccgggccucagcugaaggagcacaucacucccugcagaaucagugcccuggccaaaccgagcagcuaugcaucccagggcugagcugauguaguauccuaugucucagggaaacagagcaguggcugagcugagacacccuguucuacaggccaaauaacuguaguaccccgcuucccuggagcuggacuaguccucuagagccugagcugcugagacacucugaggaguggagucaucacugugcuguucccuaccccccauucccagcccagacaacagcuaugcuucaccauuuuguaguacuugcugcugcugcuacacuuggccucacagucugggguacugcuuaucccuagcuauuccaagauuuagagucaugacuucauggugccucaucccuugggaccuguguugccacugagcccuauuagcucauauucccaaauuaaaaccauacccugcuccccaggcccaaaccuccagagaaccccuucuuuauagucaggccagugcuaugcccugacccccauagggguagaaucaaagcuacaacccauucucugggccuaagcugccaggaagcaccuccaggucacaaauccuggcucugugagcaacuacguccaagcccugccacagagagcaaacccaccucagcaaccaagugucucaguagguuugugagauccugagccuaggaccuuugcccaguagccacucugaauaccuucaucuggaaucaagagcugcugcagcugcauauauauagccccugucagaccugacaccaagagguguugccuuggcugagucuccccauuguggggaagacaagaauaggaggauccuaaaagccuucaacacugagaacauuaacaaccuacacuaccacugccacaaacuucugcagccuaggccccugaggcacccauuuacuacugacauugaacacagguaaagcagcugcuuuaccauaccacugcaucugucaggaaacagucaccacacccuucgaaaccagcauacugaaacccaacugcuaauaaaagacuuuaucuuugaaagccacugucuguaaaguuuggaagagguaauuauccuaucaacacaaagacacaaaaacaugaaaaagcaaggaaauaugacaccaccaaaggaaaguaagaacucucuaaugguggcccaaugaaaagaagaucaacaaauugcuggaaaaggaauucaaacuaaugaucuuaaggaaacucaacaagauacaagaaaauacagauaguucaaugaaucaggaaaacaauucacaauacaaaaaauucaacaaaaaaauuaaaacaugaugaaaaacaaccaaacaaauccuacaguugaagaauucaaugaauuacauuuaaaaaauacaauaaagagcuucaauaacagacuugguaaagcagaagaaagaaucucugaacuugaagauauaccauuugauauuacuuaauuguagaaaaaacaagugaaacccuacaagacuuaugggacaucauuaaaggaacaaacguucauacuauguaaguuacagaaagaggagaaaagguaagaggcauauacaaacuauuuaaugaaauaauagcugaaaacuucccaagucuggagagagauacagacauccagauccagaaagcucaaugauucccaaauagauuuaacccaaaaagguucucuccaaagcacauuauuaucuguugucaaaagucaaagacagagaaagaauucuaaaaauagcaagagaaaggcaucaagucacauuuaagaaaauccccauucagcuaacagcagauuucuucacagaaaccuuacagugcagaagaggaugggaugauauacucaaacagccaagaaugcuaugcccagcaaaacuauccuucaggaaugagggagaaauacaguuuuucccagacaagcaaaaacugagggaauucaucacugcuagaccagccuuaugagaaaugcuccagggaguccuacaucuggaagugaaaagagagcagucaguaucuugaaaacauggaaaaguauaaaacucucugauagagcagauacacaaaggagaaagagaaaagaauuaaaccuuaucaaaccaucaaaccacaaugauaaauaauaagagaggaagaaaggggcaaaggauauuauuagaaaacuuuaacaaaaugacaaauguaagggcucaaauaucaauaauaaucuuaaauguaaauggauuaaauuccauacuuaaagagacuggcggaauauuuuuuuuuuucuuuuuuuuuuuuuuugagacggagucucgcucuguugcccaggcuggagugcaguggcgcgaucucggcucacugcaagcuccgccucccggguucacgccauucuccugccucagccuccugaguagcugggacuacaggcgcccgcuaccacgcccggcuaauuuuuuguauuuuuaguagagacgggguuucaccguguuagccaggauggucucgaucuccugaccucgugauccacccgccucggccucccaaagugcggaauauuuuuuaaaugacucaauuauaugcuuucuauaagaaacccacuucaccuauaaagacacauauaaacugaaauugaagggauggaaaaaguuauuccaagcaaauggaaaccaaaagcugucaggaauugcuauacuuaugucagauuaaacagacauuaagucaaaaacuguaaaaacagacaaagaagguuauuauauaaugauaaagggaccaauucagcaagaggauauaacaauucuaaacauacauguacccaacaccagagcacccagauauauaaaguaaauauuacuauacguaaagggaaagauagacuccaauaugauaguaguuggggacuucagcaccccacucucagcuucggacagaucagcaaacuccaaguacagugaacucaaagagaccacaccaagaaacagucaaacuuuugaaagccaaagacagagaagugacuugucauacacaagggaucuuugauaacaugaucagcagauuucucaccugauacuuuggagaccaguguauucaaagugcuaaaaaaaacaaaaccaaaaaacucaaaacccuguauauggcaaaauugcccuucaaaagcauaaggaaauuaagauguucuuagauagacaaaagcuaagggaguucauuaccgcuagaacugcccugcgagaaaugcuuaaggaaguccugaaaggugaaaugaaagggcacuagacagaggggacagugcagauucaggcaggugcaauggcuucuggggaagacccagccaguggggcuauugccagcauccagucagcugccaccuucccugaccccagugucaagugaugcgcagggugauccaggugugugaggggcagcuggauguccagacugagggcacuggugccaucaguggcuauccuaccacucaauucaugacccagguggugauccagggugauaucaccaguuaugaugcaguuaacacagaggggaaagcugcugagauacacuauacuuucccaccccugcagugggagauggggcaggggguaccacaucagggaguacagcugcuguuguuacuacccagggcucagaggcacugcuugggcaggugacucuuccuggcacuggucaauuauuugugaugaugucaccacaaggaguacugcagggaggaagccagcacuugauugccccuaggacucaaccuuauuuauuuggacguaacaccauuguaagucaagaagcaucucuaucuaucuaugaacauacaaugugaaaucaaauugaggccauaaaacaguugaaccucaucauaagagugacucaucggugucacuucuaagaccaagaaaaauucuauuuuuaugcagagaccauuuguuuuuuaauuaaaagacaacucuauuucaaagaggaaaaaaaaucaacucuuuuuucagcucucucagaugcagaaauguaauuaucagcaucccugugcugggagcaaucauuaguuuuuuuagauuuuuaaaauauacuucauuauguuucacuguauucauucuuuaaucagggaugugagggauagaauaacauuuagaauaucuguacaguuuguauauaauguucuuauuucuuguugcuuuuauagguggaaaaaaucuaaaaucuccucaaaaaguagaggucgacaucauagaugacaacuuuauccugagguggaacaggagcgaugagucugucgggaaugugacuuuuucauucgauuaucaaaaguaugugacucuacuuacugauuugucagaaugaccugaauaauuuuuacaaguuuaacaacaccauaauuuuuagauuuggaaaguguuugguuuuucuauuuuuuagaaauguuacgccuauuuuacauaauauuuuuaacuuuguuucuguagagacuuagucaaauacaucuuuggguguugaagcaaaaaauuggggaugagggugguagacagcgucucuaacccauagccauuccuucuuucuucuggguguuccagcuucuuuuuuuuuuuuuuuuaauuauuauacuuuaaguuuuaggguacaugugcacaaugugcagguuaguuacguauguauacaugugccaugcuggugcgcugcacccacuaacucgucaucuagcauuagguauaucucccaaugcuaucccuccccccuccccccaucccacaacaggccccagagugugauguuccccuuccuguguccauguguucucauuguucaguucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcuccagcuucuuucaauauaaguuggggucugagcuaggguauaucuugaagauauggcauuguacuccaaaagguccaucgaagaccuuggaauaggccaccagguuuccugugaucaggcuuuccuauuaucuccaugauauacuauauuuuaauuuuagguacacuuuuuuuuuuuuuuuuuuuuugagguggagucuugcuguguuaaccaggcuggagugcaguggcacaaucuuggcucacugcaaccuccacuucccgguuucaagcgauucuccugccuuagccucucgaguagcugggauugcaagcacaugccaccauguuugacuaauuuuuuuauuuuuaguagagaugggguuucgccauguuggccaggcugaucucaaacuucuuaccucagguggucugcucaccucagccucccaaagugcuaggauuacaggcgugagccacugcccuggccuagauacacuuuguaaauauauuguuaacugggcaugguggcaugugucuguaaucccaccuacuugggaagcugaggcagaagaaucgcuugaacccaggagacagagguugcugugagccaaguuugcaccacuguacuccagccugggagacagcaagacuccaucucaaaaauaaauaaauaaauaaaauaaaauaaaaaucgauauauuggaccuugcauuucuaaagacucaguuuuucuggaguguugaugucucuuccuuaguacuuucuacuuaauuauucaagaggagaggcaggcagaaggaggaauauagaagggaacacagaucaggaaguacaguacuuugccuuccgauuauguguuggggccccaccugccaaccauguuccccuguccaagaaaaagcaggcaaugaagaaauaaggcauuaggcccuccggaaccaggagcccaccacuucagccacagcugugacacuauucucgaguuguaacuaaaacuggcauaugaaucucacagcuucaguaauuguguaugcauauauaaacaaauacacacuguauauaugcauauauacacuauauauauacauacuguauauauacauuacacuauauauaauacauacuguauacauacauauacacacauuguguauacauacauauacacacauuguguauacauacauauacacacuauauauacauauacacacuguauauguauauguauauacacacacaaauucauauaugacuuuucucagaauugaucauuuaaaauuuuuuaucucuagagauuuucauuaaauugaacuuugaguuugguuaccaguuuuguuuuuucccuuaguuuggaauuuccuuaugaacaacuauuuuagguagagaaggaauuauuucagauacccuuauuuaauguuacuuguauaaagaaacuauuugcaaaauaugcauccaacaagagcuuaauauccaaggaacucaaacaaucaacaacaaaacccaaauccaucaaaagguaggcaaaagauaggaauagauauuuuucaaaagaaaacauacaguggccaacaaguaugugaaaaaauggucaacaucacucuaaucaucagagaaaugcaaacgaaaccugccaugagauauugucuccccgcagucagaauggcuguuauuaaaaaguuaaaaaaggcugggcaugguggcucacaccuguaaucccagcacuuugggaggccaaggcagguggaucaccugaagucaggaguucgagaccagccugaccaacauggugaaaccccaucucuacuaaaaauacaaaaacuucagccggaugugguggugcgugcuguaaucccaccuacuugggaggcugaggcaggagaaucgcuugaacccaggaggcacagguugcagugagcugaaaucgugccccugcacuccagccugggugacagcaagacuucaucucaaaaaaaaaaaaaaacccaacaaauauugaauauauuucaugccaaacacucuucugacugcuuagacugccucagugaacaggagaggcaaagauggcaugaaguuauauuaugaaacggauuucaugaaguaaauauuacauuaguuacauauucauauuucauauucuguucugagcuaauuauugcauaugauaauaguuuuuuuguuguugguuuuuuuuuuuugagacggagucuugcucuguugcccaggcuggagugcaauggcgcaaucucggcucaccgcaaccuccgccucccggguucaagcaauucuccugucucagccucccgagugccugggauuacaggcaugcacccccacgcccggcuaauuuuguauuuuuaguagagacaggauuucuccauguugaucgggcugaucucgaacuccugaucucaagugauccaccccccucggccucccaaagugcugggauuacaggugugagccaccgagcccggccaauaaugauuuuuuuaagaaaauauaaaaguagcuucugcugcaauaucuugauuagauguaaaacaguuuuaauggagcaugcuucagcaucuccugaaguaggaaagacagauguaaacagugagguuggguugaaauuauauuaaguuuuaaauuuuugauaagguuuucuguuuauaaugagaguuucuggauuuuuagaaauagauucugauguggaaccuuuucaagaauguuuaagguauuuuuaaugccagcucuaaucucaggccucagauauguaaaaguggaagugaaaacuggccaagaaugaaguauuucauaugcuaguguauauuuuugguaauuucuuaaaaauguuuccauuuugaaaaacaagguagacuuguauuugguucagcaacaaaauuauuuugguauuaucucugguuucuaauaucuaaaucgucuuuaaaauggcaucugugauauuauuaaaaauaaauaaaucagcuaaugaauuaggcuugacaaaaaugccuucccagaagauaguuucucugcuacuuauggucaaugggcuuaacauagguaaaaguucucaaaucugcuaaauuggccgggcaugguggcucacgccuguaaucccagcacuuugggaggcugaggugggcagaucaccugaggugaggaguuuaagaucagucuagccaacauggcaaaaccccaucucuacuaaaaaaaaaaauacaaaaauuagccagacgugguggcacacgccuguaaucacagcuaguugagaggcugaggcaggagaauugcuugaaccuaggaaguggagguugcagugggccgagauugcaccacugcacuccagccugggcaacagaguaagacucugucucaaaaaaaaaaaaaaaaaaaaaaagaaaucugcuaaguucguuucuaucccucacuuucccugcaagcucuucuuccccuuucugggcaacauguccuuuucugcuuuaggcacuccaugcccacuuuauuuuucauguuugccccuuuuuugaaaggaagaaucuaauaucacuucagcuuucugauuggccaguuccacuuccaaaaauuuauuuguuuauguaaacauuuucaguuuugugguuucugaugauguaauagaagaaauuacggagacaggcaagcagaagggaugguuugcuuuuggagagggcagaggaaaccuugaaaccauacugauucugaggucuuucuuagggaagguaagucuauucauaggaggaggucagaagggaaucaucaaauccaauuccccaguuucuauuuaauuuuauuuuauuagagacagggucuugcucgguugcugaggcuggagugcagugauaugaucauagccuacugcagccugcagccuugaaccccuaugcucaaaugacccucucaccucagccuacccaguagcuaggacugugggcaugugccaccaugcccugcuuugccuuuuuuuuuuuuuauuucucauagagacaggguuugcuauguugaccaggcuccaaacuuucaauaaggaagauaagauccagaaacacaaaauaguuuaccaaaagucacacagcuauuuuuaacagagccaacauacuaaauccacuuuuaccuuaugggucauuuauuucucugcuuccugaagcaaccacccacaaaauuauauaaagaacuguauuuuaaaauucaguuucauaaguaauaacuuggcuuauaugcauugaaaaagaguggaaggguguaugcuaaaauguuaauaggacauuagcucaaguagaagaaauaacucuuaaaccaaaaauagaaauaacucuuaaacaagaguuauuaagaguuaagaaauaacucuuauaccaguaaauagaaaguauuugacacuuacauuuauacauuugcucacucauucauuuguuuuuuuuacuuuaaagaacugggauggauaauuggauaaaauugucugggugucagaauauuacuaguaccaaaugcaacuuuucuucacucaagcugaauguuuaugaagaaauuaaauugcguauaagagcagaaaaagaaaacacuucuucaugguaugagguugacucauuuacaccauuucgcaaagguaagaaaaaguugcuagcugaauuauauucuuuaguaaauauuaccagagcaguucacuuuccaagccauucauuugcaugaugcaaaaucuaacaucuuuuaaaaagaacaaaaauucccuuaaaccuauaucuucuuccugcuauggcuccauuuguccuacuuucccuguaguagugguucucaaagagugauccucaaggcccuuucagggggcuguaaagacaaagcuauauuuaugacaaaucuaagacuuaguugccuuuuuaauuuuuguucuuucuuguauucacaguggaguuuuccagaggaggcuguuugaugugugauguggugauauggucacugauuuaacauagaauucaaugugaaauucaucugccuucuuuauuaauccaaacauucaaaagauuuggaaaaaaaauguaaaacagcaccacucugaaguuucuauguuccuuuuggcaaauguuuguuaccauaaaauagguuuaucauuguuauuucuuucuuuuuuuuuuugagacagaguuuuguucuuguugcccaggcuggagugcaauggcacaaucacggcucacuacagccucugccuccuggguucaagugacucucccgccucagccucccgaguaccugggauuaccagcaugcaucaccaugccuggccaauuuuguauuuuuaguagagacaggguuucuccauguuggucaggcugaccucaaacucccaaccucaggugaucugcccaccucaaccucccaaagugcugggauuacaggcgugagccaccaugcccaguccauuguuauuucuuaauggauuaauuaguuaaaauggauugaaaacuuuaccaguuuuaauguuuaauaugcuaauauaaaaauauacagcccacauaaauaauggcuguuugggauucucgauaauuccuuuaagaauguaaaggagcugaguguaguggcccacaccuguaauuccaacacuuugggaggcugaggugggaggaucacuugaggccagaaguucaagaccaaccuaggcaacauagugagaccccaucucuacaaaaaauauauaaaaauuagccaggcaugguggugcacaccuguagucccagcuauucaggaagcugaagagggaggaucacuugagccugggagaucaagguugcagugagcuguguuugugccacugcacuccagccugagcaacagagcuagaccauaucucaaaaaaaaguggggauccugagaccaaaagguuugagaaccacugcccuguaccaagaaugaucuguacucccuuucuauacuaaucuuccaauucccugucagcccucuccauucaaauucuguuccuccucacuuaaaaccacucuuuuuggccaggcgcgguggcucacgccuguaaucccagcacuuugggaggccaaggcgggcagaucacgaggucaggagaucgagaccauccuggcuaacacggugaaacccugucucuacuaaaaauacaaaaaaaaaaaaaaaaaaacuagccgggcaugguggcgggagccuguagucccagcuacucgggaggcugaggcaggagaaugacaugaacccgggaggcggagcuugcagugagccgagaucgugccacugcacuccagccugggcgacagagcgagacuccgucucaaaaaaaaaaaauaaauaaaccacucuucucaaggucacagcagccuccacaaugccaagcaaauucccaguccucuucuggcuucaucccucuguagcauagauguggucaucacucaguuuuuccuuuacuggaucucugggacacugcucuuuccugguucuccuccugcucauugaucgcuucaucuucccaacuuuucaguguuagacugcugcugggcucagucauugaaccucuucucuuucuguaucacuccacuggugaucuuacagcuuucuauccuaucuguaugcucuuaacucccagaaguggcaggcacauauuaagugcucagaauuauuuguugaaugaagguuuuggcauuguauuaauaaaguuccauaguaauuguuuugauuuuuuugcagcucagauugguccuccagaaguacauuuagaagcugaagauaaggcaauagugauacacaucucuccuggaacaaaagauaguguuaugugggcuuuggaugguuuaagcuuuacauauagcuuaguuaucuggaaaaacucuucagguguagaaguaagcauuauuuuuaccucuguuuaaucgaugugagagaaaaauuaggcgaauuaauccuaaaauuugacuuuauacuuuuuuaaagaaccaacuuauauuuguguuauaggaaaggauugaaaauauuuauuccagacauaaaauuuauaaacucucaccagagacuacuuauugucuaaaaguuaaagcagcacuacuuacgucauggaaaauuggugucuauaguccaguacauuguauaaagaccacagguaaggaagauguuuuguuuuagauucaauaaauauauaaacagauugucaauuuuggcaucuuccccauauugcugaaguuuacaugauaggucaauauauguuaaaaacauuguaacauuuacauaagcaaaauaaauguuacuugggauuuuugucucaaauaguaaugaaaauuaauucuacuuaaaaguucaggcugggcguaguggcccacgccuguaaucccagcacuuugagaggcugagguagcuggaucacuugaagccagaaguucgagaacagccucgccaacaugggaaaaccccgugucuacuaaaaauaauuagcugggcgugguggcucacgccuguagugguagcuacuugggaggcugaggcacaagaaucccuugaaccugggagguggaaguugcagugagccaagaucgcgccacugcacuccagucgggagcaagggggacaaagaguaaggcuccgucuuagaaaaaaaaaaaaguucaaauauuuuguaaugacaaaacuuuucauuuguucagaauccacaugaagcaggagguagcugaacuaugaguucugcaagugggaagaaaagguggggaaguaguugcuaguagacaaguuauuguucaagaaagcauaccuuuguaaguggaauguuaaaauaugaaaguauccugauacauuuaguaacaucuuuccaauaauuaaggucaagggcaggagcugggauuuguuuauuuuaauuguaaauuucauaugcuuuuuuuuuuaaucaaacauuacggaaggguuuaaagugaagucuucuucucccuucuuauccccaauuccauucacuagagauaagcauugcuuagcaguuuguguauauccuuucacaacuuuuuucaggauuuauguaagcauauacacagacccacaguuucuuggguuuuguuuuuuaaaauuacaaaauaaaaucuuacuagaaguauuuuacagcuugcuuacuuaacccaguguguuggggauauucuauaucacucaauacagaucuauuacguucuucauuugaucuuagccaucuauugcauucuuucuuuuuuacuuauuuauuuauuuauuuauuuauuuauuuauuuauuuuugagacagagucucacucucuugcccagaauggagugcaguggcucaaucucggcucaccgcaaccucugccucccagcuucaagcgauucuccugccucagccucccgaguagcugggauuacaggcgugugccaucaugccuggcuaauuuuuguauuuuuaguagaaaugggguuucaccauguuggccaggcgcgucucgaacuccugaccucaggugauccauccaccucagccucccaaaguucugggauuacaggugugagccacugcgcccggccuguagucuuucaaauggcugcauaguauuacauagugugaauacaaaccauauuuaacuauuaccuuauaaugauaaaaugcgagccuuuaucuucuugccaguuaucucacuugaguaaaaaugugugcuuuuuuuuaucuguucuuuggcuucuaguugaaaaugaacuaccuccaccagaaaauauagaagucaguguccaaaaucagaacuauguucuuaaaugggauuauacauaugcaaacaugaccuuucaaguucaguggcuccaguaaguuccauuccauaaauuuccuuuugcccaguuuguuuugauuaugcuucuuuucgcucugcaucagucaccagguccuugcacacagaaugaccgacugggagguggguacgauauauuggaaacgugagaaaucucauuucuaaccccaguucugccaguaacuaacuggaugacauugagcuaaucgcuuaaccuccaugggccucaauuucuucacuuguaaaauagauggauucuaauaucugggguucuuacuggcuuaagaaaaaaaagaaaguguaacuaguugcauguguuauuuccccaaucuggaagacucgacaguugacccugaucuuuuucuaagaacucacuucuuccaugaguccuuaaaaugaucucaguccacucacuuguucaauucaaaaaauuagccuuccuauuuucuuuauuacuuuagugguuuugacaaaauuuuguaguagauacuucggugggaaagaaaguuggaaagaacuauguucuaugugguugagcagaggcuagcuaaacauggaugaaguccaggcgcugcauaaaugaaagagaacuggccuggugcaguggcgcaugccuaucgucccagcuacucagugggcugaggcaggaggauuacuugaggccaggaauugaggcugcaguguuguaugaucacaccugcuaguagccgcugcacugcagccugggcaacauagugagacccccaucucuaagcauuaaaauuuuuaaaaagcugauaaaagagaacugcauguaguuuauauugauuggaaaauuguaggagaugaauagagaaaagagaagaggaaaauuaaguagaaggaaaaauggguuauggggagaaaagagauggaaagaaagauauacauugguggcagaggaguagagagagcaaaggcaaguauagcuaagacaggaaaggaaaagucagaagaaacuggaaagaaacagaaaaaaugagggagaagggaaguguaaguaccgcuaugaucaauuucuaucuuuuaguguuaauuuugaaccaagggugacugguagaaugcaaaugcauuuaugugcauaugugccccacaaugcauauauaaccucacaaaccaaucaggaaacuguucaguagucuuuuguguauaccucacuuucagaagugaauaaauaauagggucaccaaauagauaaugagagguauuucugauagcugaucucuaagcuucuuuuggguacuuaccauauuguacaaagcacugaagaaauggaaagagucagcagaaucaaacgugguucaaaaauugaaagcaguuagccaacauugcaaaguguugugugguuuaggacuaaagagugguauacaaauuauaaggguugcagaaauugaaaauguaaaggugaauaggggcuaaagagaccaaagaagccauaaggaaagagauaagguaugaacaaggccuugauuguuaauucagauuuuuuuuaaguagacaacuauuagauguuaguuuucugugucuguaacuaauuaccacagacuuagcaacuuaaacagcuguuuauugucucaaaguuucugugagucaggaguccaagcguggcuuagcuggcucuucugcuaagcagucaaggagucagucauucauacaagacuugggggccgcucccaagcucacauguuguuggcagaauuuauuucuagagcucaugguggcucacuucuuagaggccaucaggaagggagagucugaccucuagauccuuuuuuuuuuuuuuuugagacggagucucacucugucacccagacuggagugcagugacaugaucucagcucacugcaaccuccgcguccuggguucaagugauucuucugccucagccucccaaguagcugggacuacaggugugcaccaccacacccagcuaauuuuuguaguuuuaguagaaacgggguuucaccguauuggccaggcuggucucgaacuccugacuucaggugauccacccgccucagccucccaaaguucugggauuauaggcgugaggcaccgcgcucagccauuuuuuuuguauuuuuaguagagacggaguuucuccauguuugccaggcuguucgcaaacuccuggccccaagugaucugcccaccucagccucccaaagugcugggauuagaggcaugagccaccaugccuggccuagauccucuuuuaagggguucaucugauuaggucaggcccacccagaauagucucucauuugauucaacugauuugggaccuuaauuacaucugugaaauaccuucucuucugccacuuaauguaaccuaauuaugagaggagggccuccaucguauuuacagguccugcccaugcucaagaggaggggauuauacaggauguguacaccagggggcaggaaucuugggggccaucucagaauuuugccuucuccaguggggaggauguccuucuagaguagcagaacauuuggacaccagguggcaaugggaagaaagcugaauaaguagaaugggacaagauuagggucaaccucaggcuguccuguaggcuuuuggggauuuuguguuggggugauaguuaaccugagcucuggauuugaggaaggugcaugcggcgacaugguaugugggagaguggacuaaggagacacuaaagagagauaaggaaaccagucaggaggcuauuagaguucugggcuugaacugagaugcuuuuagcuguugguuucugggcaaguuacuuaaccucuuuagucucguacuuauacuugcucuuauaaccccgcagugugucucuauuuuagcacuuaaucaguguccauugguaugcuggcgcauguuuagcagcuggcuuuccagaaagaaaaaguccuauuuuguaguguuugcugauuuuuaugauauaaauauucccaccauggccacuuucaagccaccagccugaugucccugaauauggaguugggaacauaugcacaguagcacaccacuaucauauagcuacaauagauaaagauagccccaagagcuuagaaaauaaaauguaguaaaauaauuaggacaagaugaauuuauuuauuaccucugucuuuaaaacaauuuuuuauuugcaaauuuauauaacuuaauuuuuaguaaugguuuuucuuuaaaaaccaguuuguauuuuaggaggccgagguagguggaucaccugaggucaggaguucaagaccagccuggccaacaugacgaaaccccaucucuacuaaaaauacaaaaauuaggcaggccugguggcgugcaccuguaaucccagcuacucagggggacagaggcaggagaauugcuugaacccaggaggcagagguugcagugagccaagauccuaccacuccacuccagccugggugacagagcgagacucggucucaaaaaaaaagccaaaaaaaauaaaccagcuugcagcauuccuggaaauucuaacuaacagauguucuugcauauugauaugagccaccuccagcagagcacaacaugaccacagucuggaacagucuuugguuuucuuuuauguuagaugcauaucucuuccauuguuugugaguuuccugaguguggauacuauuuauuucuguaaccuuagccccuaacauagugucuggcaauuguaaauacuuaauaaauaucuaaugaauuuaaaaaauauuugucuuaaaagcgccuuuuuaaaaaggaauccuggaaaccauuuguauaaauggaaacaaauaccugacugugaaaaugucaaaacuacccagugugucuuuccucaaaacguuuuccaaaaaggaauuuaccuucuccgcguacaagcaucugauggaaauaacacaucuuuuuggucugaagagauaaaguuugauacugaaauacaagguaaggcaguaguuuuuacuggagauuguaauucucuggugcaaguuuuuaaaauuguuuuucuaauugaacauuauuucuuuacaaauuuuuucuagcuuuccuacuuccuccagucuuuaacauuagaucccuuagugauucauuccauaucuauaucggugcuccaaaacagucuggaaacacgccugugauccaggauuauccacugauuuaugaaauuauuuuuugggaaaacacuucaaaugcugagguaaaaagacuguauaguauaauuuuguaacuuagaguuauaauuaugauuuggguaaauaaagcuugaauguaaaauuugggggaaauuuuuaaacuuuaugugggcuggaugcaguggccuguaaucccagcacuucaggaggccaaggcgagaggaucacuugagccuaaggguuugagaccagccugggcaacauagggagacccugucucaauaaaaauuuuaaaaaauuagccuggugugguggcgugcaccuauauucccagcuacuuggggugggagggucacuugaaccugggaggucaaggcugcagugagccaugaucgugccacugcacuccagccugggugacagagugacugacagcuugucuuuaaaaaaaaaaaaugugauuaacucagauauuaacaaaaugaagauuaugagcauuuuucauguuuugcacuguagaguuaugggugagcugcaucugggccccaguuugcuuuuaaaauacagauuccugagccuauuguuacugaaucauuaucucuggggauggaacucaggaauuugcauuuuuaacaugauucccauguauucaucuaaaccugggauucucagcacuauugacguuugggcuggauaguuccuugggagggggcuguccagugcagugcaggaugcuuggcaacauucugguuucugccuacuagaugccaguaguguuccuuccuaguugugacaaccaaaaacaucuucagauauugucaaauguccccugguggcuccuccaaggggacaaaaauugguucuuaugggacaaaagaauuuauguaguacaguuguuuguuuuccuccaaaaccauuggaaagcauucuuccaaaguucagcuuugcccaacaaaaucuuauuccuuaguauuuaauuuuaugaugggggaaggauuaggaaaaaauugcccaaaaaguuguuuaguuggggagguaaugaaaaaaggguugacaaacacuggucuaaacccuaaaauucagauaccacugacaaagauaauauauaccgucagauaauauacguguuucccagaucacuucccccucguggacuuguagucaagaaucgaccuuuaaaacuccuguccagucaggcugguaaauucuuuaacuucaccucauuuucuauuggaaaucuaagcaaauuccauugauuuggcugcuucccuuuuuaauugucugacaacccuguaaccauagcuuaauguagcccauugagaauuauggucgguuuucagaugucuguagaucagacaaaccuaaauuucuaucucacugcuaaacuguguaaccuuacguacgcagggugcuuuaccucuuggagacuuugcuuccucuucucugaaguggugguaaucauaacaacuaaauuuuucaaaaggauguuuauaagguuuaaaaggaaguaacaaauaugaaaauaccuagcacauugcuggacaaguaguagagauucaauaaauuguaguugccaucuuaaccuauacuggauaauauaucaauaauuguuacuauagaaacucuuauugaauacuuauauguaagguacuaugcuaaguauuguacaugaauugucucagucauucuucaaaacaacccugccggauuaugugauugguuacauugcuguuuggcaaauacuugggacggugacuucuucccugcaccaccagaccguagaugcuggagcccaaguagaugugcugagaacagaggccuuaagugugcuugcaggguuuggcuuggcucuugcacugcuccuauuugccaggaauaaaauguauuccacauagucucugguccaaggaggauuagaggcugcuggagcugaccuaaaccccaugcacagccuccgugggagcugcccagccagucuguagacuugugagugagaaacuacauaaucguuuugugagccacugaacguuaaggcaguuuuguuaucuauauuuuuuuauuuuauuuuauuuuauuuuuuuuuuuuuugagacagguucucauucuuuuucccaggcuggagugcacucaugugaugucagcucacugcagccucgacuuccugggcuuaagugauccucccaccucagcuucccaaguagcugggacuacaggcacaugccaccaugccuagcuaauuuuuuguauuuuugcuaaagauggaguuucaccacguugcccaggcuuuuuuggugguggugguggugguuguuuuggaaauagggauuuccucagccucccaaguaacagagacuacaggcucacaccaccaugccuggccaauuuuuuugaaauuucuuguacagacagagucuagcuauguugcccaggcucgucuugaacuccugggcuccagugauccuccugcuuggccucccaaagugcugggauuacaggugugacccaccggcuuguuagacauuauucuggcgauagcugacugauacagauagcagcaauaacugucccgauuuuauagaucagggaaucagguagagagaaauuaaauaaugcuugcaagaccacacagcuguaagugauacucuuaauaaggcaguuugaggccaaaaccccuacucuuaaccauucugucacuaaucagagguaauacaauggcaauuaccccagacuuggcauguacuuguaaaucaauuagaauucucuuaggaauagaucauaugcuuuuuuggcagcagcauuuuuaacuuucugauuugguuauagugguguaucuaaaacaaauuuauauuucucacacauauacucuguaaucccagcacuuugggaggccaagguggguggaucacuugaggccaggaguucaagaccagccugaacaacauggugaaaccccaucucuaccaaaaagaaaaaaaaauuaggcgugguggcaucugcaucuguaaucccaacuacucaggagggugaggcaggagaaucgcuugaacccaggaggcagagauugcagugagcccagauugcaccacugcacucuagccugggugacagagcgagacugucucacaaaaaaaacaaaacaaaacaaaacaaaacaaaaaauacauaccaacuacgugggagaggccaauguuagacugaacauaaaaaauugagaaagcacauauucccugauuucuugaggugacuaaauuuuaucagugauuuaauuauauuuucuagagaaaaauuaucgagaaaaaaacugauguuacaguuccuaauuugaaaccacugacuguauauugugugaaagccagagcacacaccauggaugaaaagcugaauaaaagcaguguuuuuagugacgcuguaugugagaaaacaaaaccaggucagaaucuuuuauugucuuuuuuaaaaauguagcuagacauaauaaaaguaauucuauacuguacauugaaaauuguaaaacauuuucucuuuacugcaaaaaauauauagaaagaauguuuucuucaugaacuacaugaaucaaaaguagacuuuuuagaaaauauuuguaacgcuuaacucucaagucgguguuguuggaugcuuuauauuucauccaguaucccuauaauuaauuuccuuaauguauuucucuuuaacauuuaauaaaacuauuuuaaauuuuuagaauauaauccuuaacauaauuaucauguagaaaucacuuaguucaauugugaguuuuuuaaugugggaauugguuuagucucauuuucuauuuuacaguuucuaguguugaccgguagaggcuuagucacagaauaucuauuaaauuuugcuaguuguaugguguaaaagugcugaaggauacuugcauguuuggccuguaugucaauauuguauuucucccugaggaucucuuacuucaguucccacgccaaucuuuaaauguaaaugucauugccuaugguugcuguggacucagugcugccagaaauauuuuuaagaguauuauuuaauagauuuuauauuuccuuucauauggcuagucuuucacacagcugucagcacuguuaaggcauuuguaugucaaaauauaugcuaaauaucacguauaucuuuuuaggaaauaccucuaaaauuuggcuuauaguuggaauuuguauugcauuauuugcucucccguuugucauuuaugcugcgaaagucuucuugagaugcaucaauuaugucuucuuuccaucacuuaaaccuucuuccaguauagaugagguauguuacuuuuuuuauuuuuuugucaacagcuagguaaugaacagaaaauguguuugauuucaacaggauauauguagguuuucuugauauccagaaaauaauagagacugauuuggguaucuucuucaaagcuuuagucaauuaacuuuaaaaacaguaauuucauguaauaacauagcaugagauaguaaugauuguccuuaauuucauauuuuucuggcaauuccuagauucacuguggcauuuguuuuaccguuuaaagccugugauucuuggccaagcgugguggcucacgccuguaaucccagcacuuugggaggcugaggcgggugggucacuugaggucaggaguucgagaccagccuggucaacauggagaaacccugucucuacuaaaaauauaaaauuagccgggcgugguggcacaugccuguaaucccagcuacucgggaggcugaggcagggggaucgcuugaaccugggagguggagguugcagugagccgaggucaugccacugcacuccagccugggugacagagcaagacucugucucuaaauaaguaaauaaagucuguaaugugauucuucucaguacagacagucccaaacuuacgcuguuucaauuugugaugcguuugucagaacguaauuccauuguaaguuaggagcaucuguauauauccagaagacuaaaauauucuaucagcguagaaaguauauucuauggaugaaaucauacaaaaugaaauaacuaaaaacaugagacuuuuuuuaugacacacaucacaguuuuuuguuuggcacuucuaugaagcuagcauauuaaaugaaagcacugaauggugaaggccuaaacauagaaucuguuccugggaaaccaugugcucaucuaggguggguuuugugaauuugagcaagucacuaagggcagguaagcaaguacccuuggcuguaaaccaccccauagagguguuaggagcaaaggaguuaaaccauaagaaccuuaccacucuaaaaaugcuccguaaauauuaacaauuuuacuauuauaccccugaguuuuuaaaugucauuccuguguacuguaauauucauagcuauuauuuaaaauagacuuaaaaacuaguuacaauagccaauaauuucucaauugugcuucuucuggauauauauguguuggauacaaacauuuuuauuauuucaaaaaaaaaaagucaugaucccagaguccgcccgcuccuguccuuucccguguucuuccccgccuaccccgauggcacaguguaccuuucuuagguacucuucaaagacucaccacagaagguacuaagauaugagugaccucacuaaugaugcuuuuaaacauuauaaggcaauuaguauguucuuaggcgacuuuuuaauaugcaugccagaagauagguuuucucaguaauggauguaagaaacuaaagcuauuacaacuagaaaaggaauuuuuauuauuuuaaauaauugauuucuacucuuucccuuuuuuuaaauuaguauuucucugaacagccauugaagaaucuucugcuuucaacuucugaggaacaaaucgaaaaauguuucauaauugaaaauauaagcacaauugcuacaguagaagaaacuaaucaaacugaugaagaucauaaaaaauacaguucccaaacuagccaagauucaggaaauuauucuaaugaagaugaaagcgaaaguaaaacaagugaagaacuacagcaggacuuuguaugaccagaaaugaacugugucaaguauaagguuuuucagcaggaguuacacugggagccugagguccucaccuuccucucaguaacuacagagaggacguuucccuguuuagggaaagaaaaaacaucuucagaucauagguccuaaaaauacgggcaagcucuuaacuauuuaaaaaugaaauuacaggcccgggcacgguggcucacaccuguaaucccagcacuuugggaggcugaggcaggcagaucaugaggucaagagaucgagaccagccuggccaacguggugaaaccccaucucuacuaaaaauacaaaaauuagccgggugugguggcgcgcgccuguugucuuagcuacucaggaggcugaggcaggagaaucgcuugaaaacaggagguggagguugcagugagccgagaucacgccacugcacuccagccuggugacagcgugagacucuuuaaaaaaagaaauuaaaagaguugagacaaacguuuccuacauucuuuuccauguguaaaaucaugaaaaagccugucaccggacuugcauuggaugagaugagucagaccaaaacaguggccacccgucuuccuccugugagccuaagugcagccgugcuagcugcgcaccguggcuaaggaugacgucuguguuccuguccaucacugaugcugcuggcuacugcaugugccacaccugucuguucgccauuccuaacauucuguuucauucuuccucgggagauauuucaaacauuuggucuuuucuuuuaacacugaggguaggcccuuaggaaauuuauuuaggaaagucugaacacguuaucacuugguuuucuggaaaguagcuuacccuagaaaacagcugcaaaugccagaaagaugaucccuaaaaauguugagggacuucuguucauucaucccgagaacauuggcuuccacaucacaguaucuacccuuacaugguuuaggauuaaagccaggcaaucuuuuacuaugcauuaagaccucugauucaaaacuuauuagaacaguagcuucugcuggaauuugcaaucacugaagucauagaaaauagguaacuaucuaauuagagaaauaauuguuguauuuuaagaucugagaguguguacaaguuuuaguauacaugccaugccagaagauaguguaugcaagaagucuugggaccagaaaauggcaaugauaggagacugacauagaagaagaaugcuucccuaggaaaaaggucgcuggcuuuggugcaagaggaagaagaauguuccacuggaagccugagcaccuaaucagcucucagugaucaacccacucuuguuauggguggucucugucacuuugaaugccaggcuggcuucucgucuagcaguauucagauaccccuucugcucagccugcuuggcguuaaaauacaaaucauugaacugagggggaaaaauguaacuaggaagaaaaacccaauuuaagaaauuacauaaugcuuuccaaaggcaccuacaacuuaguuuuaaauuacuugcuacuggggauuacccauggauauccuuaauaggcaggaagucugggaauucugguggccucuagggcaguguucucacagcaccguuccgacagggaccagugaaagaaaagagacaaaguuagaacgugcuggggagcggccauuucuaaggccagucugguuuaaguagucauuucugcugaaaaaacagaugauccugguggaagaaaagguugaaggcagcugcccucgggagggcugugaugcucggcacauccugccuggcacauacacgugucugcaggccacaccgugcauguccccagaccugccgccuggcuucuggagugcuucaagcagagcauggugggucauugaggagacccaggaaucucaucugagaacccacucucugccggagaaccccauggugacacauuuucaucuuucugaccagaggcuguuuuuuuuuuuuuuugagacagucucauucuguugcccaggcuggagugcaguggcuugaucucggcucacugcaaccucgccucccggguucaagcaauucucugccgcagccuccagaguagcugggauaacaggugcccaccaccacaccccacuaauuuuuguauuuguauuuuuaguagagaugggguuucaccauguuggucaggcuggucuuggacuccugaccucaugcuccacccgcuucggccucccaaaguucugggauuacaggugugagccaccgugcacggccggccugaccuuuggaaaagccuugucacuuuggacguuugcgucuuugaagaggcgaugggagcauaucaugacugccugccaccauugcuuuucagacuaccacaacucaaucaugcuguccaggacuucuggcccuguguucaccacugggaaaacguacuucagacuggauagccuaaaaaggagcaaugcccuuguaggauguggagaagggaaaauacggacauuaacauuaaaagacaccagugaaauuguuaggucucuaggaaguuggagcacaaggcuucacgcuuuaagaccaucugugguuuucagugaacaagcgcugagcaccagcagcagaaaacaacaacaaaaaaacaccucguuuuuaccuugucuucuagacaugaaaaggcaguugcauuccacucugcauuauguucuacauguugcuuuaucaguauaugcuuagcuguaagugacaaguauuuuuucugaacagaaguuuacuuagaaauaccaugcacuuggggguaccaauuaaccgccugaaaauuagcauauugauaguucuuagagagaccagauauaaucuaagaauuuauaugaaagauuuguaucauuagagccagaaauaauuuuauauuaauauauaauacagauuaacauuauauauaauauguaccugugucacuucugacaugagccuguaaacauauauucauauauguaccugcacauguacccaccugauguaggucuuauuccuuuaguauggacuuaaaguacuuauucauauaccuuguaacuaaaaauuagaacagcucccuagaauugugaacuuuuaagagucugacuagaaauuugcaacuuauaaaaaaguuacuuuuaaaaauauaaguuagggcuaggcacaguggcucaugccuauaaucucagcacuuuugggaggccaagacaggaggaucacuucaggccaggaguucaagaucaaccaaccuggguaacauggccagaccccaucucuauuuauauauauauauauaaaacuuagaguuuuuaucuuccccuaaaagaggccgugauauuugcagcagccucaaauugcucuuaagggguuuaggugugcagaagcuuuccuuucccuacccaguaaccaugugacuacuaacgugguauauugauuuauuuuguuugcugucugucuccccugccccacugcuggaacagaggcuccaagaaaacagggaccuuauuauucauuacugcauccccaguaaugaaaguacuuagaaaauaauuauugaaugaaugaaaucuaaacugugaaccugaggguguuuguggcaguguuuguuuuacugaauuguagaaggacauaaccguguuuucaguguuucuauggaacaaacuuguacauuuuauuucacuuguguuuugucuuaaacccuacugcuggaaacaauuuuauguaauaagcaaugggcccaaaagucuaggaguuuuuuuguacuuagugaauuuguaugcaacagagaugcugcagcugaugccuuuaaaagguauucaucauggaagagcugaggccugugcuugguguuccagagcccaggguugagcauccugaaggagccacugcagccgucacuguccccagagccuguggagauagagccuguuugcugcuuuuucuucccgcucuuaagacauggcuggagcucagucuucauugaaugaaguuugcugugguauugcauagccuugcuuucuugaacuaaacuguuugcccuucacaaguaguucuucuuucaggauuaguucguuccaaggaggcucuucagucucacagauaaguagaucucuccugcugucuggacacauuucacucggaaauugaauacaauuuguauucaggcugggaaccugaacacacacuuguguuuuuaagcuucccuuuuuuacaguggacaaggacacaaauaauaaauaaaucaucccuaaugcccaagaa

SEQ ID NO: 192649 - RNA, 3786 nt, Homo sapiens
uaaucacuugaaccugggaagcagagguugcagugagccuagauugugccauugcacuccagccugggugacagagcgagacgccgucucaaaaaaaaaggaguuucaguuauuuucuuuucuugcuauauccucaggacaaaccugauagguuucucacucacacaucauuggcuaugugauuaguuuugugauaaguacaauggcacaauucuuaaauucuuguauuauagcaauaaaucucauuuuccauguaaagugucaguggaacuaagaaugauuuaugauaguaaacaucaaaaugaucguauuuuaauaaauuuccacagauucauccaguuuaaaaaaccuuucuugauuucagguguuuucucuccuucuccuugaucaagguuauuuggguuucuaucugugacuucuuuuguuuuuauaagggucucguauauuuucugggcucugacaauuucuuucugagcaucaaaauggacuuuuugccuggucaggaugggaacaauuaaauuaaaaucauuaauucgcuuguuuaauuuucugauguuuucuugaaacugcucacaaacaugguuccacuguuucuuuucaguuggugucauuggauucccaaguuuuuuccuagacacuaaaauugccucucugaguugcucaauaguaucgcuuauuuccuuuugcuuaaggauccauucugguugguauccauuaucgaucaguauucgguucagguugugagucaugggaucaauguaagaacagucagaaaacuuuuucagagguuuuccuuucccacugagauugucaaagucuccuuuugccauggauucuugaaugagguccuccacuaaacguucuauagcuugcguuaucuuuugcuguuugcucugucuuauauuuuuaacaauuacacuaucaggaaaauacuggcuuuguaguuucugcuuuugauauuccaucacuuguucagcagcacggucugcccuaaauugccuauaaugcuucucucguugaguuggagucccaaaaccaauaccuucaaaacuuaaauaaugucgguguugggguguuuuauauuugaauuuuucuacaucuucuucuucuucaccuuuacucugacuggcauuuguuuguucuaucacaugggagagcaccuuucuauaagcuuuuucaauccuuauaaauguugcagaaucagcaguauuagagccacugucaggaugauauugcuuggcaagcuuaugaaaagauucccugacuucaucugcagagcauccuuccuccacguucagcagucuauaauauucucugaucuucuuuuuggauuuauggguugacaucauucuauuucuaaugauaccaaaauauggaagcauuuucacucgauuaggaaucacuguagccuuuaucaggugagaucuuaagaucugagccaucaucacauacauuguauucauuauuguacccagaguucuuccuagcaaugaccuauaaaacgacaacaaauauagguugaacaaaguuguauuaucaguuaauuucuuauuuucagcaauaagguaaaagauacagcaugaauuuauaaguacaacaaggggcaguucuuuugaaugcugcugucaacuuuuuccuuuuuuuuuuuuuuuugagacagagucucgcucugucacccaggcuggagugcaguggugccuccaccuccagagccacgccuagcuaauuuuuuuguauuuuuaguagagaagggguuucaccauaucgcccaggcuggucuggauauccugacaugguuaucugcccgccucggccucccaaagugcugggauuacagguaugagccacugcgcucagccuuuuuuuuuuuuuuuuuugucugagacagggucuugcucuguugcccaugcuggagugcaguggcacaaucguggcucacugcagcaucaaccuccugggcugaagugauccucccaccucugccucucauguugcuaggacuacaggcgugcaccaccacaccuggcuaauuucuguauuuuuguagggaugggguuucgucauguugcccacccuggucuccaacuccugagcucaaacgaucugccaguuucugccucccaaagugcugggauuauaggggugagccacugugcccagccacauucuuuuuucuuuucuuuucuuuucuuuuuuuuuuuuuugagacagagucucacccaggcuggagugcaauggcaugaucucggcucacugcaaccucugccucccggguucaagcgauucuccugccucagccucccaaguagcugggauuacaggugcacgacaccacuccuggcuaauuuuuguauuuuuaguagagacggcguuucaccguguuagccaggauggucucgaucuccugacccugugaucugcccgccucgaccucccaaagugcugggauuacaggcgugagccaccgcacccagccccaccagcugcauucuuauagcuauauuucacugaugugggcagaaaaguggaagcugaugaaguuuaguguuaacauauuguggggccaggcacgguggcacacgccuguaaucccaguacuuuaggaggccgagguggguggaucaccugaggucaggaguucgagaucagccuggcuaacauggcaaaacccugucucuacuaaaaauacaaaaauuaacuggagguugcagucccagcuacucgggaggcugaggcaagagaaucgcuugaacccgggagguggagguugcagugaaccgagaucgugccacugcacuccagccugggcaacagagugagacucugucucaaaaaaauauagauagauagaaucuggauucuaccccucacuaacuaaccguauauuuuacaaguggaaaguucuuagagaucaucuaauccaaucuucucauuuaaugagaaaacguagguccggaagguuaagcaauuuaaccaagucccauaacaagguguaagcaaaaugguuaggggugggcacaguaaaaaaggaggcuugcuuaacugucuauaccuccagccgauuauaaacugcacgagagucugcaucaucucaagaagucuucucauaagacgacuuauggacaagguacguaccuggucugauacuggauugaauagaaucaaguguccaaaagacuuuaagcuccacagcucgcuaggaaggagcuaucugccagaggccagaaaaaccaugaugaauugugaggccucccaacacguuugcugcuauugcaauaacauggucucgaagaggaggaagacuuguacacugacaauggccaaaaaauacuggaaguggcuuaauuggaauugggauauauaaacgcuaaaacggagcuccugagacccccuauuuucuaggcaaucggugccaacggucugggagccggcugcgaaggugguuaucauggcaagggaggucgguccugccccgcccccuccucaccugcgcagaccugggguagggguuccgcggcucccgccccccugccgcgccucugcgcaugcgugcgcgguccgcccuucacugcgggugucccucccaccgccuccagcuggugccuccgccgggcuagaccauuugccacuuuacacugaggggcucggggguacggaaggcagaaucguaccugauugggacaggugaccuuaccaggaaaacggacaaucuuccgccaaacgaacuuuaccccggaggacccaggcagggcaccucgggagccuucgucccgaccggggaccacc

SEQ ID NO: 192650 - RNA, 52513 nt, Homo sapiens
agauguaguuccgagaccgguugccauggcguucuggacagccucgcgaguccgaccccgcccuucaggagugacgagcggccugaccaaugggagcagggggcgggcucucugacgaaggacuggaagguggcgguggugaaggugcaggccguuggggcggcucagaggcaggugagccccgggaaacgcguccugugucuugggaaacgggccuuuaagcgaaagguggagagaugccccacagaaccgugcagcccuggggaggauggugguucgcgucgaacccuaaccugggacuuguucgggcccaggccuagcuuagcugaggccgcugagggguggguaagacuagauuugagggacaguuuccuggaccuugacggguuuugauuguaggucuuaucucaguuugcaucucccucuacuuuuauggaggcagaggucugggagugcccuuccacuuaaucucccagguuggguuuuucuccucugcuucuuguuccuagaauuugagugucuuuuucuuucucuguuacuucuucucagccacuucuuucuuccucaucacuuugcuguuuucggaaagcaguuaguaguuauucgcuguauguggcuuuugagccagaucggcccucuucauuaugcuaaacggcggaaucaucuggagcgagauguaagcaucgccuugggauaggucugggucggggccgaacaucugcguuucuaagaagcucccaggugcugcuguccacguuaugaguagaaagguuuuaccugaacucuguccaguacaaauauaaugcgagucccuuaugucauuuuaauuuugggguagcuacauuuaaaaagugaaaagaaacacgugaaauuaauuuuaauuauauguuucauuuagccuaguauaucugagacauuaucauuucaacgcuuaaacaaauauuuaaaaauugagauuuuacguucuuuucuucguauuaaaucuucaaaauuaaauuaaaaaauuaauucuucaaaauuaaaucuucaaaaucugauguguauuuuccacuuaacagcgcaucucaauuccgacuagacacaguuggagugcucaauagccaccugugcuaguggcugcuacaguagccuacugcagaaauuaaaaggugggaaaaauaagguugcauugaccaaacccuuugcaacucuaugagaugggauucagaacuacuuuagagauucucuguaauugagaugugcccaauuuacagaaauaauagucaaaauagccaacauuucugaaaguaugauguugcgcugagugcuuugcagguauuauuuaauccuuauggcaacccucugagauaacugcuauuauuaucuaagauaugggaucucaggcccagaaagguuaaaauuaaguagcccaaagucauaccgcuaauaaguaggaaagccccgauucaaacucgggucaguuaugacuucuaaaucagaucccgcagccauugcaguguauaauuacuaccuuuuaucacuaauuucccuuaucgaugccucuguuccagcuuacagcaggggauaagacguuuagauuugaaagugagguaguucgccauacaagauaaagcugccagccuugugcaaugaaauauuucuaagauuaacuaugcucuuuuuguagacccaaugaacuacauugagcucaggagaguuuuaugagcagaagagcaaaaauacacauauuggccgagcgugguggcucacgccuguaaucccagcacuuugggaggccuaggcggguggaucacuugaggccaggaguucgagaccagccuggccaacauggugaaaccccgugucuacuaaaaauacagaaauuagccgggcaugguggugcacgccuguaauuccagcuacucaggaggcugaggcaggagaauugcuugaacccgggaggcggagguuacagugagccaagaucacgaccaccacacucuagccugggcaacagagugagacccugucucaaaaaaaaaaaaaaaaauacacaucuauauaugcuaaaauaugguauuuuacaaaaaaaaaagucuuccauuuuaugcauaauaaagacaugaaauuauuuucucuugauuuuugaauuaguaaauauuuaaucaaaauuacaauucauauuuuucauuugaagcaagaagugguuucucuacaauccucuagugaacuggaaaauuaagcauuuacaaacuucaauaauguuaguagguggaaaagaaagucaguuaaauggauuggaggggagcgaguaacuguugugugguagaguuucgggaggaucccucaauuaguuauucucaucaccagaggccuccaccugcauugucccagagucacauaauuaagccaccuuauaaagggaagacucauucaucacaccguucgcucccuuguuccccaguaguacaauauaggaaaauaagaugcucauucaaaaauauaaaugaaaguuaaguuucuguuguucuggaucauauuauauuaaauagcccuacauugaauaguaacuggaucagagauuuucagaucuuugggauaaugaccaucccacgucuccaacccccagagauauggguggggaauuggucauguaagaaacccuagacucuuaagucaaaaugccaccugaaaaucaacagauaauaaaauaaaucccucauggagguggggaggucaucaaaaauucuuuugagauccaaaagaguucuuuguugagagccacuguaggcaaaaaagaaacaauuuuccuuuucugcuccuuuaucuaucuuuagaucucaaguugcauaagauguagagauuaugccacacauguauaaauucaaucgaauaugccuugauaauauuuaucaagauugucacaauuagaagagaacuaaauggucauuugauccaccugucccacucaguugacucuggaaucugcuuuaugaagccuguguaauauguacccauccucuguuucagucccucuagugauagggaccaucuaauguuacgcauuuuccauuuaguuuuaaguuauaaugccuaaaguucuuauauuaucagcuggaauugcuuuacaagguuuagccagauauaagccacugucacaauaucuccugugcccaucuuauauaauaacaggcacaaaagagcacugcaguugugcacagcaaaacacccaaaacaccuguggacucauugcuagugcaaaguguccuuugaauauacauauuucuagagacuguugacuauaccauguagagauauccucaacuguuauaaccaugcauucacuacccucuuuaagaagcaggccaagugcaguggcucacgccuguaaucccagcacuuugggaagccgagguggguggaucaggaggucaggaguucgagaccagccuggccaacauggugaaaccccaucucuacuaaagauacaaaaaaauuagcugggugugguagcgugcgccuguaaucccagcuacucgggaggcuggggcaggagaaucacuugaagccgggaggcggagguugcagugagccaagauuaugcagcugcacuccagccugggugacagagcaaaacuccguaucaaaaaaaaaaaaaaaaaaaagcagaccugacccauuaggacuaccauccuccacacccugcagaauauauuugagccaaaccuccagcuaguugcuuugauuauggugacuauauucuuuuuaaucaaauauuugggcauauuucuuuuuccaaugugugaauauguacaaaaagucucacagauuaaugugaacauuguuaaaauuuaacauuaauucaccuuuucccaaaugaucaaaauauaacugaagauuucccccuaacaauccagcuaguauuauaaugcuaugcacaggucccaacgauggauggguaauaggguauuggauacugcccaagagagccuggcauggugaccagguugagcauacagggccacauuucagaguugacuucaucuguuuuucucuugucuagcuguuuauauguguguguguguguauauauauauauauauauauauauauauguuuuucucuuguguagcuguuuauauauaucuuugcuuuccuuaaaaaugaagguagguuagaaacauuauaaccgaacucugaaccuggaguggccauaguauuauaaaguuuguguuggggacuaauaaaaauuugagcauguaagaagaggaguuuggacuuucaggaauuaaauuaaccauaggggaauagaugaguugaaugagggagaguauugaaagcauuuggcagccuaucgccacagcccgagccccaggcauugaggugaaggugaugggauggaucuaagguacucuuuuuuuuuuuuuuuuugagacagagucucgcucugucgcccaggcuggagugcaguggcgcgaucucggcucacugcaagcuccgccuuccggauucaugccauucucccuucucagccucccaaguagcugggacuacaggcacccgccaccacgcccggcuaauuuuuuguauuuuuaguagagacgggguuucaccguguuagccaggauagucgccaucuccugaccucgugauccgcccgccucggccuccaaaaaugcugggauuacaggcgugagccaccgcgcccagcgaucuaaauuauucuugaugacuagagaguacagcaaaaucuuguuugggggaaagaugaguccagcuuugugucuguuaaauuugaaguuggucugaugcucaaaacacuuuuggccugaaaguguagguaaggaaugauuuguagagguuuuauuuacaacuaagaauagaugaguuuuauacaaaaaauuagccgggcgcaguggcgggcgccuguagucccagcuacucgggaagcugaaacaggagaauggcgugaaccccggaggcggagcuugcagugagccgacaucgcgccacugcacucuagccugggcgacagagugaaacugucuaaaaagaaaaaagaauagaugagcuucuugggggauugaguguaacagaggagcaaguggaguucauguugcuauuauaagaaggaugaaaccauuugaaacuacuucccauugauuuuuuagaaaucccuuaacagaucaguauuuuuauuaacuacuuucuugaaguguuuguagucaaguguuuaauuuaugcaaaguucucguucugcuuuugcuaaaaauuauucuaaauugguauuaucuccuuaauuuuuguuucuccagauuuuuuaguaaguuuacuguauggccaauauaaaaauuuauaguauuacuaacauaauccucaguuuguggauuaauucaaacauuuugaaauucugauauaccuguaaaaguauaaaauuucuaugcuuuucacaggcuauaucagccuacauuuuuaaacagguuuauuguaauuaaaaaguuuuguauguuuaagagacaggguuucacucuguuguccaggcuggagugcaguguugauuauagcucaaagcagccuccaaugccuagauagaacuacaggugagcaccacuacgccaggcuuauuuauuuauuuauuguauuuuaagagacagggucuugcuuuguugcccaggcuguggaacuccugggcugaagcaguccuccuaccccagccuccucccaaauuguugggaugacaggugugagccaccacucugggcaaaaaguuuuauaucauacuuuuuugguauaguaaaauuuauaguagaacuuauaauuuugaaguuacaugacuuuucuuagaaaugucauauuauauauuuuguuuuauuuauuuguucauuuauuuauuuuugagacaaagccucgcuguguugccaggcuggagugcaguggcgcgaucucagcucacugcaaccucugccucccagauucaagcgauucuccugccucagccucccgaguagcugggacuacaggcauacgccaccacgcccagcuaauuuuuguauuuuuaguagagacaggauuucaccaucuuggccaggauggucuguaucuauugaccucaugauccacccgccucggucucccaaaguucugguuacaggcgugagcaccaugcccggccuauacauuuuaauuuauauuuuuauuuuauaaaauguuuaauacuuuuauggccgggcgcgguggcucacgccuauaaucccagcacuuugggaggccgaggcaggcggaucacaaggucaggagaucaagaccauccuagcuaacacggugaaaccccgucuguacuaaaaaauacaaaaaaaauuuagccaggugugguggugggcgccuguagucccagcuacuccggaggcggaggcaggagaauggcgugaacccaggaggcggagcuugcagugagcugagauggcgccacugcacuccagccugggcgacagagcgagacuccgucucaaaaaaaaaaaaaaaaaaaaaaguuuaauacuuuuauguccuaugugcaaauguauuuuaagucaauacaaauuuuauuaaauaacaugagacuuggcagagugugagacaaaaaacaaaaaauaaaaugaaauacaauuuuguuacguaauagacuguuuuauuuaaucugccuaggaaaccaugugggccuugaauaccauccauucuaccauuuuccuaguacuaggaacucaguauucuuuuuuugggcuuucaagacaaauauuuccucaguuuucuucuggcuacuuuuguaaaaacaccucucuuucuuuacuuuguaacuuuaaggauauuuuuguucccauacaauucucaauuggaccaacugaacauuacuuuuuuccaccaaccagggcaauuuucaccuaauuuagagaaacuauuuaggaugaugugacuaaaaauauugccauuauuuuauauauauauauauauauauauauuguuguuguuguuuguuuuaagggauacuagggguacaaacaagcaguuaucuuccagggucuuugaaauuggggcacagucuaagguccaugugacugcuuaucugggagacaugccauauauuucaagauucaaugggcagagaaaacaguagcuuccaguaucacaaagcaagaugcuuugaaaucaaggcauugauacguaauuguuccacuucucaaaaaggcaauucuaguaacuccagacugaguaggaacagaguuguuuuuuuuuuuauuuaauaauaauggauauauuucccaggcaaugguugggaaagcccgcuaguuaguaaauaaauaaagcaagguuucauuaguguguaaugaaaucgggaagcauggaacaaauggagugagugucacuggggaugauuccagagaggggguagaacuugaacuuuauuuacuuagcagaaucuaaauuacagcauucugucagagaacaggccaugccuagaagcucugagaugggguaaccauaugauguaaagucauacuaacuagauagaggguaugugcuuggacauuguggaagcaguaagguagaguagggagagagaguaugcauuuuagagagccuucaaaggagguuagauuuaaugcuggagggaauacguaaauguuguauccaugcuucgguucuccccagcccccaaacaaaaacauugacacaaagaccuucugcaaccaaagcguuagaauuaaucauuuaaccuagcuuaauccugcuuuuauauacuucauugauacaugcuacauacguaauuucuauauaugucuugaauguguauucauuucuguuaauuccagcguuugauuaucacguccgagaaaccaacaaccauugcucaacuacacucuguaaaaacucuuuacguauuuggauccaaguagauccacuaacauucaacacagagggcuggcuuuauggacauauggccuaugcagucucacugaccucagauucagaagagacuuuugcuugauuucaugcucugcuaucuugaaauucuaauaauuucuagacaaggcuucccacauuuccauuuugcacuaggcucugcaaauuauguagccagaacuaucaauagguacuuaauuauuaucuuaaagguauuccacuuuaggccgggugcgguggcucaugccuguaaucccagcauuucgggaggccgaggcagacggaucacaaggugaggagaucaagaccaucuuggccaacauggugaaacccccucucuacuaaaaauacaaaaacuagccaagugugguggcacgugccuauagucccaacuacucggguggcugaggcaggagaaucgcuugaaccugggagauggagguugcagugagccgagacugcgcccuccagccuggcgacagagcaagacucuguugcaaaaaaaagaaaaaaaaaaaguauucaacuuuaauugauauaucuaauguuagcagcucaguaggaaaccauuaaaagccaugguuaggaguaaugacuuuggaagaaguagcaccuaguuuauaucccaguucuggcccagcuggugcuaugagacaccagcuacaugcuuuaagcuaagacucacuuuccucauucauagaauaaaugaaauaauaguauucuuaccaaaaaguauauacaagaauguuuuuaacagaacaauucauaagagccccaaacuggaaacaauucaagugucugucuauaguggaauggauaaauagcaauuuguuuauacaguggaguacuauguagcaauacgaaugaauggaauacaacuacaaguaacaacaugagugagacucacaaaccuaauauagaaagaaagaaaacagacauuaaagaguauaauuuuauuuauauaaaguucaaaagcagacaaaacuaaucugugcuguuaaaauuuaggauauugggucuccuuaggaggagaaggggacacagggaacuucuggagguguaugaugaugugucuccugccaugaugugggcauauucacacuguaaaauucaacaaguuaugcgcuucaaggauuuguguacuuuucuauauuuuauacuucuguaaaauuugcauaaaaaauagucuuaccacauaauuacucugaaaauuaaagaaacaauuguggaaucuuuagagauaccucaagaaguucacagagccgggcgcggugacucaugccuguaaucccagcacuuugggaggccgaggcggguggaucaccugagaucaggaguucgagaccagccuggccaacguggugaauccccaucuguacuaaaaauacaaaauuuagccgggcaugguggcgcgugccuguaaucccagcuacuaggggggcugaggcaggcggaucgcuugaaccugggaaacggagguugcagugagccaagaucgugccacuacacuccagccugggcaauagggcgagacuccaucuaaaaaaaaauaaauaaauaaguucacagaauauaaguuuauuuauuuuauuuuauuauuuuuuugagacagaguuucgcucuuguuccccaggcugaagugcaauggcgcgaucucggcucaccgcaaccuaugcuucccagguuuaagcgguucuccugucucagccucuugaguagcuaggauuacaggcacgcaccgccacaccuggcuaauuuuuuuuuuuuuuuuuuuuuuaguagagaugggguuucuccaugucggucaggcugaucucgaacuccugaccucagaugaucugccugccuuggccucccaaagugcugggauuacaggcgugagccacugugcccggcuauaaguuuaaauacuuccauuaaaugguuuauagacugauacagaagaauuagggccacaauuuucaaccggugucuuggcuguucacuuucuccuuuuuaaugaucuuuaagacuucgaaagccuuucauaaacgguaauuaaaggaaaauuuaauaaaagguaaauaaaauugaguuucucuggccaucauaaggcuucuuuuaaguaaucuuuuuuauuguauaggaaaguaaaaugaagcauguuugccuuuguaguaaaagguugaacuguaaacccauucucaguaagacaggugcccagagaguguugcauauucucuuauuugaucacuuugugaaagauuuuuuaaauuuacuuauuugaaaacuacauuuguaguugucguuuuauccuuugccagcacuguuuuuccauuuuugcuuacauuuagucuggaagacuuguuauuuuauuucauuuauauauauuuauuuuuaggugacuaugaaaggcuuauauuuccaacagaguuccacagaugaagaaauaacauuuguauuucaagaaaagguaagaaaaaauguuuaaucauuaaaguaguuaguguauuuuuaucugcaauaaacccacuuuuaaaugacguuauuuucagugagacuuaaugaacaaaauuacucaaaugaaacuccucaaauuacaguacuuuccuuuaaauuuuaugugaaaauggugguucauauaguaguuuaacuauuuuuuaaguuuuauuuuguuuuuaauuggcacauaauuguacauauuuaugggguacccugugauguuuugauucauguauaaauuauguaaugaucaaaucaggguaauuagcauaucuaucaguaaaauacuugccauuuuguugugucauuuaaaauccucucuucuagcuauuuugaaauaugcaauacguuguuaacuauagucaccuugcuguacaauagaacaccagaaccuauuccuuccaucuaccuguaacuuuguaccuguugaccaaccucuguccccagcucccaccccuuuaaucuccccagccucuaauaaccauuauuggacucucuacgucuaugcaaucaacugucuuagauuccauauuugagugagaucauguaauauuugucauucugugcuuagcuuauuucacuuaacacagcguucucaagauucauccacauuuucacaaaugacaggauuuuacucuuuuuauggcugaauaguauucuguuguguauauauaccacauuuucuuuacccauucauuuguugauggacgcuuagguugauuccauaucuuugcuguugugaauagugcugcaguaaacauggagguacagauaucacuuugacauauugcuuucauuuccuuuggauguauguauacccaggagagggauuguuggauuaaaugauaguucuuuuuuuuuuuuuuuaauugcgacagagucucacucuguugcccaggcuggagggcaguggugccaucccaccucacugcaaccucugccucccagguucaagugauucuccuaccucagccuccugaguagcugagauuacaggcacgcaccaucacaccuggcuaauuuuuguauuuuuaguagagacaggguuucgccauguuggccaggcuggucucaaacccccgaccucaggugauccgcucgccucagccucccaaagugcuaggauuauaggcaugagccacugcgcccagccugguaguucuauuuuuaauuuuuugaggaacauucauauuuuuguccauaauggcuauacuaauuuacaugaccaccagugguguauaagaguuuccauucuccacauccuuaccggcauuuguuacuuguugucuuuuugauaauagccauucuaauggggaugaggggauaucuuccugugguuuugauaucuauuucccugacggccaugaucgagugguguucaucccagggaugcaaggauaguucaacauaaguaaaucaauaaaugugauacaucacauuaacagaaugaaggacauaaacccucugaucaucucaauagauacagaaaaaccauauaaugaaauguaacaucccuucaugauaaaaauccuacauaaauuaggcauagaaugaauauacaucaauauaauaaaagccauguauaacaaaccugcagcuaacaucauacugaacaggaaaaaguuggaagcuuuuccucuaaaaucuggaacaaggcaaggaugcccacuuucacuacuucuauucaacauaauaauagaaguccuagccagagcaauuaggcaagagaaagaaagaaagagcauucgaauuggaaagaagaaagucaaaccaucccuguuugcagaugacgugaucuuauauauagaaaacccuacagacuccaccaaaaaccaguuagaacuaauuaaugaaucaguaaaguuauaggauacgaaauaaaaaaucaguaggaggcugggcaugguggcucacgccuguaaucccagcacuuugggaggccaaggcggguggauugccugagcucaagaguucaagaccagccugggcaacacggugaaaccccaucucuacuaaaaauacaaaaaauuagccgggugugguggcgugcgccucuagucccaguuacucgggaggcugaggcaggaucauugcuugaacccaagaggcagagguuguagugagccaagauugugccacugcacuacagccugggcaacagagcaagacuccaucuccaaaagaaaaaaaaucaguagcaguucuuuguuguuguuguuguuguuguuuuuugagacagggucuugcgccaucacccacacuggaauacaguggcgcaaucugggcucacugcaaccucccccagcaucagcucccaccucagcuuccugaguaacugagacuacagacaugugccaccaugucugucugacuaacuuuuuuuuuuuuuugguagaggcagguuuugccauguugcccaggcuggucucaaauuccugggcucaagcuauccucccaccucagccucccaaagugcuggaauuauaggcgugagccaccgcgccuggccgaguaguaguucucuguagcgacagcaaacuaucuaaaaaagaaauuaaaaggccaggugccuauaaucccagcacuuugggagaccaaggauggaagaucacuugagcccaggaguucaaguucagccugggcaacauagggagacccugucucuacaaaaaaaaaaauuuuuuugaguuaaccaggcaugcuggcugacaccuguagucccagcuacuugggaggcuaaggcggaaggaucacuugagcccaggaggucaaggcugcagugagccgugaucuugacacugcaccccagucugggcgacagggcaagacuugucucaaaaaaaaaaaaaaaaagaaagaaauuaagaaggcaaccccauuuauaauagcuauaaaaaauaaaaugcccaggaauaaauuuaaccaaggaggugaaauaucucuacgaugaaaacuauaaauauugauggaagaaauugaagagaacaguaauaaguggaaagauagucuauguucauuaauuggaagaauuaauauuguuaaaauguccauacuacccaaagcccucuacagacucaauucaaucccuaucaaaaugccaguggcauuauucacagaaauagaaaaauaauccuaaaaaucauauggaaccacaaaagacucugaauagcaaaagccaucuugaccaaaagaauaaagcuggaggcauuacacuaccuuacuuuaaaaaauauuuuuaaaagaauuacugcaaaagaguuuuuaguuccucagggugguaguguaaaagguauuaggaagacagaacaaacuuaauagucuuacauguugugaaaguaacccaauguauuccgaauaccacaauaaugcaaguuuccagaaaguagccauguuucagaaaagaccuugucucggccaggugcgguggcuuacgccuauaaucccagcacuuuggaaggccaaggcaggcagaucaugaggucaggagaucgagaccguccuggcuaacacggugaaacccugucucuacuaaaaauaaaaaaaaauuagccaggcgugguggcaugugccuguagucccagcuacucaggaggcugaggcaggagaaugguaugaacccgggaggcggaguuuguagugaguggagaucacgccacugcacuccagccugggcaggagagcaagacucggucucaaaaaaaaaaaaaaaaaaaaaaaccaugucucauaugugaaauggaagagguagaaagauauuauuuuccauacacauuucagagagugcugaaguuaccugauuuacuaaguuuuaaaugaucacucauauucauauuaucaccaaguuuuuuauuacuuuaagcauagauaguagaauuuucauauacaguauuggugauuauuagaaagauuuguggcaagccaaaaucauucuuccauaaauuuagggauuaaaaguaaguguuauauguaaaucaguauuucauaauaauuaugagaguuuugaucgugaacacaauccaguuuucucucuugucugucacuaacuccuaaaacauuuaggccaggcacaguggcacacgccuguaaucccagcacuuugggaggcugaggcaggaggaucacuuaagcccaggaauucaagaccagccugggcaaaaaagugagaccccuauuucuaccaaaaaaauuagcugggcaugguggcacccaccuguguaggucaaggcuacagugagccauguucacaccagagcacuccagccugggugauagagcaagacccugucucaaaaaaacaagaacaauuaggccaggagucuguguuucagacagcuuggcuucuaucauugaucaggaugagggucagggguugauuggcucuugggaagaaacaucuccagguucacaaaaucaugaguaaaauucacaaacucaccaauauuaaugaacaucuucauauuaucaccaaguuuugucaaaacugugauuuaaaaagauguucucagauuguguucaugacaaaacacaguaaucccuuugauacaucacaggaggggcuauguaaguggcuauucuuggcuagcuuuucaucuaauugugggcauauuggguagaggagacugauuuaauuauuaguaccagguucaguuguuuagaugaggugauacuguauuuaauaauauagguggaugacauugagugucugaauuuggacuauuuuugccuuugaauuucuuuucuuuuucuuuuuuuuuuuuuuugagacagggucucgcucugucacccaggcuggagugcaguggcacaauaucagcucgcugcaaccuccaccuccuggguucaagcaguucuccugucucagccucccaaguaccugggacuacaggcaugcgcaaccaugcccagcuauuuuuuguauuuuuaguagagaccggguuucaccauguuggccaggcuggucucaaacuccugaccuuaagugauccacuuaccucggccucccaaagugcugggaugacaggcgugagcccccaugcccggccuugcuuuugaauuucuaucuagaaguggaaucugagggauaauuagguucaauuacguugguauguugagcccagaaucccauggggcaugaugaaaugcccaaggcacauguuaaggaagaguugaauaaaggacgcuaaagaauuccacuggcuagccaggcacaguggcuuacgccugcaaucccagcacuuugggaggccaaggcaggcagaucaccugaggucaggaguucaagaccaaccuggccaacauggugaaaccccaucuucuacuaaaaauacaaaaaaaaauuagccaggcauaguggcucaugccuguaaucccagcuacucaggaggcugaggcaggagaaucacuugaacucgggaggcagagguugcagugagcugagauugcgccacugcacuccagccuggguaucucaaaaaaaaaugaaaaaagaauuucacuggcugggcacagcggcucauaccuguaaucccagcacuuuggaaggccaagacaggaggaucacuuuagcccaggagcucaagaccaaccugggcaacucagcgagacaccaucucuauuuuuuuuuaauuauauuuuuaaaaaagaauuucacuuauagcguuaagaaaauuuaagggcugggcacuaugucuuaugcuuuuaaucccagcacuuugggaggcugaggcaugaggauugcuugagcccaggacuuagagaccagccugggcaacauagcaauaccccagcccuacaaaaaaauuaaaaaucagcugggugugguggugcaugccuguaaccccagcuacucagaaggcugaggcaggaggaucacuuaagccuuggagguugaggcugcagugagcugugauugcgccacugcauucccgcgugggagacagagugagacccugucucaaaacaaaaccaacaaaaaaaggaaauucuaaaaauuaguaaaggccugcugggcgugguggcucacuccuauaaucccagcacuuugggaggccgaggcgggcggaucacaaggucaggagaucgagaccauccuggcuaacacagugaaaccccgucucuacugaaaauacaaaaaauuagcugggcaugguggcgggugccuguaaucccagcuacuguggaggcugaggcaggagaauggcaugaacccgggaggcagagcuugcagugagccgagaucgcgccaccgcacuccagccugggugacagagcaagacucugucucaaaaaaaaaaaaaaaucaguaaagguuauacguuauguguauauguguuuaaggauaucccuguaaaugugaagagccgguguucugagauuauuuagguugaaauaaaggaguacaguauuugcugcuuuacuuuguuauccuaacuuuauugucuacauauauauccauauuguuauuugaguacuuuuaaaaauauguauccaaaagcuuuuuuaaaauuguacccccaaauuuucuuuauuuuuuuauuauauacauuucuauaauuacuuauaguuguuaaaauuagcugugagauuuagggucugucuaauuuuguuuaauuacauguaaaaauuuucacagcauaaagacauauucucauaggaauguguaaaauaacauauuguuuuguuaucauuugguucuaggaagaucuuccuguuacagaggauaacuuugugaaacuucaaguuaaagcuugugcucugagccagauaaauacaaagguauugguucuuuuauuauggcacaaaguaaaaugagaguuucuuaguguauuuaguguauaaauauaacgauaacugaccucucaaugugaagaauuuauuaccaucuucauuuuuguuaauuuuuuuauuugagacggaguuucacucuuguugcccaggcuggagugcaguggugcaaucucagcucacugcaaccucugccuccuggguucaagcaauucuccugucucagacuccugaguagcuaggaucacaggagcgcaccaccacacccagcuaauuuuuguauguuuuuucauaaaaauggguuuugccauguuggccaggcuggucucaaacuccugaccucaggggauccaccugccucggucucccaaagugcugggauuccaggcaugagccacugcgcccagccuaccaucuuuagaauagaacagcuaggggaaaaaauuuagugugcuuuuguauauuucuauauaagggacauuauuagucugauugaaguuacguauuuuauaugaaaauacaaauauuuuauaagaaaacagacauaauguaaauauuuuauaauauuuuauaaacuccuuuacauugcaaaaaacuaagaguuuauaauuaacaaagccuauuauuaaggaagaaauaaauaauaaaauagaaacuagaaaccuaaucaguuuauuagcuaccaauuagauauuuaacuaauauuacuaguuaugguucauauuucucuugucauuucuuuuugugucgcucucucauaaacauacaucuuuaccucacauuacccugcaguaaucuuucauuauugaccaugaaauacauagaauguuuucagugguaaauaaacugugguuaaaugugccaugauaaauugagcagguccauuuacuccguuuuuuuguuuguuuuguuuuauuuuuuaggauuaaugccauaguuuacaugacccguaacuuauuggauuauaaugugacuauaauuuuuaggaaccuaaaagucuucuuugauaaagucacacuuaggaaauuacagaccagguauaggcuuucacugggcaacucuguaacaugagcaugacuugagaaaugcauuagugggauccccugaagucuuuucacaagaguacuaguacuagaccuugucugcagacuucuguuuucagauguuuuuauuaaaauggaaaaauccauuaaaauccaagucuaagaaauaaucuccuugucuaacagaaauaaauaguaaauuauaguaaaaucgguugaaugaaauauugcacaucuguuaagcauaaugguuaugaaaacuguguggguaauguaagaaaaugcuuaugguaagugaaggagccaggaugcaauugcuaaaaccauaguuuuaacuccauacaaaugugcauaaaagaaauacuguggccaggcacaguggcucacaccuguaaucccagcacuuugggaggccgaggcaggcagaucaugaagucaagagaucaagaccauccuggccaacauggugaaacccuaucucuacuaaaaauacaaaaauuagcugggcaugguggcacgugccuguagucccaucuacucaggaggcugaggcaggagaaucgcuugaaccugggaggcggagguugcagugagccgagaucacaccacugcacuccagccugggcgacagagugagacuccaucugaaaaaaaaaaaaaaaauagaaaagaaacacuguaaaacacccaguacuucuauaagaaugucauaugaacaucuuaagaaaaguauuauguuccacauugaaaaagagacuucugaccaucaaguauacaauacaggagaucagaaaauugaaaaauaaauauagaagagaauuaauuucuuuuuacuuacuguuccuaaaauauugugguaucuacaaauacguucagcaucuguaguguuaagugccaggagcuuaaaccacgggcuuaaagacaguauacccuguuacuucaaaagacaaguacuuacaguuaauuuggucacaaucuaauaaaauaccaaucucuuaaaaauuuagccuuaaccaaaagaaacuccagucaccaugaaucugaaauuauauggcagauuaccuguuaauauccaucacuacuucucacccacucccuaacccaaggcuuuugagaacucaggugauuuuaaaggguauaggaauggagaacccuuuguucucauuggccacacccccuuauucaacagucuucucuccagacuacccucccuucaccugaguaagaugacugauaguguuuagccaaucaagaaauguuuuggccauaauuucccuucauacuuggcagaguaaagauguuaaacaaaggauguuaaugguaauuugaauaauaauauucauuccuaaguccugcagaacaacuaaugccucaguaaauucuugguuuccuacccuuuagagaaaccuauuuugugaaguuauuugcuuugucucaguuccaaaacuugaaccauauuugcucuuucugugauuugacuuuuacucucgcuuuccucauauauaauggaguccaggauuucuucugacaauaguauguuaacugccuuugucaugauuuagcuucuggcagaaaugaagaugaaaaaggauuuauuuccuguugggagagaaauugcuggaauuguauuagaugguaaguauacagaugugaguauauguauuuauuuucuaagguaaaagagauuaaauguagcuaauugguuuacugguacauaaaauuauauacagccuuucaaauuuaaauuuaauuauaugaacauguccuuuuuuauuuuuauuuuuauuuuuugagagacaaggucucucuguguugcccagccugaucauagcuacagccuuaacuccuggguucaagcaauccugcugccucagcuuccugaguagcuaagucuacagcaagcuuguccaaccagcaugcagcccaggacagcuuugaagucagcccaacacaaauucgugaauuuucuuaaaacauuaugugauuuuuuggccaggcgcaguggcucaugccuguaaucccagcacuuugggaggcugaggcgggcggaucacaaggucaggagaucgagaccauccuggcuaacacggugaaaccccgucacuacuaaaaauacaaaaaauuagcugggcgugguggcaugcgccuguagucucagcuacucgggaggcugaggcaggagaauggcgugaaccugggaggcagagcuugcagugagccgagauggcgccacugcacuccagccugggcgacaagugcgagacucugucucaaaaaaaaaucuauuaauuugaaaaaaaauuacaugauguuuuuuuuuuuuugguucaucagcugucauuuaguguuaguguauuguauguguugcucaagacaauucuuucucuuccaguauggcccagggaagccaaaagauuggacaccccggccgggcgcgguggcucacgccuguaaucccagcacuuugggaggccgaggcgggcggaucacgaggucaggagaucgagaccauccuggcuaacacggugaaacccugucucuacuaaaaauacaaaaaauuagccgggcgagguggcgggcgccuguagucccagcuacucgggaggcugaggcaggagaauggcgugaaccccagggggcggagcugcagugagccgagauugcgccacugcacuccagccugggcgacagcgagacuccgucucaaaaaaaaaaaaaaaaaaaaaaagauuggacaccccuggucuacggguacacgacauuaugccuggcuuugucuagcuucuuugguuuuuguuuuguuuuguuuuguuuuuguuuuuuuucagagucucacucugucucccaggcuggagugcaguggcgugaugucugcuccacugcaaccucugccucccagauucaagcaacucugccucagccuuccaaguagcuggggcuacaggcgcucaucaccaugccuggcaaauuuuuguauuuuuugguagagacgggguuucaccauguuggccaggcuggucucgaacuccugaccucaagugaucugcccacaucggccucccaaagugcugggauuacaggcaugagccaccaucccuggccccuuuuuuuuuuuaauugaaaagaaaaauaggacucaauugguauuuuauaagugaagagcuuauuacagugguaaauauuuagggguuauauauuuaaauccacaaguaaucauauauugaauagaaugaccaauauugucuuuuuaugaugaaauaaugaucuuuacauacagaacaguaagccuuauaucaggcauuugauauaauuuguuucuaaauagaccuauacuuaauauucacuaacaggugguucaugauuaacguguuugcuuuuaccuccuaugcgaaugaauaaauguguuaagguauguuagaguauauuugaguuuuaccugggauuuuaacguagaauagauuugauacucuauguaaucuucugacauagcuaaaugauaauuauguuucuuuuuucucagacuguagaaaaauaaauacaauaacuagaugaucauucauuuuacauuuaaugagcaauugcuaacugcuuaggauauaagugaaacgaacuccuugcccuuaaacgguucacucucuaggggagagacaaauauacacaugagcagauuauuauguaagcuuggaagaaaguugcuuaaccuggccagaagaaacaggaaaggcgucuuggaguaagauguccaaaucauaaggggcaagcauguugagaaucacaccuagcagggaggauauuaugagcaaagacaagcaagugaaagugggauguguauaagaauuacaaagaguuugguauugcuagagcaagauaaaguccugggcaggcgucaaggguaugguacuugguagcagagaaacauuuugucaagaaaauucuccuccuaggcugggcuugguggauuacaccuguaaucccagcacuuugggaagcagaggugagaggauggcuugagcacaggaguuugagccaacagagcaagacccugucucaaaagaaaaaaaagaaaaagaaaaaaaaauuauccuucgaauauugcagaauaaaagauauuguacaaaauacuuucaugauuaugugaacacuaauuccugccuuccuaaaaugaagcaggaggauaggcaagggccagaccuuugguugagccuuagauaucagauuguauuuuagggagauuauuagaguaggcauuugaaggaaggguggauguaaggcaaacgagucuaaaggcaagaggacugguuggguuguagaccaagaggcaagaaacagcaaaguccauaaccucaacagugguggcagagguggagaagagggauggauucaagacauauugaggaaauaaagucugcaggaccuaguaacugggaaauuaaaaacagaucagaaccaggaauggcuuacagaguucuuguucaggcuugaauuggaaccaacauuugauaaaggaagaugauccaauuuggaggaauauuaugaguuuagauuuauacuuacugaguucaaggaacuuaagugacaucucacuggcaauaucuaguaagcaauuaaaugaguuaaagcucaagggugagagaucuaugcuggaaaguacauauuugagaaaugucagcauguagguuguauuugaaauaauagaauugaugaguucuccaagggauagaguagaaaaggaggagagauguaaacaaagaacccuuuggaaugcacuguuugagggucaauuaaaagaagaggaguaugaaagaaaccaagaaaaaaagagucagagugaccuuaggaggacagggaucagcaguagaagggaaagauaaaaguauagugaaucagaagccaaaaggauugggggaugauggcacaggagggagccaaagaagaagcaaacuccaaaagaaagacuugaaaguagaaauaccaggcuucgaauuacuugcuaguggcaacaaaugcacucuggggccauuuuguugacagagccagucaaaggggccauuuccagauucagguuuccagcuuacuucaccgcuucaugucagcuuccuugucuguuaaauagaaauaauaauaccuaccuuauugguacauugugaaguuuaaaugcauaaacacacaacaaugcugggcacaaggaggcauucaacaauauuuggaguuuuuuccuccccuuuccucuuguaacucauugaaugaaacuacucaaaugaauugacugauagucgaggcuuuuucucuacauaugcagagaaaauguaacuauaucauuucuuuuuuuuuuuuuuuuuuuugagacggagucucgcucugucacccaggcuggagugcaguggcgcagucuuggcucacugcaagcuccgccucccagguucacgcuauccucccgccucagccucccaaguagcugggacuauaggcacccaccaccacgcccggcuaauuuuuuguauuuuuaguagagaugggguuucaccguguuagccgggauggucuugaucuccugaccucgugauccacccgccucggccucccaaagugcugggauuacaggcgugagccaccgcgcccggccaucauuucuauaaaguuccagaaaacuucuugguaccaaccugaauuuauuucccaaaucaaaguaauuuuaacgucacucuucuuaagggaggagaccaccccucaucuuaugcccaauuucuacuuccaaagaaagaggaaguaaaaacuaaaaggcagaaaugaaauccacaggcagacagcccagcgccacgcccugggccugguuaaagaucgaccccuguccuaaccgguuguguuaucuguagauuccagacauuguauggaaaagcauugugaaaaucccuguccuguucuguuccguucugauuaccagugcaugcagcccccgaucacguacccccuacuugcucaaucgaucacgacccucucacacggacccccuuagaguuguaagcccuuaaaagggacaggaauugcucacuuggggagcucaguuuuuggagacgugagucuugccgaagcucccggccaaauaaagcccuuccuucuuuaacucagugucugaagaguuuugucugcggcuuguccugcugcauucucagaauucccuguuguaugagauucugcaacaaaaauaaagacagauugggcuagccacaggaggaguagaaaacaauauaauuaucauagaagcuauagaauagauuaguuucuuuacuccuucuuccuuaaagucagcuaaauagaggccagucacagugguuuacaccuguaauccuagcacuucgggaggccaaagcggguggaucaguugaggucaggaguucaagaccagccuggccaagguggugaaacccugucucuacuaaaaauacaaaauuagccaggcaugauggugcaugccauuagucccagccacucgggaggcuggggcacaagaaucacuugaaccugggagguggagguugcagugagccaagaucgugccacaaacuccagccugguugacaagagcagaacuccaucucaaaaaaaaaaugaauaaagucaacuaaauaggcaaagagagagauacuucuccuggucacaauaaucgcauggcccaaauaucuagagaauccagauuugaagugcuguauauccuguagucuuuacagaccaucaaaauguuauugacauuuugguccuuuuuuccacauuaaacaaaaucagucuuuuuacaaauccacagauuuuaaaaauguauuuuaauagauaagaauuauauuuaauaaacuuguaauauuaacuauuaauuuucuucacucuuuaguuggaagcaagguaucauucuuucaaccagaugaugaaguaguugguaaguuauaguucauagucuuauuucaagucaucuauuuuaccgucaucucuguuuuuucuauauaacuauuaauguucacugugaccuugcuucauauagaaguacuuucccggcugggugcuguggcucacgucuguaaucccagcacguugggaggccaaggugggcgaaucaccugaggucgggaguucgagaccagccugaccaacauggagaaaccucgucucuacuaaaaauacaaaauuagccaggcaugguggcacaugccuguaaucccagcuacucaggaggcugaggcaggaaaauugcuuaaacccaggaggcagagguuguggugagccgagaucacaccauugcacuccagccugggcaagaagaaugaaacuccaucucaaaaaaauaaagaaagaaagaaaugcuuuccugguuuuuggaauuuacugucaaauuucuauugaugauaaaaauugggaccuugauugcaauagcagaacauuuaaaacucacaagaacaaaaaaccaaacaccgcauauucucacucauaggugggaauugaacaaugagaucagauggacacaggaaggggaauaucacacucuggggacuguggugggguugggggggggagggauagcauugggagauauaccuaaugcuagaugacgaguuagugggugcagcgcaccagcauggcauauguauacauauguaacuaaccugcacaaugugcacauguacccuaaaacuuaaaguauaauaaaaaauauauauauuuagcuguagaacaguuuuauagauaaaaagauaaucauaguugcuauagugcuugguguagccuuuuucuggcagaugcuuagucuguggccagacugaagucuuuagggagaaggaaaguuacaagucacaugcuugaaggcugcugacugacugggccauauagaagcuccaugcaccguuucaacugaaaucauacagagcuuuucucuuacaacucuuguaaaacuaaaaauugacuuaaaacuuuuauuguuuuuuaaaauccacaguauuuuugcaauuuugcaaccuguguccuagacagucacacaaacauaggcuaugacuuuuauaguugcaaccugcauccuagacagucacacaaacauaggcuaugacuuuuauaguaauccuugaaauuuucauuucucuguggaagacauaaaguuagaaaacauuuauauaacuuguauuauauagggccauauaauauauauuaugugguggcucacaccuguaauccuagcacucugugaggccaagacaggaagaucacuugagcccaguaguucaagaccagccugggcaacauugcaaaagcucgacucuacauaaaaaauacaaaaauuagccaggcgugguggcacacaccuguggucccagcuacucaggaggcugaggugggagaucgccugagccuggaaguuugaggaugcagugagccaugaucacaccacuguacuccagccuggugacagagggagaccuuguccaaaaaaaaaaaaaaaaaagagagaaagaaaagaaagaaaaaauauuuagccuuauagcguuaaaauuauagcaugcuugaaauucuuaaaggauagauuuguaagaaaguuuucaucagcuuuuuauaguauugccuuugacucaggcauuauccuggagaauugauuauuucuuucuugucuuuuuauucugcucaggaaaucaguggcacucuguauuauucaagauucuuuuugugagaaaccaaaaacaaaaucagacuagcuuagaagaaaaaugggauuuuauuagaaacauacucuggcuggguguaguggcucacaccuguaaucccagcacuuugagaggcugagguggguggaucacaagaucaggaguucgagaccagccuggccaauguggugaaacugugucucuacuaauaauacaaagauuagcugggcgugguggugcacgccuguaaucccagcuacucgggaggcugaggcaggagaaucgcuugaacccaggaggcggagguugcagugggcugagaucgcgccauugcacuccagccuaggcaacagagcgagacucugucucaaaaaaaaagaauugaaacauacugagguaugucauggaaccaaacuauaggaagguagcuaugcaucaaggacaauuuuguuuauuuguuucuuaguuugagacagaaucuugcucuugucacccaggcuggagugcagugguguaaucauggcucauugcagcccugaacuccuggacucaagcaguccuccugccucagccuccucaauagcuagaacuacaggugcauaccaugauauccaacuaaucuuuaaauuuuucuucuguagagaugaggucucacuauguugaccaggcuggcuuugaacuccuggccucaagcaauccuccugccuuggccucccaaaguguuggauuacaagugugaaccaccaugcccaacccaucagggacaauuuuuuuuuuuuuuuuuuuugacacagagucucgcacugucggccgggcuggaaugcagugguguaaucucagcucacuacaaccuccaccucccagguucaagcgauucuccugccucagccuccugaguagcugggauuacaggcgccugccacuaugcccagcuaauuuuuuauauuuuuaguagagacaggguuucuccauguuggccaggcuggucucaaacuccugaccucaugauucaccugccucggccucccaaagugcugggauuacaggcgugagccaccacgcccagcccaucagggagaguuuuaacaaggaguccagaugcucccaagacucugacuuuguucuauaacaucagccaucaucuuacugucacucagaggggaaagaagaaagcgauagcaggaguggcacagugcacuucccaucccauuucugaauuuuuucuuguccacacuaguaauuacuggaaccuuccucaaaauuucacugaacaaaauuuguaauaauacuggccucucauuaggaaugaauuuuugacuuacaucccuuuaauuucuuguuuugauuuuuaggaauuuugccccuggacucugaagacccuggacuuugugaaguuguuagaguacaugagcauuacuuggguauguagcaauucaguacuuuggagcucacauaagucuuacuucacugacauaugguuuaauaacauuuuaauuuuuuugaaucuaccauaaguguuguacuuaauaaaguaucauuagccagucauguauguaaaaaauguuggcuggucaugugaauacuucuagcuuauaauuaguauucauaaaauucauauucagacuaaacaauauauagaccuuuaaguuuuacuaacacugcucaugguaagaucuuugaaaagugauuucucucuuggcucuuaaauuauauaccuaaucagaauuaaaaauuuuuuuuuacucuugguuauugacugaaacaaaaaacauauaaaauuuagacaguacauggagaguuugagacgggaaagaaucaagaacacucaucucaagcuaggugugguggcucacaccuguaaucccagcacuuugggaggccaaggugggcaggucaccugaggccaggaguuugggaccagccaggccaacauagcaaaaccuggucucuacugaaaagacaaaaaaauuagcuggguguggugacacgcaccuauaauuccagcuacucaggaggaugaggcaugagaauugcuugaacucuggagauggagcugagauugcaccacugcacuacagccugggugacagagcgagacucugucucaaaaaagaaaaaaaaagagcacuuaucuuugguuucuaauaucuuuugacuaguguugaguuuaacugaaauauucguuuuuaauuuuucuuaugguaauuuauuuuuugaauauuuaaaguacauguacacacacacacacuucaugaaaccauauuaaacaguugcuucaucuccuaaguaaucaggggaaagcaauuaaaaccacuuagagauaacauuaugcauccaccagacugacaaaaguuaaaaagucugaccaucagccaggcgcagcggcucacgccugugauccuagcacuuugggacgcugaggcgagcagaucauuugaggucaggaguuugagaccagccuggccaacauggugaaacucugucucuacuaaaaauacaaaaaaucuuagcugggcuguuggcgcacgccuguaaucccagcuacucgggaggcugaggcaggagaaucacuugaacccgggagguggagguuacagggagccgagauggcaccacugcacuccagccugggugacaagagugagacuucaucucaaaaaaaaaaaaaaaaugaccaucccaaagugugggaaggauguggaaugauggaaccuuucaugugcuggaguguaaguugguacaaauauguuagaaaacaauuuagcuuuaucuaauuaaugauguauauauaccagaccuaguaauuccacucauguagccuauggaaauuugaugugcacuaggaggcauacugcauaagaguugauagcagcuuauuuguaauagugaaagaaacuggaaacagcccaaauguccaucaccaagcaaauagauaauugaaaauauucauagaaugaauuucuauugagcagugaaaaugaguaagagcuaaacauaucaaaguggaugacucucacaaacagcauugagugaaaaaagcaaguuacagaagaauacaaacagucccaugccauuuauuuauauacaguucaaaaauguacaaaauuaagcauauguuauuuaaggauauagagaaaagguagaggauggaaaguuggguggaaguuaccugugugagcaggggaggaagauguggucaguggauacaccaggacuccagugguacagccagcauauauuucuuaugcuggaauucauuauguucuucauaccauauccauaguagcaaauaccuucucuuauguucuugaacuauugaauuaaaccuuuuccuaaguucuuuucuuaaauaaugugaucucuaaucagaccuuuuggggacagaggcuaauuuggauuugggucuuccaaaaauaguaaucuuacucaguuaaguccuuacaguaacuugagcuaggcuaccaaaucuuuggcauuucauuucuaaaauuauaaauuuaaaguaauuuuuauuuaaauuaaugucauucauuauaucuaaaauuuccaauaauacuuuauuauuuuauuaaaaauuaauuuccaaaagacacuuuuucagagaucugagggcugcacuuauuggaacguacaugaagccuagugaggagccaagugugugucuuccuuugaaagauaaagaccucuuucaaauaccacgcagugagagucucuaauccagagcuaucuugaaauugugcaguuugaaauuugaggacugccacgggcuccuuuacaggaaacuauccuauuuuuggccccagaguuuccuugaaugguuggccuuauugcccuguucuuucgaguacguugugaauauggagucuuuucauuaaguaaccaaaacuaaauugcuauagaagauaaauuauuaaaaacaacaacaauuggcugggcgcgguggcucaugccuguaaucccagcacuuugggaggccgagauggguggaucgccugaggucaggaguccgagaccagccuggccaacauggugaaacccgucucuacuaaaaauauaaaaacuagccgggcauggucgugggcgccuguaaucccagcuacucgggaggcugaggcaggagaaucgcuugaacucaggagacggagguugcagugagccaacagugccacuguacuccagccucggugacagaguaagacucugucucaaaaaaaaaaaaaaaaaaaaaaaacaaccaaacaaggcccauuccuuuaggcacugaugaacacuggagaauuaugacauggaccagaaggagaaaagcaaauuagagcauccauuuucuagcuauaaaguuuaagcuaagaccggcaaaccacacaaauggccuuuuucuucuaccuuauuuauaaaucaggaggauggauuaaaguccagaaauccauuaaaguauauagagaaaacaauugcagauauuccuugaggaagaaaacacagcaaaauguuucuuuaaaagaaguacgacaggcgugguggcucaugccuguaaucccagcacuuugggaggccaaggcagguggaaccccucaaaaguuugagaccagccuggccaacaugacaaaaccccgucucuacuaaaaauauaaaaaauuagccagcugugguggcacaugccuguaguccgagcuacucaagaggaugaggcacgagacucgcuugaacccaggagacagaggugagccaaaauugugccacuguacuccagccugggcaacagagcaagacucugucucaaaaaaauaaaauagcauaaaauaaguacuuuaaggcugggugugguggcucaugccuauaaucccaacauuuugggaggcugagguaggaggauugcuugagcccaggaguucaagaccagccuuggcaacuugcuugucucuaccagcaaauaaaauuuuguaaaaaaaaaaaaaaaaggcuaggcaugguggcucacgccuguaaucccagcacuuugggaggccgaggcgggcggaucacaaggucaggagaucgagaccauccuggcuaacacagugaaacccccucucuacuaaaaaauacaaaaaaauuagccgggcgugguggcaggugccuguagucccagcuacucaggaggcugaggcaggagaauggcgugaaccugggagguggagcuugcagugagccgagaucgcgccacugcacuccagccugggcaacagagcgauagagcgagacucugucugaaaagaaaagaaaagagaagagaaggaaagaaagacuuuaagaaugggcaacauagcaagaucaucucaacaaaaaguuuguuuaaaaaaaaaaaguacuaggccaagcacaguagcucacaccaauaaucccagcacuuugggaggccaaggcagagccaauugcuugagcucaggaguccgagacuagccuggauaacauggugaaaccccaucucuacaagaaauaaaaaaaauaaauaaauaauaacuagauaugguggugugugccuauagucccagcugcuugggaggcugagaaggaagaaucgcuugaaccuaggagguugaggcuacuguuagcuguauuugcgccacugcacucuagccugucucagaaaaaaaguaguacuuuaagaaggagcucuuacacagcaaaggaaacaacagugugcagagacagccuacagacugggggaaaauguugauaagccguacaucugauaagggguuaauauagugauauagaaggagcucagaaaacagcaagaagaaaaaaacaauuagaaaagggucaaaggaccugaauagacauuucucaaaagaagacaugugaaaaaauacucgacaucaguaaucauuagggaaaugcaaauuaaaaccacaaagaaauaccaucucauaccugucagaauagcuguuaccaaaaagaugaaagguaaguauuggcgagaauguggagaaaagggaaacuuuguacgcuauuggugagaauguaaacuaguacagucauuauggaaaguguaugaauguuccucaaaaaucaaaacauagaauuaccauaugauucaguaauccuccuucuggauauuuucccggaagcuuugaaaucagaugucuugcacucccauauucauugcagcacuauucacaacagccaaguuguggacucaaccuaaguguccagaugaaugaauaauaugauauagauauacacaauggaauacuguucagccuuuaaaaagcaggaaauugugucauuugugacaacacagauggaaauggagagcacuaugcugagugaaauaagccaggcacagaaaggcagauacagcauguucucacuucuauguggaaucuaaaacaaacucauagaggcagagaguagaaugguggcuacagaggcugcgggcuggggagaauggaguguugauggacaaaggguauaaaaucucagcuaaacaggagggauauguuuuuauuuauuuguuuauucaugagauggaguuuugcucuuauugcccaggcuggagugcaauggcgugaucucggcucacugcaaccuccgccucccagguucaagcaauucuccugccucagccucccgaguagcugggauuacaggugccagccgccacaccuggcuacuuuuuguauuuuuaguagagacgggguuucuccaugcuggccaggcccgucucgaacuccugaccucaggugaccugcccaccucggccucccaaagugcugggauuauaggcgugagccaccgcgcccagccaagggauauguuuuuauuuucaguucuuugcacagcauggugaguauaguuaauaauagaguauuguacauuucaaaauugcugagaguaaauuucaaauguuuucaucauaaaauauguuaaguauuugagaugauggcuauguuaacuugcuugauuuaauuauuccacauuguauucguaaaucauagcaucauuuugugccccauaaauuuauacaauuauaacuugucaauuuacaauguuuaaaaaaaaaagaaugaugacuaacagugugaccuuuaggcuagauccuaggcaugcugacugcaucuauaaaugaggacacucaacugaauaaccuguaaucucuguuguagcuccaaccuuuuguaaaagggaauaauuucaguuucccggcaaguuuguaggggaaaacuuucaguucaccacaacucuauuuuaguuucuauuacuuuccuggugauuuuuuuuguauauaauuuguuuuuauuuuuaauuugucuuugguguuuuguuuuuuguuugcuuguuuauuuuugagacagggucuuacucuguagcccaggcugcagugaaguggaauuaucacaauucacugcagccucaaacuccuggguucaagagauccucccaccucagccucccaaguagcugggacaauaggcaugcaccaccaugucuggcuaacuuuuuuuuguagaaacugucuugccauguugcccaggcuggucucuaacuccugagcucaagugaucuucccgccuuggccucccaaagugcuggcauuacagguaugagccacuaugccagccuucaugauuguuuaaugagugcucagugcucagucacuuucaacucaaauaagucuguucuuuaccaaaccaaagagcuauguuucaaacauucccccaaaaugugguguuaguccuauuucucaaacuugauaauagaguuaaagaguagaguaauucuuccaacucuuuuguacuuuucaguucuuaagcaauucugucaagccuaaaacuaauuuuauuuuucauucaaaauuuucagcauuguuguuuuuauuccuuuggagcuaaacuagaaagagaucaaauuauaauucuuagaugcugaaauauggcucgcauuuauuuguuuaauuguuuuuugagauggaguugcacucuuguugcccaggcuggagugcaaugaauggugugaucucagcucacugcaaccucugccuccuggguucaagugauucuccugccucagccucccaaguagcugggauuacaggcaugcgccaccacgccugacuaauuuuuuguauuuuuaguagagaugggguuucuccauguuggucaggcuggucuugaacuccugaccucaggugcucugccugucucggccucccauagugcugggauuacaggugugagccacugcaccuggccuuauuuguuuaguuuuuauaacauaauaaacaccuguggacccccaacacaaaagcaaguguguugacauuaacccacaucuaaccaugcaauuuuuuuuuugagacaaagucuugcccugucaccuagucuggagugcaauggcgcgaucucagcucaccgcaaccuccaucuccuggguucaagcgauucuccugccucagccucccaaguagcuggaauuacaggugccugccaccaugccuggcuaauuuuuguauuuuuaguagagacgggguuucaccauguuggccaggcuagucucaaacuccugaccucaggugaucugccuaccuuggccucccaaagugcugggauuacaggugugagccaccuugccuggccgcaguuagcauuucuuuaaggacaacaugauugaguuuuuaauaaaaauaugguagucccaauccuuuugauagaagauguucccaauaaguaaauuauacguugauugagcgugcacuguugaaauagaugugcuuuaaagucauauauucaccuuaugagcuauguggcauuagacaaauuaaucaauuacccugaacccuauuucaucauccguaaaauugggagaauagcuaucuuaaagaguuaccuaaggaauaaaguacugugugugcuaucaccuggugcuuaauauguuuuuacuguuuuaauucucagcucuugucugagcauuucaacaugcauguuugaaugcuccacuucgcccacuagauggcacuaguuuguugcuaaaugcagugcugacuacucuggcuaguccacaugaaucauugcuacuagaggaagcauuucaaagagcugguaaagacugugaaaguguuauaaaguugaucuuagguaaaaugagaaagaauuucuuggccaggcgugguggcuuacaccuguaaucccggcacuuugggaggccaagguaggcagaucaccugaggucaggaguucgagaccagccuggccaacauggugaaaccccgucucuacuaaaaaaauacaaaaauuagccaggccugguggugugcaccuguaaucccagcuacuugggaggcugaggcaggagaauugcuugaacccaggagggggagggugcagugagccaagaucacaccacugcacuccagccuggcgacagagugagacuccaucucaaaaaaaaaagaauucuuguacugcggaaaaauuacaucaguguacaacauaaauacaaaacaaaaauuaaauagugaaacauguuaaggaauaguuucacggucagaucaugcggaacuuuuuaaacuauauuaggaguugcauuugguuccaaguacaguguaaagccauugauaaauuuuaagcagggaauuguuaggaugucaguuaucuuuuuaaaauaucauucugaugauucuguuuuuuaaagauacuguuaaagagauugaaaacagaaggcacaaaguugaaaauaauauuuacagcacaugaacaaaugacuucucuagaauauauaaagaauuccuguaaagcucuaaauaagaaaaagacaaaacaauagaaaaauugauuaacacuugaaaaaggaauucacaaaaggaauuccagauggccagugaacauggaaagaugcucaaccucuuuuaguagucagagaaagcaaauuaaaaucauaguaagaaacuauuaccuaccuacauaauugguaaaaauauauaaaugugaucauuccacaaguugacaaggacauucacagcaacaggacacuacugugggaaaguaaauugaugcaauuacuuuggaaagguguaguuaaggaacagauaauauaccugggaccuaggauuuccacuccaauuuaaguauccuaggaaaacccaugcacgguguaacaauauuuuucauauacgaacacacuuagcagcauuguuuguaacugacaaaaauuggagacaacacaaauguucaucagcuaaacaauggguaagcaaaugaagguguuuuuaauauauuggaaugccauaaaacaacaagaaugaaagugcucuaacagccucauccacagaauggaugccuuaaaaacauaauauggaacauaaaaagcaagguagaaaagaaugcauaugguaugauuccauucagauaaaguuuaaagccuuggcaauaugaaauuuuuuuuuuuuuuuuuuugagacggagucuugcucugucacccaggcuggagugcaguggugcaaucuuagcucacugcaaccuccaccucccggguucacaccauucuccugccucagccucuccaguaguugggaccaaaggcgccugccaccacgccuggcuacuuuuuuuuuuuuuuuuuuuuuuuugagacggagucucgcugugucacccaggcuggagugcauuggcaugagcucugcucgcuacaagcucugccucccggguucacaccauucucuugccucagccucuccgaguagcugggaauacaggcgcccgccaccacgccuggcuaauuuuuuguauuuucaguagagacgggguuucaccguggucucgaucuccugagcucgugauccgcccgccucggccucccaaagugcuaggauuacaagcgugagccaccacgcccggccagagacgggguuucaccgugucagucaggauggucucgaucuccugaccucgugaucugccugccucggccucccaaagugcugggauuacaggcgugagccaccacgccaggccaggaaauuguauuguuuaggaaugcguacuaaugagugauacaaauaagaaauugcaugagaaugguggugaccuuuggugaggagagaagaggcugcuggggugaugguugugcucucucuccaccaggaugguauaccguuaacuuugcauauuuccuuuauauuuauucauccagcuauauuuuauauuuuacauacuuuuucugcacauuuuauuucacaauauaaaaaguuuuaaaaauacacacacacugacuccuauauggagaauuauucaugggcaaauaauggaaaguauuguaggugagagagaaugggaguaggggcuuggaccagggccauaguaguacuagagauggagagaaauagauccaggagguaggacuugugggacuugcuaacagauuguuucuucuuguucuuuaugauaguucauaaaccagaaaaggucacauggacggaagcagcaggaagcauucgggauggagugcgugccuauacagcucugcauuaucuuucucaucucucuccuggaaaaucagugcugauaauggauggagcaaguguaggugcuaaugguuuuguuaagaaacagacaagcauacaguaaacuuaggaaauuuagcaaugagccauccauuugcuaauauaauucuuugccaauagcuuauugauugacuuuuuuuccaguguccuauuuuguuauaauaagcagcuuuuaucaauagaagaucaaaguuagauuuagugugauuaguuuaugacuuugaaucugcugguacauuaaaaagacaagccauuuuuauucauuccuguuagacaaagccuaagaugccacaugagccuuugaagucauaguccagaauucccuaauagcuuuguagccuauuucccacccucacacuuacguugaucaaguauuggcauuuuauguauagauggaucacacaaaagaucaacacguccuaauuuaaacauauuacauauaucaaaaaauaguucaagacacuaaaagaauacauaaaauauugucaucuaaaaauguuaagaaaaucuugaaauuaacuuauaguuuuauuuucuaacuggcuugugaugaaaugcuuucuuccugcuuuucuuugaagaaaaggcaaagcugucuucagcacuggcuucagccugauauccaacaucaggauaguaguguuuccccaaacuuacccuauaggucugaacaggauggagcuuuugaaguguuuugaucuucaaagagagauagcuggacucccauauauaguauauaauuagcuuagaccaucgcauugacaaggcccaguuuucucuuugcaaggccaugugucugaauguggcccuccauccuugaaauuaugugcuguggucagacugagugacagcgugugacaugcagcuuuuccaccaccccuuguaaagaagaaagucaaucaaauauuuccccuauuaaacuugcccauaacuuugcucuuuuccuauuagauaacauuuuaaaauauacuaaaguaacacuaaagaauuauacuuuauuaaauaauauaaagaaaucaauucgauauggccucuguucuauaaccauacacccacuguauauuuuuuucuacacaggcauuugguacaauagcuauucaguuagcacaucauagaggagccaaagugauuucaacagcaugcagccuugaagauaagcagugccuugaaagauucagaccucccauagguggguaauauuaugagcacagacuuuaaaacaggaaauuuugaaggaaaaucaccuuuaaaaauguacuuguaaaaccaaguacaaaaucccuggccaggugcaguggcucacaacuguaaccucagcaccuugggaagccaggaugggaggauugcuugagcccaggaguuugagaccagccugagcaacauagaagaccucaucuauauauaaucuuaaaaaaaaaaaaaaagaauuuauaaaaucccaaaugaaagucaguuucaaaaugcaguguaugugcuaucucccaauuugcuuuuuuuuuuuuuuuugaaacagggucucacugugucacccagcuggaguacaauggcacaaucguggcucacugcaguauggaccuccccagggucaggugauccucccaccucagccaccugaguagcugggacuacaggcauaugccaucacgcccagcuaauuuuuuguauuuuuuguagagacggguuuagccauguugccuaggcugguaucaaacuucugagcucaagcaaugcacccaccuuggccucccaaagugcuggaauuacaggcaugagccaccauguccagccccaguuuacuuaagugauaguuuuaauuuuaauuauuuuuuuuuaaacuuacauuuuucaauguuuuuuccuguuugccccauuguuuucaacaauuuacuuaauuuugaauuaggugaacuuugaugcaguuuagaaacaccugaugcaggcuggguguggaagaacuagagacaagccucagagaacuagcuucuccaaggauauacaccuaguaaaggacuggaaugagauuugaacccaggccugucugacaguaaagcucacauuauuuccacuguuacauuaugcuugugacagagauaaccaagaaauagaaggaaggcaauacaggggcuggagaaaggaggagaaaaggaaaaagaagagaucugaaaauagaauggagaaagagcacaggcugggcgugguggcucacaucugcaaucccagcacuuugggaggccgaggcggguggaucacuugaggugaggaguucaagaccagccuggccaacgugaugaaaccccaucucuauuaaaaauacaaaaauuagcugggcgugguggcagacgccuguaaucccagcuacucaggaggcuaaggcaggagaauugcuagaaccugggagguggagguugcagugagccgagaucgugucagugcacuccagccugggcaacagagcgacaguccgcccccaaaaaaaaaaaaaaaaaaaacuuuauggaccgggcacaguggcucauaccuauaaucccagcacuuugggaggccaaggcgggcagaucaugagguccagagauggagaccauacuggcuaacauggugaaaccugucucuauuaaaaauacaaaaaaaaaauuagcuggcaugguggcgggcaccuguagucccagcuacucgggaggcugaggcaggagaauggcgugaaccugggaggcagagcuugcagugagccgagaucgcgccacugcacuccagacugggugacagagcgagacuccaucucaaaaaaaaaaaaaagcaugaaugguauuaaaaaaaagaacaugaacgaagggaaaauuucuuauuuguuaauuugccuuuccuagauugcuuugucccccuuucccuuuuguccucuuccuccuugccuccaaguccuagauuacucuguuggacuacaccacuaaucugagcagcucuaagaggaauucucuucagcuagaagguguugaaagauagagaaaggaaauacaaacauguuguuauuugccaguucaaaauucugagaauuauuuuuaauucugucaauaauuuauauucuauuaauaggauacuacuaauauccuuuaaugcagccaauuaaaaucuguuuaauuuuuacugacuugccuaaaaaucaugcuccuuuuccuuagcuuuaagauuuuucuucauuugggagaguaaguggggaagagagggagauuucuaugacugagaaagggugaaacagccucuaguagauaauuaccauauuauacaaauacagacuguccccagcugacaguguuucgauuuaggauuuuuuaaauguuacgaucgguuuauugggguauagagugcauuuuugacuuacgguggguauauugggauguagcccaucguaaagaugagcauaucaucuguauauuuuuauguuuuuuagcucuaaagacuauuaaauaugaacauacuugagaaacuacuuaaucuagcugggggugguggcucacccuauaaucccagggauuuaggaggccaaggcaggaggaucacaugaagccaagaguucaaaaauagcuuaggcaacauagcaagacccucucccuacaaaaaaaaauuaaaaaaauagccaugcgugguggcauguaccuguaguccuagcuacuugggaggcuagggcaggaggauugcuugaacccaggaguucaaggcugcacugggcugugaucacaccacugcacuccauucugggcaauggagugagaaccugucugaaaaaaaaaaagaaacugacuuaaucuuccauuucaugucguauuauauauguaccucuguguuuucagauuccuaauucuggcaacauauccuauaacuguagagaauagugcucugugucaacagaccagccuuggaucaccuucuccacaaaauguucacauuuuaguuuuauuaaauauacaagucucuucauuuagacugcuauaucccauauuggguuagaugagaaaaaguauaauuuaaauugacuuucucccuuuaaauucaguaauuguuugaauugcuuaacucauuucaagaauagauauuuauuugcuuuucuuuuucuuuuucccugauuuguuuguguugaucacauagagaacaguacaauugccugauuuccuguccuuuacagcccgagugauugauguaucuaaugggaaaguucauguugcugaaagcuguuuggaagaaacagguggccugggaguagauauuguccuagaugcuggagguagguaccuuaugaaauuaguagccuguguaguuuuuuuaguuugaugaauuuaagaaaaaaaauuuaaccagggcauaauuauuaaugcacuuauuaaaccagauguucaguuuuagguuuuguuuuuaacugaagacuuuuuaauuuaaauuggaacuuccacuuuauucucauuguaagcgcuguauguaagagagaacaugcuuaucuuuuacagcguagacuagggguguccaaucuuuuggcuucccuggccacauuggaagaagaauugucuuaggccacacauaaaauacaguaacacuaaugauaucuuaugagccaaaaaaaaaaaaaaaaacucaaaaaugucuuauaauguuuuaagaaaguuacgaauuuguguugggcagcauuuaaugccauccugggcaggcugcgaguuggacaagcuugguguagacauuagaguaacaaaugacauaucgcuacaagaaaucuagaaacauggccuccucaguggcucccagaaaacacagcaucauucucaugccuuuucagucccaucugcuguguguggcugccuucgauuggauaguugacuucugcagucucuauuuggaaaauaucaaaauuuguuccaguuucacuuuucuugaauguuuuuaguuuaaccaguauuuauuuaacacuuacucugaacacacuuaaguaauagcaugacuucuaaaggauaggcuuuacgagccugcaaagugcuucuauuuauacuuugguaggauuuaucuucuaaugugagaaucauggaugaauaugguuaugacuauagugugguuuuuuaaaccaguauuuucuaagauuugaaaauagcucaggaaaaucugucaguggaaguaaauacauacuuuauugcaucauuuuuucacauggacauuucaguaauuauguuaagacuaucuugagucuaugaguuuuuuaauugggaaucaauucaucucacuauauuaagcuaucaguguuaauugucagauuugguuauguguuacauuacuuugccugguuuucaaaugaagauagacuuuuuaucuuuauuuauuucuauaauaaguagauuuacaauaaauuacaauuaaauguugaauaaauuuuaugaucaguuuaaugcaaaaaguagauuuuaagguaucagaauacauuguguguugcuuuuucuaagaaaaauauuuccucauuuguacauuaaaaaguaaggagggcugggugcuguggcucaugccuguaaucccagcacuuugggaggccgaggcgggcggaucacgaggucaggagauugagaccauccuggcuaacacaaugaaaccccgucucuacuaaaaauacaaaaaaaaauuagccgggcaugguggcggcgcuuguagucccagcuacucaggaggcugaggcaggaggauggcgugaacccgggaggcggagcuugcagugagccuagaucgcgccacugcacuccagccugggcgacagagcgagacuccgucucaaaaaaaaaacaaaaagagagugccggcggacacaguggccugugccuguagucccaacuacucaugaggcugaggcuggaggauugcuggaguccaggccagccugggcaacauaguaagaccuugucucuaaauaaauaagaacuuguuugaagaauaaauuuuugucagauuauuauaaaauauauuucuucucucucucuuuuuuuaaaacuauucccuugcaagugagauuauauaguaaagaugaugaaccagcuguaaaacuacaacuacuaccacauaaacaugauaucaucacacuucuugguguuggaggccacuggguaacaacagaagaaaaccuucagguacuaucagaaaccauaaagcguuaccauuacaccaaagggguguaauuaacaaacaauaaugccuaaguuauuugaggcaagguaugacuaaauuaguauaaaaucugggccaggcaugguggcucacaccuaugaguccagcacuaugggaggccgcggcgggcggaucacuugaggccaggaguucaagaccagccuggccaacauggugaaaccccaucucuacaaaaaauacaaaaauuagccaggcaugguggcacaggcuuauauucccagcuccuugagagacugagggcugaggcaugagaauuacuugaaccugggaagcggagguuguagugagccgagauugcgccacuccacaccagccugggucacagagugagacucugucucaaaaaaaaaaaaagaaaaaaaucugaaaaauaaagaaauuuagcuuuuuuuuuccauuccauauuuuauaucagaaagaaauguagcuuuuuuuuucacuuuagcaacauguuggccaaaauguugaaauacugccuaguagagacauccuuucaaugacgaugaaguguaauuuuauuuagugauuuagacaugugacuuacgaauuuauuuuauuuuauuuuuuuauuuuuuuauuuuuuggaacaaaguuucgcucuuguugcccaggcuggagcacaauggcaugaucucggcucacugcaaccucugccucccagguucaagcgauucuccugccucagccuccugaguagcugggauuacaggcgcccgccaccacgcccaguuaauuuuuguauauuuaguagagacaggguuucaccauguugaccaggguggucuugaacuucugaccucaggugauccaccugccucggccucccaaagugcugggauuacaggugugagccaccacgcuggcaugaauuuuuaauaguauuucagauagcauuuuuucucggugacauuguugacauauacuuagcaaaauauuucuauauaaaauuaucacaauuuccuaauuauucaaauuggaauuacuauauauguuuauguaucucucaagguuauauuuuucagcauucuaguuacauauuuacaugauggcugauaugcaaauaccguaauucucaccuaccaaucuucacugauuuuccaacacccucaugaagauggccagaaaagacacacacacaccccuaccacuucaccaccaggauucuagauuggccuugcaucugccauguacuuaucaccucgcuguuucaucauuuuggaccaugaaauagaaaauauuaucguuuacguuauuaaaguuuaugugcauauuuuugugauuuggacaucauuuaauuuguguagaaguuuuucugacucgagauaccagucauccugcuguuaaacucacaauaauugauuagucuuuguuucauucuauccaaguuggauccuccagauagccacugccuuuuccucaagggagcaacguuagcuuuccugaaugaugaaguuuggaauuugucaaauguacaacagggaaaauaucuuuauauccuuuuuaucgacugauugaguuucuggcuugaacuuuguacuguacuaaguucuuucauuacgauaauaggaaauaauaauagcaguuaaguuuccuuaaguauuccaaacaguauuccaagugccuugcaaguauucauuuaaacauuaaaacagccuuuugagauguaaguacuguuaucauccccauuucacaggugaagaaacagaagcacagagauguugauacagacucaaggacgcagcaaguggcggagcaagaaucacacucaggcagucucucuccuuucugaacagagaugagcccuaagauaccuggaagauuuuguuuuuaaccucacauuaaggaaagcacacaucaccuugaaagguugcacacuuacuccuaugauggugccauugcacagaaacauuucagaauacuuuucuaaauuaaagaguuuguggaguguuuuauaaauaucaaugcuaggaaaucuuuaucaaaugaagauagguuugacuuuuugaaacaaaagucauucagagauaagucuggugugauugaagccaaaucauuccaguugaguaaaaauaauaaaaaguuuggaauauacaaacaauuucaaaaagaaaggugcaaaccucuuuagaguagggucaacuuaagaauuccuuuuauuucuaaaaugacuggcuuagaggcagcagcacuugguaaaaguuuuaauguauuggauaaaaaaaaaguuaucauuacuugauagagcauaugugugugucugaagaaagauuuacauagccuuacacuucucucuacugaauaucauacguuacuuuucuuaaaugugucuagucauauaugugugauauguauaaaggccaguucccuccaggagcaaugacagucuuuauucggagcuuuaagguaguuauguaggccgggcaugguggcacaugccuguaaucccagcuacucaugaggcugaggcagaagaaucgcuugaaccugggaggcagagguuucagugagccaagauugcacuacuacacuccagccuggugacagagugagacuccaucucaaaaaaaaaaaaaaaaaaaaaaaguuacguaauuaguauacugcauguguuaaguuuuaaggaguagauuucaaaaccccuucauguagugaauguaugaguuuaaaguuauuucugauuaaauauuuccuauuaaauuugaaaauuagauuuaacuuucuaaaaggauuuuuaauuaauuucauuuuuuaaaaagguacaugagcuggcacaguggcucaugccuguaaucccagcacuuugggaggccgaggugggggaucacgaggucaggaaaucgagaccauccuggcuaacaugaugaaaccccgucucuauuaaaaauaccaaaaaaaaaaaaauuaguugggugugguggcacacgccuguagucccagcuacuccagaggcugaggcaggggaauugcuugaacccaggcagugaagguugcagugagcugagaucgcgccacugcacuccagcuuagcuacagagcgagacucugucucaaaaaaaaaaaaaaaaguaaauguccaauccaauaacauuguaauuauuaagaauaacauggaaugaugcuacaguggagaauaccauguggcuauuaaaaguaacaguuaacaaaaguaacauuaguuaagguuagaauacuauguagcuauuaguuuugauuuuuuuuuuuuuuuuuuuuuuuuuuuugagacagagucucacucuugcccaggcuggagugcaguggcaugagcuuggcucacugcaaccuccaacuccuggguucaagcaauucuccugucucagccuccugaguagcugggauuacagacaugcgccaccacgccuggcuaauuuuuuguauuuuuuaguagagacggaguuucaccauguuggucaagcuggucucaaacgccuaaccucaggugauccacacgccucagccucccaaagugcugggauuacaggcaugggccaccacucccggcuguagcuauuaguuuugaaucuuacauguuggaaacuagacugcucugcuuauaguauauaacuuaauucucucaaaccaccucucccgaugagaaggcaauuuuaaccuauuugacaaauccuuggaccaaguugaaacaugacauguguauaugaaauacuguacauuuuccagaaucagaaauacaugcuuugcacacagguaagaauuuuauuaacagcaguaggaagggaacuugcagggaugugaauuaguaaauuuauauucuuuaguuuccuuuuaaaaauauuuuuaggccaggugugguggcucacgccuguaaucccagcacuuugggaggccaaggugggcggaucacgaggucaggagauugagaccauccuggcgaacauggugaaaccccuucucuacuaaaaauacaaaaaauuaaccaggcaugguggcgggcaccuguagucccagcuacucgggaggcugaggcaggagaauggcaugaacccaggaggcggagcuugcagugagccgaggucgugccacugcacuccagccugggcaacauagcgagacuccgucucaaaaaaaaagaaauguuuuaaaugacuuauauuugcuaauuugcauuuucuuucuuucuuuuuuuuuuuuuuugagauagagucucgcucugucaccaaggcuagagugaaguggcgccaucucagcucacugcaaccucugccucccagguucaagcaauucuccugucucagccucccaaguagcugagacuauaggcgcaugccaccaugcccaccuaauuuuuguauuuuuaguagaggcaggauuucaccauauuggucaggcuggucucgaacucuugaccucaggugauccaccugcuacagccucccaaaaugcugggauuacaggcguuagccaccgcacccagcccuaauuugcauuuucuaaaguccugaaucauacaguaguccucacuugugcaaacccuccucauucaguucauacaagcuaaguugcugcuugugauuuaacagagacaucuccuuccaacugugucauucugggccauaaauaauucagaaguacgggcaauuacauagaaucuugaucuuaguauuauaauuucaauuaaauuagcaagauagauuuuuucuuugauuuuuacaucauuuucugauucucuuagugacauacgaucagcccccuguaucugaggguuccacauccagggauucaaccaaucaaggaucaaaaauauuuggaggcugggggcaguggcucaugccuguaaucccagcacuuugggaggcugaggcaggaggauggcuucaucucaggaguuugagaccagcccgggcaacauagggagacccugucuauacaaaaauaaaaauaaauuaaccugguguggcggugaauugcuguggucccagcuacuugggaggcugaggaucacuagagccugagagguugaggcugcagugagccaugaucaugccacugcacucuagccugggccacagagggggccccugucucaaaaaaaaaaaaaaaaagcucugaaaaaguaauaauacgacaauaaaaaaaacaaaaaaaauagcauaaccacuaucuacauaguauuuacauugcauuagguauuauaaguaauauagagaugacuuaauguauaauggagaugugccucgguuauaugcaaauacuaggccauuuuuuuuuucuuucuuuuuuuuuuucuuuugagacaggguauugcucuguugcccuggcuggagugcagugcucauuccagcucacuguaaccucaaacccaugugcucaagggauccuccugccucagccuccccaguagcuggggcaacaggcacaugccaccaugccuggcuaauuuuuaauuuuuuuguagagagccuuguuucccaagcugcugcacuauuuucuauaagggacuugaguaucuggagauuuuggucuucauggggguccuggaaccaaucccucauggaugcgugagggaugacuguauaucauacacacauaaaguuuacuggcuucugcaaacaaauuuugagcccauuaaccaaccagccuggucaacgaauguacaucuaaaguaagauauauacgugcuaaaauuguuuuuaacuaaaaaugccauauguaguguagaaaugaaaacuagacacuauuucauucgcauccauugagauaauaguggugagcacuuaggauaagcaccaggcuugacuugcugcucuugucacuuguccuuggaaauuuaggcucuauuacaccaccaacucucaaaucauuucccuguuguagagcuaaacuugacguccuacagaauuucucuaacuuaacauguugagucucugagagugcaaaacuugaaacaagagaaaguggccugccuggcauccucugcuuauugaaugguuuuauuuaauucuccuuuacauugccaccuuaacaauccuuccagcuacguaucuuaaaggaugugauggagaaguuaucaacugguguuuucagguacgcuaaaguaaccaaaucauuguucuuguuuguuuuucuauuuucagggagcuaaggcaggcagucccacuuuuguuuuagcucucgccauguaccuguugccuccauauuuuauuauuagguuggugcaaacauaauugugguuuuugccauugaaaguaauggcaaaaacugcauuuacuuuugcacugaucuuauauuucguuuaaauagcugcucuuuaauauuuaucaaaguguaucuggugguacaccaguagguacucgcagagauagaaguggcuugugaguuuuccucacuccauuauguaguguaccucacccuuugcuuuuccucaucaccccucccaaagcaacuugaaguaaccaauagcuugaaggagagaaaaccaugguauauuuguuuaaaguugaauauguuuaucaguuauaaaagagggaguaggccaggcgugguggcucacgccuguaaucccagcacuuugggaggcugaagugggugaaucaccugagaucaggaguucgagaccagccuggccaacauggcaaaacacugucucuacuaaaaaauagaaaaauucgcugagcgugguggcgaacgcccauaaucccagcuacugggaggcuggggcaggagaauugcuugaaccugggaggugaagguugcagugagccgagaucacaccauugcacuccagccugggcaacaagagaaacuccgucucagaaaaaaagagggaguaaauaaaguagauaauuuuuuuccuucaaaacuuaaccacuuuuaacauuggaaacacuaauggacgaauuuguuugaauuacuuaaaguaauagauuugaggccgggugcaguggcucaugccuguaaucccagcacuuugggaggcuaagguggguggaucacuugaggcuaggaguucaagaccagccuggccaacauggugaaacccaucucuacuaaaaauacaaaaauuagccaggcuugauggugcaugccuguaaucccagcuacucaggaggcugaaguaugagaauugcuugaacccgggagccggagguugcagugagcugagaucgugccacugcacuccagccuggaugagagagccagacucugucucaaaaaauuaauuaauacacuaauagauuugagcacuagcauuugucauauaccacccuguuuguucuacuuaucuuuaacuagaccugacauuucuaauuucauuccuucucagaccucaguuggaugaacccauuccacuguaugaggcaaaaguuuccauggaagcuguucagaaaaaucaaggaagaaaaaagcaaguuguucaauuuuaauuuucuucuuucucagaccucagucggaugaacauauuccaguauuugaagccagaauuuucuuuggaaauuguugagaaaaaccaaggaagauaaaacaaguugcauuuuuaagcacguuucucugcuaagacaagaugcucaguugacacauuugaaaaguguuugaaaaauucuugugcaaaugaucaagauaauucuauaauuaacaucuuaagggaauuuuucuaaaaaccuuuucauuguuucuauauauuuugccccugcuauaaaauuccuuccaugaagaaaacugcugcuuucagcaaaagucacacuacucuugauaaaagcuguugcaggccuuugcuaagcuaucaaaguaacguauuaauuuuguaucaacuccguucucaacaccuuccuuaagucuuugcugucauaauuuaagcauuugaguauauuuugaagucuuaaaagacuuagcccauaggcacuuaa

SEQ ID NO: 192651 - RNA, 16630 nt, Homo sapiens
guugcccggguaacgggagcagagucggcggggugcguuccuuagucuuucauucaucagcguaaaaagaacugaguuuaggucgcagguccccuccagggcaggcauuaucgugugcgcugcaguaaccucucaucuuguggaguccuacacuuagcgcauguugcuccggcgcgcugcguaaagcugaggagccugaggcccgagguccgaugcucgccuggcuggccuauggcugcgggagcggugugugucggaccguaggacggccucacggcuagaguuugaggacuaugggggcggggacggugccugugucuguggcggucaccgggcuucacgugguccucagcagggugaugguggacagcucgcgcgagggcccgggagucuuggggacacuucccggcgcggucuguggacugagcgcugggacccgcaccgaaccagccgccguucgccucuggagcuggacaugccgacuuucguuaggucaaauaaugaaccuuauacugcggaagugcgguauuaauauugccuggaguucuugucucuugcucauuucugcccucguauguuuuagaaguagauuuauuuuuuauuuuuauuuuuuuaauuuauuuuuugugacagagucucgcucugucgcccagguuggagugcaguggcgugaucucgucuagcugcagcuuccgccuccugagaucaagcgauucuccugccucagccuccccaguagcugguauuacaggugccugccaccacgcccggcugauuuuuguauuuuuaguagagacgggguuucaccauguuggccaggcuggucuugaacuccugaccucagcccgccucgggcucccaaagugcugguuuuacaggcgugagccacuguacccagccauuauuuuauuuuuauuuauguauuuauuuuuuuauuuuuuugagacggagccucgcucugucgcccaggcuggagugcaguagcgcgaucucggcucacugcaaccuccgccucccagguucaagcgauucuccugccucagccucccaaguagcugggauuacaggcgugugccaccacgccuagcuauuuuuuguauuuuuaguagauuaagcuguagucacuaggucugcaagauaaaacuguuuuagagggacugauauaaugggaauucuguuacuguagggaucaugauuuagcucacaguauaaacguuucauguacaaaagcacuugagagaaacaguuuaccaaaacauacauuuguauacuuaaagguacaaagaacagugauuaucauauaacuggaaaguaaaucaaagaaauguuuuuuauuuuagauugagcauuuccacagaaauuacaguuuuguccuuuuugaaaaaauagaacuguauuucagaaaaaagaaacuacaguuuuagcaugcagaaaggaaaagggagaacaagccggaucagaagacgaaaacucugcggaaguucugaaucaagaggagguaugguuuuucuuuuaguaccaguaaugaaaaaagaaauccuuuugugauugcuuguuuguucauacguagcuuuucuuucuuucuuucuuuuuucugagacggauucucgcucugucacccaggcuggagugcaguggugucaucuuggcucacugcaaccucugcuuccccgguucaagcgauucuccugccucagccucccaaguagcugggacuacaggcgugagccagcaugcucggccuaacacauagcuuuucucaaaggcacacaguguucaaagagaaucuuucuuuuuuuuuuuuuuuuggagacaagguacauucuguuacccagauuggaaugcaguggcgugaucauggcuugaucucccaggcucaagugaucuccucccuuagccucccuccugccucagccucccaaguaccugggacuacagguacaugccacugcacccggcuaauguuuuuuuaaauuuguuguagugacagggucuauguugcacaggcuggucuugaacuccugggcucgagugguccuccugccuuggccuccccaaagcacugggauuacaggugugagccacugugcccagcccaaagagaauauuucuuaaauaacacucuuuuuuaauggugccauuguauucuuuuagauccuggugggaaugugaagauaacuaacucauuguuucaacugucuucucuggggaugacucccaacuuucuuuuucuggucuugaccuucagcuaucuguaggauaucaauguuuggauguaaauuuaugacuucaaauucaggguaacccugucugaagaagauacuguaucuuguucaauacaaaagugcuuggccaucuggaaaguccuauguaaauccaacuggauaugguacaagauaucgauaagcucacuuuuuuuuuugcugauggagguccaguuguuugaucaucauuuauugaaaagacuaucuucuuccacugauuugccuuugcacuuugucaaaaauuuacguguggaccucuuccuauuuucuguguuguuccuuugaccuauuugugucuguuuugacaauaucacacuaauuugauuacuguagcuuuauaauaaguuuuaaaaucaaucuuucaaagauauuggggcuauucuaggcuuuuuacauuuccacaugaauuuugggaucaucuuguuaauuccuguaugaaagccugcuugaauuuugauuaggauuacauugaaugaauauagucguauguugcauaaguauguuuugguugauggaucacauguacaguggugguccucagauuauaauauuguauuuuuuuuuuuuuuaagagauggggucuuucuguguugggcaggcugggcucaaacuccuggccucaagcaguccucccgccuuggccucccaaaugcugggaauacagaagucagucauugcgccuggccaauacuguguuuuuauuguaacuuuucuauguuuagauacaccaauucuuacuauuguguaagucugucugacacauuucaucagacauguucuuuuaaaaaugguaauccgauuauauagugguuuuaaucaccauuuguucucuccuugccugauagugaaugagagccacaagucugaauuuauagagcugaggaaguggcugaaagcuaggaaguuucaagauucaaacuuagcgccugcuuguuuuccagguaagaucuagccuucagcuguccugcccuuucccacacgagagccagguagacagcaggggccacucuugcaggugggccucagcagauauuguccuucagcugguuugcauguguuccccuuggguuggaggaggaguccccuguguauggccaguuaauugcagagcagugggcuucagcacugaacugagguagacugacauucuucucuggaacuugugcuuauuagggagguuagguuaacauuuugccaggcgugguggcucacaucuguaaucccagcacuuugggaggcugaggcaggcagaucacuugagcucaugaguuugagaccagccuggccaacaugacaacauccugucucuacuaaaaguacaaaaguuagccaggcgcgguggugugcccuguagucccagcuacucuagaggcuuaggcaggaggauugcuugagcccgggaggcugaggcugcagagagccaugaucaugccccugcacuccagcuugggcgauagagugagaccuugucucaaaaaacuaacaaaaaacaaaaaccacuuucuucuggaacauucucucacagaaguugggcagcuugcuaugggugugugccugcauacauggccacuccacucuucccacaggugggcaagagauaaccacagggaggaccaagaugcucuuuaaaaggauuuggagucugcuguagcacagagauagugguggugcaauuagggccccaaaauucuacaucacagggcaggcugcaucuuacagaaaagucaaagcauaugccacacaaugcuccccuuggccauuagaauuauuauucaaguacccauuagguaauugaacuuugagcaaauuaacuuccucauauaccacacgccaaggcaaaugauuucccacuugugccccuugcugagugaggugauguguguaaaguuguucuccaugagucaguuacacaucaugacuuugaacuaaaaugcuugauuugagccauuuucuauuaaggccccuucuaguugauggucaugaaccauauugucagccucuaaaauaaugcuugacuuucuguuuuugugugucaaagauggucaguaaaagccacacccuuagauguacagaacagaguuuuuccccagaugaucaagagagucaguagugucagcaguaaacuugccgugucuaaggccugcccacaucucuggugucauuugcccuaggaaggauggguuuaaaaucaucaagcaggaaucagcagaugguuuagauggaauaccugagaauaggucaucuguuuguaauuuggagcaguaaagaguuccuauuuuuaaaagugagcacaacuugcccuggccccagccccagauuucgggugaugcagguggcuuggcagugacccgugcccagugcuuacaguucuggggaaccuucuguaagugcuucauguaguuuuuagcucuuaaucaguguaugauaggagguaacauuucugggcuucagucaaaauguaugaacucuggggaauucaucuuaguuuguggaggggcacaggaaaucuccuaagcaggauuccaucuuuagacucucucuucuuuucugccuugggaacugaccgcagcauuuccuuucaccaccaaaagcacuagccaggucagggccucccauguagauugaugauaguggaaauuuugaggcuuugagacauuugugauaagcuuuacucucaugagcuccuaauggccacuucuacuuugccuaguauauccaauaugaaaaugaaaguaaguguagauuacuauauguuuuuugauauuaaacacuaucuaccauauaaauauagguaaaggaucuucuagauguauuccauaggccagcuuuuguucauauauauguuuggagagaauuuccacuuagauuagcacguaaguuuuuggaaggauaaccagguagaagaaaaucuucccauuagucauugauucuaggaggaguucuggagcacagggaugauuaacuccacaaugggguacacaaaaucaaugaaauaaguuaacacuagaaccagcuguauaagcagacaguguccuccugggaggggagaugaauugggacucaucaaauccaacuugcugggaaacugauggaggacuugaggcaggaauucccaccaugagccaggagcaucaaauccaaccugccaggaagcugauggaagacuugaggcaggaauucccaccaugagccaggagcaucaaauccaaccugccaggaagcugauggaagacuugaggcaggaauucccaccaugagccaggagcaucaaauccaaccugccaggaagcugauggaagacuugaggcaggaauucccaccaugagccgggagcaucaaauccaaccugccaggaaaccgauggaggacuugaggcaggaauucccaccaugagccaggagcaucaaauccaaccugccaggaaaccgauggaggacuugaggcaggaauucccaccaugagccgggagcaucaaauccaaguugcgggaaacugauggaggacuugaggcagugagccaccgugagcugggagcucccaguaguccugcacugacuuggcugaauuauuuucccucccagcuaagagaggaaaggugaagaacgaugaauuggagacguuaaugcucuaggccucuuaugaccauguaauaccuaugccugccagaaaagcugucaucugagcauccuuucaauguuugucugacuguuccaggagcagaagcuuaggcaugaagggagaaacuucuggaaguugguauuaauuuuuaaauaaaggaauuuauugaauuaauugguauuaaugcagcugcugagguuacuauggugacugugcuccagccggagccuuggcucacagggaacagcuggagcugaccuacccagcugagcucaccaggucauggagagcccaucucauggguuaccugaucagagaggggaggaugucugcaggcuuuguggggacuugagugggguuuauuggccagucggccaaucaaaggggucucaaggucuucacuugggagagcugagucugguaauggggauaaguggccuggggcucuagccucagagguuggcugggcauugggaauagcaccuuguuagcugguaggccccaguggagagaguccagcccaaagcguccugcaggaggcccagcaguaggucuguauaaaguccacggugcucuuuaggucucaccucugaagcugacugcccuucaaggauuauaacucacuggaggucaagacauuuucuggaauagcuuucugacucccuguuuccccugggaaucaaaggcugagagacauccagcuucagccuuguguaauuuugaaguucacauuuuuuuuuuccauaauaguuaucucugggaccuugaaguuaugguaggauuuacucucuuucugucuuugcuuuccuagguacaggaagagggcugaugagucaaacaucccugcaggugagaacuguucuuugauccuugaaacccaauguagauuuugcugcuuuguuuuugcgguucaaacgaagugaauuaaaaaaauuucagacauacagucauuucuuacuuaccuaauagauauauuugaauaugguucuaucaacuaggauuaaguuuguugcaauaaaagacaagcccaaaauugaggugcuuaagcagcauggaaauuuauuuuguucucacucauagaaacaagcuuggaguaggcugacccuggcugguggggcagucccauggcuggcagaggccccaacuccuuccagcucucucauguccuuaagggaacugcacccucaggucagguugugggucuuggaacuugggcaucaggagagagcaagcgggugaggaagggcaggcuuccuuccuuuaaggaaauuccagucccucuguccuuggccagugaucagguacacagcccuagccagcugcaagggaggagauccgugcuggccuuuccccagccacgugcccucuaaguaggauuccguuagcgaggagggggagagaaggcguguugggauaggcaacuagcaaucucugccacagcacauguuacaugucagaucacguuuucaguaugccaagggagcugcugcugucugugaggcagucgugauguggcagguagaaaccagagcuaggggaggaugaggccucagacuugggccagaguugccuucagcugccugaggccccagcaugagaccccucauacucuuggcuccuguuuccucaccuacaaaaugaggaaguaaaugacagccuccaagguuucuuuucauucuuccaaugcuauuuuaaagaucucuagcgcacgauuuucugugaagccagaaauuaauuucuuccuuuauuuaaaaauuaucuuauuuuaaauucucuauuuaaaacuugcacucagauguguacauauguuuaggcuaaggaaugguaucuuuuuuuuuucaguagauaaaacguccuuuuuuuuuuuuuuuuuugagacagagucuugcucuguugcccaggcuggagugcaguggcgcgaucucggcuccuugcaaccuccgucuccuggguucaagcaauucuuuugccucagccuccugaaguagcugaaauuacaggcaugugccaccaugcccagcuaauuuuuuuuuuuuuuuuuuuuuuuaguagagacaggguuucaccaucuuggcuaggcuggucuugaacuucugaccucaggugaucugcccgccuuggccucccaaaguguugggauuacaagcaugaggcacuaugccuggcccaaaaguaauuuuacuuuuuaaaaauguuguguuaaaaagagaaguuuuuaaaauauuaaaggaaaguauaguuucuuuaaaaugcaagcauagucagcaagggaauucagguuaucuuuccuaaacaggugaaaaucacaaacacaagaaguccaauauauaaagaaugguauguuuuaauguuguaauucuauuacgccguguuaauguuuucaucauuuaaaaauuuuuaauuguaaaauauauguaacauaaaacuuuuuuuuuugucauuaagaagccuuuauuggguuauauucacuuugacccucccaccaaauuaagagggaaaaaacgaaaaacaaaaauaagaaaucccaguaaaagagccccucaagauuucauaaacuacaaacuaaagcugcuaguuaauaaggaaauggcagaauuuucagagcuguauaauacaaaaauuccuguaauuuaagcagauguuuuccucacugaugacaaaucuuccaacacaaugugaaguuaugcuacuuggauauuuguagcaaaaccauuuuuuuuguacaaaaacaaaagcaagggaccaugaaaaaaaaaguauuuguuccucauggucuaugagcauacaaauuuuuuagcaauuuaaaaggguaacugacagccugacauuuuucuauaccccaccuauucugccucucuguaggauuuguaaaugaaaguaacaucuuacuagcgggggucucgucuaucucccacucucuccaacuaauccuacuaauuuucucucaucuuccugagcauccuccaugaacagcauugcaaguugguuuuaaaaauagaaaagaaaaaagaaagaaaguuuuacaaggguuuuguugguuaauuaccaguggagucaguccaccaguaguuugauuucauuggcuagcagcugguucauguugaacagucacccugggaguuuggugagcagcucucgcuccaugcuuucagggucacugucaacagagcuggaacuugcacuuauguugucaacagcagugcuggcugggggacccagcuccagcucacuagucucacuggcaguggacaccacagagagcagggacauacgcugggugagcuggccagaggguagaagggaggcaguauagucugcucugauaccagcuacaucuagauuacaagccuuaugaaagacgaugaaaccuacauuugcauuggccucacagacacagaaggagcugccaucuuucaucaacaggucaacgccacacacauccauccccaggauauuagacaccuggauagcuagcugcuucccuuguucacucaaugaacacaucauccccacaccaccuaaugagcaguugcuuugcauucucccaucuguugaacaauguaacauggugccaaccacauggccucccacgacaaugacacguacaucccguccaugugacucuuuaacauacuucuggaacaaguauggcgcuucauggcaaauaagauggcuuagaucagccaaauggugcuuaucucgagccaagaaaacagcuuuaccucuaugaccccgcguauucuuuacuaccauugggaacuccgguacuugagcuucaucaaucauuuuagcaaaauuuucauggccaccauaagagaaaguauccggcagaggaacaccauggccagccaacucuugaaauguccagaacuuauuaacgcaguucaggauggcuugaagucgguucauuaacuggcaucccaucuucucuagauggcgcaaaacagugaugucacuaucacuuugcacccaagggguugguacucugacuaccaccacuuguggguaggcagugauuagcucuccauugauccgcagacccaaguuuccuuucuccauugucagcaccaccucauccaucaccacagcccuaaaguccaguuccuccucacaacauuuggccuuuaaugcucguaaaaucucuguuugaggauagucuucccugaugggacaaucuaucaaaaaccacaacuuggcagccacguaacuacagaucuugaucagcuugugcuuccuugccuggauuguuuccucuuggauguaacaucuaccaguugauuauggaagaugaacagccagauauagaggucugcaagaguccugagcacaggggcuucuguccccgaguuagagugcaccacccuccuagcagguggaagcagcccacgaauccauaaacccggaagcucaucuaacauaaaacuuaccaucuuaaccauuuugaaguucaguaguauuaaguacauucauauuguuguacaauauuuuuguuuuuggaggaagguguaauugacuuuauucuguagcagaauuuggggaugagaaaugucauguaugcagcaguaacuacagguaguuuuuguuuaggucaugaaauaauuggcaguuguuucacauguacauucaaauaugguuguuuuaucaaaaguuuuugaaaauugagacauauuuuacauauagugaaaugcacagugaaguguacaguuugcauuuugaugauaaagagauuuacccaaauauuuucaaaccaaaagaucauaggauguuggaaugggaagugaccauagugaucauccagcuuaaucuugcuuuacagaugaggaaaccagaaauugaucccggaagauuuuuuggcugagauuuuuuuuuucuuuuuugagacggagucacguucugucgcccaggcuagaguacaguggcgcaaucucggcucacugccaccucugccucucgaguucaagugauucuccugccucagccucccgaguagcugggaugacaggugugcaccaccauggccagcuaauuuuuguauuuuuaguagagaugugguuucaucauguuggucaggcuggucuugaacuccugaccucaagcgauccaccugccucagccucccaaagugcugggaugacaggcaugagccaccgcgccuggccuuggcugagauuuuuaaccaacuuagaugccaguuagaauuaaaggagagucuuacaucuggcuucuucaugcaguguuuauuuaaacuguuuucuauuacuuuacaucuaauuuuucuuuccaugguucuaucuccgugggagacacugaaaacgauacucuugcaagugguagaguucgacgcuuacuguguugggcaugcuggccuuucuuuagcucauaagcguggguuauguagagagcagaccaucaccuggccacuuggauuucacuggauacaauuuuuuggggguaguuucugucuguuuacuauugguagcacuauuuccuggcauaagaaagugaagaaauaggugaaacccugucucuacuaaaaauacaaaaauuaggcaccaucauggugaugggugccuguaaucccagcugcuugggaggcugaggcaggagaaucgcuugaaccugggagguggagguugcagugagcugagaucacgccauugcacucuagccugggagacaagagcaaaacuccaucucaaaaaaaaaaaaaaaaagugaagaaacaguauaauuugaauugucagcauguuuccaccacucauucuggugaaggguugacugcuugugggugucagucacauaauugaccuuucauuuuuguuggggcuguggggccucgccuuggagcagccucgugugcaucugcugacucgcagaguugggagcgacuccauugguaggcucauugguggcuuuugguugaguuacaguggguuacugguaggugauugugggaucaacgacuuuguaagacucauacucauggguccuucccaaagcauaggcguccucaacuuuacuuuccuuuuggccaggagggacagaugauuauuucguugccugagaguugccugcucaccacggacacagugauucgaagcuacuuaggggcauacauuacuaaguaagugaccacacacuugcuuaccuggugcaagugcuucuccuuaaggucugucaauggcaaauaugucacuugagacacaauucauuagaacccagucccuuguagagcugauaaauaaccugaaugaugugaaaaguuuacuccauucuagaaaguuugcccucccucccugccuuccugccugccugccugccugccuuccucccucccucccucccuccuucccuccuucccucccucccucccucucuuccuuccuuccuuccuugucucucucucucucuuucucucucucuugcuugagauggagucucaccuguugccaggcuggagugcaaugucgugaucuuggcuuauugcaaccacugccucccagguucaagugauucucgugccucagccucccaaguagcugggauuacaggugccugccaccacgcccagcuaauuuuuuuuuuuuuuuuuuuuuuguauuuuuaguagagacaggguuucaccauuuuggccaggcucgucuugagcuccugaccuugugauccacucgccucagccucccaaagugcugggauuacaggugugagccaccgugcccggccagaaaguuuguucuuaauucacuguaaauggcauuucuaagguuuuuaauaggcuuccuggaguguggguaugauaucccgauccaucacugacuaagaaauaaaaauuaaaugggauaauauauguaaaucacagcugagugccuuggcucauaguagccucuucucuuccaucauaguagcucuugacaaauguaaguuacucucucuuauuucuaccguuauuguacuucaguuuuccuugaacuuugaagagcuguuaauuuugugaaagaauuaguuuuauuuagguauagaagagaggaggcugauggggaagaacuguuuucuggcacacguucugcugggccuuuguuuuggggcaucuuugaggacagagugagagcgacccgcaguggaagggauuucuaaauacaaggguugaaagaguauaccguuuuuuucuuucuuuuuugagacaaggucuugcuguguugccuaggcugaagugcaguggcgugaucuuggcucccugcaaccuccaccuuccggguucaagcaguucucaugccucagccucccaaauagcugggauuacaggugugcgccaccaugcccugcuaauuuuguauuuuuaguagagaugggguuucuccauguuggucaggcuggucucaaacuccuggccucaagugauccacccacuuuggcuucccaaagugcugggauauaggcaaacggccacugugccuggcguauacugucucuuaaccauuagguaagugcuggucuuuuuucccccuggcauguuuuuggaagagagugaauaggucuuuuaggccuguguagagacaaugaugcugucauuguuaacauuuucugaaucauucugaaauuuugaguagaauguauggcaguauaggaaucuggaugucgaaggauugaugaaaacuuucuaaauacauucaggcaacaugagaucuuuuuaucggcaauugugcaaguaaaaauacugugauacauaauuuguaauagagcagguaaacuuaggaauaaaagcuuuagaacugcaacaacuguauaugagcauauucaguuuugguuuagguuggugcccuccaauagagcuuuuagcaaugacagauguuuuuuaugcauuguccaguaugguggccacuagcucugaauggcuauugugcaauuaaaacauagcuuaucuuaccaagggauugaauuuuaaauauucaauucuaaauaauuaaagguuaaauuuaaauagcucuguguacccagugauuacuauaucggauggugcaggucucaguucuuuccaccauuuuuuccccaccauauuuuauaucuuuacauaggugagacaaauggacuuaggucaaaagguuuacaacuggagaaccaaguuggaagcaaagagguuuuuuugcaaagaggaaucucuugcaaacaaaccuggaacuuggcuuagugagucaguuuuucugacauguaaguauggcucuuucagagcacuagcacuggggcugugcuccccuggagaggaagagccuuaaggaaggaaggaaggaacucuugagucuguuaaguaaacugaguguguugacaguuugaacacacuccuucuggcagcaaaacaaacugcuuggcuuauuucguauuuugaaucaaaguaauuccuuuaaacuggcuuuuaauuuucaaagguggaagccuccuccaucuccucugcuggcgcugugcaccuuuuuaguuucagaaaagcaugcugggcaccgaucucuuuggaagccuuaccuggagauuuuacccaaggcguauaccugcccuguuuguuuggagccggaaguggugaaccuucuucccaaaucuuuaaaagcaaaggcugaagagcagagagcccacgugcaggaguucuuugcuuccuccagagacuuuuucucuucucugcagccucuguuugcggaggcuguugacagcaucuucagcuacagugcccugcugugggcuuggugcaccgucaacaccagagccguguaccugaggcccaggcagcgggaaugccuuucugcagagccggacaccugugcacucgcuccguaccuggaccugcugaaucauagcccacauguccaggugagaagcugacaagggagcagcuauucuauuuggauaggaaggcuuccgcugcccagaaccuguggcuguagauguggguggcaccacagggagaggugucggcggcuucaggugacccugucagguuggccugacgucaggaggcuccuguuguucuucuagaccccacuaucccucccgcagugcuugccuuggccccuuuucuucacucugcucuucaggccuacagagccucgugcugcauccucuguccggucuuucccagcagccuguggugcggagccuuccuuccuucucccucguuccuccuuccgggacugaagcuuagcuugcuuuccugccccgucccuuuuaaacugguguuguagcugucacagcauuucucuucgcucugaucgcugacugacuugcucuuuuucccacugagcucugaaaucuuugagaauggggucuuugucuuguuccucuuugucaccucagugcucauggcagggccuggcacauaguagguguucaguaaauguuuauugaauggauggguauuuguggggaaaggguucugggaaauaaugaaagaaaccugauuugggagguggucacagaucgccuccuccccagcgcuuuccccagguggcucauuuaggaaaugaguguauuugcagggcaugcagggguagaggccuggcuuggagagcggaagagaguccaucaguuggcucaccuguaaccacuuugggguguguuguggagggacauggcugggaucuguguccuggccgucgccuucaucugacauuccacuggagaagagcagccaugccuugugagcccacgugcuaagcuuucgugcucucuacgugagaucagagcuuagggagguucccgcucugcuuucuuagcccaggaacaagggcugucugcuuguuacuuuuguagaaagaaguaucuuuaauaaucgggagcaaaggagccugggauuaggugaguguuucugugguugauguugacgaaauaauaucaggaguguguagugugauaggaugcuagacauggggacuccgucagcagugauuuauuuuuauugggacuuuuggugcauuuaugugccaaaccaaugaguuuauaguuuacuguaggaagaccacagcacgaacuacagccugugggcguguggcccaagagcccugagcuaagaaugguuuuuacacuuugaaaggauugugaaaauacaacaacuugugacagagaccacauagugcuggcaaagcugaacguauuuacucucuagcuuuuuacagauaaaguuuauuggcaccaccauguccuccuucccugggcugugaguggacgugaccaauaaacugcugaugaucucaucugugcugugucgggugucgugguguggccacccccagagcccuagggcaggacucccuccgucaucaauggggugaagucgagguggaugaaaccggaaguggcauuuucccuaugcguaguuacauuuauugauggguguuugaaagcugcaccugacucacauuaauauuauguaauaacuuaaucagcuuuggaguuuuacaccuuacuuuaaaaaauaccuuaacaguuuuucuuucuagguaaaagcagcguuuaaugaagaaacucauucuuacgaaauuagaacgacuucacguuggagaaagcaugaagagguauucaucuguuacggcccucacgauaaucaacggcuguuccuggaauacggauuuguuucuguccauaauccucaugcuuguguuuaugucucaagagguuggaaucaacuuuguucuuaacauuaacacuauauaauuuuuuuccccauuuggagauguguauuuucaguuuuaauaaaaauaucaaaaccuuaa

SEQ ID NO: 192652 - RNA, 129734 nt, Homo sapiens
ugaaagguuaaaaauaacauucuuuuaauaaguuuaaacuuuuagagaaaagagaaauauacugagaaagacccauauaacugcuucaacaaagaaaacaacuucuucauuaucuucauacuuuacuucauauuacaaauuuugugcuacuguuagaugauauauuaauuuuauuuucauuacauaaauugaggaagaaaugcagaaucagauucaaauauauuacaaggcauuuagggagguguguccuguugcugaacaguaaauuaucugaaaucuacuuuuuuuuuuuuuuggagauggucucauucugucacacagcuggagugcagugucgugaucucggcucacugcagccuccaccuccuggguucaagcaauucucaugccuuagccucccaaguagcugggauuacaggcgccgccaccacacccagcuaauuuuuguauuuuuaguagagacagggucucaccauguuggucaggcuggucucgaacuccugaccucaagugaucugccugccuuggccucccaaagugcugagauuacaggugugagccaccgcaccuagccugaaaucuacuuucaaaauggaaauaggcuuguucaaaagcacuauccugccuucuuucuucuuuagaauauaaccugguuuucaguaaaguaccaauacauggauuaaacauauucucucucacaugguuaacauucuggauguuccagaaaaucauauucgaugcauucuuccaguuguuuuaagauccuugggcuaucugugacaggaaaguccaagaauggaguuccugggcuaucagcaggcagcugucucugggucuuaaaugcaccauuuagagucaugaagaauggcaucaacugccugaugcuggaaacagaauguuggcgcagaagcgggaauucacucuucauggugaucucaucagagcuacugauuuccugcagaaaaaacaaacccauaacaaugauaugguuuuacugagggcucgagauggcugggaagcacaugcauguggcaaaaccuaagaaauaagguccuuuuuuuuuuuuuuugagacagagucuugcucugucgcccaggcuggagugcagcagcgugaucuuggcucacugcaaccucugucucccggguucaagcgauucucuugccucagcuuccugaguagcugggauuacagguaccggucaccaugaccagcuaauuuuuguauuuuuguagagauggaguuucaccauauuugccagguuggucuugaacuccugaccucaggcgaucugcccaccucggccucccaaaaugcugggauuaccagccucaugaauauaauuuuuaaaaagaaaagcaggcuggacacgguggcucucgccuguaaucccaacacuuugggaggcugaagcaggcggaucaccugaggucaggaguucgagaccagccugaccaauauggcgaaaaccugucucuacuaaaaauacaaaaauuagccccaagagugguggcaugugccuguaguuccaacuacuugggaagcugaggugcgggaauugcuugaaccugggagguggagguugcagugagcugagauccugccauugcacuccagucugggcaacagagugagacuucgucucaaaaaaaaaaaaaaaaaacccaaaaacaaaaaaacaaaaauuagccaggcaugguggcgugcgccuguaguuccagcuauuccagaggcugagaggagaauugcuugaaaccaggaggcugagguugcagugaccugagguugugccacugcacucuagccugggcaacagagugagauuccgucucagaacaaaacaaaacaaaauuagccaggugugguggcacauuccuguaaucccagcuacuccggaagcugaggcaggagaaucacuugaaccugggagguggaggcugcaguaagcgaagaccgcaccacugcacucuaaccuggguggccgagugaaacucugucucaccaaaaaaaaaaaaaaagaaaagaaaagaaaagcacuuaccccaaacuuuaauuuuagaaguucuagaauccugacagugugggguuugcauucuuggugauucuccucuacauccgacaggaaggcagggcccucuguguccacuucuggaauaaaugcccaccuauaacugcagggaacaaacagaaggucaggucugcugguaagaggccuucaacgucguuaaaauuaguuuuauuaagauauaauucacauacuguaucuauuuaauauggacaacucaaugccuuuuauuauauucauagaguugcacgucuauuaucacaaucaauuuuagaguauuucauuaccccaaaaagaaauccugcccugcucagccaucaccaccccaacccccuauacccuugagaccuaggcacccacuaauccacacucugucucaucguggacauuccauauaagcagaaucauacacuauauguucccuuguuucgagcuuucacuuagcaucauauuuuccgguucauccagauuccagcgugucucaguucuucaauucuuuuuguugcugaaccguauuccacuguauggauaugucacaugaucugccuguucaucagcugauggccauuuggguugucucuacuucuugccuauuauaaauaauguugcuaugcacauucacauauaucggaacccacuuuuuuguuuuuuugagacagucucguucugucgcccagucuggagggcaguggugcaaucuuggcucccugcaaccuccaccucccagguucaagcaauucucugccucagccucccgaguagcugggauuacaggcaccugccaccaugccugacuaauuuuuuuguauuuuuaguagagacgggguuucaccaucuuggccaggcuggucuugaacuccugaccucgugauccaccugccucagccuccuaaagugcugggauuacaggcaugagccacugcgccuagccuccacuuuuuuuugguuugagaugcaguuucgcucuuucgcccaggcuggagugcaguggugcgaucucgguucacugcaaccuccgccuucgguuucaagcgauucuccugccucagccucuugaguagcugggauuacaggugcccaccaauacaggcagcuaauuuuugcauuuuuaguagagacaggguuucaccauguuggccuggcuggucuugaacuccugaccucaugauccgccugccucggccucccaaagugcugggguuacagacaugagccacugugcccggccucuuuuuuuuuugagggggagucucgcucuguugccuaggcuggagugcaguggugcgaugucggcucacugcaaccucugccucucggguucaagugauucuccuuccucagcuuccgaaguagcugggauuacaggcgcccaccaccacaucuggcuaauuuuuguauuuuuuuuuuuuuuugagauggagucucgcuuuuguugcccaggcuggagugcaauggcagauggcaugaucuuggcucacugcaaccucugccucccagguucaagcgauucuccugccucagccucccaaguagcugggauuacaggcauacgccaccaugcccagcuaauuuuguauuuuuaguagagauggauuuucuccauguuggucaggcugaucccaaacucaggugauccaaccaccuuggccucccaaagugcugggauuacaggugugagccaucgcgccuggccuaauuuuuguauuuuuaguagagacaggguuuuucaccauguuggccgggcuggucuugaacuccuggccucaagugauccacccaccuuggccucccaaagugcugggauuacaggugugagccacgguaccuggccuaauuuuuguguuuuuaguugagacaggguuucgccauguuggccaggcuggucucgaacucccaaccucaggugauccacccgccucagccuccuaaagugcuaguauuacacguaugagacaccacguccggcccaaaccugcuuuuuaaaaacuaaaagacuuucuuuugcagaacagcuuuagguucacagcaaaauggaguagaaaguaguucccguacaucccauccuacauacauacaagccugccguauuaucaacauccugcaccagagugguacauuuguuaaaacugaagagccucuacugacucacuguuauccucccaaguccagaguuuacaucaggguucacucuuggugguguacauuguauggauuuggagaaauggacaaugacauggaucuaccauuauagcucuguaugcaauaauuucacugcccuaaaaauccucugugcuucacccauucaucccugccucccucuccccaaccccuggcgaccacugaucuuuuuacugucuccaugguuuugccuuuuccagaaugucacaugguuggaaucauacaguguguagccuuuucagacuggcuucuuucacuuagcaaugugcauuuaagagaacccgcucuuuaaccacaaacauuucuauaugauuacucucuuuguggggguaggagagagagaaauagccucuggggcuggucaugaaauuaaacaaaugagcagcugugcuaagccggcaggaaacauaagccuauggggcaaagugaaucggagauggcaggcuccaaauaaaggcauuuguaucuaacuaaacacagacaaaaaggucuacacaaaggcagugaggagcaccaguggguaagcccuguuuuauaagcauucaguagcaaaaaccacacacacacacacacacacacacacacacacacacacacacacacacaccauagaaacacauucauaaacacuccugugagccaaauuugcagagccacagauguugcaaguaaucugaaacuugguauuccgagcuggcuuagcugucacuagaaacccagauggugguuucccauaaacuguacaugaaaaacaagugaaagugcuuaaaaggaaaaaacaaaaucucuuacuucaaaaaggacacacgauccuaucugacuuacauuugaaauaauggcaucuugucagguggaaaagaaagcgcuguguccaagaauuugcaagcugauaaauacaagaugaguucacucugggguaucucccccacugaggguccauuugcauccgggacugaaacuuucguucuguuuacuuuguuggugcuucuauaaauuugcaaagaaacgcuuguuauaaauucauucagaucuguuauaguccauucaccuaugaccugucccucagaagaauuuucuuuuuaagaaauuuuuggaauagcugguccuuucacaaguacuucaagauaacagcauuuaacauuagacaacucuauaucuaaagugacgugcuuuaaucgugacuaucuuuuccucuuguguacagaucuuguacugcuuaccucaaugacucaucuucaucuuuuagaucuucuucaagcugugugaaugucugaaucugaaaaaaaaaugcauucaaguuacuaucugagacagauuaaaucuacccaaauauuuuuuuuuacuuauuuuuaaaaaucgauuaauuuaugaaugaaugaauaagacggggucuuacucugucacccagucuggagugcagugguacaaucauggcucacugcagccucaaccuucugcagaugcaacuucccgccaugccgaauuaauuuuuguauuuuuuuguagacaaggaguuucaccauguugcccaggcuagucucgaacuccugggcucaagugauccauccaccuuagccucccgaagugcugggauuacaggcauaagcuaccacgcccagcccaaauuuauauguauauaaaaaacuaguaaguauuaucaaaugguacaaguuaguuggaauaacugacagggugagagaucaaauaugaucauagaguaaaauauucucuguuuaaccaagagcuaaccaugugcuaccaaccugauuaaaaauaacauuuagauaaaaugggauacauaggaaauaguacguuauguuacugaaaaagcauuuuaaaaagcuccaaccuugcuuucaaacuuacaauacuuguacucaccaauucagagaccauuauuggccacaaugaagucaaauguugaggagauauucuuagcagcaaaacucugaaaaaaagaaacaucugagcagcaacuauggaugucuguccaacucugagauugucugucaggcguucuaaggaaagaagauuguaaagauguuacacaaauaugcaguuuaggguuucuuaucagacaaagaaaaauaaaacugugacuguucugacauucuaguaacaacccaguguaaggaaugaguguuacaggccaggcuugguggcucgcacuuguaaucccagcacuuugggaggccgaggcgggcggauaacaagauaaggaguucgaggccagccuggccaauaugguaaaaccccaucucuacuaaaaauacaaaaauuagucgggcgugguggugggcgccuguagucccagcuacuugggaggcugaggcaggagaaucgcuugaaccugggagguagagguugcagugggccgagaucacaccacugcacuccagccugggugacagagugagacuccaucucaaaaaaaaaaaaaaaaaaaaaaaaagaauguuaggagaugcuuuugugcaacuaguccaccccagcccucuucuuugugaaauacagcaguucauggcucuugccaaaccuaaggaaaugauucccacaggccgucccccugccacagcugaguagaaagacaugaacaucugucaccagaaauccacuggaugaccaacagccauuucaauguucuuuuaagaauaugaaugaggagacgcagaaaccaagcagcccauggugaggaauggacuuacacaaucauauggacuggcuggcagacaacaccauauuuugaggguggugggugggaagcggagcaaguaaauauaacagauuuacugaguaagguuuaaacuugauggccaugacaaaaacuuucauuccuauggagggaaaaguguuucaaauaacacucucuagccccuaacacucuccccugcuucuccccugaaaugucuuguuuguagaaugagacuuuuuuuuucuuccauagcuuaagguuuccuaggaauguaacaaauugcuacagcaaacagcugaaugguagucaugcuagcuaagaucggcuguaguacauuaguacauuaguauauuaguaauaaauuuuuuuuuuuuuugagauggagucucacucuguugcccaggcuagagggcagcagagcagucuccgcucacuacaaccuccgccucccggguucaagcaauucuccugccucagccuccagaguaguugggauuacaggugucugccaccaugcccggcuaauuuuuuguauuuuuaguagagauaggguuuagccauguuggccaggcugaucuuuuaacuccugaccucagaugauccaccugccuuggacucccaaagugcugggauuacaggcgugagcugccaugcucagucaguuuuguguguguguguguguguguguguguguguguguuuuugagauggagucuuacucugucacucaggcuggaguacaguggugcgaucucggcucacugcagccucugccuccuggguucaaaugauucucaugccucagcuucccgaguagcugggauuauaggcacccaccaccacacccagcuaauuuuugguauuuuuaguagauaugggguuucaccauguuggccaugcuggucuugaacuccugaccucacgugaucugcccuccuuggcuucucaaagugcugggauuacaggcaugagccaccgcgccugucuuugaccuuucuuuuuugugguaagagcaccuaaaaucuacucucuuggcaaauucccaguacauaugcaguguuauuaacgacaguccucauguuguacaugccuuuucuagacuuacucauccuccauaauugcaccuucguauccuuucaccuacaucuucccagcccccaaagacguaagacugaugucacucugagccgagacauacagagcugcucagcuccccaucuccuucucugcuacucgauggugcaacaguguccggggaaaaggaccccaaacgguaucccaggagagaaguguuagaaauucuccacuccugucucuuuuuuuuuuuugagauggagucucacucacucugucacccaggcuggagugcaguggcgcgaucucggcucauugcaaccuccgccuccaggguucaagcaauucuccugccucagccucccaaguagcugggauuauaggcgccugaaaccaugcucagcuaacuuuuuguauuuuuaguagaggugggguuucaccauguuggccagguuggucuugaacuccugaccucaagugaccugcccaccacagccucccaaggugcugggauuacaggccacugugcccagccuccugccucuuuuaauugggcccaaacuauuuacuaugggacacuucuugggagcuucuggaugcaucuaccucucugaggcagaugugggcaucaucccuccacagggcaucuccaggcaaguucagugucccacagcucuggcagaggacacucugagugccaucaacccaggacucaggggggcugggccuauccacgagcauccuggggacaacgacaacauguaggaaagugcucuguaaacugucaguucaucaaaaaugaaaacagggcaaaaggcuuauuuuuuaaaaacacguaguauuuuuagaaauauagcacuugagcuauccaaaacgaagcguauuuauuuagaaauucuuuuucccggccagacaugguggcucaugccuguaaucccagcacuuugggaggcugaggcggguggaucacuugaggucaggaguucgagaccagccuggccaacauggugaaacccuaucucuacuaaaaauacaaaaauaagccaggcaugguggugggugccuguaaucccagcuacuugagaggcugaggcaggagaaucacuugaaccuaggaggcggagguugcagugagccaagauugugccacugcacuccagccugggcaacagagugagacuccguuccccucccaacaacaacaaaaaaauuucucuuuucccaagagcccaaaaccuaccuccauuuucaguuagcauucugcugccuuuauugcauauuugaauauauaauauaaacaaguauauuguuauauaguauaauauuuaauauuacuauuuauauaaucauuaccuauuaguuauuacaaucaugucaauauaauacaaauauaauaauuacauguuacaaugucauauaauuauauaacauauuaauauauuauguaaaacauguuuuuuauauauauauucuauuauauugccugugcuugcucccucucagagaaauaauuucucagaauugcuggguguuuaaacucuaccauggucaaauucuccacaccccuguuucagaauguugucuaucuuuuuguuuuuuugguucuagcuucuauacaccuaaugcugucuauuuagcuaucugggcuuccucccaaauuugagaggagugugagaugggguagaaagaaggaacagggcugggcgcaguggcucaugccuguaaucccagcacuuugggaggccgaggcagguggaucacggggucaggaguuugagaccagcaugaccaacauggugaaacccugucucuacuaaaaauacaaaaauuagcugggcgugguguugugugccuguaaucucagcuacucaggaggcugaggcaggagaauugcuugaacccgggaggcagagauugcagugagcagagauugcaccacugcacuccagccugggcgacagagcgagacuccgucucaaaaaaaaaaaaaaaaaaaaaaagaaagaaggaacaggugguuggccacgguggcucaugccuguaaucccagcacuuugggaggccaacacaggcggaucacuugaggucaggaguuugaaaucagccuggucaacauggcgaaaccccaucucuacuaaaaguacaaaaaaauuaccugagugugguggcuggugccuguaaucucagcuacuuuggaggcugaggcaggagaauugcuugaaccugggagguggagguugcagugagccgagauugugccacuguacuccagccugggugacagagcaagacuccaucucaaaggaaaaaaaaaaaaaaaaaaaaaaaaggaacaggugucugcucuuagacugaaaaggcacugaaaggguuaucagguacauugcccaauaugcucuccuuuucauuuuccuccacugagaaaguaggcuuacugcuucccuuagggccacugucuagugguuggguucauaaagaauccuccccuauacugcacaugaacuaaagaaaaggugauuccuguuguucuuuuucucuccagauuuuguagggaggcaacaaaguucagcucugaccuugcauuuagccacagucuuuggagagcugacauuaccuuuacuggugcuccugguuaccgucugauuaaaucauccuccuaucacaguuauucaagcaaggcacgccaacuggacuuguuaauauuugaaaguuuucuuucauguuucuuaaguguucaagauauuacaagguaaaaaucuuaugugcacuacaugcggaaauuaugucaguuaaaguguaaagguguuuuauuauugcauauguaaguuaucaugacuaacgagucaacgcuguuaaugcuuugaacuaaaacaagaucuuuccggcugggugcgguggcucaugccuguaauccaagcacuuugggaggccaaggugggcagaucaccugaggucaggaguucgcgaccagccuggccaacauggugaaacccugucucuacuaaaaaaauucaaaaauuagccggacaugguggugggugccuguaaucccagcuacuuggaggcugaggcaggagaaucacuugaaccuaggaggcggagguuucaaugaggcgagacugcgccacugcacuccagccugggugacagagggagacccuggcucaaaaugaaaacaaaaacaaaacagaaugucaacuuugccaccugaacauuuuaugagaaggaaaaaaaaaaaaaaacccugacaaucacguacgauguuggcaauaauaauaacaauuuauuuauuuauuuuugcaauggagucucucucugucacccaggcuggagugcaguggcacaaucucggcucagugccuaccagguucaagcgauucuccugcuucugccuccccaguagcugggauuauaggcaugagucaccacaccaggcuuauuuuuguauuuuuaguagagaugggguuuuaccacauugggcaggcugaugucaaacuccugaccucaagagauccacccgccuuggccucugaaagugcugggauuacaggcgugagccaccgugcccagucagcaauaauuauuuuugaugcagucaaagaauguaguggggaugaaaaaaaaauuguuaaggaaaaauuagauccuucuccaaaaucuugccccuucccuggccucagcugaaggugcugauuaagggaguacuguaaacaccgaguaccuugacugcaggaggacucuagcaagagacagugcugaggaaguauuauuccuauacuguggucagacuuuuaaaaacuaauacaaauuaauaacacuguaauugauuuuauuauguauuuauuuagagacagaguuucgcucuuguugcccaggcuggagugcaguggugugaucuuggcuuacugcaaccuuggccuccuggguuuaagugauacuccugccucagccucaaguagcugggauuacaggugcgcaccaucacgccuggcuaauuuuguauuuuuaguagagaugggguuucaccacguuggucaggcuggucuugaacuccugaucucaagucauccacccaccugggccucccaaagugcugggauuacaggcaugagccacuguaccugaccuauaauugauuuuaaaauaaaguuucagauuuaccaauauacuucugaaguucuauaacucugcagaauacuuguuuuaacaagugacaaucaugccaaagcacgcaguagaccccucuaguacuuaaucaucucagccccucaugggucuaucugugugugggggcagugagggcaggucagcuguugcugugguuugaauguuuguccuguccaaaaugcaugcucaaauuuuauuguaaauguaauguuaucgggaaguggggccuuuaagaggugauuaggccacaucauggaugggauugguacuguaauaaaagggcagguucagcccccucuugcucuuuugccuuuccaccuucugccauaggauguugcagcaagaaggcccuugccagacgccagcccuggauauaggacuucucagccuccagaacugugaggcaauaaauuucuguuuuuauaaauuccccagucucagguauucuguuauagcagcaaaaaacagacuaagacagcugucuuaccuuguaucaguggaagguaaaggugguauugaucaaguucuccacugaagacagcaaaagccuggcgcuuuaacagcauggcuuucuguucaaaacuugagaauaguuucaaagaacugcucugcaugucuagaauaaauacagcaauguuuuacuuagugagaaaaccacaauuggagggaagugaugggaaauucauacuaguguaauucuauauucccuggugaaaaaucaugaucuuuauuaaguaaggacaugagauuacuguucccauguauauuuaaaaaauaguuauuucucuuuuuauuucuuauuugagacaggaucucauucuaucacccagccuggagugcaguggugggaucacagcucacugcggccucgaccuccuggguucaagcgauccuccugccucagucucccaaguagcugggacuacaggugcgugccacagugccugguuaauuuuuuguagagaugggguuucgcuauguugcccaggcuggucuugaaccccugggcucaaaugauccacccaccucagccacucaaagugcugggauuggcgugagccacugugcccagccaauacuuauuuuuuuauuuuuuugagaaggauuuucgcucugucgcccaggcuggagugcaguggcacgaucuuggcucacuguaaucucugccucccggguucaugccauucuccugccucagccucccgaguagcugggacuacaggcgcccgccacuaugccuggcuauuuuuuguauuuuuaguagagacgggguuucaccguguuagccaggauggucucgaucuccugacccugugauccgcccaucucagccucccaaagugcugggauuacaggcgugagccaccgugcccagcccaauacuuauuucuuuaaugauacuuaaugauagugcaugagaagggaucugagguguagaaaaguccuccuaguaaauuauagaaacuuauuacuuucagcacaaaugucaagaugugaagcuggaugcuuucggcaguauuucuccacuauaaaacuaugaaaaagguugucguggcguucuugucaauaaauugcaacuggaaaagacucauugauuuaguccugccauauuaugaacaucacauuacagucuuuguggcguagacagcaccaugaaagugugaguaggguucggaaauacaugaugaaagcugguuauauuggcauugauccuaucaagugugaguuaugcaaaaguaacacagaacuuacucauuaaauccuuaaacauuguuuucucaugagucaaaagauggucaauaauggacuuccaacuggauauuaaagaaagcaaaaucaauuaaauuugcaguggaugauaguuugauucaaaacauuaagaaaauaacauauccucuuaagauauauuaaaaacugcuuucugggccaggugcaguggcucacgccuauaaucccagcacuuugggaggccgaggugggcggaucaccugagguugggaguucaagaccagccugagcaacauggagaaacccugucucuacuaaaaauacaaaauuagcagggcgugguggcgcaugccuguaaucccagcuacucaggaggcugaggcaggagaaucgcuugaacccgggagguggagguuguggugagcugagauugugccauagcacucuagccugggcaacaagagcaaaacuccaucucaaaaacaaacaaacaaaaaaacugcuuucugaaaagagguuagugauagaaauaaauaguuuacauauaaaagaaagcuacgaaaaagcuuuucauuuauaacccuaacauagggaaugaaugaugacuuuuuccaguuuaccacaaagaaacaaacugacaaggcacucuggcuuuuucaaggguuauucuuaaauauguucauacaggaugauauucacacaguuguguugaugaaaagagugggauagugaagacaaauaccacccuuagcuuuucuuuccaaaugagcuaccccagcagagcaacaagaucacguggagggaggccacagggccaccagcagcccucuggggguggccaugcuuucaugccauacaaaaaggguucccaaucucuacccucuaucgcuaagccuuccugucauuaauaaaggaguggcuuucuuucuuucuuucugguuauuuugagacagggcccagggucgugugcugucacccaggcuggagugcaguggcacaaucacagcucacugcagccucaaccuccugggcucaagcgauccuccugccucaggcuuccauguagcugggaccacaggcauaugcccgcaugccuggcuaauuuuuuugauuuuuuuuuuuuguagagaugggguuucacuuuguugcccaggcuggucuccaacuccugggcucaagcaauccuccugccuaagccucccaaaauguuggauuacaggugugagccaccaugaccagcccugagugauuuucuuuaucucaggaaaaggcccaggagcacaucuugcaucugagucucaguggaucucugcuuggcugcugcaagaucucaguaagaacuuguggaguaucagccgagaagugggguaaagacacccccagggucacccagugggcucugucaucuuaacacuggccaauuauuuugugauuacaagacaaagcaguauuagauagaacaaguaucacuggaaccccaaguucugcuguuuauuuauuugagacagaguuucacucuuguugcccaggcuggagugcaguggugggaucuugacucacugcaagcuucacuucccagguucaagcgauucucauaccucagccucccgaguagcuggaacuacaggugugcgcugccaugcccggcuaauuuuugaauuuuuuuguagagacgggguuucgccauguuggccaggcuggucucgaacuccugggcucaggugauccacccaccuuagccucccaaaaugcugggauuacaggcaugagccaccgugcccagccaggaaauaacaugcucucugaauuaagugauauuccucuuuguacuuuaaaagacuugaucccuuucccaugaacacauggucaacaugcgagccugugacagggacguccuguuauuuggguugauccuauggcucugcuucuauuucaggaaugagaauucuguaaaccaaaaugccauuuccaccugaagauucagagcacguuguuaucaggacagcauaucuuacugaacacaggaaguauccaucugaaagaaagcggggucgagaaacagcuccaggaccuccuuccuccaggcucgcuuuguguaggcauagccacucagggagcucagcagcugagcgccagcccggaagcugggagcauuguaggcacugagugggagugggaagagagaagggucaaggucaaggacuguccaaggaaaacuacuugauucauuugugaaaacauauuuuucugcauaugggugggaagaaauggcgaagaugacguuaccugugguugcguaaguauggaaaaacauaguaaagcagacgggagauuaacggcacagcuuucuccuucucaucacuucgauaaaccauguccaggagggaagccaguaccuaaaagaacaaggcccuaagaaaacagaaacuggccaggugcgacggcucacaccuguaaucccagcacuucgggaggcugaggagggcggaucacuugaggcugggaguuugagaccagucuggccaacauggugaaaccccaucucuacuaaaaauacaaaaauuagccagguccuguaaucccagcuacucaggaggcugaggcaggagaacugcuugaacccaggaggcagagguugcagugagccgagaucacgccacugcacuccagccugagugcagacuccagagcgagacuccaucucaaaaaaagaaaacagaaagaaaaagaaaaaaaaaagaaagaaaacagaaacccuuggaagcgagcaacaauaagaaaagcaguuauggcugggagcggugggucacgccuguaaucccagcucuuugggaggccaagguggguggaucacgaggucaggagauugagaccauccuggccaacacagugaaaccccgucucuacuaaaauacuaaaaacuagcugggcgugauggcgcgcaccuguagucccagcuacucaggaggcugaggcagcggaaucgcuugaacccgggagguggagguugcagugagcugagaucgcgccacugcacuccagccuggcaacagagcaagaaucugucucaaaaaaaaaagugcaguccuuaaagcaaaaccuaacccaaaacuccauggugcagcuugaggccaaugcugccugauggacgagcucaccugggagggugcggcccacgcucacuggcaccugggaaugaacaaaugucuuugcaacaauucgugauggcgcucauuuccauaaaggacgacaggucagguguguauuuaccucugccaggagagagagggcuugcacgcuguacaccgacggggcggaugaagacaccauugcugaagcugcagcagcaucugugaacagaaagagccauuuguauguuaacuaugauggaugggucaccauuuacuguccccaaaagcccugcaugaaugugagccaucagcucccgccuuucauaccaauuguguccauaugacucagguauuccucucuguuaacuuucagcuuuuucuuuuuuuuuuuuuuuuuuugagauggagucucacccugucacccaggcuggagugcaguggugugaucucggcucacuguagccuccaccucccagguuuaagcaauucucuugccucaucuucccgaguaacugggacuacaggcaugugccaccaugccuggcuaauuuuuguauuuuuaguagagacgggguuuugccauguuggccaggcuggucucgaacuccuggccucaagcgauccuccugccuuggucucccaaagugcugagauuacaggcgugagccaccgugccuggccaucauucaacuuuuuuauuuuuauuuuugagacaggaucuugcucugucacccaagcuggagugcaguggcaugaucauggcucacucuauccuugaccucccaggcucaaaugauccuccugccuuagccucccgaguagcugggggcacaggcacacaucaccacgcccagguaauuuuaaaauuauuuauagagacaaagucuugcuauguugcccaggguggucuugaauuccugggcucaaguaauuugccugccuuggccucccuaagugcuaggacuauaggugugagccacugcacccugccaacauucaguuucaacaacuaagaaucuggauauuuugaucaaauaaauuagcacuaacucacuaacauccucuccauuuccauucucaucaucguucuugaaacugcacgaccccuuuggaugcucccuccuacaucccagccucuaagccccuggccuucuucucuucuaaccauccccgacuccgcuccagcuccaccacugucauacccuugaccucaccagcuucucaaaucuccguuuccagcauccuccucugaccaccccucuggcauuuuccugcauccuaggacagcuuuccagucccugaguccuacugccuaacuacccagcagcugcuacagguccucaccucccacccacacccagggucagucaucuacccuucacuccuuugcuucuuucccucggaaggacucaccuagaagaaugcacugcuggguacacccaaugaucugucuacguaguuauguguagcuaaauguuccagagcaaaccagaccaccaagcaacugaucuuacuuuaugucaugaccaugaaucucucaagggacuugaugcuaccacauguucccagguggggugcuggcuuucccacucuccaacauaauucuuuuuuuuuuuuuuuugagacaaguucucgcuuuguugcccaggcuggaguacaguggugcaaucuuggcucacugcagccuccgccuccuggacucaagugaucuucccaccucagccuccucagaagcuggaacuacaggucccauuacuacaggcuguaauuuuuguagagauggggauuuuucacuguguuguccaggcuggucucgaacuccugggcucaagcaaacugcuagccucagccucccaaagugcugggauuacaggcgugagccacugugcccagccucaucuccuguuuuaauagauauguuccugacuccuaucaaauaacaauaauuccauuuaugaucccaauccuggcccuguggccaucaaggacucugcuaauuauccuuccucucucuugaauuaauuucuuccucucugcuguacuguucugucaccaugcaaauaggcuuugauauccuccauuuaaaaacaaaucaggccgggugcagugguucaggccuguaaucccagcacuuugggaggccaaggcgggcagaucgcuugaggucaggaguucgagaccagccuggccaacauggugaaacccugucucugucaaaaauacaaaaauuacccaggugugguggcgugcaccuguaaucccagcuacuugggaggcugaggcagaagaauugcuugaacccaggaggcagagguugcagugagccaagaucacgccacugcacuccugccugggcaacagagcgagacuccaucucaaacaaacacacaaaacaacaacaacaaaacauucucugguccuuaauucugcuuggcuacugcccuauggacaacuagccucaaagaguuaccgaccuccacugucuccccuugcuccauucccauccucuucuccaccuguuucucaaguguccccucaccauccugaccacccaccccgaugaauucuacauugucagcuccuguugccccuuccuguugcacuuugcuucucagcggcccuccaccgugugucugccccuggggccuucggacacauugucuccucccagacuccaaggcucuaugcucucuugguucacccaccucagugacugcuuaaucaucuuugcuggguccuucucuuuuccaucauuuccgacuuaacaugugcaaaaucaagcucaauuuuucucuacgaaauguuuuuucuucuguuuuuuccaccuugguaaauugcuuaagccaaaaaccugucauccuuggcugcauuuucuaaaauaacuacauccgauccaucagcaaauccugcugacucugcauuuaaacugucccuuucuguugacccugccuccaagccagaaucaucuucugccuuaaccagcgcaaaauccuuuuaccuggacuuccaguuucugugcucauccaauacacacuguacugaucacagcagccaaagugaugguuuuuaaaguuugacuaacauguggcugcucuaaguacuuuaaggcuaccuguggcaagugggaugaaauccaagcuccuuagugugcuuucuuucuuuuuuugagacagagucucuguugccuaggcuggaguggagcggcgcgaucucggcucacugcaaccuccaccucccugguucacgccauucuccugccucagccuccccaguagcugggacuacagguaccugccaccacacccggcuaauuucuuuuuguauuuuuaguagagacgggguuucaccauguuagccaggauggucucgaucuccugaccucgugauccgcccgccucggccucccaaagugcugggauuacaggugugagccacugugcccggccccuuagugugcuuucuaccaagcccgacaaccaucagucucaucagucuccacccuuucucugaccucuucccaccacuuucaugaagcuccagaguccuggucuucaggucgcugggucuaagcccacucccguggccaaggccugcaauccccucggggcagugccuucccagaccucugcagggcuguccccuugucuuucaucucucagcacaacugucaccuccuuggggacauguucuguaacacucacaguggcccugccccacuaccagccacuccuuaucacauuacucuuacuuuccucgcaguacuaagucccaccugaaauucucuugguaauuuacuuucuuuuagucauuaaaaaaacuuuuuuuuuuuugagauggaguuugcacccucuguugcccagacuggagugcaguggcacgaucucggcgcacugcagccucugccucccagguuccagugauucuccugccucagccucccggguagcugggauuacaggcacacacuaccauaccuggcuaauuuuuguauuuuuaguagagacaggguuucaucaugcuggccaggcuggucuugaacuccugaccucaggugaucugcccaccucagccucccaaagugcuaggauuacaggugugagccucugcaccuggccuuauuuuuauuuauuuauuuuuuugagaugagucuugcucugucgcccaggcuggagugcagugacgccaucucgacucacugcaaccucugccuccccuuuuguagagauggggucuuuuuuuuuuuuuuuuuuuuuuugagauggaguuuugcucuuguugcccaggcuggagugcaauggugcgaucuuggcucacaguaaccuccgccucccagguucaagccauucuccugccucagccuccggaguagaugggauuccaggcaugcgccaccacacccagcuaauuuuguauuuuuaguagagaugggguuucuccaugucggucaggcuggucucgaacucuggaccucaggugauccgcccaccucggccucccaaagugcugggauuacaggcgugagccaccgcgcccggccugagauggggucuugcuguguuacuaggauaguccuuuuuuuuuuuuuuuuuugagauggaguuuggucgcucugucacccaggcuggaguguaguggcacgaucuuggcucacugcaaccuccaccuuccggguucaagucauucugccucagccuccugaguagcugggacuacagaugcccgccaccauaccuggcuaauuuuuguauuuuuaguagagauggaguuucgccaaguuggccaggccagucucgaacuccugaccucgggugauccacucaccuuggccucccaaaguccugggauuacaggccugagccacugugcccggccugauuuauuuuuaaauggaguauaucccaaaguguugggauuacaggucugagccaccaugcccgcuaaccaggauagucuuaaacuuguagccucaagccauccucucaccuuggccucccaaagugcugggauuacaggugggagccacuacacccagcccugcuaacaauuuucguagaaguaauaaugaaagauaacaauauuugaacauuacucuguggcagguacugugauaguuuacacugaaaacugaaauguaguuucuuguuccuguauuaaauaaaacugggaccaaacauccuuucucacguuguauuaagcucuacuggcacugggcauacuguccuucccuguguuaaaugacacugacaguagcaaagaaaaucacuugccccaagauaugcuuaauccugaaaaaaaaaaaaaaaggaucauuuguaaucaccucaggcgacccgcccaccucagccucccaaagugcugggauuacaggcaugagccaacccucccagcuugauuugcuaaauucucuuuccauaguucugcaaaaagaaacacacacauucucaucaucuuuaucccacacagauuucuaucaccauguccagguaaauggucuugggguguuacuuucuggagccccacugaggcucagugaaggucagcaggauggcauacacauggugggacaccagcuaaggggucccgguguuuagcacacacacauaguauguuguaaaaagucaaaacagacaguucagucaucuggcuauggauacaaaggaagagucugggccgggcgcagaggcucacgccuguaauaccagcacuuugggaggccgagguggguggaucaccugaggucaagaguuugagaccagccuggccaacauggugaaacgcugucuuuacuaaccacaaaaauuagcuaggcauggugguagaugucuguaaucccagcuauucgggaggcugaggcaggagaauggcuugaaccagggaggcggagguugcagugagccaagaugacgccacugcacuccaaccugggugaacuccaaccugggugaacuccaaccugggugaacuccaaccugggugaacuccaaccugggugacagagcgagacucugucucaaaaaaacaaaaacaaaaaacaaagaaagagucugggugaaugaacacagacuugagaagguaguuugcuuuuuccuaugccuaaacuuuuuuuuuuuuuuuaacuuuccaacaucuuuucccuuaccaguuuuaauuagauauaacugacaaauaaaacugguauacauuucagguuauaacaugauguuuugauauauguuuucuuuuuucaauauuucaccaucccugcugauauaugcauacauugugaaaaaacacaaguuaagacaugcaucaccucagguacuuucuuucuuucuuuuuuuuuuuuuugagguguagucucacucugucgcccaggcuggagugcagugguacaaucuuggcucacugcaaccuccuccucccagguucaagcaauucucugccucagccucccauguagcugggauuacaggcgcccacuaccacgcgcggcuaauuuuuguauuuuuaguuaagaugggguuucaccaucuuggccaggcuggucuugaacuccugaccucaggugauccacccaccucggccucccaaacugcugggauuacaggcgugagccaccaugccuggccucaaagugauguuuucuaaaguuugacuaacaucuugucacugcucuaaauacuuuuuuuuuuuuuuuuuuuuuuuuuugagacggagucuugcuuugucgccugggcuggagcgcaguggcgugaucucggcucacugcaaccuccgccucccagguugaagcgauucuccugccucagccucccaaguagcugggaccacaggugcuuaccacugugcccagcugauuuuuuuacuuuuaguagagacgggguuucgccauguuggccaggcuagucucaaacuccugaccuugcuuuaucugcccaucucggucucccaaagugcugggauuacaggcgugagccaccgcacccagccuaccuuaaguacuuucuuucuuuuuguggugagaacacucaagaucucucuuaaggaaaagccagaaccacgcgcugaccagaggcacuaucagccaacccaucuccaccuaccauacagguccuccucagcaucagauucuucuagagaggccugagguugggccuucacuuccagguuucugcuuagccagcugguuugcuccaaggaagagccggcaauguuccccacagcuucuaggauuuucugagugauuuccugagaauuaucaggaggagggggaaaggaaguuaauuaaggaaaagaauguuaagugccuaaaacagcacuguccaguagaaauaaaaugcaggccacagcugugagcauauacguaccauuaagcuuucuaggagccacauugaagguaaaaauaaacaguuaaaguuaaauuaauaauauaggcugggugcaguggcucaugccuguaaucccagcacuuugggaggcugaggcugaggcagggggaucacuugaggucaggaguuugagaccauccuggccaacauggugaaacccugucucuacuaaaaaaaauacaaaaauuagcugggcaugauggcacaugccuguagucccaguacucgggaggcuuaggcaagagaaucgcuugaucccaggaaguggaagcugcagugagcugagaucaugccacugcacuccagucuggaugacagagugagacuucguuucaaaaaaaaaauuaauaauguauuuuauuuaacccaauauauacaaaauauuaucaacaugcacucaauauaaaaauuauuaauacgcuaggugugguggcucaugccuauaaucucagcauuuugggaggcugaggcgggcggaucaccugaggucaggcguuugagaccagccugaccaacauggugaaacccugucucuaguaagaauacaaaauuaggugggugugguggugcaugccuguaaucccagcuacuuuggaggcugaggcaagagaaacacuugaacccgggagguggagguugcagugagccuagaucaugccauugcacuccagccugggcaacaggagcgaaacuucgucucaaaaagaaaaaacaaaaacaaccuauuaaucagauuuugcauucucuuuugugugugcccuaagucugaaauccaauguguguuuugcacuuacagugcauucaauucagacuaccacauuuuucuuuuuaggagguggugggcaggacagggucuugcucugucaaccaggcuggaguguaguggugcaaucaagacucacugcagccgggcgcgguggcucacgccuguaaucccagcacuuugggaggccgaggcaggcggaucacaaggucaagagauugagaccaugauggccaacauggugaaaccccgucucugcuaaaaauacaaaaauuagcuaggcgugguggugcacgccuguaaucccagcuaccugggaggcugaggcaggagaaucauuugaacccagaugacagagcuuguggugagccaagauagugccacugcacuccagccuggugacagaguguugcgggaagucagcgaccccgaacaaagggaccgacuggagccgcagcaaaggaacauaaauugugaagauuucauuuuaauauggacauuuaucaguucccaaauaauacuuuuguaauuucuuacaccugucuuuaaucucuuaauccuguuaucuucauaagcugaggauguacaucauggcaggaccacugugauaauuguguuaacuguacaaauugauuguaaaacguguguuugaacaauaugaaaccagugcaccuugaaaaagaacagaguaacagugauuuuuagggaacaagggaagacaaccauaaggucugacugccugugggguugggaaaaaagagccauauuuuucuucuugcagagagccuauaaacagacgugcaaguagggaagauaucgcuaaauucuuuuccuagcaaggaauauuaauauuaauacccugggaaaggaaugcauuccuggggugaggucuauaaacagccacugugggaaugucugucuuaugcgguugagauaaggacugagauacgcccuggucuccugcaguacccucaggcuuacuagaguggggaaaaacuccauccugguaaaucuguggucagaccgguucucugcucuccaacgcuguuuucuguuaagauaagauguuuaucaagacaauacgugcaccgcugaacauagacccuuaucaguaguucugcuuuugcccuuuguccuguucccucaaaaguaugugaucuuuguuagacccuuauuauuaguucugcuuuuugcccuuugaagcaugugaucucuguaccuacucccuguucuuacacccccuccccuuuugaaacccuuaauaaaaacuugcugguuugaggcucaggagggcaucacgguccuacugauacgugaugucaccccugguggcccagcuguaacauuccucucuuuauacugugucccuuuauuucucagccggccgacacuuacggaaaauagaaagaaccuacauugaaauacugggggugaguucccccaauaacagagcaagacuccaucucaaaaaaaaaaaaaaaaaagucucacugcagccucgaccuccugggcucaagccauccuuaggcucccagguagcugggacuacaggugcaugccaccacaucuggauaauuuuuaaauuucuuguagagauggggucucccuauguugcccaggcugcagacuagccacacuucaagugcucaacagccaccuguggcuaacggcuacuauacuggccaauguagguaaaauauacagagaacacaagucauugcagcacgcugaugaaaaaaccauaaauuguauucaguggauuggcuuucugguuucucuaggaccacggguucuuccuagaaaugcaucuuucaauaauauacaagaaauaaaggucaguaaguuaaacugacucaguggggugaagugaggagucauccacucucaggaguaugaucaguaaagaaucugguuaguagcuggagagacagaaacucgaagcaggcuucucagccagugucaucaagugucaccagcuacgaguggcuauaauccuugacauccgagaauuuuauaauccugaccucaacugugccacacgguuccuaggcucagcaguuguguugaggugugaagcagggcacaccugccugcugggugagagaagggugcgcucgagggaaguggcgaauuggcuaacuuaggcagggcagggugugaagggcacaaggaaagucaggaaaagggauuaggggcuuagaggaguucccguaaggacugaugaaagcacugaguggacgggugugauauuguggaaauguuuuuggccuuucuccccauuucccagcuauaacuccuaaauuccuuggauucuccaaaguaauacgugucuuagaugguuguggcugggggcccccagagaacuucagcuccccaaccuccaggaaggggagaggggcuaaagguuaaauugaucaccaaugaccagugauuuaauccaucaugccuauguaaugaagcuuccacaaaccccaaaguaacuggguucggaugagcuucuggauggcuaaacauguggagguuccuagaggguggugcccuaggagggcauggaagcucugugccccuucccacguaccuugccugaucaucgcuucaucuguauccuuucuaaucuccuuuauaauaaacuggucagccgggugugguggcucaugccuguaauuccagcacuuugggaggcugaggcggcuggaucacgaggucacgaguucgagaccagccuggccaacauggugaaaccccaccucuacuaaaaauacaaaaauuagcuggcauuguggcgggcaccuguaaucccagcuacucgggaggcugaggcaagagaaucgcuugaaccugggaggcggagguugcagugagcugagaucgugccauugcacuccagcuugggcaacaagagcaagacucugucucaaaaaaauaaauaaauaaauaaaauaaacuguucaauguguucccugaguuccaucagccacuccagcuaauuaacagaacccaagggguggguagugagaaccccaguuuagagcuggucugucaaaagcacagaugaaaccacuuggggcuugugauuggcaucugaggggguggggcagucuugugggacugagcccucaaccugcaggaucucaagcuaucucuagguggggaaugccagaauugaauggaauuggacggugccuaucuaguguccacugcagaacuacuagcuugguugcuggugggaagcaauucccacacauuuugguuacgaggucacagaaggauucuauguuacgagagugugguaggaaaaucacacuuuguuuuuuucuauauccucaguggggaagaagcauagggugucgcucaaaacaguaggaaggaauuaguggcggggaggccaggugucaugagacagaaagaagcagaugccaccugguccccgcaaccaaaaggagcagagaagaggcaugccagcugcaacaacggagggaaugccuguggccagagcccuguccaggcuggcugaagacagaggggccugcuacaggcaacaggccacgaaagcagggagggcuuaggugagcaagugcuaucccagcaccuggacgugcagcaucggcauuguaacguuuucuucucuggcuacaagucaaggccaaaggaggaggcacuggaauuuucuaauuaugcuuuaugguguuuuuguuuuuuuguuuuuuguuuuugagacgaaguuucacgcuuguugcccaggcuggaguacgguggugagaucucggcucacuguaaccucugccucccagguucaagcgauucuccugccucagccuccugaguagcugggauuauaggcauccgccaccaggcauggcuaauuuuuguauuuucaguagaggugggguuucaccauguuggccaggcuggucuugaaccccugaccucaggugauccgcccaccuuggccucccaaagugcugggauugcaggcgugagccaccgcacacggccuacugcacuuuauacaguacucuugugguucagaacuguggaccugaggcuguuucuggauauaccuuucacaaaugccagggaucauaaagauuagcaguaguaucgccaaggcuauaaaugugauagaaaagccaacugaaucaaugucuauaaugguuugcaaaacagugauuuuuccaacuucaucauaacuuccguauuuauuaguuggcauuccacucugaguuuuccuucuccuaugaugaguuuuauuuuucaguauuaaacaaauuguuaugagcauauauuacuguuauaaugggggauaaggcguuuaaggaaagaaauccauguauggaggcugggugugguagcucacgucuguaaucccagcacuuugggaggccaagguaggaggaucaccugaggucaggagucugagaccagaccagccaacauggagaaagcccgccucuacuaaaaauacaaaaaauuagccgggcgugguggcaugucuguaaucucagcuacuugggagacugaggcagaagaaucgcuugaaccccagagguggagguuucagugagcugagaccgugccacugcacucuagccugggugauggagugagauucuguccaacccccuggcccaaaaaaaaaaaaaagaaaaaaagaaauauccauguauggagauagcuuccuuuuuuaaaaaauuuuuuugagacaggaucucucucuguugccaggcugaagugcaguggugugaucacagcucacuacagccucaaccucccaggcucaagggauccuuagccucccaaguagcugggacuauagguguagcuaucacacuaggcuaauuuuuguacuuuuguagagaugaggucucacuauguuacccagauuggucucaaacuccugagcuuaagcaaucugcccgccucagccucccaaaguacugggauuacaaguaugcgccaccgcgucuggggggaaauaagauuucuuauuccauuuauguuuuacagugagauccacauacaucugcauacaguguggagggugaggggugcagcugucaauuccacaaucgauugcucaagcauuacacaagaaccuucaucagaaaacccgggccccgggacuguccgaacucucuagagacagugauggcagaaguaagacuugagaacaagugcaaagcuaaccucagauucuguccaaugucucuugucuaccugcuaucugauaucccccaaaggaggacagcacugcugggguaauaucauuuggcugaaccucuuucauauacaaaccugcaggucuuuuugguccuucuuguuuuccagguugggaguucuuguuacaaagucauucagcaugcuguugggagacaaucagcuucagauuaaaaaugcugcagaaauaaaauaugugccaagagaaaauauuacacaaugacaauguggugacaugauaccugagaagcagaaaauacccagguggggcuagauucaacuguacagacucuuucaauacucccaacagugaagaaaaguucucuugcaaggcugguacugggagccuguuuuuuuaaaagauaggaaaaauacucaaccacgaacaagucaaaauacauuuauuuauaagcauauuuaagauccuggcaguuggaaagcaaaggguaaacagcauaccucacugaccuuuuucuuuuuaaaaacuuacaauguacaugagcuaaacuuugguauucuggcaaacacuuggaguuugagaaccugaaauccuacugcuggcaggugagauacuccugguuucuuugucucuaaaauaaaagccuuaaauuagaugaucgaccuugaccucucaggccuuuuuuuuuuuuuuuuuggugagacggagauuuacuuuuguugcccaggcuggagugcaauggcgugaucucggcucacugcauccuucgccucccagguucaagcgauucuccugccucagccucccgaauagcugggauuacaggcaugugccaccacgcucggcuaauuuuguauuuuuaguagcgacgggguuucaccguguugcccaggcugaucucgaacucccgaccucaggugauccacccgccucggccucccaaagugcugggauuacaggcgugagccacugcgcccggccuuucuucuauuuuauuuuauuuuauuuuauuuauuuauuuauuuauuuuauuauuguuuuuuaagauagagucuugcucugucacccaggcuggagugcaguggcacgaucugagcucacugcaaccucugccccccggguuuaagcgauucucguucuucagccucccaagcugggaguauaggcgcgggccaacacacugggcuaauuuuuuguauuuuuaguagagauuaguaggguuucaccauguuggccaggcuggucuugaacuccuggccucaaguaaauccacuugccucggucacccaaagugcugggauuacaagcgugagccaccgugcccggcugaucucucaggccuuucuagugcuaauauucugcuucccugaaguggcugguaacacagcaucaccugucagaaggcugcaaagcauuaggucccaggacacucaccaggaaacuggccuaccccgcucuguagcucucaggaugaggauucugagaucaccgcuccaaagcgaggaagcacaguccaggcagugaaagcucagacuacagucagagugucccagguccaaguccugguucuccaacuuacuaccuauugugugaccuaggcgguuucuccucugcaaaaggaggaugaccaaaucuaaccugcagcuccugggaaagcucagcugucccucaggccacuacacucaacauucgccagcaacgcaauauauauucgcugucacaggagggaagugaccggcucaucuuuaacuccuggaggaaagaacaacaaugaugcucacaagggaaguggucugaauuuaaccccacccuggucaucuaccaggaggccucaauuuaccguccugcaacuucagaauguggugagugggaauaacuauguaauguuaacugugugaaucaaggagccugugccugguuguuggaguuauuuacagugagacuccugauggcuauguaggcauagugaggcuucccugagaaguggucuauacccuucccacccccauuuuuuuuccuuuuugagauagagucucauucugucccccagccuggagugcaguggugugaucucagcucacugcaaccucugccuccuggguucaagugauucaccugccucagcuucccgaguagcugggacuacaggcaugcugccaccaagcccuggcuaauuuuuuguaguuuuaguagacauaggguuuuaccacguuggccaggcuggucucaaacuccuggccucaagugacucacccacucuagccucccaaagugcugggauuacaggcguugagccaccgcacccagccaccucacccucauuuucugcaacacagagcugcaccugggaugcagccauuguaagaucugaaugagguccaguaaagcuucuuuuucauccauggggaaaaaccugcggaauccccuuuaaugcucucuuagcugagacaccuaauacauauauuaacuuagcaaaucaaagcagauaccucuccacauaaaacaugggaaggcacacugagaacgccaccagaaacaaucauuuugccuuuuuuuuuuuuuuuuuuuugagacagagccuugcucugucacccaggcuggagagcaguggugaggucuuggcucgcugcaaccuccgccuccuggguucaugcaauucuccugccucagccucccgaguagcugggauuacaggcgcacgccaccaugccggacuaauuuuuguauuuuuaguagagauaggguuucaccauguugacuaggcuggucucaaacuccuggccucaagugauccgccugccuccaccucccaaagugcugggauugcaggugugagccaccgcgccuggcccauuucuccuuuuucuaaaagaggucuuuaacacuucccuauaugugguuuuuuucuuuuucuguaucaauuuaaugcaaauccaagccuuuuaaaguuuaacaggccucacauaaagcuucgcucauauaaaguguucaaaguacgcugcacagauuuuaagauguuaacucucuggagaaggaaaagcauagaucaauaccuugggaagaaauuaugacaacuuuaagauauuuucugaacaauggcucucuaguagucuagaaauaaaaccagauauuuauuaugcaugcucacugcaauagcaucuguauuuaaggaaguuuuuggaggacgggggacuguauuaccuuuggagaaaagcauagcaaaacugcaacacaggaauguccacuaggggcgauuucugaaaaugaaaguaaaaccaauuacuccgaguuggugggaaauaaggcuaaaagaauucagauacaaaaugaaacagaucuauagccuaacaaagcaaagguuuuugacuaaagaaucuuucagauauaacaacagacaugauagugcccaucauguacaauuaaaacaaguguguccuaugaguccccaaaucauucacauccccuuagacuucuacagugaucucccacccugugcaccuacuuuacauuccaggcgucaacaggcauuucgggaaaauuggcacuguaaccgaacuucccaaacagaaagcuagggccaguguugacuccagugaaugcauaugauuaccaagaggcaagaaaaaauucuaauucuucuuucuuucuuucuuucuuucuuucuuuccuuccuuccuuccucccucccuuccucccuucccuuccccuucccuucccccuucccuucccuuuccuuuuucuuucuuugcauuccuucuuuccuuuuuuuuuuuucuuuuuacaagagucuugcucuguugcccaggcuggaguacacuggugcaaucucagcucacugcaaccuccgcuucccagguucaagcgauccucgugccucagccucccaaguagaaccaccgcacccggccaaaaaauucuaguucuuaguuuagaagaugacuccaagcccagcucagacagcuuccccaaaaacccuguggcuggaacuacuuggaaacaaguucuaaaacacauauuuuacccccuccuugcuuguaaaaagcuauuugcagcuauuaauuaacuaaacuaaccacaaaauguaguuuuguuauuugaaccgccaaaaaucagucagcuagauaaaauccgguuccuuuauagcccaggaaagacuagaaauugcagguauuuguagaaauucaaguaaugugaaggaauacaaccuaaacacacucgcucuggcugucauagccucugcagagcugucuucaggaccucgaagaaccccuugguucuacggcgaccaagccugcagcagcacagaccgcccuguggagcaccauucccacuccuaacauuuauggacaagaaugaaaggaggccaggcacgguggcucacaccuauaaucccggaaguuugggaagccaaggcggguggaucacuugaggucaggcauucaagaccagcguggccaacauggcaaaaccccaucucuacuaaaaauacaaaaaaauuaacugggcaugguggcgcaagccuguaaucccagcuacucaggaggcagaggcaggacaauugcuugaacccaggaggcagagguugcagugaaccaagaucacgccacugcacucuaggcuaggcaacagagcgagacuccaucucaaaaaaaaagaaaaaaaaaaaaaagcccgggcgcaguggcucacgccuguaaucccagcacuuugggaagccgaggcggguggaucacguggucaggagaucgagaccauccuagcuaacacggugaaacccugucucuacuaaaaauacaaaaaauuagccgggcgugguggcgggcgacuguagucccagcuacuagggaggcugaggcaggagaauggcaugaaccugggagguggagcuugcagugagccgagauugcgccagccugggcgacagagcaagacuucgucucaaaaaaaaaaaaaaaaaaaaacagugaaaggcaacaggaugaccauacguucuuggaagauugggagaccugggccagauccccaagaaauacuguggaagucauccggguccuuuuacauucgaagccuuaagcacugacugagcucgcuccauaaccuggccucgcagugcuguuauuuuuuaggauggcuucucuucucuucucucuucuuugccaaccuagaauauaggaggacugagggcaggaauugcuuuuuccacuauuuagccuccacgacaccacucagugcacauagagcauugucgauuaacacuggaacgaaggaagagaccaggagcuggaggauaacugacugggugacgcccaacggccaggcccucggggccuggacauuucuauagggggcugccccgugucauaugugaggcugaaaaaaauggcugaaaaaaaagucuuccgauucaucugcaguucauuagugugaugauuggguguucacgcacaugcgugauaugugccacccucaaacuuuguuacaauggucggcacauugucugaugugaaaaaaaaaaaaagucuuucuuuuguuuucagacagggucuugcucuguacuggagugcaguggcgugaucuugacucaaugcagcuucaacuucccuggcucaagugauucucccaccucagccucccaaguagcugaggcuacaggugcauaccaugccuggcuaauuuuuuuuuucuuuuuagagucaagguuuuacuuuguugcccaggcuggucuuaaacuucugggcucaagcaaucccccugcuucggcuucccaaagugcugggauuacaggagugagccacccuuuaacacucuaaaaucauaauaucuaucuaccuaccuacaucuaucuaucuaucuaccuacaucuaccuaccuaccuacaucuaucuaccuaccuacaucuaacuacaucuaucucucuaccuaucuaccuaccuaccuacaucuaccuaccuaccuacaucuaccuaccuaccuacaucuaccuacaucuaucucccuaucuaccuacguaccuacaucuaucuaccuaccuacaucuaccuaccuaccuaacuacaucuaccuacaucuaucucucuaccuaccuaccuaucuacaucuaccuaccuaccuacaucuaucuacauaccuacccuacaucuaccuaccuaccuaccuacaucucucuaccuaccuaccuacaucuaccuaccuaccuacaucuaucuaccuaccuaccuaccuacauccaucucucuaccuaccuaccuacaucuaccuaccuaccuacaucuaucuauuuaccuaacuacuucuaucuaucuaucuaucuaucuaucuaucuaucuaucuaucuaucaucuaucuacguaucaaccuauguuuuuacguguuugucugcaguucuugguucauaacuccugcccuccuuugaccugccccaaggcaggacucuaaucugacuacgguucauaagacccucauucuggagaggguccugucccacacccuggaggaagcagugcugugcagacaggccaagaagaaucugaacaggcaggcccugcuagguuuccccagucacuguauuaaguauuagaucacacucuuuuuguccaaucacacuucgacacgguuguccaugcuuuagucauacccauccaaugaaguuuccauaaaaggcccaagaggacuggguuuggugagcuuccagagagcagagcacaugaagguucugugcccacggagggcacaggagcucugcaccucuucccccauaccuugcccuacgcaucccuucauuuguauccucaguaguagccuuuauaauaaaccaguaaacguguuucuggaguucugggagcugcucugacaaauuaacugaacccaaagaggggguucgugggaaucccaacuugaagcuagucagucagaaguuccagaggcccagacuugugacuggugucugaagugaagggugcucuuggggacugagcccucacccugugggaucugacacuaucuccaagcagauagaguaggaauugaauuggaggacacccaacugguguccacugcggaaucaauugcuugcuugcugguggggagaacuccccgcauauuugggguaagagaagucuucuguguugauuguuauguuguugagugaggacacaguuguuuuuuuuuuuccagauauagaacuguguuaguccucuugugacuggcuuauuucauucaacuuaaugucuucaagguucauccauguugaggaucugacauccauguuguguagcacgugucagaauuucauuccucucgaggcugaguacuaacgcgcugcacgcacagaucucacuuuguuauccgcacacccacugagacacacagggauugcguccaccuuuuggcugcugugaauaaugcugcuaugaacaucgguacacaaacaccuguucaaguauagcuauauuuuuuaauaaucacuuuuuccauugcacgaauuuucuuuuuuuuggacagggucucacucugucacccaggcuggagugcaguggcucaaucauagcucacugcaaccucgaacuccugugcucaacugauccuccugucucagccucccaaguggcugggacuacaggugugcacuaccacacccagcuaauuuuuaaauuuacuguagagaugaugucucccuacauugcccaggcuggucucgaacuccuggacuaaagugcuaggacuacaggcaugagccaccaugcccggccccccuaauuuucauuuagauuauucuuaaauuuuugcuaacuguaugauuuuaaacuguucgacagaaggcaauuauuucaagauugaaauaaaucccugguuuuuauuaaauuaguuaauuaagagcaaaacagcucugcugcuuucaaugaugaagacugcuuugguaaaaacagaaauagaagacucuaagggaaugcaaauauuaaaccacacagcuugcccuguuuuaaauccaccguguauaauugaagaagcucucuagacaacaugggcccuccaggcugcuguaaugaaauugagcagaaaaauuacaaggaacuucucgguucaaugacaucacccugaagguuucuguuucacagcagccagaugaaaucuccucuuucucagagugucuaucauuaguuauguucucugacauuuauuuucuaccuuuauaaaaaauuaugcagccaggcaugguggcucucgcccguaaucccagcacuuugggaggccgaggcaggaggauugcuugagccuaggaguuccagaccagccugggcaauguggcaaaccccgucacuacaaaaaauauaaaaauuagccaggugugguggugugcauguguggucucagcuauuugggaagaucauuugagccuggggaggucgaggcuauggugagcugugauugugccacugcacugcagccugggugacagugagauccugucuuaaaaaaaaaaaaguuuuaaaaaaaauuaugcaaauuuuggccgggcacgguggcucacgccuguaaucccaggacuucgggaggccaaggcaaguggaguucaagaccagucuggccaacauagcaaaaucccgucucuacuaaaagaaaaaaaaaaauacaaaaauuagccgggcuugguggugcgcaccuguaaucccagcuacucaggaagcugagacacaagaaucacuugaaccccaggggcgggguugcagugggcugagauugcaccacuguacuccagccugggcgacaaagugagacuucaucucgaaaaaacuaaacaaaacaaaacaaaaccaaaaguuagccaggagugauagcaugcaccuguacucccagcuacccaggaggcugaggcacaagaaucacuugagcccaggagguggagguugcaaugagcugagaucgcaccacugcacuccagccugggugacagagugaaacugugucucaaaaaaaaaaaaaaaaaaaaguuacacaaauuuuaauuugcccuugacaaagacucucuccuugagcugauucuagcuaggcuccucugagcccucugcuugacaaaugauucuguccacccccacagccccaaacaacacuagcauggaucccuaggauggggacaccaguccucuucaaacacuuguccgagaaagcucaagguugccaaauaauuuacuguuuguuccugcgagaccccugaccucccuuucuuagagcauuuucuuuuaaguuuacaaugauaaauacuuucucugucccuuugagauguguaugugucucccacaaccuaggaauguguuucucaaggaccugggagccaucccuuugaaacagaaucaucaagaaagacagagucucgaucucccagccucugugggaggguaggagccucauuuggauaagccccaguuagcaaacccagauggccuaaucacaucuauggacugagcagccuccccaccugcucuuuuguaauuuucuacuucuccaacucuccuuaaacuuccugcuccuucccccucccuccucccucauccuuucccagucaucuccacacaaaucuaaacugaacccaacacuuucccuuaccgcagugguuauugaaucacaucugucuuuaccaucuuucacuagagucugguuuuguuuaucuuuggcaucuuuauggcugcgagcuccuugaggcaggugccauuuccucuuucuaaagauuuuauuccacuuggugcccagaaggcgcuaacccauguaccaggcaguguccucagcagcaggguacaaggaaugagagccccugaccucaggcaguucccaacuuaaaaaagaagcaccagaucuucauaggucucccccaaagcacagcaaacagcaccuccacuucacuaccccaagcauucccacuagcucuuguuaccuauccuucccucccaaacacgauuuauaaggaaguagaguuaugacaaaugccacccacuaaucugcagaagcccagaggcuuccccaggcuccucaccucaucacccccuuugacuugggguggccucuucaccaccuccuucaccaggugcagcagcgugucagucugcagggugcugagugcacacaccaagucgacaaggguuagcugggaugcacuugccguugggauaaucugccaagaaaaaaaaaaguuccuugaaagcuuauagagagaaaguaaaaauaaggaugacacauccuuauuguauucuacaguagucgucccuggagaaaucaaucuguuuucaucucuuuuuuuuuuuuuuugaaacacggucucacucugucacccaggcuggagugcaguggugcgaucuuggccaccaccacgcccagcuaaguuuuguauuuuuaguagagaugagguuucgccauguuggcuaggcuggucucaaacucccgaccucaggugaucugcccgccucggucuuccaaagugcugggauuacaggcaugagccgccaccgcgcccggccuguuuuaaucucuuaaacaaacauuuccuauugaacuagguaaaggcuccacccaggggaacaacauaauuugauacaaauuaggaauaaaaggugcaggccaugauggggcuguaauagugguauguuugaauuuaguagaaagcauuuuagaaacaaauauacuaaauuugaaggaaacaagagauggaaucaaaaauacgaagacaggaaguaaaaacagauaaaccaggcucccauuugcuagccuuggaaggaaagcccugguaugggaggcauauuuuugaugacagaagucugcauacccuggucaugggcauuuggaagaaaaacaacuagcaccagguuccucaccagggaaggagccgacaggcgcucaggaggguggccuuggacacugaccacugacucuuccucagagaacaggcgcccaugucugccacaaaggcugagcacugggggagugucaaggaggugcagcagcagaucccgagcaggggauggagcaggggugggagggaacaaaggaagaggauugagguugaaaaagguaagccgaccccugcaggacuucaucauggaccagucaaguggauaaagaacgggcaaaauacaaacugauauuaucuuugggcucacgccuguaaucccagcaccuugggaggccgaggcaggcggaucacgaggucaggaguuugagaccagccuggccaacauggugaaaccgucuuuacuaaaauuacaaaaauuagcugagugugguggcaugcaccuguaaucccagcugcucaggaggcugaggcaggagaauugcuuaaacucaggaggcagagguugcagugagcugagaucgcucugucucaauagaaaaaaaaaaaaagaaauuaucuuugggcauagaaauaugauuggugauuucaauuuucuuuauuaucauggacaaauguaauuuccuuuuuuuuuuuuuuuuuuacaugaagugucacucuguugucuaggcuagagugcaguggcacaaucguagcucacugcagcuucauauuccuggcuucaagugauccuuccaucucagccucccaaguaacuaggacuauaggcgcauaccaccaugcccagcuaacaagugugauuucuacacauuaaaaaagcaauaagaugguacuacaaauaaaaaaaggcccacagugcuaggauaagugaccauuucuuaagccaaauggguggcauguucuuagguaaaguuuuuuuuuuuuagauagggacuugcuuugucgcccaggcuggaaugcaguggcacaaucauggcucacugcacccuccaccucccaggcucaagugauccucccaccuuagccucuugaguagcugggacuauaggugcacaacaccacgcccggcuaauuuuuugccauauugcccaggcuggucucaaacuccuagacucaagcgaucugcccgucuuggccucccaaaguguugagauuauaggugugagccacugugccauuuuuauucuuuaaaaauguucauguuauauauacucuuauauguauuuuagauuuaaaaagauuaaacacaaguacuauauacucauuacagaaaaauuagaaaacagaagucaggugcgcucuucccuaccugcccaauacacauucuacuuguacugagacacagcuauauuaucucaugcauuucaaaugaugaaaucggcaaggugugguggcucacgccuguaaucccagcacuuuaggaggccgaggugggugggucaccugaggucaggaguucaagaccagccuggccaacauggcgaaacccugucucuacuaaaaaauacaaaaauuagccgggugugguggcgggcaccuauaauuccaguuacaugggaggcugaggcaggagaaugacuugaacccaggagguggagggugcagugagccaagaucgcaccacugcacuccagccugggugaaaagagagagacuccaucucaaauagauaaagaaauaaaauaagauaaaaugauuaaaucaacucaauaguuucccaugcuggcuuccaaugucaccuuugauuccacaugauucugugguauuucuuugucacaguaaguuuaaccacuccuguaacuuuuuaaacuuuaccuucaucuuacugugacgcugggcuuucuuucugcuccacacugccgcaacagccgcugucaacugaaccccaagaugggccgucaagggguuuaagaagucuaaaauuuuuugucuuauggucuagaaaauagggaaaaaaaaguuacugcagaguaauauuggggcuauggcaucauauacauugaaccaccacugcuguccauaccgagagcaaggacccugucauguuugugcccaauguugugcugaggugcuucccugauggguggaucccagcaaugggaggaaucaaacccuuuccgcaaggagcuagaugugugauguuggcgugucaugccggcggggggaaggggcagugagcagccaagguggagagacggauggccagcucgauuggccaggagcaucucgggagacgaugaauaucacccuugcugcugugagcacagugggggucuugcaggaagccgggcaaggcuuugcagcacugcuuccaucuggaaaccccacagccucagccugacuccaucugcugcggaagggcuuauauucauuaggaaaguuguugcucaauuuccagaaauaagcaccauuuaacuaauuuuaucagguaaucaauuuaaaccuguaacaugguccugaugucacucagcacccucuguuuugcuacuuaugaauuucucuguguucccgccacguuucucgcucuguaaauccuaccgcucucucagccugcagugcccaccguaguuaaauccucuccgccuggggccucagcuaagccaugccgccucaggaaccccaggucaggccaggccuccuguucacacacucucaggaaacccuguguuucuuugaagcccugcucacaucguuauuacacugccaguuaaugucugccucugccacaggggcagggacuucaucucucuuguccaccgguaaagcaagagagccuggugcguggcagcaggcacaaaaugucugucgaagagacggauuuacccagcgcuuccugugacaaccgcccauguuuauuucacauuagauacaacugagccagcaauggagcuguccccucuuuuccaccauggcuucugcucuagagggacuaauguggggucccgcuccccggcccuggguuccucagggagggcuaggaguuaagugccuaaugagcaucggccuuuaucguaauuacucuuucccucaacccaugaggacaggaugcuagccacagccugguuuaacagacgaggaaauggaggcucagagaggcugagugcuacaggaagcuccccuaaaaaagguuuagaaaaucuuuuuuucugagugagaaaaaagguuuucugaaucuuuuuaagagcagguucuuauaggagcuugaaauacagaauucccuuggcacccuaggaaccgacagaaugucuggaggccaacaacgcaccgugguaccuaaaugcaggauggcaaggcucaucccugcggccacaucuggcaccugggggcucucaacugaugucagauguggcagauaauucugagaugccacacacaguaacacagauggugagcgaccgaguccugcgccuacagccuucugaggcagacacugaaaaccaaagacuaaacuauaauauaaauauucacaguugugcguuuuugguuuaagaacucaaaggcacccugacauuccacucugauggggccauguuugacaggcaccgcuaaaagcagaacagagaugagcugucucgcagaaaugcuuuagagacucaaggcuggggucucuagaucauuuagaggugaggaucuagguauccccgcuuugaaccacuagagacuauuguuuuugagacagggucucacucugucacccaggcuugagugcacuggcgugaucucagcucacuucaaccuccaccucccaggcucaagcaauccucuugccucggccuccugaguagcucggacuacaggugccugccaccauacccagcuaauuuuuguauuuuuuguagagaugggguuucgccauguuggccaggcuggucuugaacuccugagcucaagcaauccaccccaucuuggccucccaaagugcugggauuacaagcaugagccaccgcgccuagcucuagagacuuuauuuauuuuaauuauuuuuauuuuuuuuugagaugggguuuugcucuguugcccaggcuggggugcaguggugcaaucuuggcucacugcaaccuccgccucccagguuccagcgauuuuccugccucggccuccugaguagcugggauuacagacacgugcuaccacaccuggcuaauuuuuguauuuuuaguagagaugggguuucaccauguuggccaggcuguucuugaacuccugaccucaggagauccauccgccuuggccucccaaagugcugggauuacaggugugagcuaccaugcccggccaagacuuuauuuuuaacuacaaaauaaggugaauggaaaauaagaagaaaacaggcugaaaccacucagacuccuccauuucagguauaggaaacuuacugauaacaaaugaacuagagauuucuacuucugaucucugacuuggguuucauugagcacaucuguuuaucaugcacacuuuccuauacacauuuauuuuggguggaacaauacaagaccaaguaaaugacagaacuacagagacauccucuuacuuuggugguuuuaaaguaaacggaagaggaucccuucguggccccuaggagaucgacaggucucuuuugagucuccuccuuucugagaacauuccagagaagggccaugguguuaacaguucgaggcagcucuuccaaaauggcauuucuggcauuccucaaguuggcaggaucaccugcagccauggucuaaaaauuaaaaugaauacaugaggcaggcugugucuguggaaugguuuuucuucccacgagggcagcagugcuagcgggauuaggucugggcuguuggacucucuucuaagcaacucauacaugugguggucugggagcaauaagcuucucugugcauuucaacccaugguucucuuucacagagacagcugugagucugauguucuaaauuacaaacuuuucaaccauucaaccaaaguguuagauguauucuaagacuuaaucccaggguauucuacaggguagaauaaccaacagcuaaaaugucugccuacucagauuucaugaacaccaugauagcaaguaaaaaauacauggaaaaagaugacuauaagccuaaaaucaaacaaguggcuuuauaaguuaucucacaggcuacugauggaacaaugggcaaagggcuggcacagggagugccagcaggaagaaaacuauguuugcauggcugacauacauacuuaugcauuugcguuaauuauauacaugcauuugcauaugcauuugcguaggcacuugcauugcuaacacacaugcauuugcauacguguguacgugacuuauguaauauuugcauucacauuugcaucaccuccauacgcauauuaguuacagacauuacauacauacguuacuuauuugaaacagucauagcccaaagacaaaacaauacaugaaaauugccuugaacucaggaaaaaaaaaaauuuaccuuuuuguuuugguuggcuuguuccaaaagacaaaaaugacuaauggucguuagaccuucuagaagggugaguggauaaucuggagaaauguuuucccucuuggagguugugcuguggugaagaaaagagaaacugguuugagaauuuuuaaagaaugaggccauaaggguuucuaauccuauauauaaacacaggaacuagggagagaucaccaucccaaauaaacuggagcucucgucauagaauaucauuauaauaauguuaaccauccuuugugugauuuuacauucauauagucacuuuggaaaaaugguuucaauguuuuagaauuucugugaagaugauucacauuuuuauuucuguuuugcaaaaauaguagagaguagcugacaugcccugcaacacugagcuagacuggguaccugugcggauuugaaauaaaggaucagggcugggcgcaguggcucccucuagcaccccagcacuuugggaggccgaggcagggggauugccugagcucaggaguucaagaccagcaugggcaacacggugaaaccccgugucuacuaaaauacaaaaaauuagccagauguggcgguaggcaccuguaaucccagcuacucgggaggcugagacaggagaauuguuugaaccugggaggcagagguugcagugagcugaggucaugccacugcacuccagccugggugacagagacucugucucaaaaauaacauaacauaacauaacauaacauaacauaacauaacauaacauaacauaauggaucagaacauuuaguugcuuguuaccccucuugauaaugcuaaacaggcuucucauugggaugaaauuauccuccaaccgacauccacauccguggcaaaacagucauucguuauaaaaaccaucacuaaagcaauaaagaugucacaaggagcguaacgcaccugacagagagcuucacagauucgcuuucauacugcuugaccaagucauccaaguuuuugcaaaucuggacaacaaagggugucaccguccagcccagggacuuuccgaaguagggcaaggaaugcgugaccaagcucacccaggccggaugcaugccguaaccguaggcgggcugcagaccccucaccaccgcagagaccagaagacccugggaggugaggggguggggcugcacguacugcagggcgcugauggccugcuggaaguucagggcucucugccacucccgggacaggucgggcugguuuuccgccuccucaugggcccgacccaggugguguuccaagacaaucagcaccugcagcagcuucagcagcucaaucugcagcgggugcucacuccagaucugguccugacccaaguuaaugagacucuccucaaagaggcuguccucuggcagggcccugccguggugggcgguggccagcccguagcgcuucuggcucguguacauggacgccgacagggagagcaggacaaacuccugaacuuugcaccucugcagcaagcuguggaugaacuccacguucuucccuuccgaagacuuggccacugagaccagcugcaucauuauccugaucaaaaccucgacacuuuugaccugcacgucccgguugccgagaaugucucggugcgagaccuucaaauagcaaggguaguaggagcgcaggaagcucaggcagagguaggugagcagcuccaggagcagagagugggggcacacguuggggaccugggucuggagcuuuccguagaaacucuggccaaugagggccuccugguggcgagcgaggagguuggagaugagguugaggugcgcgguggagcugguauccaugcuaguccuggacacagccucgaugaauuccuuaggguugguuuugagcacagccuccagcaccgagaaggcauagaggacccgccgagagucguagggcugcagguagagcaggaugugcuugaacaaggccucgacggccuccugccuuucccgcugcugcuuuagcagccuggauguggugagggccuggagcuccaaguccgccuccucgucgcuggagaacgacucagaagccugcgucuuguccgaguccacccgcaccaggcuuaacuuggccccagccuugaagcuuucugacuggaaggccgccagcagggccgagcgcuugggguacgcccugccccccauggggaugggugcacagcaguucucuucguugcucagcuccugcaggucgugggaaggggaggagaaggaggacguguucucgcuguccguguggcaggagcuuguaucugcagacucggugugcucgcugcuguccggggcgccgugggccguccugucuggaagcuccacguaguagggcagcucuuccucgcucagcucgccucgcagcggguacuucucgggcuccuucuccacuucggcccaaauggcuucacgguccacuguggugaacuggcucagaggcaggugcucuucagagccgcucuccugaggcucgggcacugcgcaugccucucugaaagagguuuucuuccuguuaaaccaacggugcaagucaucugaaaauuacaagaugacaaaugacuuuagacagaagggucagcuaugauacauuagcuguagggcggucuuugucuuaaagccagacagaaagaucaauauuccuaaaauucucacaugaaacaccaccaccagaguccgguuuacauuacagacaaaaguagacaaaggaagguggauagguuuuacagaauguucaaggaugggaucauuuaguuacauuguuauaguaaacuuaaguauuuuaauuuuuuggaggggagcaauuuuuaaaaauacguauuauuuuuuccuaggaauucucuuucaagaaaugucuccuggccgggugcaguggcucacaccuguaaucccagcaauugggaggccaaggcagguagaucaccggaggucaggaguucgagaucagccucgccaaaauggugaaacccugucucuacuaaaaauacaaaaaguuagcugggcgugguggcaggugcuuguaauuccagcuacucgggaggcugaggcaggagaaucauuugaacccaggaggcagagguugcagugagcugaaauugugccacugaacuccagccugggcaacaagagcgaaacuccgucuuaaaaaacaaaaaaacagaaauguauccugcagaaaugucagcagaagacuuucaaagccauaaggauguggauauucaccgaaaugucacauguguauaaagacaaacuggaggcugggugugguggcaugguggcucaugccuguaaucccagcacuuugggaggccuaggaggacagaucaccugaggucaggaguuugagaccagccuggccaacauggagaaacuccaucuacuaaaaauacaaaaauuagcuggacgugguggugcgugcccauagucccagcgugggagacugagacaggagaaucacuugaaccugaaagauggaaguugcagugagcugaaaucaugccacuacacuccagacuaggcaacagagugagacucugucucaaaaaaaaaaaaaaaaaaaaaaaaaggaaaggaaaaaucaggccagguacagugaauuaugccuguaaucccaauacugugggagaccaagguaggaggauuguuugggaggccaaggccaagguaggaggauugcuugaucccaagaguuccaaaccagccugggcaacauggaaaaacuccaucucuagaaaaaauuuaaaagcuaucuagguauggugacacacacuuguaguccuagcuacucgggaggcugaggcaggagggucucuugagcccaggaguucgagacugcagugagcuaugauggugucacugcacuccagcuugggcaacagagugagaccccugucucuaaaaagaaaggaaaaaaaaaaucaagcagcagaagaguauuauguagaaugagcccaguuaggagagaguauguauaauacacagccacuaggaaagucugggagacuaccugcaagccauuaacaaucccuaguucuaucaacuagcauuacaaaggacuuccacuuagguuuuuauguccucauuauuuccauuuuaaaacuaaccauguuaguacuucuauaaucagaaaacguaugacacuuuaaaauauugaagucuuuuuuaggagaagucaaauaggccacugaccacugccuauuuaaaaaaaaaaaaaaaagaagaaaaggaaaaaaaaauuagugagucaaaagucuuugauauugccaaacauuuuaaauaagcaguguucaauaaaucuaugccaugagccgggcaugguagcucauaccuguaauucuagcacuuugggaggcugaggugggcggaucacuuggggccaggaguucaagaccagucuggccaacauggcgaaaccccaucucuacuaaaaauacaaaaauuagcugggcguggcggcgcgugccuguaaugccagcuacucaggagucugaggcaggcgaauggcuugaaccuggaaggcagagguugcaaugaaccaagauugcgccacugcacuccagccugggccacagagugagacuccaucucaaaaaaaaaaaaaaaagaaaagaagaaaucugucauucucauaagguuuuuaggaugaucaaacaagauaaaggcacacaaaagagcuuuaaaaaaacucuaugccauggacauuaagcaagaucaagaaaugaagaagaaucagacaucagaaauugaugagcugcuugaagugcauagcaguauuuuaaaaauagauuucuacaggauuacagaaauagggugggguaagcaggacacuuaucauuuuuuucagagaaagaaaauggcagagcaaagauguucucuccuauucggagguagcagaccauuucuguggucagcaggaaacacagauuagaggaagcagcaagguagugcuggggaacuuuuaaagcccaaggaaggccaggcguaguagcucaugccuguaaucccagcauuuuggaagguugaggcggguggaacacuugagcucaggaguucaagaccagucuagccaacauggcgaaacacccaucucuacuaaaaauaccaaaacuaaggcugggcaugguggcucacaccuguaaucccagcgcuuugggagguagaggcgcauggaucacuugaggucaggaguuagagaccuaaccuggcuaacauggugaaaccccgucuccacuaaaaauacaaaaaauuaguuggcugugguggccagcgccuguaaucccagcuacuugggaggcugaggcaggagaauugcuugaaccugggaggcaaagacugcagugacuugggaucacaccacuguacuccagccugggcaacagagugagacucuucuucaauaauaauaauaauaauaauaauaauaauaauaauaaugcccaaggaacuguggagauagagcuuuccucuuaaaacagaaagaaaaagaaauacuaaaaaauguagcugccaugaauaguagccaaacuuuuaagaagguucuuuguuuacacuucuuucaguuuuacuuucuuacaauguggaacaauaaaauguuuccuauuugauagggcagccagcuuuuccccuaaaggaaaaccagagguuagagguuuaggccaggagccuuauaaagacaggaaaccauuucacacaccucugcuuacuuagcuaauggguugcuuuucucuguaagauaagauugagauagccaggcgugguggcucaugccuguaaucccagcaauuuaggaggcugaggcgggaggaucauuuggggucaggaguucgagaccagccugaccaacauggugaaacccugucucuacuaaaaauacaaaaaaaaaaaaaaaaaaagaaagaaagaaaaaaaaauuagccaggcaugguggugcaugccuguaaucccagcuacucaggaggcugaggcaggagaaucacuugaacccgggaggcggagguugcagugagccgagauugcaccacugcacuccagcuugggugacagagcgagacucugucucaaaaaaaaaaaaaaaaaaaaaaagauuaagauaaauacaggauaagaaaaaacaagaacuggcuaaauacagacauuuguccuuuuuuuccuucacccuugaucuggagaggggggugucuggagcuuauuccuuugguuucaacuucucgaacagcguuagcuuauaacugucuuugaagugagcuugcuaggcagaggaaaacuuguucuucuuuucuuucuuuuuuuuuugagauggagucucacucuuuugcccaggcuggagugcaguggugugaucuuggcucacugcaaccucugccuccuggguucaugccauucuccugccucagccucccgaguagcugggauuacaggccccugccaccaugccuggcuuauuuuuuguauuuuuaguagagaugggguuucaccguguuagccaggauggucucgaucucuugaccucacgaucugccugccucagccucccaaagugcugggauuacaggggugagccaccguccagcccuucuuuacuuuuuaacccuugucuugccacauucugggccuugguuuuuacuucuuagacuaggucacuacaaccuucuuauagccuugucuguuacuuuucuuggaaugaaugaaugcaguacuucuucuuauuauuauuuuuaaauuucugccucaagcuaaacaaacucacucaaaguuugcaaaccaucccuuagaaaauugugaagucauuaaauacagcuauuguaggaaguaauguuaguucauaaaaugcauuagauauuaaucacugaaguuuaauugacucaucaggcuuauuuaguuuuucuuuucuuuccuaauuucuaccuauauucuuuuauguuuguguuaaagaugccucuggaaguucucugaacugaaagguuuauuucuucuucauuucugauaaucugauuaacaagauuuuauagucuaaaagaaucuuagagcacagauagaaaauaaaccacuuaccuuguaguugaagguucacaaauaaguuauuuuauuuauuuauuuauguauuuaugaaugacagucucucucugucacccaggcuggagugcaguggcaccaucucagcucacugcaaucucuaccucccggguucaagagauucuccugccucagccuccugaguagcugggauuacaggcauguaccaccacgcccggcuaauuuuuguauuuuuaguagagacgggguuucaccauauuggccaggcuggucuugaacuccugaccucaggugauccaccugccucagccucccaaaaugcuaggauuacaguugugagccaccgugccuggccaacuuuccuuuuuuaauaacaaaacaaucugguuuuucagugaaaacagcaaacccacucccuaauaguucuaaaugcuagaucacuagguccuuaaauugccgaaguccucacaauuuacaaaguaccauuugcaucuaacaaaacccccuagugggccucagucucucagcuaucacugcugagguccaguccccccacccauuccucccucacccucggguccugugcaggcugcucaccggccgaguucuccugcuugaggcaguggauggagguucucuggguuuuuggcugcagcagcagcaggagcacggguucgaggaugcgagccacguccccgagggagagcgcacgcaccagccagcccugggcugccgcaccgauggcaccauccgugcaggccaggcuguccagcacgacaaacaaggaccugcagugggaaacacaccagugaguucacucgcagccaccccugugcgccaggcaccguggcagacacugggcauagggcgucacccaacacagguacccuaggaccuccacccaagcuggacuuccagacccaaguagaugagcacaauggggacucaacuuugguuucgcguuggaaucaccagugggagcauuuaaaaucccaaugcucaggccucaccccaaauggguuauauaucugagucugggccugggccucaggcaucagaaucagcuggugucucuaaggccgagugccuggccucacaccuagaguuucagaggcacucgggaaaaacaauguggaauacaaugggcugcaaucaaguucaccucuuaagcaugagacagugaugggacaagcacacacaccaaguauggucacugcuccaggggaggucuaggccaucugaccucccugcaaaguccccucauaggggcaugccguaaaagcugcacaggugaucccggggcaugccaggauuccucacaucccaaccaaauuaagaaaauuccuaacauguguucacaugugucuggccuaaauucacuuagggguuuaugggaaccacuggcugugcucggaggggucaugugcaggggucagcuuuucuuuguuugagauggaguuucgcucuugucacccaggcuggaguggaguggcgcagucucggcucacugcaaccuuugccucccggguucaagugauucuacugccucaccaucccaaguagcugggauuacaggugcccaccaccacgcccagcuaauuuuuguauuuuugguagagaugggguuucaccauguuggccaggcuggucucuaacuccaggccucaagugaucugcccgccucggcuucccaaagggcugggauuacaggcgugagccaccacacccggucauauggguucauguuuucaacugcacgcuccucucccuccccagccccacacguugggcaggcaccucuguggaguuuccucgugaguuaacgguagaucauaacgaaggccgccucaccuaucaaaggagcgauugugagauguuacucgacugccuuggaucucucuugucagaugccagaucacggaaaaucuaaacagagcuuccagccuuguucccuugaugaggagauacaugggagugaggaacuugguuuuguaacugaccacugucuucagucaccauaaaccccauuuaaacaauagaucaaagacuucagcagaacugacagcaaccacagcaaagacgcugcauucuccuuugacugauucggccagaaggaaaaggagaaccugcauccucucucucugauuguucacuuuaacacagcggcacauucagaacucaguauuagaguccagggucaccccuguggucugcagccaaaggaaaacacaaaggagcauggcuuccuugcaagugucaggcccaagugucuuaaagaacgaggagacacaacagacuggaaaggagacccaggacgauaaauucucaauaaaauauauucuuuuaaaaaaauugguuuauuauuauuuuuauuuauuuauuuuuugagacggagucuugcucugucacccaaaccagagugcaguggcgcgaucucggcucaccgcaaccuccgccucccagauucaagugguucuccugccucagccucccgaguagcugggauuacaggcaugugccaccaugcccggcuaauauuguauuuuuaguacagacaggguuucaccauguugcccaggcuggucucaaacuccugaccucaggugauccgccugcuuuggccucccaaagugcuggaauuacaggcgugagucacugcaccuggccuuauuuauuuauuuauuuuugguagagauggaucucacuauguugcccaggcaggucuugaacuccuggccucaauuucucccaccucagccucccaaaaugcugggauuacgggugugagccaccacgcccugcuucaauaaguucuuaaagggacaauaaauucccuacaacugccuauuuugccaacaccugcagaagcccugcaaguccuuccagcaaguuugggcagguuucccuggugagccucaauauggucacaaaccacauuuccagggcuguaaaaagaauggcucaugcuucuaguggccuuccaguacugaaauccuagaacaccucugcuuauuuuauuaaucacgauguccacucagccccagaaagacuucgaccgaauggaugucaguuggcuaagggcacguacagcaggggccggggugcugcaggauggagguggcggccagaaaggcucaccuugucaggguccaggagggcauggcagaugauguccucgcagauguuggccguaggggccaggcagugcagccgguagaacaauucuacgcaggugacgugaugcucccgggucucuuuguucagcugauuccaaagcacacgagccacccucugggacaaggaaaaggcaggcggugggggaccaggucaacacaggcaacauccgcucacauccucacucagucagucccagccccgacauacuggaucucaccuauacuugccaugugagaauccuccaugcucagagacaaaucaccaacaaauaaagcaagaaaccuaccaaaggcugggagcgguggcucaugccuguaaucccagcacuuugggaggucgaaguggggcagaucaccugaggucaggaguucaagaccagccuggucaacauggcaaaaccccaacucuacuaaaaauacaaaaauuagccagguguggcggcgggcaccuguaaucccagcuacuugggagggugaggcaggagaaucacuugaauccaggaggcggagguugcagugagcugagauccugagaucaugcaacuacacuccagccugggcaauagagugagacucugucucaaaaaaaaaaaaaaaaagaaaaagaaaaagaaaaaagaaaaaaaggaaaaacccaccaaagucauccaggcagcaggcaauguuauaggaggucaaaccuggagguuucuggccgacuaagaacacugcagcucuugccucaaccucaacauuacuuucagaaagagaauuaacuggaaacuggaccaaagggguugaagcauucuuucaacaggcaggugccgagcaggcacuggggaaugcacagauguacccucuggggaguuuggugaauuuacagugguugucaagaucacucauucugggguucagcuccacagcacuuggucaccucuggggucugcucgaauugguuaccacgcagcauggauaaagagccacgccuaccagcuuuaauuccacuaacuugacucuucccuuuucccugcacaacgcuguggcaggugccugccucacuuucaaaacacuauuauacccccaaaucguguccuccaucuucccagcccugaacugagcucauuaaacaugcauggucugcaaagggcuacagccccuugccaaguggcagggagcaggagccagugugccugccccaacaagggugagacccagaaggagggcugguccccacuuccgggagggaaauuucuaaauuucuaaagacauucuuauacuucauagacuauaugaaguuuauaucucauagacuggaguauuuuaggcauaacuuagaucaaauaacuucuuuggcccauuuauuucuacucaacaaaaccgucuuucucugcauagaucaaguuaaccacugacuggcucaaacuccuaaccauuauuuuguuacuuuuucucuaagggaaagugauuuccaacaaucacauuacaauugaauucugauauauaacuuuuugacuacguagaccgccccccccccgacuuccuugcugucacuauggcaaauauauaugcaagagacucccuuccggaagguuuaaaaaauuuuuuugcaagguuuuugagaguugaugccgaucacaaauccauaccuacucccucauauauauuuuuuugaggcagggucucacuaugugccccaggcuggagugcaguggcacgaugucaacucacugcaaccucugccuccuuggcucaagugauccucccaccucagccucccaaguagcugggacuacaggugugugccaccaugccagguuaauuuuuguauuuuuuuuuuuuagacaugggauuuugccguguuggccagacuggucucgaacuccugagcucaagcaagcagcccucagccuccuaaagugcuggaugcugggauuacaggcgugagccaccgagccgggccuuccuucacauguuuaaaccuuacucuacuccucuguucuggguguugucuuaguuaucugaaaucugccaacacuaccugauaagaaaggucagggcacccuugggcuaucugaccuuuucuuguuugcacugugggaagcaggaacucugguaugugagcuguucccgcaggauuaaaaaaaggcugaaagaucagacaacagcccugucuggagucugagaauugggggcacguccuggcuauggguaagguugcugugucucuaguuccagcaucugcaacagggacaggcacuagcugccgcuguccucaacucucaagaacuguacaguacauaaaagugugcuccaaggaauaaaucuugguacucuacugcacaguagggugacuacugcuaacaauaaugcauuguguauuucaaauugcuagaagagaggguucugaauguuuucacaacaaagaaaugauaaaugcuuaaggugauggguaugcuaauuaccaugauuugaucaucauacaauguauaaaugugucagaauaucaaauuguacccauauauauauacaauauuacaugucaauaaaaaaaguaugcucuuggccgggugcgguggcucacgccuguaaggcacuuugggaggcugaggugggaggaucacuugaagucaggaguuugagaccagcguggccaauaugguaaaaccccgucucuacuaaaaauacaaaaauuagccaggugugagggcgcacaucuguagucccagcuaccagggaagcugaggcaggggaaucgcuugaauucaggaggcagaggccaagaucaugccauugcacuccagccugggcaacagagcaagacucugucucaaggaaaaaaaaaaaagaaaaguaugcucuagugccaggcaaaugguaaguacuugaauauguacuacaugaaaaugaaaguaaaaaucaaggcuucaguaagaacuuggaaaagcuucccucacugccccaaaauaaaaggaauguauuuaaugcugccacuuuuauucuaugaguaccuuuccaaagauucaugaucucaauucuuucuucuuuuuucuccccugugccuauauauaguguaaauaugccaaauuuucugaucucugaucuauguagggccaagaugacacuugcuuaaucacugcugcuuauagcgguuccaguccugguuucaaguucugucuauucaagaucuaaugugacucaacucuagcaggaagaagaaaugugguacaaaagucaauaagcagcugggcacgguggcucacaccuauaauucuggcacuuugggaggcugaggcgggccucccaaacuccugaggucaggaguuugagaccagccuggccaaugcgguaaaaccccaucucuacuaaaaauacaaaaauuagccaggugugguggcaggugccuguagucccagcuacucgggaggcugaggcaggagaauugcuugaacaugggaggcagagguugcagugagccgagaucgugccacugcacuccagccugggugacagagcgggacuccgucucaacaacaacaacaaaaaaagucaaugagcaauuaaguaaaagcucccccaggaccugacaccguagauggugucccacauggaaccaaagcugagcggugugaggaguuccacagacagacccucucccaagcaacacaaccauaacuggugaaaauuauuuuaaaaccaacaacaaccaaccauuuagagucuggaaauuauccaaaggacauucaggaaauaaagaaacauuuauuccggaaaaccuacgacauuucggucaaagcagcaagagucauggcacuugagccaugaccugcucaucaucuccuuccuuccccagcuuagcuccauggaaacgucacuauccacucuggugcauguggccaagcaaaagggugcucucuuuccccagcucccagucaagggcuuuugcaccuccugggaggggcaggccaccagcacgucaccuucccaccccucugcuggauguggcagaggcuaaauccaggugagugcaguggaggagucaugggcucccugccuccacccagaccccacucccaggcagggguuccacucaguccuggcaggcccagaauacuggggccccaguugcucucacuguagcuuuccuggagggugaaaguuacaugcugggagaggaagaccaaaggcuacugccucugcccagugcccuauagaauaucacucucagagaagugggccacugcccccauccccagcaauacgguucugaguuuugcucagggggagaaggaggccauaagaagaguguucccagugggaaauaccugauagaaaucuguuuucucugcaaugacuuucaauaucccuggagcaaugggaggaaccgucaccaucugcagcuugccaaaaaaaggguuguguccagagcucuuauagcguuucaucuugucuucaaugacaagcgccagggacugggaaugguuuaucacuuccagcagaguggaaauggccacguucuggagguagcagucagucacacagcagcaaauagucaugagggacuucagccaagauggaaaacuggaaucaccggcuccugaaaggaagccagccggagaggcagaaacaagcagaaccacgugagaauggguccccagucugcagauucuacagcacccuagaucugggaaguuaccugagaaauccaccuggacagcagugcgcuaaccucccgcuggugagacuuauuuggaaauaagguccuuacagagguaaucaaauuaagaugagguuguuagggugggcccuaauccaauaugacugguguccuuguaagagggacaugucaagggaagacaggacauacagaggacacccugugaagacaaaggcagagacgggacugaugcagcugcaaggugaggagcccuccaaggguugccggccagcaccagaagcugaagaggccaaaaaguauuccauccagggucucagaggaggaguauggcucugcugacaccuugaucuuggacuucuggcuuccagaacuaugagacaaauuucucaguuuaugguacuuuguuagaggagcccuagcaaaccaauauauaaaauauuggccaggcacgguggcucaugccuguaaucccagcacuuugggaggccaaggcgggcagaucauaugaggccaggaguuugagaccagccuggccaacauggugaaaccccaucucuacuaaaaauaugaaaauuagggggccaggugcaguggcucacgccuguaaccccagcacuuugggaggccuaggcggguggaucgcgaggucaaaagauugagaccauccuggccaacauggugaaacccugucucuacuaaaaauacaaaaauuagcugggugugguggcgugugccuguaaccccagauacuugggaggcugagguaggagaaucacuugaacccgggaggcggaggcuguagugagccaagaucgcgccacugcacuccagccuggcgacagagcaagacgcugucucaaaaaaaaaaaaaaaaaaaauuagcugggcguaguggcacgugccuguagucccagcuacuggggaagcugaggcagaagaaucacuugaacccaggaggcggagguugcagugagcugaguuggugucaccacacuccagccugggcaacagagccagacccugucucaaaaaaaaaaaaaaaacaaaaaaacccaacacaaaaaaaacuuuaucaacaggcaucaugaaauagucuauuuacuaucacugaaugccacucauguucuaggucuucugaugggcugugcuggacacccaggguuuaaaaacauaggccccacccuuaccacuuugccauguggugagacacaagucaaaaauguacuaauuacaaaugaggaagggaacaaaugaggccaauagcaccuucuuggcuuacacaauuugagcuagucuuuaaauauagguugagaaucucuaaucugaaaauuccaaauccaaaaccugaaaccuuauuagcacugacaugaugcucgaaggaaacagucacuggagcucuuggauuuuggauuucuggauuaggaaugcugaaucgguaaguguaaggcaaauauuccaaaaaucugaaaaaaguccgaaauccaaaauacauuuggucccuagcauuguggauaggggauauuccacccacgucaaucgccucaucguaugauucccaaagagggacuucggcagggcugccucucaccuggcagcuggaagagcguugcacagagcugcucggucucuuccucggacagguagacagggaaaguggcacaauccagcagcagguggcaggcggcggcaaaggccucccugcguuccucccuggaaccccccaggucaaugaccaccuucucaacaucccauucucccccguuuuuccuggcagggcugcugggcgaagacgauggugacucugaacuuuuugucuugaauggagacccucgugcugugaacaagucugacagcaucugcuugaacugaggcacagugaugggcuugggcucccaagaguucuuccugcuggaaucauuggcugccaggcucugcgucccaucccugucccucuucccugcaggcuccucggacuugcuuucuucuccugacgcugucagcuguacuccaaaaauguucuugcuggcaaaguuggcgauuagcucuuggaugcaaagaaacguccucugcaugcucccgcccuucuuccaaacgucgucccuuuccagagaaacucgaggaacccucaagugcucagagagcuccggugacgaggcacugagcccgaucccacuguccucagacuucagagggggaaacgaagcaucuucgucaccgggaaucacugccuuuguuuccaaaauuauuuugccguuuucaccuuuuacuggacucuguaaaaaauaaaaagaugugaauugugcaucucuuaacaccaagcuauuuaaguaucaguugaaaucaugaauguauuucaauucuguuuuucaaaaucaucacucuccagacuagagaaucccuguguuaaguguauaaugaaauuuaggaggcacccaaagcaggagaaggagagcgguggguagcaaagaggaggcugguacacccacaugcucucuggggaggcuggcuuuugggccuauuuuucuuguguuuuugucuaaauauauaaccccuuuagaguucaaaaaaguuguuuaagaauuguuucugccaggcgugguggcucaagccuguaaucccagcacuuagggaggcugaggcgggcggaucaccugccacaauucucuggacaacagagcgagaacuguuuccgacaaauuaacaaauaugaaugaggaaacugagcugaggguaaaauaaagguaugaagaaauaaaauaaggccaggugugguggcucaugccuguaaucccagcacuuugggaggaugagguggguggaucuccugaggucaggagcucaagaccagcauggccaacauggugaaaccccaucucuacuaaaaauacaaaaaauuagccaggcaugguggugggugccuguaaucccagcuacuugggaggcugaggcaugagaaucgcuugaacccaugagguggagguugcagugagccaaaaucaugccacugcacuccagccugggcgacagagagagacucugucucaaaaaaaaaaaaaaaaaagguaaagcaagucagagaauaguguacguuauggguugaacggugucccccaaaaauagguugaaguccuaacucccaauaccugugaaugugaccuuaauuugaaaauagagucucugcagaugauccaauuaagaugagaucauuagagugggcccaaauccaguaggacuggauuuauaaaaaggagagaucuggacacagagacagacaugcacacagguugacagccaagugaacauaaaggccgagacugggcugaugccuggacaagccgaggaaugcugaauauugccagcaaaccaccagaagcucgggggaggcaugagacagacucuuuuuccccagugcacucaggaggugccaaccuugcugacaccuucgugucaggcccuggccuucaaaaccaugagaaaacaagugucuguuguggaagccacccagucugugguacuuuauuauggcagucccagcaaacuaauccaguaccucaucucgcuuauauucgaaauaaccaaaaucacaugccacaaacacacacauaaaacagugcagggcuaguuauaacuagcccauuaacuguaguuacauaguuauuaacuguaucuaaccauuaacugcaguuacagagcaggcaaguagcaugagaaugggugaaacaaagggugcuaaacuuaaaaauuuuuuuuuguagagacagggucuugcucucacucaggcuggagugcagccgugcaaucauggcucacugcagccucaaccuguugggcucaagcgauccucccaccucagccuccugaguagauggaacuacaggugaacaccaccaugccuuuuuauuuuauuuuauuuuauuuuauuuuauuuuauuuuauuuuauuuuauuuauuuauuuugagacagagucucacuuuuucgccuaggcuggacugcaguggcacuaucucggcucacugcaaggucugccuccuggguucacgcuguucuccugccucagccuccugaguagcugggacuacaggcgcccgccacugcacccggcuaauuuuuuguauuuuuaguagaggcaggguuucaccauguuagccaggauggucuugaucuccugaccucaugaucugcccgccucggccucccaaagugcugggauuacaggcgugagccaccgcgcccagcccuuauuuuuauuuauuuuuuuuuuugaaacggagucuugcucuguugcccaggcuuaagugcaguggcgugauggcucacugcaaccuccgccucccagguucaagagauucuccagccucagccucccaaguaacugggacuacaggcaugugccaccaugccuggcuaauuuuuguauuuuuaauagagaugggguuuugccauguugguugggcuggucuugaauuccugacuucaggagauccacccgccucagcuugccaaagugcugggauuacaggugugggccacuguacuuggccuaauuuuuauuuuguagagagaugaaggcuugcuauguugcccaggcuggucucgaacuccugggcucaagcaauccuccugccccagucuccgaaaguguugguauuacaggugugagccauuguaccaugccaggugcuaaaaccuuuuaaagugaggguuuuacaagcauauuugacauaucaccuggguaucuucucaucuuuauuccuauccuaaccaacccuaaagacuuucuacucccaggaaggcauaagcugcuuuuagcccccagaaccauuucugccccucagaguacacaccgagguuccgcugguggacuccgugucgagguaggaaggaggcaucuggacuuugcugagcaccuugaaacacgucuucaaggcaugcgugaguucagguaaacuuaaggccuccauguccucagcaagaggcugcaccaggcagccgagcaccugagggagauacuggguuugcaccucagaguaaaguuccugugaaauaaacguguagguuaaccccacaauguugguucacaaucagaaaaacaaugcaucucaaaauggcaucuaauucaauuuuuuagggcauaaauuucacacuaauuuucuuucuuucuuucuuucuuuuuuuuugacagagucuugcucuguagcccaggcuggagugcagugucgcgaucucggcucacugcaagcucagccucccggguucacgccauucuccugccucagccucccgagcagcugggacuacaggugcccaccaccacgcccggcuaauuuuuuguauguuuaguagagaugggguuucaccguguuagccaggauggucucgaucuccugacuuugugauccauccaccuuggccucccaaagugcuggaauuacaggcgugagccaccgugccugacccacauuaauuuucuuuuuuauuuuauuuuauuuuauuuauuuauuuauuuauuuuuuugagaugaagucucacucugucacccaggcuggagugcaguggugugaucucggcucacugcaagcucugccucccagguucacaccauucuccugccucagccuccugaguagcugggacuacaggcgcccgccaccacacccggcuaacuuuuuguauuuuuuuuaguagagacgggguuucaccguguuagccaggguggucucaaucuccugaccuugugauccgcccaccucggccucccaaagugcugggauuacagacgugagccaccauaccauauuaauuuucaaaucagaaaacaaaagaagacuaggcguaguggcucaugccuauaaucccagccagcaccuugggaggcugaugcagggagauugcuugagcucaggaguucgagaccagccugggcaacacagugagaccccaucucuacaaaaaauacuaaaacuauccagaugugguggcacaugccuguggucucagacacuugggaggcugaggugggaggauugcuugagccugggaggaugaggcuacagugagcugagaucaugccacugcacuccagccugggugacagugaggcucuaucucaaaaaagagaaaagaggaugggcaugguggcucacaucuguaaucccagcacuuugggaggccgaggcugguggaucgccugaggucaggaguucaagaccagcuuggccaauauggugaaacccugucucuacuaaaaauacaaaaaauuagcugggcguaguggcaggugccuguaaucccagcuaccugggaggccgaggcaggagaaucacuugaaccccagaggcggagguugcagugagccgagaucacaccauugcacuccagccuggacaacaagagcaaaacucugucacaggagaaaaaaaaaaaaagagagagagagacagagaaaagaaaagaacauuucuauuguuuuuguuugagacuggaucauguuaugcuguccaggcuggucucaaauuccugggcucaagcaaugcuccaaucucagccuccugaguagcugggaauuacgagcgcauaccacagagcuaggcucgguauuucaauuugaucuagacaaaucaaggauguuacuccucuccuugcaaguggcuuuacacuuucuaauaaaaaauaaaauuggcacguuucuacauuaaggaaauuaguuuccuuugagaaaauuagccaacagcacaauuuuaacuaggaaauguauugacucuuucccuaaaguaacuguaguacgggaaugauacccaguucuucagcugguugaccuaacuucagcuuugcccacuuacaacuggcccaaaaguuauagccccuuuuaaauaagacauuaaaaauuuaagagauuacauccagcuauaucuuuuaugccaaaacaaacaucaaaacaguguugcauauuuauguaaaacauuuucaguaaugugagguugauaaagcaggccaucaccaccaguaagaauguaaauaauagcaggcguugagaugucccuuccccagcacucaccaaaggaaugacauccagcaggaagaccaggagggcgcagagcuccgagaccguggggggagggcugacgcuguuccucacgcuguaacgcugcuucacuggucuauaaaucacagcaaagaaaaaauccauucuuuggccaggcauggaggcucacaccuauaaucuuaacacuuugggaggccgagauggguggacugucugagcucaggagucugagaccagccugggcaacauggugaaaccccaucucuacuaaaguacaaaaaaauuagccaggugugguggcccacgccuguaguccuagcuacuugggaggcugaggcaugagaauuacuugaacccgggaggcagagguugcagugagacaagaucgcaccacugcacuccagccugggugacagagcaagacucugucucagaaaaaaaaaaaaaaucaauucuucuuccugcgguaaguccaagcauuucuuacaauuuccaguaacguuauucuacuucaaacauaauggaaggcagcuuuuguaguucucauaacuaaauuuuggugacuaaaaguaucuaacauguagaagugucaauaaguguccugaaucuguugguguccaaacagauucccucugacuugaacucuaccaauucaggugucucccaggagaccuggaguaccaucgacagauguaaucccaaguccccaguccaagcccaaaagcacgauccaagggaacgaggcugggcuggagaacaccacaguccacauggcuguucacccugcuguaggaguggccugggacuacuccucuccaaguaauuccaggaguuuaucagcaccugaguugccuagaaaguuucagcuucuguagagaaguguaaccccaccaaucaacuauuguuaguugcuuaucuuauacugaaauucaagacuucuuuuaaaauaaacaggcuacuagauaaauggguaaguuaaaaaguaucuauugcuuuucaucucauaacccugggaugaauaaauuaacuguaauaggauccacaggcaacagcaaagccauguuacacugaagacagacauuaaucucaggacagggauuaacucugggaugaaaagaggacaaaauguugcaaagauggagagucagcucuaucuggguagaaacauuuuauucuuuuuuuuuuuuuaauaaccaggauggccagaugcggcggcucaugccuguaaucccagcaauuugggaggccaaggcggguggaucacuugaggucaggaguuugggaccagccuggccaacauggugaaacccugucucuacuaaaaauacaaaaauuagcugggugugguggcgugcaccuguagucgcaguuacuugggaggcugagccuguagucucagcuauuuaggaggccaggaugggaggaucgcuugaaccugggaggcagagguugcagugagcugggaucgugccagugaacuccagucucggugagagacagagacuccgucauaaaauaaaaaauaacauaacaaccaggcugaccaaagcauacucuaaccucaauauaauauggccuugcuguugccuguggauccaauugcaauuaacuuauuuuucccaggguugugagcuuauuugggcagaaaaguguagugguagcagcugagaaguaagacucugaaacagccaagagcauuacaguggagaugaacaagaaauaaguuuuacagcaugccucaggacaaaacaggguuugagacaugaccuuauuccucccguaaagaaaauggcaugggaaagggcucuccaggaaagcucgguauuccugggguacgccacugcaaacaauuuagggguggugcaauucacccgguuaaaagagaugguaaagcugauuauaguagcuuaaaacauuaaugcuuuuaucugaccaguuacauucauuucagcaagaguuucaaaaacacucuauccagucacaaagccacaaaacuaagcugcuuucaauagaucgggcagccaggagaggaaagcugauuugaugaauguaaccagaaaaugcgcugaggauuuucuaaaguuagacuuuuaaagcagcuucagaauuacauggcaaagauuaugugaaccuucuuauuggagauguuuuuauucugcuagaaucuuaagugaauucuuuccaauccuguuuuaguugaauuuuaaaacucaggaaagacuacucagcuucagcuacuuauauauaaucugauauucuaagcagcuacaaaauuauuaaacccucucauccuuccuaaauauucugcauucuugaacugcauacuuaccuaaagcauuccucaaaacaccuugucauauaaucccagagaaagucugugcuuagagaaguuaucagcaaauuuaccguuuugacaaucucagaggcauuucuguuuuccuugauugcacuguaaaaggggaggacaugaauaaauaugucuauaaaaaaauccugaauuacaaaaaguguccaaaaaacuguaauugauuucaccaucugcaacuuauuucuagagaagcugacacacccugauaaaaaugaaaauauuacuguucuuauaauguguuugcauaaugccaucguaaacaauauuuauauugauacagucucuuaaaaauaaauuucagagcugggugcgguggcucacaccuguaaucacagcacuuugggaggcugaggugggugcaccagcuugaccaacauggugaaacccugucucuacaaaaauacaaaaauuagcagggcaugauggcggauaccuguaaucccagguacucaggaggcugaagugggagaaucgccugaaccugggaggcggagguugcagugagcugagauugagccacugcacuccagccuggaugacagagugagacucugucucaaaaaauaaaaauaaaaauaaaauaauaauaauuucagagcuacuguaaaaagaauuuguacagaaaaucaguuuuaguccauacucuacugguggaauaacaugguacauggauauucagcagggaaauucagccaagauuuuaaauguuuaucuucuuuuuuuuuuuugagacacagucucacuguuuccuaggcuggagugcagugguacaaucucggcucacugcaaucucugccucccagguucaagcgauucuccugccucagccucccgaguagcuaggauggauuacagacgugcaccaccacgcccagcuaaguuuuguauuuuuaguagagacgggguuucaccgugauguuggccaggcuggucucaaacuccugaccucaagugauccaccugccucagccucccaaagugcuggaauuacaggcauaagccauagcauccagccuuaaauuuuaucuucuauggcucaggaaauuuauucaagaaauuuauccuaccgaaaucccugcacagcuacauagaugugugcagaaguguaccacuaaauggccauuaaaaaauacugaaaaaggccgggugugguaguucacaccugcaaucccagcacuuugggaggccgaggcaggcagaucacuugaggucaggaguuugagaccagccuggcaaacauggcaaaacucugucacuacuaaaaacauaaaaauuagccagauaugauagugggcaucuguaaucccagcuacucgggaggcugaggcacgaaaauugcuuuagcccaggagguggagguugcaaugagccgagauggcgccaccgcaccccaggcuggguacagagcgagacuccgucucaaaaacaaacaaacaggcugugcgcaguggcugaugccuguaaucccagugcuuugggaggcugaagcagguggaucacgaggucaggaauucgaggccagccuggccaacauggugaaaaccccaucuccacuaaaaauacaaaaaauuagccaggagugguggcaggugccuguaauccuagcuacucaggaggcugaggcaggagaaucacuugaacuugggagguggaguugcagugagccaagaccacaucacugcacuccagccugggcaacagagcaagacucugucucaaaagcaaacaaacaaacaaaacugaaaaagcagaaacugucuaaaagucaaucaauaagaaauuggucagucaggauuuauuauuuuuauuuauuuuuugagaugaagugucgcucugucgcccaggcuggagugcaguggcacgaucuuggcucacugcagccuccaccucccagguucaagcaauucucaugccucagccucccaaguagcugggacuacaggcauggcccaccacacccggcuaaccuuuguauuuuuuuuguagagaccagguuuugucauguuggccaggcuggucuugaacugcugaccucaagugauccgccugccuuggccucccaaagugcugaaauuacaggcgugagccacugcacuuggccuuaaauaaaugauaaauccuuaacaaauaucuaaggcaacuaaucccauaggagaauaguguagagcuacucacaacuugcauuuuaaaaaacaagcaguggccgggcacaguggcucacaccuguagucccagcaguuugggaggcugaggcaggaggacugcuugaggccaggaauucaagaccagccugugcaacauagcaagaccuugucucuacagaaaaauuaaaaauuagccaggugugguugugugugccuauagucguagcuacuugggaagcugaggugugaggaucacuugaucccaggaguucaaggcugcagugaccauugauggugccacugugcucuagccugggagacagagugagaccuugucaugcuggagagugacacuccagagaguaccaggcauggcggcucacaccuauaauccuagcacuuugaaaagcugaggugggcagauugcuugagcucaggaguuugagaccagccugagcaacauggugaaaccucaucuccacaaaaaaaaaaaaaaaaaauuagcugggcaugguggugcaugucuguagucccagcuacuuaaggggcugaggcgugaggaucgcuugagcccaggagacugaggcugcagagagccauguucacgccacugcacuccagccugggugacccugucucaaaaccaaacaaacaaaccaacaagaaaacaaaaagaaaaccccaagcaacuaaauaacugguguaauucuaccuuuaaaauaaaagacaggcaucuauguauuuauguauguaguagaaaucuagaaagaaguaaaaauguuuuaugguuuucucugaagagugcuaggauuacgugugacaccuuuuuucuugaucuuucaaauaucaguaaaugcaacaaugagcauguauuacuuucauacucagaaaaacaauaaaccgcuuucauucugggagaaaaaagcaaacacuaagaacucuuaguacacuuacaacuaacaaaccagaaaaauauuaacauugauuuaaauuuucaauguacccaaugcuaguucaggcagaaggaaauuacauuaagaguaaagcaaaaaggaaaaaguuguauucccuuaaaaggaacaaaauaaacaaacaaaacaggguuuguguguaacugcgcacgugaggccaaugugcccgcugucuuccaaacaccacucacucugccucugggggaauggagccugugcucuccggugcccugccugggucucccccaaucucccccaacacccccuggacuccuguccugaagacucacauccccuuuccacuugccaggugcccuccccuccauuuucucuguucucucugcccuguaacucaccacuuggguauacuagaucaagcugccuuuguuaaacgaguuucauacuugaucaauacauacauuucauuguuucauacuugaucaaaaaaucaauaaauaccuguccaucccaggcugggggaaagacuauaucaaacucccuuuaaacucuucaccguacucaguagggaacagucaauucccauggacugacuucaacgcauugauuauuuucaccaauggucucaccugcugcaucucugcuuucucuaccacuucacaauuuauaguaagcaagagaggaaaaaaaaaaucacaguaccggggagggagagagaugcgugagguucaaggccaaacccauaccuuaucagcgaauuuccacucuggguguagcuaaguuuaagaucagagccaagggcaucucugcaguaagaauaaaaggcccugaugacuucgagaaacaaauucccaaccacuugaggcccuguaauuagaaggaagauggucagagacagauuaacaauccccuuuaaaucaguaagugacauauguauauacauaagacauauauacaguaaaccugugcagacagacauuuuauauagucuaaaauauacagaaacuuaacuuuacuggugacaacuuuagcuggggaaacaacauucaugaaaauagccaacauuuuuguagaacuuccugugugccagacacccuucuacgcguuuuacaucuauuaacguauuaaacccucguaacagccaugcagacagauccuguacugcugauuacacauaaggagauggaagcacagagagguuaaguaacuugcccaaagcagauucugcuagauagaggcagagcgcagacuacguguguuaagugugcauaaacugcuggccagggacguuacucaacagaaauauccagagagcagggcaacuucuucaauuccuuuagucaugagcuggagcaacacaaaagaaaugauggcuauccugaaacgcugagaaagauggcacaaaagaacuggaccagcugcauguuagagaagcuucccugcaaccaggcaggggaugggcagggcauugcugcuccgcaaaccgcaacccucaggcagcugagggccugacuucuuacccauguauccaaaggcagaaacacacaaucaauucagagaaaaugaaagcucugucaacacuggcaaaaaagcagauuaauccaaucuuuuacacuucuuuucacaaaaccaaaagaugugccucugagagaauuauuuucaugcuaaguuuccuguguauuuuuuuuaagauagaauuuauuauuauuuuuuuuggagacagagucuugcucuguugcccaggcuggagugcaguggcaugauuucagcucacugcaaccuccgccucccggguucaagcaauucucucgccuuagccacccaagcagcugggauuacaggugugugccaccacgcccagcuaauuuuuauauuuuuaguagaggugggguuuugccauguuggucuugaacuccugaccucaggugaucugccugccucggccucccaaagugcugggauuacaggugugagccaccgcaccuggccuuggcuuccuguguauuuuaucuacagcauaagaaugcuaaaugcuuguuacaaaaaugaaggcaauuuuguugccuugauugauggaggaggaaaugagguauggcuaaagcccagccacaaaaaguauggacuggacugaauggccguccugugccuucuaguucuguauaaucaccuccuuugccuccugagugugauuucuugcagacagcuaaaaaauuggaaagaguaaauuaagugacuguuaugauugggcaggagcgugauauucauuugcuuccagaaaauacgaccuggagccaaguuagcagcaacguuuacuuggcucaccaaggugcauggcuuugacauaaaacacacaucuccagaaugcuaaguuauauuuucuucuuuuaauacuucccugaaguuacacagcaagcucccaauacauuuauauaaguguuccacuuuuuggacuaaaucaugauuuuucagagcugcaguuacucuacacuagcaggaaaaucuauuugguuuaaggugggagcgggcagaugggaagaggaaucugaacaaagugcagacacccugaggcagcacaucaugggcagagccuggaagaacaaaagcuucauacuuggacuuucguuaagaaugacgagagcugcacaacucuuggaauaaaguucaccuggugacagaggcaaacaucucggguaggacuucucugagugcaaucaggcaagcaucggggggugcugacaaacccagcuuaggcuccugacuggcccugggcaaauuaccuacucccacccaaccuuagucuuuccauuuguaaaacaggcauagugggagaaccuaccuugggguuguuggagggacagaggugugugugcagacagauauaaaaggauguauguaaaucacuuggcacaaaauaauugcucaaaaaaugucagccaugguuauuauuaaugaacaguaaaaacacuccaggaacauggagucuccccuucccucuaacuucaugagaagcugcuccccuuuugucccccuagagcuggcaccaucccugccacauggcagaugcucugugcuuuugaauggauaagcgaagggccuccaucccaaggccagagagaggccacuucacuaaugcccucagcucucuuuuuuuuuuuuuuuuuuuugagauggagucucgcucugucacucaggcuggaguguaguggugugaacucugcucacugcaaccucugccucccagauucaagugauucuugugccucagccucccaaguaguugggauuacaagugugcacaaccaugccuggauaauuuuuguauuuuuaguagagaugggguuucaccauauuggcuagacuggucucaaacuccucaccucaagugaggcccaccuuggccuuccaaagugcugggauuacaggcaugagccaccacacccggccagcccucagcucucuuguccucugcaaacagcuaccaggagguagguacaccuggagcacugaaaugacauucuuaggcuugcaauccuauggaagacauggggaucuuuucccugguauagggcucacauaagcagaugcagaccuuaaagugagcugauaugguagcaaauuucuuuuuuuugagacggagucucacucuguugcccaggcuggagugcaauggugcgaucucagcucacugcaaucuccaccuccuggguucaagcaauucuccugacucagacucccaaguagcugcgauuauaggugugcacugucaugccuggcuaauuuuuguauuuuuaguaggaaugggguuucacuauguuggccaggcuggucuugaacuccugaccucaggugauccaccugccucagcuucccaaagugcugggauuacaggugugagccaccacaccuggccgcaaauuucuuuucuuuuugagauggagucuugcucugucgccaggcuggagugcaguggcgcaaucucggcucacugcaaccuccaccucccugguucaagcgauucucuugccucagccucccgaguggcugggacuacaggcacgcgccaccaugcccagcuaauuuuuguauuuuuaguagagaugggguuucaccaucuuggccaggcugguccugaacuccugaccucaugauccaccugccucagcuucccaaagugcugggauuacaggugugagccaccacaccuggccgcaaauuucuuuucuuuuugagauggagucuugcucugucgccaggcuggagugcaguggcgcaaucucggcucacugcaaccuccaccucccugguucaagcgauucucuugccucagccucccgaguggcugggacuacaggcacgcgccaccaugcccagcuaauuuuuguauuuuuaguagagaugggguuucaccaucuuggccaggcugguccugaacuccugaccucaugauccaccugccucggccucccaaagugcugggaucacaggugugagccaccgugccuggucgcaaauuucuuuuuaaagugagggagagggccaggugcaguggcucacaccuguaaucccagcacuuugggaggccgaggcagguggaucacuugaggucaggaguuugagaccagcuuagccaagaugaugaaacccugucucuacugaaaauacaaaaauuagccaggcaugguggcacaugccuguaaucccagcuacuggggaagcugaggcaggagaauuaauuguucgaacccaggagacagagguuuuagugagccgagauugcgccacugcacuccagccugggcaacagagcgagacucugccauucauucauucguucauucauucauucauaaauaaauaaauagugagagaaggucacuuuucucaaccuaugcucauaggaccauaguaucuaagaagggagccuuuggugaccagagucuaguucaacccucuucauuuuacagugaaaauguuuuuacucuccacagugaaaagaaguggcuugcccaggaucccaaggcaaaaagauggacgggguccccuacuuaauugaaaaucaaaccaaagcucauuuuaaguaugacauugaaaaaauaggcuuaaaaaggaaauaccacauguucuguagacacuauaggagcucaaagguauuuuccuaacaaaaaauguucaaauuauugugcaaaacuuuuuuuucagacugggucucacucugucgcccaggcuggagugccgugguacaaucacagcucacugcagccucgacccccugggcucagguggucuucccaccucagccacuugguagcugggacuacagggaagcaccaccacgccuggcuaauuuuuuuguauuuuuuuauagagaugggguuuuucaacauggcuuuucagccauauuacccaggcugguuucaaauccaugagcucaagugaucuuccuuccucuaccucccaaagugcuaggauuacaggcaugagccacugcgcccagccaugcaaaacuuguaagugaccacagauaugaucauugaaccauauaacaugacuucaaaguugugaaauuccaaauauuaaauuauauucaaaauaacgcuuugguuguaucucaccauguuguauuucccugaaaacagguaaucuguauucagcauaggauagaagcagcauuucuaacauuaccuauuucuggcuugucaagcagacugaugaggacgcgaaaaggcuucagguaugcaugauggcguuccuccacgucagcaucuaugaacuucugaugcaauaucucagccaaacccuauuauuuaaaaaaagccacauauuagaauaucguauaucauaaaguguaacaacauuacuggcuauucuaauuguuaaauacucugggacagaaggaaaaccagucacccagcaugcaacaaauacccugcaguuccccaaaccaggggccaaggaacgugcucacugccuauguggaagccucccaaagaaauccacuggagaaucgucaccaaggauacccugaacuuuccggaaaugcuccuuuaccucaacuaaaagauccuuggaguauuuuucaaaaaaauaagacgacuggucuucauaagaauuugagauuucagauucuggcacaacgguauuuccuuuuaugucugagccuacaaaagaacaagcgccgagcuguaaagagagcugugcuuuuaaaggacaucauauugugcaaaagucucaugcuccaauauuuuuaaaaauaucauucuucugauggaaaaccaaaaucagauccagaaagaccacgucagauuuucuucuucugacagugguguggcuaaugaucagacaggcagaauuccaccucaauggguaucaauuuaguuuguucuaagaauucacccuguuggcugggcgcgguggcucacgccuguaaucccagcacuuugggaggccaagguggguggaucaccugaggucaggaguucgaaaccagcguggccaacaugaugaaaccccgucucuacuaaaaauacaaaaaauuagccgggcgugauggcgcacaccuguaaucccagcuacuugggagguugaggcagaagaaucacuuguauuuuuuaguagagaagggguuucagcauguuggccaggcugcucuuaaacuccugaccucaggugauccaccugccucggccucccaaagugcugggauuacaggcaugagccaccaugccuggcugaggaucacuuuuuaaaaccaguguuuuuuuguccagcauuaugugagaucaagguauucucaugcacaugcucccaucagcuggagcccuggauaagucugcaagguucucagggcaagaaagugcauccucaugguaugggcaaagaauauggggcuccuggggccgcaaguaagugagccagagcuggcacuguggucaggcccaguguccuccacacagcauaucaagucccguaggagcagagcugugcccuugacaaaaucauccuuuacauacaaauccuuaaagagccuacaaauagucuucuuaaaauccuuaguaagcuuccaugcaaugacuuucuaaaguuuuauaacuagggagaacagcaggaaggacugaagaggacuucuugacuuugguaagaucuuugauaagaucugaaugcuaggcugagugugguggcauguaauuccagcacuuugggagguagaggugggcagaucaccugaggucaagaguccaagaucagccuggccaacagggcgaaaccccaucucuacuaaaaauacaaaaauuacccagccgggguggugggugccugcaaucccagcuacuugggaggcugaggcaggagaaccacuccaacuugggaggccgagguuguagugagcugagauugcaccacugcacuccagucugggcgacggagugaaacuccaucucaaaaaggaaaaaaaagaucuaaauguugagaguugaucagagcuguuaaguccugucacaaucguuuuguauacguuuucuuagguacgugaauaugggacuuuagaaaauucaugaacguguuaucuuuaaaguugcaauuuccuaggcucugucccugggaggccuuccaaccaauagucaagggcccuuugccaacaaauuuauaggcaguccacacacucugacacacagaaacauggcccaggggcucucgugaucuccaaaguuauccaaaugucucccaaaacauuuacacuuacacaaaaccuccuccuuuaucuacauaucuuccacaauauuuguaaguuuucuccacgauacacccucaucccauggaacuucuccauagcaacaggcuucuaccugaauaagguuuugcuaccacuuuuuggugguauuucaagcucuuaaauggaauucaguuggcauuuuaaaaaucccacuuauuauuuccccuuuuuuaaaaaagaaacugcaaaauaaccaagcuauguguaggcagcagaccucaacugaccagugccauauuuagucauugugguaucuuuccauacuucaugauucagagauacaucaccaagaccaaaucuuauuccagaagucagcacuaaaagguuucauauuaacuuugacuuuaaaaggguguauacugcucaguaccuaguaaccaugcauacagucuucuguucagggacaugucccuucucaguagggucuggguggcggcugagagaaugcgcacgaugucagaucugaggagggggauggcucucucauuggaauccuauuagaaggacagagaaauuuacugcaagggaaugauagggcagauugcugacuuuuugacacgcagcccuuccuugcuggucugcaaagcucuaucucaaaaugggcugguuccuuacacauuacccauggaaagaagcuauucaauacgugcaaugaaaacgcuauccuugcaaaaaugaacaaggacuuuucacuggcuaccagcaaauaaugcccaugaguggcugagcuguccucguacgacagaacugcuugagaucuauaucccaccccuugggaaacaccagugacuuaccagaagaguacaaauuacuuaccagacagguauaaaaugggaagaaaaacagaacgauuuccagauuauuucuuugcacaagaacauuugaguccaacagggaggcacgcaaagacuucaccuguaaacgaucaaacggcacuagcauuuucaggcuacucuuuauggucauaaaaacgaaaguaaccuuucccgggaaucuugaaacuccugcguuauaucacucagaagagaaccagcagccacaggucaggaggguguggguucuagcucucgaggccacaggcugcgugacaucggagaagacguucagcugcagaccucacuguuccacgugagagccggagggguuuggaccagauggccggguucuaugaucucaaauucuacgaucccagaaaggauccaacaggaaccuuaaacuaaagcucugaagacacaugggaaaauaauuccugaucaauucaguagauauucugagugucuuuucugaauacagauagguagacuagagaugcauaagaaauuagagccacagacaaacgcucagaguucagaagaggagagcucuuucaacugcagagaacaaugaugcuccacgggaaagcugggcuugaagaacaggaaggagcuacacugagaccucgaagaagggcaggaaugcacagccagggggacagaagggaacagccgggagcaaaggcacugugaggccaggcccuguggcagucgugugggagcgcagggccugcagggaagagugaggugcuguggcugggagcagaugguuagaaugcucuugagcuuggacuauagcuguuggcaaugggaagucagauauuuuuauuuuuuuauuuucuuugagacagggucuugcucugucacucaggcuggagugcaguggugugaucuugacucacugcaaccucugccaccggcguucaagcgauucucgugucucagacagcugaguagcugggauuauaggugcccgccaccaugcucugcuaauuuuuuuuguuuguuuuucagacagagucucgcuuugacacccaggcuggagugcaguggugcaaucuuagcucacugcaacccccgccucccagguucaagcgauuccuuugucucagccuccugaguagcugggacuacgggcgcccaucaccacacccagcucauuuuuguauuuuuaguagagacgggguuucaccauguuggccaggguggucuugaacuccuggccucagguaauccacccgccucggccucccaaagugcugagauuacaggcaugagccacugcgcccaggcuaauuuuuguauuuuuaauaaacgugggguuucaucauguuggcccggcugcucuugaccuccugaccucaagugauucaccugccucagggcucccaaagugcugagauuacaggcaugagucaccgcacccagccgggaagucagacauuuuuaaagcacaggauacauaugagcaaagcuaggcuuucuccccaucccaaaucucuuagcagauuugggaugggaagaaaccagucagauccaagaguaagagacaagaagccagagcagggcugagacgauggagagaaagagacaaaggggauacugacggggcaggaaagggacguguucaucggggucgccuguguccugaucauugugcgaggcgcuuuucauccauuuuuccaccuugucaucagagagauccugugaagcaggucuacaacccccauuuugcaaagagaaauggaaccagaggguaauucacacucagcugcagaucuucucaccugcgaauucaaucugaacacuuuaagaucaaagugugggaacaccaccagguggcgaaagacagcaagacacaaaagcacaagaggcagguuuggggaaaagagacaaagaucugggagguuaccauuucuaagggcacgagaagggaugucguuaccagggaagagagcuucccuugaagggccuggagauggauaccugggggaccccaauaauuuagguuugagagcagccaauggagacaagagaggagggggaggacgccaagggaggaggggguuuccaugugugagugggcaguggcccccgugacacaggacagaggaaggaaacaaagacccgccaaugcagcagacccucugcgugcagaggccgucugagcgccgugugcagcuaagcacauuucugcaaagccaggggccuccagaagggaccucugagggugugaacacuuauuugaauguaugaaucuuaaugccacuuugggaggccgcgguggguggaucacccgccaggcaggcaguucgagaccauccuggccaacauggugaaaccccaucucuacuaaaaacacaaaaauuagccgggcaugguggugggugccuguaaucccagcuacucgggaggcugagagaggagaauugcuugaacccgggaggcgaagcuugcagugagucgagguugugccacugcaccccagccucggcgacagagcgagacuccgucucaaaacaaaaacaaaaacaaaaaaaaccuuaaugcauauguuaaaaaagccaccaccagccucaacugcacaaggccuccuucucgccuugcucagccguucguuacccagacuuaagcuuggugcaccucccuuuccuggaugucccuuugcagcuucagugacaaccugcccaugaggaugcugugcccacaugucgccuccuccccaugcccugugaggaacacagcacccaccgugaguuggugauugguccccagcauguacuucugcucccggccgggggcaucccuguugauguggcccaccacgaagacugaggcagggaggcggauggacgggcuggccaggacgcucccccagagggcgguguaaaacaccucuuugccaaccaccagcgacagucucaggagcagagcauccguucuguugaugagagaggauaggguucaagggcucgccccaucuucccgagucccacugcacacugcucugcgaaugcugcaugaagaaccacagcggauucgccuggcuggggaagccccaccuuccucaucgccgggagccgcugccaucucucacccugcuguguguguccaccugcuggcugucacacugacccuggauuugccaaaaccaaugucacuaggcagcgcggugucuuggccaauggaaaguggcuaagcagucgugcguggcagggcagagacccaucuccacccuggccgugccacggaugccuaggugcucacggaagggagguuccaccauaagagggauaggcaggucagccacuucacagaaaagcggaaggagccauugguguaucaaaaacaagcauaugcugaggagacugaucaaagacuuaagcaauuagaugccaccaacuugagcacagccaaaaaugugccaagugacaucugccuuuagaaaugcuaggggcaaaucugccuggggccucccacgacccugcaaauuccaucagccuggagugguguuuccuuucagucugcccacagcaccugcaugugcugacucccgcucccaggggcucuugugcugaggccgggcauuuguucgccucuuaucuuuaucuaggucucccgugauacaaagucagcaccuucucaugcauccuuuuaagagaagcagcgucaccaguggaucagggcucguuuuuccccugacgcugaccaaggccaggcccaugucuguucgguggugucccugcagcugacugcggcccuuucccuguccucagugcacacaaucugcaggcugggugacagcaucuaccaguaaaacagcagaggcacauucccccuaagggauaucaccccacgaaggaucugacucauuaccugaaaggauucaguuucucacaugcuuccuaucugcaaagaccacaaaaaacaaucagaaaaaccaacccgguggaauguguugguucacagagcuugccagaguuggcccucccguguccagauccugguugugaugccuccuagaugcaggaccuaggaccaguuuaacaucugugcacgcccgugcucagcuaaaagacaggggaaggagccucgaccucguggagauguugugagaaugaagugagaguccccucaaaaaaaaaaaaaaaaaaaacaaaaaaaacuguuuggcugggcgugguggcucaugccuguaaucccagcacucggggaggcugaggcggguggaucaccugaggucaggaguuugagaccagccuggacaacauggugaaaccccaucucuauuaaaaaugcaaaaauuagccaggcaugauggcaggugccuauaaucccagcuacuggggaggcugaggcaggagaauugcuugaagccgggaggcggaguuugcagugagccgagaggccgucacugcacuccagccugggcaacagagugagacucugucucaaaaaaaaaaaagaaaagaaaaaaagaaaaaaaaaaaacucaacccagaagaacagaccuaaugcuugggccaugccgccugcaauuacuacuagguccacucuguuugcugucacagccccagugccuauuugagcaagugacuccagguuggcacucgaaaaaccccucgguuaauuuuuuuguauuuccuucaaaaauaucuaccaucgcguuauauuaaaaguacauuuuguucuccuuaaaauuagucugaacuuccuguaaaauauugcaggaaauaaugcaugguaccgucuucuuagaaaaaauaaaaaugaagagacauaaguaauggcuaaguguauagaagaaguaggcagggcgauuuaauggcugagguuauugauuggucuucuauuaaaggcugaguaaacaaauagagcuugucuuugccuagcucugaaaucaucacaaacacuauaaugcacacaucguggugucacagucccccuuuaauuagaacugcauauucccaaaguauguuccauggaacacuggccacuagagauguuccacagaagagggguuccacccucaaaaaguaugggaaacgcugccuauguugucucuucaauauucugaaaacuggcuacuagcuuucuauuaaagaaauaauuuuuuuuuuuuuuuugaggcaggguguuacucugucacccaggcuggagugcaguggcaugaacacagcucacugcagcccugaccuccugggcucaaucaauuuuccugccucagccucugaguagcugggacuacacacccaugcugccacacugggcuaauuuuugcauuuuauauguagacagaguuucaccauguugcccaggcuggucuugaacuuuuggcuucaagugguccacccugcauggccucucagugcugggacuacaggugugagccacugugcccagccagcuuuguuuuuuaagucucauuuuauucuaaaaaaaauggaugcauacuaacaauuuaaaugacaucauaguagaaacaacagcaacuaugacaaaccuuugguaugagagagcaaaauaaacgggguuaaaaacgaaauaacuuccuacucaacaagaguuacuaugaucaucucgguuguuaaauuccaauauuagugugcaguuuacaguccagaacucuaaacuuuuuuuuuuuugagacggaguuucacucuuguugcccaggcuggagugcaauggcacgaucuuggcucacugcaaccucugccucccagguucaagugauucuccuggcucagccuccugaguaucugggauuacaggcagccgccaccaugccuggcuaauuuuuguauuuuuuuuuugguagauacgggguuucaccauguuggccaagcuggucuugaacaccugagcucagguaaccccccgccucggccucccaaagugcuggaauuacaggcaugagccaccaugccccacugggaacccuaaacuuuuaauucaaaaccaacaaacgggccaggcacaguggcugacaccuguaaucccagcacuuugggaggccaaggcagguggaucauuugagcccaggaguucaagaucagccuggccaacaugguaaaaccccgucucuacuaaaaauacaaaauuagcugggcauggugguucgcaccuguaaucccagcuucucgugaggcugaggcaggagaauugcuugaacccaggagguggaggcugcagggugccaagauugcaccgcugcacuccagccugggcaacagagugagacuccaucucaaaaaacaaaacaaaaacaaacaaaaaaccaacaaacauuaaaaaaaaaaacccaacuuccaaaccccaaguauuuccauccuuccuaacucaucccagcuuaugcucucucaugccuccugcaaacgcagcuccuucaaaugacacuggcaugcuccacuccacaacugagagcaggugaguggcaugggccgggcaccgcaaaucccaagcacuccacaacuuugguucugcagcugcuugccaaaaggacaaccauggaaagccaagcugucacaagacagcaccgcuuugguacaaucaucugaaacugaagaggcagggcagugacaacagcacccuguacuguaaacugcaggucagaaacagcgcuaaagagggggcaaaaaaaaagccucgaaccagcacagaucaugaucacagugccugaaaccaaccaaaagaaauguuggugcugggugcaguggcucacgccuguaaucccagcacuuugggaggcugaggcagguggaucacuugaggccaggaguucaagaccagccuggccaacauggugaaacuccgucucuacuaaaaauacaaaaauuagccaggugucauggugcaugccuguagucccagcuacucgggaggcugagggaggagaaucgcuuguacccgggagguggagguugcagugagccaagauugcgccacugcacuccagccugggcgacagagcgagacugucucaaaaaaaaaaaaaaaauagaaaugucagccaaaagggguggcucaugccuguaaucucagugcuuuggaaggcugaggccggaggaucguuuuauccuuggagguugagacugcagugagcuauaauccugccacuguacuccagccuggguacacagcaagacccuggaauucaaugugaucaugugggucaugcacgucgcaagugcucaguaaaggguccauuuguuuccuccacgauaggggcccuaagaggguacgucuuccccucuucauauggugacgcuguggguaacucuuuaaugggacaggacaucauggaaacucuguacuauggccucccuuauuaaugagcuccaaaagaaaagaaaugucaauaaauauuuuucaacucuuuaagccaggguuucugaacguccaccccacugacaucugggaccagguaagucuuuguugucggggcaccugugugcauuguaaaauguucagcagcuccuggacucuacccacuaaauaucaguagcacccuccccacccccaguugugacagccaaaacugucuccagauauugucaaauguacccugagaggcaaaauuacuacuacauugaaaauuacugauuuaaauggaaauaucuggugagcuaguuguugccuucuuacaaaccauuuaaaacauucaccucuccucaucuccugagaagaagaguuuagugcuuucccuguucuaaucuuguuuucuuaguacagcaaaacacagcuauguagcuauuucaugggcacuuaaaaaaaaaaaaaaaggauuucugaccagucauagguuaucugcagaccccaaaggguuagaaagccaggguggauaauaaguucuaacaggggccaaaaguuucauuccuuaugguucacuaaaaagcacacaccagggacagccuccaccuacaugaaaccugugagucaucccagccuucaccagcucaaccuaacucaccacuuugcaauuucuacccacgugcucaucaugaccccccccacugcacccucccuuucugcucucugcacauuuguugggguguuucacucaauucccaagcacuuuuuuucuuuuuugagauggagucuugcucuguugcccaggcuagagugcaguggugcgaucuuggcucacugcaaccuccaccuccgagguucaagugauucuucugccucagucuuccaaauagcugggauuacaggugccugucaccacaccuggcuacccaagcacuucugggaacaguuaccaaaccgucucagacugaaauggauauagcaaccaaaaaaucuuguacagucacuucaauuacuguggcugcaacacacuggcucagagauuauuguauaaccuuucaccugcauccaccuuggagagcugauaacuaaucacuucugggugccacacugcauuugguuuucugucacagcuaaauagauucggugauucaugaagcuuuacuuggcucuugguucaaugucaagaaaucacaauauucagaaaaaaaaucaauguuaagcaacuuuagcaacuguucaaaugaaccuuuauuuaucaacuaagaaaacaaaaacacuccaacuauuuacacuucuagugugauucacacagauuuaaaagaucacaguaagcuuuagggaacuaauguguucaucuguccaaugauggaaaaaucauguaggauguauacucacauaucugucaucagaacacaaacacagcagaacuucuagaaagggccugggauuaggaguccauuggcauggagucuggcaauguccuccagcugccuccuaugugaccuggaccacucguuaacucaacacacacuuaccgagucucaccguguaccagccacagggccuggcgcugggcuuaaaaccgcaacgagacagauucugccuccuaagguagaaacuguaaagguggauucuccuuugggaaauggagagccaacaccuggucuaugugagagcuugaaaugguuaaagugcaauguuuuaguuacaucugucaaguccugauauagagcucacgaaaugcacccuuggccacuuccuaacuaacccuucaaaccauucugauuacuugguuuacuuaaggcugggggagccgugcaaauggaccuuggauugauuccuggguuagacuccagccuccugcaccccucagucacagcugacaccacaggaaagggugaccugacuagggccuccagcacaggguaauaugagcagcgcguuguguaaucacauggcagcuuuuacaagcacaaaagucaccagugacugaacaugggcucuuaaaacaggucccauuaacagaggugaaucacuguggcaucucucagaagaguuaauaagcuggaagugaguucuuacuuuauacuucuccggaaacaaaggucacuguguauacucaacagucugguuuuuguuuguuuguuuguuuuuuucugagacguagucuuacucugucacccaggcuggagugcaguggugcaaucucggcucgcugcaaccuucaccucgcaggcucaagcuauuccccugccucagccucccaaguagcugggauuacaggcgcacaccaccauguccggcuaauuuuuuuguauuuuuaguagauaugggguuucaccauguuggccaggcuggucuugaacuccugaccucaagugauccaccugcucuggccucccaaagugcugggauuacaggugugagccaccgugcccggccauacucaauagucggaacagauucacacuuucucccauuccuaagcagugaccacacacacacacacacacaaagcuacaugaacuuuugugcauaugagugcuauagauuucuccaaggugcuacugaaaccugucaagauauucugcuucacaucacacuaaauugccuucucaagcccugcccuggcuuugcuuuuuaauuuagaagcagccuaguuuaauggaaagaagaaggacuuuagaaucugauaugagccgugugugguggcucacgccuguaaucccagcacuuugggaggcugaggugggcggaucacuugaggccaggaguuugagaccagccuggccgccagagggaaaccccaucucuacuaaaaauacaaaaauuagcugggugugguggcacgagccuguaaucuuggcuacuugggaggcugcggcgggagaaucacuugaacccaggaggcggagguuguagugagccgagaucgcaccacugcacuccagccugggugauagaacaagacucugucucaaaaaaaaaaaaaaaaaaaagaauccaauagauacaguggaauagaaucccagcuguggggcucacugacugugcgacugggaaaccuucuuacccucugacccucaccuguaaauggagguaacuccuggagcagaggaauucauuacacaaugugaucauguguguaaugcacgcugcaagugcccaggaaagggucccuucauuuccuccacacuaggcgcccuaagaggguaugucuucccuccacacauggugacucuguggguaacuccguaacgggacaggacaucaugggaacccugcacuauggucucccuuauuaaugagcuacauuucucuccgccuaaaggaucucaucucuccgggcucgggacuuccccuuugguaaagagacaagagagauucccgggaggaauuugaaaucacaaccaccaaggaaaugugaaagagcaacccgaccuccacaccuacugcugcuucccaugucucugcacuuccuuccccgugucuuuuuuuuuuuuuucgagacagagucucuguuguccaggcuggagugcaguggugcgaucucggcucacugcaagcuccgccucccagguucacgccauucuccugccucagccucccgaguagcugggacuacagacgcccgccaccaugcccggcuaaauuuuuuuauuuuuaguagaggcaggguuucaucguguuagccaggauggucuccaucuccugaccuugugauccacccaccuuggccuuccaaagugcugggauuacaggcgugagccacugcgcccggcccccuccccgcgucuuauaaagcaguggaguaaacacagccuggacaagacgcccacgcaccugucggagaucucggagcccucuucaaggccgggcagcaggcccacgaugaaggccugcagacugggcaggagcagcuucugcagugggaggaaguacuucucguacagggugagcagcaccggccucaccgacaccgccgcgugugccaggagaggaaauaacccgcagcuucgagaaagaacgagagggagcggggcagaaauaagauacccagucagaagucccaggugacaagccagccgaggggaguuuucacaagcaaacagcuggccauuuaaacugcugguuucgauguguggguaugacaugagauggucacaaaacacuguuacguaacaagccagcaaugaagcuguccgcacguucagaugcuaaaguucccuuauagcaaagucaaaauggggugcuggagaggauguggagaaauaggaacacuuucacacuguuggugggacuguuaacuaguucaaccauuguggaagucaguguggcgauuccucaaggaucuagaacuagaaauaccauuugacccagccaucccguuacuggguauauacccaaaggauuauaaaucaaacugcuauaaagacacauccacacguauauuuauugcaacacuagucacaauagcaaagacuuggaaccaacccaaauguccaucgaugauagacuggauuaagaaaauguggcacauauacaccauggaauacuauguagccauaaaaaaggaugaguucauguccuuuguagggacauggaugaagcuggaaaccaucauucucagcaaacuaucgcaaggacaaaaaaccaaacauggcauguucucacucauagguggggauugaacaaugagaacacuuggacacaggaaggggaacaucacacacuggggccugucauggggucgggggaguggggagggauagcacuaggagauacaccuaauguaaaugacgaguuaaugggugcagcacaccaacauggcacauguauacaugugugacaaaccugcacguugugcauauguacccuagaacuuaaauuuaaaaaaaaaaagaaagaaagcaaaguuaggacggauagacuccagaaggcgcccagugacgucuccuggugauggcuuuaugauaaacuguugcacacacagcccuacgcuuauuuugccuguuugucauuuucucaucuugugagcugaaauaccgguuacuuggguaauaaaaaggaacacagcagagaagcaaucgcaccuguacagaaacaaguccuuggccagccauuugguccccacgauuuuaaagauaaucucguagguuuccagagcuuuuaaguggacaccacugggcagggcagggugcaaacacugagcuaaucuuuugcugaugaggagccgucuuggcaacaaggaguaccucagguuacucugaagagccugucaaacaagacaaaaaaaacacaugaggaagaaggcagcgauauuuacaauggagaguggaucugcugaagccagagagacugcagccaugucccaguguggcuguaagaaagagacauacacaacaaaggggcagagggacugcauggcgagaguccacagcagcucuggcagcgcuggagaugaggcaggcacaaggacuuucuuaguagguggccagcuucucggucacaccucugagcccgugaugggugagggccgugugcuucuccaucucaggaagccaugaguaggggcucacucagaagauauggauugggauuaaagccuuccaggcugugacgccugacauuucuaccaguuggagauggugcugggaggaacccguguucuccaggaggaaaacagcaccaccccacugggcuggagcaaugguagucccaagcuaggcuuccauaagcaggauacacgacacgucugcgggaaagcaucccagagugcuugcuguacccgagaagcaaggucgagagugugaacagaucgaugcuguccuucguggcacagaguaaccaugggcagaacuuugugcgugggaggccccucauggcuuaaucuuuuuuuuucuuuuuuuuuuuugugagaugcagucuugcucugucacccaggcuggaaugcaguggcgcaaucucagcucacugcaaccucugccucccagguucaagcgauucuccugccucagccucccaaguagcugggacuacaggugcccgccaccaugccugacuaauuuuuuguauuuuuaguagagaaaggguuucaccgcguuagccaggauggucucaaucuccugaccuugugauccacccgccucggccucccaaagugcuaaaauuacagaugugauccacugcgccuggccggcuuaaucuuauaacacagugucugauguuaucagggaaugaucugcauaaguaguucauuugcucacacaaauauuuacugaaggccuacaggguaaaaguucacgcuucuuuuuuuuuuuuuuuugagacggagucuugcucuguugcccaggccggagugcaauggcaugaucuuggcucacugcaaccuccaccuccuguaccuccuggguucaagcgauucuccuuccucagccuccugaguagcugggauuacaggcacacgccaccacauccagcuaauuuuuuguauuuuuaguagagaugggguuucaccauguuggccagacuggucucgaacuccugaccucaagggauccacccgccucggccucccaaauuguugggauuacagccgugagccacugcaucuggccaaguucacguuucuuaaaaggucucccaagcacggcuccagccuuccuuucacugccccuugccuaaaugcccuuccggccaccuugcuaacucuuccucacgugugauuuagcucagugcccccaucucagggaggcagaacaggccuucccucuacagugcgagggcagggacuaucucacucuucucugcugucuccagcacccugcacagugccuagaacaaagcgggcaguugggaagagcaucuaagacaugugcaaugccagcugcauuccauccacaucagaaucgugggcccucagccucaugaccacagggccaugacaacuuuccucuuguacgcaaacacuacgaucccaccucuaaagcacacucagguuaugcaggacaugaaaggaagacaaggaaaacaagaauauuuuucaucagauaucuguggucuaagugaauucucaaauucaauaaaaugacaucuuuaaaaaaaaucagauauggccaggugcaguggcucacaccuauaauccuggcacuuugggaggcagagguggguggaucacaaggucaggaguucaagaccaaccuggccaacaugaugaaacccugucucuacuaaagacacaaaaaauuagccgggcaugguggcgcgugccuauaaucccagcuacucaggaggcuaaggcaggagaaucacuugaacccaggaggcagagguugcagugagccaacugcacucuagccugggcgacagggugagacuccaucucaucucaaaaaaaaaaaaaaaucagauauaacuaguggucaucaaaaaaggguugcacucuguuacacaggcuggagagcaagugugcgaucaugguuccaugcagcuucaaccuccagguuccagugauccucccaccuuggccuccugaauagcugggacugcaggugcaugccaccaagccuggcuaauuuaaaaagauuguucuguagagacaaggucucccuacauugcucagaaugaucaacuggucucagacuccugggcucacgcaauccuccugccucagccucccaaaaugcugggauuaugggugugagccacugcgccuagcccuuaaaacaucauuuaugaagaaugugauaccuuaaaacaaagggaaugcuaauaaaauaaugugaaaaaaugugcuuauguuccaaaaaggaaaaaaaaaaaaagaacagaggagaggccacuuaacuuccacacugucacaaaggaugaaaacagacugacgguagcagcagagaaggaaugaacguggauaauggauagcaaacaguacauuugcucaugggcaauuucaaacacauagaacggucaggcagccaacauccagcuucaccaccagcaaugcccagccagcccgcagaaaacauuuccacgacucccauggcuuacugaucacaggcuaacaagcuuucuccauggauucaagagcaggagagcuaaaagcugucuugaccuguaccauuauuuuugucaaggcagaguuuucucuuuuuaacacuaccaaaucucauuuuugcucauuauacucuaagacuucugcuauuugggacaaaaaagauguuaaguacuucccauggggagcaucugggauuccuaagagguucccucagucugugcacacagcaggaucccuuucuucugcucuuuugaguauaggcacggcaacgugacauacuuggggccaacaagaugaauagaauuaugggagucacuucuggcacagaucuucaaagccaacucauagcuuaucacuucucuuuucccugccucuaagauuauggaaacacagguugagauaaagccccugagaaauuucagaaagcagaaacuacuuucugauccaguaaggcagaaauaaaccauguuguaaaagucaccaugauuugaggauuguuuguuacugugcauaacuuucccuauccugacugauagaucucuuuucauaugaacgcaauugcaaggaaccacaaccacucauuucaaauuaauagaacugauugcuauuuuuucucauuuacauguguuaccucacuucauuuaaugugaaaaagacauagaaaaagacacauagcccagaacugaggcuguaaccaguaaaaguggaaugaacuuguucacuguauguugaccauguuuaucauguuuugauuuuuugagacagggucucacucugucacccagacuggaaugcaguggugugauugcaacucacugcaaccucuaacucccaggcuuaagcaauccucccaccucagucuccugaguagccaggguuauaggcgugcaccaccacacccugcugauuuuuuuuuuguuuuggggggauuuuuuuuuuuuuuuuuuuuuugagccagagucuuguucugucaccaaggcuggagugcaguggugcaaucucagcucacugcaaccuccaccucccagguucaagugauucucccaccucagccucccaaguagcugggauuacaggcaugugccaccacaccuggcuaauuuuuguauuuuuuaguagagacaaguugagccacauuggccaggauggucuugaacuccuggccacaagugaucuaccugccuuggccucccaaagugcugggauuacaggcaugagccaucaugcccagcaucuuugguauuuuuucguagagaugggauuuugccauguugcucaggcuggccucgaaccccugggcucaauugauccaccugcacuggccucccaaagugcugggauuacaggugucagccacuguacccagcccaugugaauaaugugagcaaggcccaucugagacaggcaacugauuucuguugaagaaaaggugcacuaaaggcaaacucagacugcuuaucaagagagacaagcugcaguugucuucuuuaaaaaugcagcaagaaggcugggugcaguggcucacgccuguaaucucagcacuuugggaggccaagaugggcagaucgccugaggucaggaguuugagaccagccuggccaacaugaugaaacccugucucuacuaaaaauacaaaaauuagccaggcgugguggcacacgccugcagucccagcuacucaggaggcugaggcaggagaaucacuggaaccugggagguggagguuggagagagucgagauugugccacugaacuccagccugagugacagagugagacucugucucaaaaaaaaaaaaaaaaagagagagagagagaaaugcagcaaaagcaaaggcaaugaaccaacaggacuuagaaaaaugaagagauauccuuccuuugugguaagaaaaauaaaauuaauauaacagugaaauaucauuuucuucacccaucagagagguaagcuugacucaagcauacagguucaagcauagagcagagugaucuagagaucaugaacaaaguuaaucaaaaccaggucuagauuuggccagacagaacuugcuggacugcuccuuggagcugucgucacacagagauugaguguuuauacacucuacauggagccucgcacuuaacaagugcuucaaaacuaaggcuuaacaaagcaauaaacaaaacugaggcuauuacugaugccuggucuaaauaugcaagcuugggcaccagagccaccaauuccaguuucagaauuugcuguucgggcaaauuaccuuucugggcugaaguuucaucuguaaaaaugaggacugugauaccucacgaaguuacaagcauaaagaguuaccauguauaaagaauuuagcauacugcccagcacaaaguaaguaauccacacacaugaccucuuaguauaaugacaaauugaaaaauaagcagaauauuuaaagauggagacuccacucuuugugcagaagcucagagcuguagcccaguggagaagggagaaccaguugcuuggaucagugguaaaggccaccauggagguucccacucgggcuccccgcaauuccaccuuacgagacuuuuccgugaugcccuucagucucacugaaggccagcaccagacacaagagggacagcacauuuuuagggcaaacuucucugguggauacuaauggggugcaggaaaugcuaccccaaaauaugguaccugggaaacugagaaaacagcagaagcaggaaggauacucucaccuuccucccuguggcagcucauaaagccuaggcagcucauaaagccuagggagaucaagaucucccucccuucuccccugaacgcccugugacaggcguccugcccuauacccagagggaaggaaugucucccagaggcaccaagaagaaccugaacaaacaggccuugcuaaauuccccccgggguauuccugaaucaucacagcccgcauccagucauucuacgcgacugucacacuucaucaaacccaagcacagagacacagauuggaaucccuguuucuccaagucuucauuucugaaggcucucaugccauguaaaacuuaauuugcaugcuuuucucucguuaaucucucuuucguuauaggggucucagccaugaaccucgcaauggaugaggaaaagauauuacuuauucaccccuucaacacuguucuuuacaauugcuaaugcccuguacccaaagacaacaccggugcccucguccaaguacaggacuuaggaaagcuucuuucuuagauaaaacaguaugaauuuccuuguucuaaagaaugaaaguggggccgggcaugguggcucaugccuguaaucccagcacuuugggaggccaaggugggcagaucagaggucaggagaucaagaccauccuggcuaacacagugaaaccccaucuccacuaaaaaaauacaaaaaauuagccgggcgugguggcgggcgccuguagucccagcuacucgggaggcugaggcaggagaauggugugaacccaggagguggagcuugcagugagccgagaucgugccacugcacuccagccugggcaacagagugagacuccauuucaaaaaaaaaaaagaaugaaaguggcugggcauaguggcucacaccuguaaucccagcacucugagaggccaagaaggacagaucacuugagccuaggaauuggagaccagccugggcaacauggcaaaaaccggccucuacuaaaaaaauacaaagaaauuagcugggugugguggcacauggcuaugguccuagcuaccugggaggcugaggugggaggaucaccagagcccaggagguugaggcugcagugagcugugaucaugccacuguacuccagccugggcgacucuugucucaaaaaaaaaaaaaaagaaugaaaauuaguuuuugguaguuuuuuuuuuuugacagugucuugcccugucacccacaguggagugcaguggugugaucuuggcucacugcagccucaaucucccaagcccaggcaauucucccuccucagcuucucgaguagcuggaacuacaggcguauaccaccacgccuggcugauuucuauauuuuuuguagagaugggguuucgccauguugcccaggcuagucucaaacuccugagcuuaagcaauccacccaccucagccucucaaagugcugagauuauaggcaugagccaccaugcccagccaagaaugaaaguuauccuaaggaguuugagacuagccugggcaauucgguaggacuccaucuggaaguuucuguuugggaggaugaaaagguucuggagauggauggcaggauacacaauaugaauguacuuaauaccacugaacugugcccuuaaaaaugguuagaauggucaacuuuaggccauguguauuuuaccacaauagcauaaagagaaaagaaauaaugcuguuucauggcaauugcucuugcuggcuaaggcuguaagagccauaaacuuuuuuuuuuuuuuugagacagagucuuacucuguugccaggcuggagugcaguggugugaucucggcucacugcaaccuccgccuuccggguucaagcaauucuccugccuccgccucccaaguagccaggauuacaggcacgugccaccaugcccggcuaauuuuuguauuuuuaguagagacgagguuucacuauguuggccagauuggucucgaacuccugaccucaagugauucaccugccuuggccucccaaaguguugggauuacaggcgugagccaccucgcccagccuagccaugaauucuugagugacacuugcacgccagccccuccuggacugaacugaccagagaagagugggacucauuucagcaaacccugaggcagcccagggauuuggugcagcucucuugagagugagcuuucaaucuuuaauuaccacaauaacuaccuucuagggcuugcaaacuccugauucccucuucaggguguauguguggguauguggguuuuuuucuguuuuuuguuuuuuuuuuuuucugacuuguuuuuuaaaguucuagugggguaugucuuauucucugacagcgucuucacccuucccccaacgacacucuuccgcucccauuuggcaaugucgcugacauuaugacccacuagccacggcuaggaaaacuccaagguaagaaguauuuggaucccaagaaagaagccuugcucucaaauuccuucuaacucucaucuaggaggagaagcaagagcuccugcccucauggucggucuuggugacuuuuccuucucugagcaaaaacugggccacaugucacugucaucccucucccggcagguccagggcugccaagacuggaauuagcacaaaacaggugugccacccucacacuaccuuucucaucuccauccuccauccaggcuuugccaagaaucuucuccagcaagaaaagcucagcaaacacuuccaggacaguuucacuauccagaaacccaaacuggcuggccaguaagcuuaauauacguaucauaugagaaauauucuucugcaacuauagaauaaauaucacagagaaauagaugaacugagguggggcacaauggcucacgccuguaaucccacacuuuaggaggccgaggcagguagaucgcuugaggucaggaguuugauaucagccugggcaacauggcgaaacccugucccuacuaaaaauacaaaaauuagccaggcguaguagcacaggccuguaaucccagauacuugggagacugaggugggaggaucacuugaacccgggaggcagagguugcagugagcugagauugcgccacugcacuccagccugagugagagagcgagacuccaucucgaaaagaaaaaaaaaagaaagagaugaacuggccaggaaaaauggccauguuuucaaaaucacuuuuaauuuaauuaauuuauuuauuuagagacagagucucacucugucccccaacacuggagugcaguggugcaaucucggcucacugcaaccuccgccuccuggguucaagugauucuccugccucagccuccugaguggcugagauuacaggcaugugccaccaugccuggcuaauuuuuauuuuuuguauuuuuauuagagacgggguuucaccauuuuggccaggcuggucucgaauuccugaccucaggcaaucugccugccucagccucccaaagugcugggauuacagguguaagccacugugcccagcugaaaaucauuuuuuuuuuuuuuuuuugagacggaguaucgcucugucacccagguuggagugcaguagugugaucuuggcucacugcaaccuccacuucccagguuccagcgauucuccugccucagucucccagguagcugggacuacaggugcaugccaccacgcccagcuaacuuuuguauuuuuuaguagagacaggguuucaccauacuggucaggcuggucucaaacuccugaccucgugauccaccugucucagccucccaaagugcugggauuacaggcgugagccacugugccuaacccaaaaucccauuuuuuuuugagacagagucucgcucugucacccaggcuggaguguaguggugugaucucagcucacugcaaccuccaccucccggguucuagcgauucugcugccucagccuccagaguagcugggacuacaggcgugcaccagcacgcccagcuacgggguuucaccauauuggccaggccggucucgaacuccugaccuugugauccaccgucuuggccucccaaagugcugggauuacagguguaagccacugcacccagccuucaaaaucacuuuuuaaagugcuaaaaaaauuuaaaaaggagaaacugauuaaacaggaaauuaaacuuucuuauuuauuucacucaggaacuacacuguucuaaaagcauuccuugagcuauaauuaggacauaauuguaacauuuuugaccucauuauaugcauaggcucaguaggcugaccuuaaaagaaaauacuaaaauguuaaguauaaaguauguuugaaaaaaaaagauucaaacuacauccaagcuuaauagaaaucaggaagugucacuguugcuccacccaagaaaauaucuuuguuuccuuugacuuuacacaaccugacaguaugacaguccccaggacacggcaugauuuagaagcauucuguguagggaacacgaugaaaaauuccaaaaggcuacacauggacacaaguuaauaugcuuaaaaaugguuaagaugguaaauuuuauguuauauguauuuuaccacaauuuguuuauauguauuuuaccacaauuuaaaaugcuuuaaaaaaggaguaauuuaaccauauggguggggaguggacagaauuauguuucauuuuuaaaacgcuuuauuuagcccguaaaauaaaaauguuaaauguuuccuuuaaaaguuccuagaagagacagucacccuacuuuugcacagaguacaaugcugacuucagaaugccagaugucuuugucuagaaagaaauguaagucagccaauuuaaaagcacgucucccaccaagcaaacgaggaguugcauuuuucacggugaaacacugacaugucuuccuucuggaagucaggcaucuuuguaaggguguucuuuucaugccacugaaaggaagcugcacaguggcacagugagucagggaggccaggugacacaggcucaaacgcucagugaagcaccugccagggggcacuguuagugcccuuuagacaggacgaaaauggaacagaccagcacuuggccaggacuucccaagugcucaugguguggcauuccaccuugacugaaauggcaugacccgguugcuuugccagcuugagggaguggcgguggcaagagauaagcuggagaaacaggcagaaggcaaggcugccgagagccaucucagggagucgggguuccacagguaaccagugagaccaguuuuuguugaacugggagagcagugcugcuauaacuccuauguaaacaaggagcuuccuucucugaaaggucacagcugaaauaucauuguguuguauuuaccuaagucaguugaacccuaacagggccaugcacgugauuaaucagcucucagcaugaguuauccacauacccaaaucccagcuuccaauaaagcugcuagcaaggaaugggucacucaggcuaacuccaucuucugcaucagguaagaagacacauuagaauaugcuuuuuuuuuccuuuuaaaauuuucuuaaaauuaccaugcugcuugaguaggaguagaacugaaggcuggguguaucaccuacuagagauuuuaaaagcaugcucagaaaaaaaagaagcaggccaggcgcaguggcuuacaccuguaaucccagcacuuugggaggccgaggcaggugaauugcuucagcccaggaguucaagaccagcaacauggcaaaacccugucucuauaaaaaauacaaaaauuagcugggcaugugaugugcaccuguagucccagcuacuugggaggcugaggcaggaggaucacuuggaacuaggaggucaaggcugugggcgagcuacgaucgcaccucugcacuccagccugggcaacaaagugagacccugucucaaaaauaaaauaaaaaauaaaauaaauaggcugggcacaguggcuuaugccuauaaucccagcacuuugggaggcaaaggaaggcggaucaccugagguugggaguucaagaccagccuagccaacauagugaaaccccaucucuacuaaaaaaaaacaaaaauuagccagaugugguaguggucuccuguaauccuagcuacucaggaggcucaggcaggagaaucacuugaaccugggaggcggagguugcagugagcugagauggugccacugcacuccagccugggcaacagagcaaaacucuugucgaaagccaggccuuggcuucagcaaugucauucuccccacagacgaugaaugggcgcuggccacagucaagcacccucccccgggaagggaggggagaggaggggaagggaggggaggggaggggcaggacagccagcuaacccaggccaggccuugggggaagagcacagugggugcuugacuguggcuggcacccacucaccgucugcugggggaaugacauugcugaagccaaggccugagcccuggcaccuuggcagguucagaagcucauuuuuaucaguuuacccagagguggcucugcuguggagggaauguuuugcuggccgccggucgagcuccuaagacgggccccgaaagucaaugggaggggaacugugacagaggccaggcucugaguggcaggccuggguccgaguccgggcuccagcucucaucugagcaagccugucacaagucaccugauagcucugaggcucugcuuucucacccauuauuucugaaaccuggaauccuccaaagucagcaccauucagccccuuuuacugaagaacgagcuggagcucagaggucugccugcagcuucccaggugugcagaguauuucagguccgccagcgcccugcaaagcccacacuccggggguggggguggaacauguagacaugucaggggaggcugaggaagugcuguaggugaccaaaaauauaccaucaccuacucauaagcuggucgugcaggauaaacucaaaaaggagcugaaacauacaggguauucauucuauuuccacuuccccagugugucaggguuaacacuggauaugcguacacauguccacacaugcaggcacacaaauacauacauacauacuucccauacauauacacacacacacccucuacacaugcauacauguacacacaugcacacacuccacacauacacacugcauacauauacacacaugcauacacacaucccacacguguacacauacacaagucaugagcaauagggccugucagccacacaggcugcucccaaucucuuaguuaagaugacucaagaauccacaugcuagaucagaaaauuacuucuuuuuuuuuuugugagacgaagucucguucuguugcccaggcuggagugcaguggcgcaaucuuagcucacugcaaccucugccuccuggguucaagaaauucucaugccucagccucccaaguagcugggauuacaggcgcccgccaccacgcccagcuaauuuuuguauuuuuaguagaaacaagguuucaccacguuggccaggcuggucucaaacuccugaccucaagugauccaccugccuuggccacccaaagugcugggauuacaggugugagccaccacgcccggcccagaaaauuacuuuuuaaaacacaaggcaacaaacucaccgcugccucacagcggguaaucugcagcacacaugugcaaaugcugccccuuauuuuuccccgucagaguuuauuaugacacuuagacucaaagccacucugucuugccacuaacgccuacuuucccugucuucccauagaggaaguuuagguagcugugaugcuguacaguaccuuccgcauuucuagacuuauauuuuauucuuuugcgauggcacagcacuuccucagccuucccugacauuguuacauguugcccucaacccuggagugugggcuucacaaggcgcuggccgaccugaaauacucgucauacaccugggaagcugcaagcaagccuuugaacuccaguuucuucaucaguagaagaggcugaguggcacugaguuuggaggauccuagguuugaaaaacaaugguggcaagcauauaauaggggcucacaaaggaaacuguucuauuuggggggucuaagagcuaacagucucagaagugaugaaaaauggcaggaggaggugaaggcagcugaguucugcaauaaaccacaggaaaagaagguaaggauguggggccgacucucccuucagaacacagucuacaccuugaaauguacaugaugcagagaacacugccauucuuaugcauuuaucaucacaaaccagaaaaucaaauaaaaguaaucauaccauuaaaaauauaaaauaacauaguaucgggagauguuauuuuucuaauuuuuaaacauauuuuauugcacauacaaaugaucuguuuaacaaacaccaaagcuuauagggaaaccugcuuguuaaagucagagacagaagaaaaggaagaacgccuucgggacacagucuuacuacaaauccucaacagguuucaguccccaaaguucuacugguagaacucaauauucuucaaaagucacacccagaacagaacuggcaugcucuaaugaaaugagauguuaacuccuccuccccagcgccuucuucuagagaacucccagaggccuuccugacccucagcgcuacagcagauugggcgcagaguggcuguucagagcuccaggcucaaccucccacagcgauccuguuccccgcagcccgcagagccucccacaccugaagcgcacgugggcugccugcugggucagcacuugcugcguaugccgggcagccugagcaccaaggaggggaacgcagagccucaggccggcagcgaagcacacagcucuccacgauagccuguucugaauccagucugcggucuuccuccuagugcuuuuuccuccugcuucccugucccuggaauaagcuaccugcacggaagcaggagaccugugaaagaaccaucucucggcagcugggugggaaggggccgcaacaguguauacaggggcugggcacgguggcucaugccuaugaucccagcacucugggaggccgagguggguggaucacuugaggucaggaguucaagaccagccugggcaacauagcgaaacccgccucuacuaaaaauacaaaaauuaggccgggcgugguggcucacaccuguaaucgcagcacucugggagaccaaggcagguggaucaccugaggucgggaguuugagaccagccugaccaacauggugaaaucccaucucuaauaaaaauacaaaaauuagccaggugugguggugcacaucuguaaucccagcuacuugggaggcugaggcaggagaaucacuugaaccugggagccggagguugcagugagccaagaucacgccacugcacuccagccuggacgacagaguaugacucugucucaaaaaaagauaaaauagaaaaagcaaaaaacaaaaauuaaccaggcgugguggcacgcaccuguagucccagcuacucgggaagcugaggcaggagaauagcuugaaccugggaggcagagguugcagugaguugagacugcaccacugcacuccagccugggcgacagagugagacgccaucuaaaaaaaaaaaaaaaagaaaccauguacacaggaaaugugaagauggcaugaaagcugggcuaucuccagauacauucaagcccaaagcugacuccucucuccaaaaggcagcagcuauacaacucugucccgggcacucagaacaaagaggcagagugcuguggcuggcagaggcggcaggugcuggaagcacacgacccccuccaaaacacaacaaagguuccguaguuggaauggugccuccgccauggggagacagaagguccucugcaacugcucuguaggcguccugcucccagccagaaaccacuccaacagcugcaagacacugcaucuuuuaaggaugcacaaaauaccuuuacugucaacagacaaguacguccacgucagccugcagaagaaacaggcucuggcucucggguugaggaugguccaggguugugagcucagcuaggacauguguggcuguaaagaacagaccaucaagccauacagguuuaaaugaagcaauguauugccucacaaaaccaaaggucuacagcagugguucucaacuggggaaauuuugcccccaggggacauuuggcaauguguggaaacauuucuggcuguuacaacuuuggguggaggagggggugauacuggcaucuacuggacagaagucagggaggccaggaugggaauaagcauccuacagagagcugggcacaguggcgcgcaccugugaucccagcuacucaggaggcgaaggcgagaggauugugugaggcuguagugagcuaugacugcaucuguaaacagcuccugcacucuggccugggcaacauagugagacccugccucuuaaacaaaagaaaacauccuacagugcacagaccaccacccacccgcagccagaaugucugccaugccacagcaugccaaggcugggaaaccagggcuaaaggagcucauuucugcauuugguuccugcaagggcucagugacauccccaaaagauccaagcauucuggugccuuacaugcugucaaugaugaauugacucuucuuuuuuagacaaggucuugcucuguugcccaggcuagaggacaguugugcaaacauggcucacuguggccucaaccuugugggcucaagcaauucuccugccucaaccucccaacuagcugggaccacagguacacaccgucacaccuggcuaacuuuaacuuuuuuuguagagauggggucuggcuauguugcucaggcuggucucaaacuccuggccucaagcuguccucccgccucagccaagugcugggauuauagaugugaaccagcacgcccugccagugaauugacucuuaaccuaucuuucccugucguggcaguguguguuccuuuuugucucuuuguaugagaaaaaaaccuuuccagaagccacccugcagccuucccgccauaucucauugggcuagagcaggucaugugcccaccucgaaauuaaucccugccaaggaaagcaggauuuuuaggaugaaguccuagaacaauaacauuuacugcuggggcccccacccugcagcgcaucaccaccugauccccaaauauaacugggguucucuauuggcaagaaagaagagggcagaaugguuaucgguggguaaccagugcaucugccccaaucucagaaauggugagucugaacaugaccccaggugcuccaauuccgggcuccuuccugcauuccacaaaucggaauuagauuauccuccaacauauuugcuucccaggcacauccuaggcauugggaaaaucuagccuaaguacaagaaugacccccaaacacaagaguaauauauaaggcagaacugugaugcuugguaaaaagcaauucaauacuuuacauguugaucagguaaugaaaugacaugccuuucuugccauauaaagauaaguaguuauuaaaguuaguaaccaaggaauaaacugauccuuuaugacacaagaaacagagggaggucacaggguagagaugauggugaaacacuacagacccuuccauuaaauggaaggugagugcaggcacugggcccagcccacccaaaucacggcucccuucuucuucaguuagggcugcagcugggccauggcugcccagucucccugggaggcauggguggacauaacacgugccaucaggaccuggcugguuaaaaccucaguaugugugcuucucuguguccuucccuuuuccugugggacagaauggcaaugaaaagaggaacugugaaagccacguguucaagaagacaagaguccugggccgggcgugguggcucaugccuguaaucccagcacuuugggaggcugagggggguggaucacaugaggucaggaguucaugaccagccuggucaacauggugaaaccccgucucuacuaaaaauacaaaaauuagccgggcgugguggcacacgccuguaaucccagcuacucgggaggcugaggcaggagaauugcuugagccugggagacggagguugcagugagccaagaucgugccacugcacucuagccugacugacagagcaagacacugucucaaaaaaaaaaaaaagaagacagaguccuagcuugaguuucuggaaugaccguguagaagagagcugcccacccaucugaauaacaugcuuaacugauacaugagugaggauaaacuucaauuacaucgaggacauugauuuuggacuucuuuguuauagcagccaacauuaccgugguuaacacacugauagcaacauugcuauucaacacuguuccaggaaaugcuagcaaaauauuagaaaaaaauacaaaucaguauugguugacgguauaccugucuaccugaggaaaauaaucccauucacaauagcaaaaacacauguauaaaauacuuaauauacuugaggaacaggaaggucuuauuuaagaagaacucuuaaggacauaagugaauacuuuuuuuuuuuuuugagacacagucucacucugucugacaacccaggcuggaaugcaguggcauaaucucggcucauugcaaccuccgccucauggguucaagcgauucucaugccucagucucucaaguagcugggauuacaggugcacgccacuaugcccagcuauuuuuuguauuuuuaguagagaugggguuuugccauguuggccaggcuggucucgaacuccugaccucaggugauccccccgccucggccucccaguaugcugggauuacaggcaugagccacugugcccagccacaauuuuuuuucuuuuuuugagaccgaguuucacucuugcccaggcuggagcgccgucuauugcccaggccugaucucagcucacugugaccucugccuccuggguucaagugauucuccugccucagccucccaaguagcuaggacuaacaggugugcgccaccacacccagcuaauuuuuuguauuuuugguaaagaugagguuucaccauguuggccaggcuggucuugaacuccugaccucaggugaucugccugccucagccucccaaagcccugggauuacaggcaugagccaccgcggccagcaaagugaguacauuuuaaugaaugauggaaacuaccacauuucuauauggaagggcccaaguguguaaagaugucacuucuucccagaauaaucuaaauuguuauuaccuauaaugguuaauaucaauaacccccucuaguuuuuuuuuaacuuuauaaauuauccuaauguucccaacaugggaauaguggagaaauucuggaaucagaagagugacaagauugggauagagaaugugguccugcuagauaaacacaugacaaaguacagcaggugacaggcuguggcucuggcaucugugcaggcagaggagaggggcaaaggcaggccagcacauaccccuguguccagaggcuucacuguacguccacugacccagcuacuccaccucuagcaauuuaucuuaacaaaaauagccacgugcguaaagauguucauuacagcuuuauucagagucgugaaaaacuggaaauacacuaguccuacaauaaggggcuucgagaucuuguccacuccuauacaguacccccucccuuucucucacacacacacaagauugagugggcuauauguaaacuguucgccuguccuuucuucccccuuauuuauaauaagcauuuuucauguuaguaacuaccagucuacuugguuccauggcugugugugcauuauauugucguuccaugacucacuucacaacuacuccccuaccagggguggucacucccaauuuuuugcuauuaccuacaauaaaacagugaagauucuuacagugaucuuuauguuaugugucuauggaauuaaaacaaaguuacaaugaccacuuacugauuuucuaaucaucugucauguacaaaaugcaaaagccacaauaagagaguauuacacucucauuaaaaugaccaaagugaaaaagacugaccauaccaaguguugaagaggaugggggagaacuggagcuuucauacacugcagcugggaauguaaaaugauacaaccacuuuggcaaacaguuuggcagcuucuuaaaaaauuaaacauauaccuacuggaagcaacccaaauguccacuaaugggaaauggauaaagaaauuguauauauccauggacucuuacucagcaguaaaaaagaaggaaacuuugauguacacaacagccugaaugacucucgaaguagcuuugcugagugaaagaagccagaccagaaaaggagagagacggcacauacugugggauuccauuuauauaaacuuucagaaaaugcaaacaaaucuauggugacagaaaacagaucagugguugucuggggacaagggagggagggagacgacaaaaggacaggaggaaacuucugggggugacagauccaugcucauugucuugauuguggugaugguuucacagggauaaacguuaugucaaaacucuuuaaauuauacacuucuaaaugcuugcaguuuauuguaugcccaauaaaguuggaaagaaauuuaaaaggaaaagacuauuuuuaaaagauagguaaaugggaaugccuguaugugacucaaauacaagcuugaauguugguauuccuguucaaacaguugcuuuuuuucugaaaaauacaaguuuaacuuaguuccuucuguauuaguuggcccaggcugccauaacaaaauaccacagagugggcggcuuaaacaacagaaauuuacuucucccaguucuguagguugggaguccgcaaucaaggugccagcaguuucagcucucuuccuggcuugcagacagccaucuccucacuguguccucacauggugggaggugggaggaagucugucucuuccucuuccuuuuuuuuuuuuucuuaagagacuccuggacucaagcaaaccucccaccucagccucccaaguagcugagacuacaggugcaugcuaccacaccaggcuaauuuuguuuguucguuuguuuuuguagagaugggguuuccccauguuguccaggcuggucucaaacuccugggcucaagugauccaccugccuuagccucccaaaguccugagaguacaagugugagccacugugccugcccuccuccuauucuuauaaggccacaguccuauuaaauuagggucucauccucaugaccucauuuaaccuaaaccaucugccaaagauccuaccuugauauacagcuacacugggguuaagacuucagcauaugaguuugaggggagaaggagaaacacaauucaguccacagcaccuuccacaccaaggcgugacauggaguuucuagcuccuaacuuucuugggagaauuuauauaguguaggugggucacaaacccuuucccuuaucuauaaacucaauucuguuagauugcuggauauuuuagucuauuuucuguugcuuauaacagaauaccugaaacugggucauuuauaaagaaaauaaauuuacuuuuuacaguuacagaggccaagcucaaggggcugcaucuggugagggccuucuugcugguggagacucucugcagagucccgaaguggugugggauaucacauggcaaggaggccgagcaugcuaaugcuagcucaggccucucuuccucuucuuauuuagcuaccaguuccucacccaggauaaccuaucaaugcauuaauccauacgucgaguaacucauuuaugagaacagagcccucauggucuggucaccuuuuaaaggcccccccaaccccaauauugucaaauugggguuaaguuucagcauggacuuuggaagagccauucaaaucacagcacuggaggaauaauucaucucuaaaucuggacuaccuccagccccacagcagaccugaaaggaagaauggcaaaaauauuccuucacucaaacacaaaguaaauagacuauccuggcuacaaauuaucgaaaagcauaucagacucuuuucagcaaagagaaaugcucuuuucaaaaagaccaucucgaucuuacagugugaguggcccucacugaggcugcugugaagccugggguagcagugcucuugaacacccucagcuccuucagauaaccugggguaaggggugaagcugcaacaucaucagagccccagcauggcacccacaacagaacgacagcaaaggauucagcagccuuugccacaccuuagaaaugggaguuaggacugggcacgguggcucacgccuguaaucccagcacuuugggaggucgaggcaggcggaucaccugaggucaggaguucaagaccagucuggcgaaacccugucucuacaaaaaauacaaaaaaaauuagccaggugugguggcgcaugccugugaucccagcuacucaggagccuggggcaggagaaucacuugaaccugggagguggagguuguagugagccaagauugggucacugcacuccagccugggugacagagugagacucugucucaaaaaagaaaagaaaggggaggggagggaaaaaaacgggaguuggaucugcaucuucuaaauacuggugccaagagcaucaggacacugccagagacaaauggaugcugggcuggccccucuccugcagagguacaggaucuaguuuaacgugaagccagucaagaauucccaucaacagcauccuuuccauuuggugucuucucagaaggcaauucaggcccuuaucauuccacgaugacccuggcccugcacuuaccuggccaccuccacccucacggucauagccacagaggucaucagaacaaagguugcuagaaaauggcuaaaaucauagccccaaauuuaggugucacgcucuaacagaggaugcccuacaagugagaugcugagaugaaaccaggcacccugcaggcugaaagaugcagcucauacacaaggaggcuggcagggcucguagccuuguucuaggcacugagcaugcagggucuggccagcagggauaaggagugcagagucaacuguggcagcagcaccaaggcuccagugggggaggaaggcugaaagggccacccccagcagacauguaggauacccccacaaugcagugccccauaaauaagcuggugcagagcucuuggcaugcgguggagggggcacaaaucaccuggaacgcuuuccugacucagcaguucugggugcuuaacuguaucaccacacacacacacacacacacacacgcacacacaccccaaagucgaagcuccucacugggcuccuggaucaagaacaagacuaaagaaaucacacuuccucuguuccuccacaaggugugugauaaaagaccaucugggcuucuaccagagaucagcuuuguaaacaggugacagguggagagacagccugcaccuccucaucacauucugucauggcugaacuguaucccucucaaacuccuauggcaaagcccuuccugaccuccaccugagacugggacuguauuuagagacagguucuuuuucuuuuucuuuucuuucuuuuuuuugagacagagucucacucuguugcccaggcuagagaacagcagugccaucuugguucauugcauccuccaccuucuggguucaagugauucuccugccucagccuccugaguagcugggauuacaggcaugcgccaccauacccagcucguuuuuauauuuucaauagaaacaggauuucaccauguuggccaggcuggucuugaacuccugaccucaagugauccacccaucuuggccucccauaggccaagggauuacaagcaugagccaccauacccggccggagacaggauuuuuaaauagguaaucaaaguagaaugaagcaguuagggugagcccuaaugcagucugacugguguccuuguaagaagaggaaaucugggccaggcgugguggcucacgccuguaaucccagcacuuugggaggccgaggcgggcggaucacuuaaggucaggaguucgagaccagccuggccaacauggugaaaccacaucucuacuaaaaauacaaaaauuagcuggcugugguggcaggcaccuguaaucccagcuacuuuggaggcugaggcagaagaaucgcuugaaucugggaggugaagguugcagugagccaagaucgugcuacugcacuccagccugggcaacaaagugagacuccaucucaaaaaaaaaaaagaagaagaagaagaaaucuggauacagauacacccagagggaugauccugugaggacccagggagaagacaccaucuccaagccaggcagcgaggccucagaagaaccaacccugccgacacguugauauuggacuucuggcuuccagaacugugaaacaaaacaaucuguuguuuaauccacucugccagugguauuuuguuauggcagcccuagcagacuaacacagacuccaggcugaagaggauuuaugugaacuaauacuagucaacagggaagaggaguugauucaggcagggguaaaaaaucaggaucccggccaggcacgguggcucacgccuauaauuccagcacuuugugaggaucacucgagcucaggaauuugagaccugccugggcaacauagugaaacccugucucuaugaaaagaaaauacaaaaauuagccaggcaugguagcgcacacaugccuguagucucagcuacuugggaggcugaggcaggaggauggccugagcccaggaggcagagguugcaguaaacugagaucaugccauugcacuccagccucaaaaaaagaagaaggauucuguuggacucacccaaguuuuuauuaauuuauuuauuauuuugguuuuugguuacccaggcuggagugcuggagugcaguggugcaaucucggcucacugcaaccuccgccacccagguuccagaaauucucuugccucagucucccaaguagcugggauuacaggugccugccaucacgcccggcuaauuuuugcauuuuuaguagagacgggguuucgccaugucagcaaggcuggucucaaacuccugaccucaaguaauccacccaccuuggccucccaaagugcugggacuacacacgugagccaccacgccuggccucucaccaaguuuuuagguaaagaguucuugcagccgaucuguaaagggcuggaguaguucacuaggucuccaagcuccaacccguguucuucccaccacacugcagcacuaauucugaaacacaccaucaggaggcucugcuuuaaacaggaggugcuuguagcuaacugaugaagacuccggaagcugaacugugugacaccacagaccucaugcugcccuuccuguucauggcugcucugugaaaccguagugugucaucagauaaaagcagcgaaaaaacaaaaaacaaaaaaaacugguucauuuaggaccauuauaacuuuuuuuuuuuuuuaaagagcuuuaaugauaagauuuuuaaauccagaguuaauuuauuucuauuagccuucacuuccaaaaucaaagcuguaaaucaggcuugguagagcaccuggguucagggcucaaaagggcacuugaugaaaauguuuuucuugggccgggcgcggcggcucacgccuguaaucccagcacuuugggaggccgaggcggaugaaucaugaggucaggagaucgagacuauccuggcuaacacggugaaaccccgucucuacuaaaaauacaaaaaaaauuagccgggugugguggugggcgccuguagucccagcuacucgggaggcugaggcaggaggauugcuugaacccaggaggcgaagcuugcagugagccaagacggggccgcugcacuccagccugggcgacagagcaagacuccaucucaaaaaaaaaaaaaaagauaaacuauucucuaacacagaaaaauucuaaaaaugaugcugaaacauugagcaaguuugaaaaugauaccauuagaaucugucuacagcuggacauaccaagaccuucugggaaccaguuuucuuaguugaaaaaaggguugacuggaugagucuucuccuccaaaucuaaguuuuaugcauuauaacauuuaguuaccuaccuuaaaaaaaagaauguugacccuaagcuuuuguguccuauaucauuguuuaaaucuguauuauaaagaauuuugcuaauucaacucucaacucuuuuuugagacagagucuuccucuguccccaaggcuggagugcaguggugcaaucuuggcucacugcaaccucugccucccagguucaagcgauucuccugccucagccucccaaguagcugggacuacaggcauucgccacgaugccuggcuaauuuuuuuuauuuuuaauagagacaggguuucaccauguuggccaggcuggacucaaacuccugaccucagguuauccaccugccucagccucccaaagugcugggauuacaggggugagcuacugcgccccgcccaacucucaacucuuacucacugaauuucugugcauaaguccaagaaaugugacgaucaccaaagccuuaaaaaaauuccuuuuuuuuuuugagccagggucucacucugucacccaggauggagugcaguggugcaagagcuccaggcugaggcuccagggauccucccaccucaggcuucugaguagcuggacuacaggugugcaccaccauggccagauaauuuuuguaguuuuggagagacaagguuuugccauguugcccaagcuggucugaaacuccugggcucaagugauccuucugccuucagccucccaaagugcuaggauuacaggcaugcaucacugcacccagugaagaaaauucuuuauucauaccaacuccuaucagggacccuugaaugcagaaguugcaaguuucacagaaccaaguauuccugaugcugaucaagaugugcucccuccagcaccauccaaacccuccacauccaguaacggcaggaacugaucucaggccuaauggugcgggcauccacacuggcucuugugcuugcugacggcccggggaauucuuggaaugggugaggcagagguucccuugcucacagccucccugggaggaagcucaguggcuuccccuccccgccagagcaaaauccuaucaguggccugacccugcuguaucucuggucacucuguccucuggcuacuccuguccccuucccaugccuuggacacaggcccaugccccagauugcccuucccaccagcuugcucacuucaccccaaccucugcuuuaaggucacgcugucaguguccucucugucuaaaauagcacucccuccuccuuccuccauaccccacuuccccaguuuauuuuucuucuuagcauucagcaucugacaucacacagucaucugucgucugucucucgccaagaaagcgucauuucuuuccaugagagcaggggcuuaguguucaaugccuuauccccagcacugagguguuaacagaucuuguccuaccacugucauagcauucuagggcugcuauaacgaagugccacacaccagguggcuucaacaacagaaauguauucucucauguuaagucugaaaucaaggugucaagagagcggcuuucuucugaaggcugcauagacaaucugucccgugccucuccccccgcugcuaggaguuugcugucauucuuuggcacuucuuggcuuguagaugcaucuuucuggucucugccuucauccucacauggugccuucccucaugcaugucugugucuacauuuccccuuuuucaucaggacaccagucacacuggauuagggccacccccuaaugaccuccucuagcucgauuagcucuguaaagaugcuguuuccaaaucaaguuacauacugagguacuaaggguuaagacuccaggguuucuuucacggaggccaaaauucaauccauaauaaccacucaguugccauaagacacugggcaaguagguuagccuucaucgguaaaaugggccuaauaauugcgccuacugcauuugggugauggagacagggucccuggcagcaaagaagcacagcccuuuccccuuacguaagcuauacagauacugacaugaagaaggcuggaggcucugcucaugagcaugggccuuggaaccaggcuggucggggucugagcccucucucugccacuggcuggcaguggccuugcacaagugguugaaccugagacggaucucaagauacauuuuaaguauuauacaauaaugcacgucaacuccuuagcacgcagugagcucuccaugaaugucagcggccucaggcaaagcagagguagggacugacagcaucaccuuugucccaaccguaucuugcaaauucuucaagguggcugcuuaaacucaacaguuaaucacagcagcagggaacaagaaaugagauccaagaggagacccuugggaugggaauccucagguaacaacucuaacaaaguuaugucuuuuuuuuuuuuuuugaaacaggguuuuguucugucacucagcacuacgugcugcagcguaguggcaugaucaugcucacugcagccuugaucuccugggcucaagcgauccuccuacuucagccuccuaaguagcugggaggacaagcaagcacuaccacggcuggauaauuauaaauaaauaaauaauaauuuuauauauauauauuuauuuauuuauuuagacagagucucacucugucacccaggcuagagugcaguggcacgaucucagcucacugcaaccucugccucccggguucaagcaauucuccugccucagccuccuggguagcugggacuacaagugcaugccaccaugcccagcuaauuucuguauuuuuaguagagaugggguuucaccauguuggccaggguggucuccaucuuuugaccucaugaucugccggccucggccucccagagugcugggauuacaggcaugagccaccgcgccaggccuagaauagaaauuucuuccaaaaagauacacaaaugcccaaaaagcauaugaaaaggugcucaaaauuauuagucauuagggaaaugcaaaucaaaaccacagggagagcucuaccgguggaauuugauugugugaugucucacagaaaguucuccacucccagacaugggucccucugcuuccugccauaggagugaagaaauaggcaacgugggaaggugaagagcuucccuaaggaugacccuuccaagcuggucaacgucacagccuuccugggauacaaggcuggcaugacccacaucacacgggaagucgacaggccaagauccaaggugaaagugaaggaggugguagaggccaugacuacuguggagacaccaccuauggugguugugggcauugcgggcuacguggaaaccccuugaggccuccggaccuucaaggccaucuuugcugagcacaucaacgaugagugcaaaagguguuucucuaacaaccggcauaaaucuaggaagaaggccuuuaccaaguacugcaagaaauggcaggaugaggauggcaagaagcagcuggagaagacuucagcagcaugaggaagcacugccaagucacccgccucgcugcccacacccagacgcgccuacuuccucugcgccagaagaaggcccagcugauggagauccaagugaacggaggcaccauggcugagaagcuggacugagcccaggaggggcuacagcagcagguaccugugaaccaagcguuugggcuggacgagaugaucgacaucaucggggugaccaagggcaaaggcuacaaaggggucaccaguuguuggcacaccaagaagcugccccacaagacccaccgaggccugugcaagguggccuggauuggggcauggcauccugaccauguggccuucuccauggcaugugcugggcagaaaggcgaccaucaccacacugagaucaacaagaagaucuguaagauugaccagggcuaccuuacugaggacagcaaaccgaucaagaacaaugccuccacggacuaugaccugucugacaagagcaucgaccuucuggguggcuuuguccacuauggugaagugaccaauaacucuguuaugcugaaaggcuguguggugggaaccaagaagcgagugcucauucucugcacaucuuugcuggugcagaccagacgaugggcucuggagaagacugaccuuaaguucacugacaccaccuccaaguuuggcuauggccgcuuccagaccauggaggagaagaaagcauucaugggaccacucgagaaagaccgaauugcaaaggaagaaggagcuuaacgccaggaacagguuuugcaccugguggggucucaauaaaaguuauuuuuuaaaauuauuaauuaaaaaaaaaaacccacagggagagaccacuucacacaacuaggaugguuaucauuuuuaaaaaacugaaaauaggcugggcacaguggcucaaaccuguaaucccagcacuuugggagguugaggcgggcagaucaccugaggucaggaguucgagaccagccuggccaagauggugaaaccccaucuguauuaaaaaguaaaaauaaaaaauuagccaggcauggucgcuaacgccuauaaccccagcuacucaggaggcugagggaugagaaucgcuugaacccaggagguggagguugcaggagccaagauugcacaacugcacuccagccugggcaacagagcgagugucaaaaaaaaaaaaacuugaaaauaaguauuggugaggauguuaggaaauuggaacacucacgcauugcuuuugguggauauguaaaauggugcaacugcugggaaaacaauuugguggcuccucaguaaguuaaacauagcguuuccguaugucccagcaaugccccuccuaaguaugcaccccaaagaauugaaaacugagguucaaacaaaagcuugcaaaugaaugcucauagcaacacuauucacaauagccaaaagguaaaaaucuaaauguccaucaacugaucaauggauaaagaaaaauguggcucggcgcgguggcucaugucuauaaucccagcacuuugggaggccaaggcaggcagaucacuggaggucaggaguucaagaccagccuggccaacauggugaaacccugucucuacuaaaaauacaaaaauuagccgggugugguggugugcgccuguagucucaguuacucgggaggcugaggcaggagaaucgcuucaaccuagaagguggagguugcaguuagccgagacugugccacugcacuucagccuggaugacagagugagauuccaucucgaaaaaaaaaaaaaaaaaaaagaaaaagaaaagaaaagaaaagaaaaugugacuuacccauacaauagaguauuauucagcuguaaaaaggaagguaauucuaacacauacuauaacauggaugaaccuuaagaacauuaugcuaaaugaaauaaaccagucacaaaaagccacaugugguaugauuccauuuccauggaaaguccguagagagggaaaguagauucgugguuaccggggcuggggggagggaggaauggggaggaacugcugaauggguacggguuuccuuuuggagugaugaaaauguguggaacuagauaguaaggguuacacaacaugguaaacauacuaaaggccacuuaacugugcacuuuaaaauggguaaauggugaauuuuguguuaugugaauuuuaucucaauaaagaaaaagaaaaaacagaaauaaugaagacugugcccuccccaacaauaaauaugcuguucggcugggcacgguggcucaugccuguaaucccuguacuuugggaggcugaggugggcggaucacuugaggucaggaguucgagaccagccuggccaacauggugaaaccccaucucuacuacaaauacaaaaaaauuagccaggccugguggcgggcaccucuaaucucagcuacucaggaggcuguggcaggagaaucgcuugaaccugggaggcucagguugucaugagccgagaucgugucacugcacuccagccugggugacagagcaagacuguuucaaaaagaaaaagaaaagaaagaaaaaguaggcuguucuuagacuccaggagggcugaguacugaaaagugaaacauccagaagaaugugggacucaaugcgguucuacugcuucucccuuuccccucaaaaagcaauccaccuucagagcaagucugcgaaugcaaucugcauucaccuagagaauuccugagauagagcuguaaaaccaaagaauuugcaagcucuuauuuccuguuuuaaagaccuuagaaacauuuauccaccccagccagcacggagccgugacauuuacaggucguaaauauaccuugcaaaagaccagcagcuuacuggccacgagcuguaagaacugcccaucugcagcgugccugauagccaucugucagggcuggagggucaggcugcugaaauucuucacucaccccaguuccccugguguguuuggccuggggagcugagaucugcagaguagaguuagacaucuccuaacucccaccuagcacuugggcuccaaacucagguccugucugaacagcaacagagccagguacagcuuaucuaagcccagauaucaucuaccuacauguuguaguggucaucugagcacuugaaagucccugugucacuuucuuucugggaaagaaaggaugggaaaauauaaugcucccaucuauaugucacuuauauagagaugugguucccaaccuuuuuggcaccagggaccaguuucguggaagacaauuuuuuuuuuuuugagacggagucuugcucugucacccaggauggagggcaguggugcaaucucagcucacugcaagcuccgccucccugguucacgccauucuccugccucagccuccugagaagcugggacuacaggugcucgccaccacgcccggcuaauuuuuuuguauuuuuaguagagacaggguuucaccgcguuagccaggauggucucgaucuccugauuuugugauccgccacucaccuuggccucccaaagugcugggauuacaggugugagccaccacgucuggccacguggaagacaauuucuccacagaugggguggcagaugggugggagggcgcaugguugguuucaggaugaaacuguagaucugcuguuguaccaccucagaucaucagguauuaguuagauucucauaaagaguggccaggugugguggcucacgccugugaccccagcacuuugggaggccgagguggguggaucacuugaggucaggaguucgagaccagccuggccaacauggugaaacccagucucuacuaaaaauacaaaaauuagccaggugugguggcacgugccuguaaucccaacuacuuggguggcugaggcaggaguaaucgcuugaaccugggagguggagguugcagucagccaagguugcgccauugcacuccaaccugggcaacagagugagacugucucaaaaaaaaaaaaaaaaagauucuccuaaagagcaugcaaccuagaucccucacaugugcaguucacgauaggguuuaugcuccagugagaacccagugccaccacuaaucugacaggaggcagagcccaagcaguaaugcucgcucgcaccgcucaccuccugcugugcgucccgguuccuaauaggccacggacugguaccggucagcggccuggggguuggggaccccugauauagaguacaaggucaagcccacgugugaccaguuuugguuuuccuagaucugaccccauacacacacaugcacacacguaugcacacacaugcacacacacacacaaguuuugggcagauuucaauauuuauuucaacuuuuauucuucuaggaguuaccagacagcaguaaaaggaucaaaaaaguagaucaaagaagaaaaauaaauaaaaauccuaaggaguauacaaagaacagucuuugaauaccuaauuugaccauuuuaaauuuuaucuugucuagacauuaacauuguuaagaaaaagacuucaacuauacgaacacuauauauauuuuuaugcucagaaaaagcuggaaggagguacauacauugauagguuaacaguggguaacacuggaggacagaauuaugagugguuuuuuucuuuucuauauuuucuaauuauuguaaucaucauuguauauauaaugguauuuccuugaaauaauauaaagauuauacuguauaauauguaaugauauaaagauuauaaaauacaaauaauauaaucauguaauuucuuauaauaauaaaaagacaauuacguccccaccuccaugcaauccaaauaggauacacccuacauaccuuguugaguuugccaagugaagauaugagauccgcccauucacucgaggacucaaaauuucucaaagccuuuucaaucacugaagaguagcuucuguaucuguaaucauuuaagagcuccugcucuucuggauccaucuuacauucucacagcagaaaaguaucuaaaagcaaaucaaaaaauaaccaaaugagagagccauuuggggauacaaaucauucccaacccagagcuacagaagacacguguccacaaacacaacugugcacaaacucacugggcaauccuguucaaauauuuagcaaggcuucugggccaggcacuguggga

SEQ ID NO: 192653 - RNA, 31437 nt, Homo sapiens
cgggaagcggcgcgcgcugcgcgggaggugacggugccucugacuguccgggucccuccagguacggcuucccuggcccgggcagcuccgcggcucuuuuggucgcgucgguccgggccagaggcccucgccgagggcgggccccugggccccgggauagcuccggagcggcgcgcguuggggcggcggggccccguccacccccggccccgcgcggccuccucccggcggccucagucccagcuucccgggcccagcgcccggucccugggaaaggcgggguucuccucucgccccgccgccccgguccccuaccccguuuggcccccucuuccgggaggcuccucccggggcgggccccuccccgggcucucagggcgcgccccuagccccuacuaagcggggacaggccgugcagacggccggggccccuagguagccuuuaccuggguguuucguuuugcuuuucuggauguagcggcguaucauaaacuuguggaugucaggacccagcgaagcauuuuagguggagcuagcaagguguuauugucagauggcaacguuaacauccuuucccaaugcagugugcauuuuaaauggcuccuggccccuauucagcgcucaauaacccuuugcugcuguuaacacuguuguuuaauccaucaccagcauuuugcagcuuucuccugucuugaagaaguagaacggugcccgagaaacguuuuuccccuucgagacucaggaggaugaaagucaucacuugugaaauagccuggcacaacaaggagcccguguacagccuggacuuccagcaugggacggcugggaggauccacagacuggcgucugccggcguggacaccaaugucaggguaaacuggggcagagauagacauccgggaacacugcuugaagcaauaguuuucauucuuuuacuuaaaaccagugucggcugggcgcgguggcuuacgccuguaaucccagugcuuugggaggcugaggugagaggaucgcuugaguccaggaguucgacaccagccugggcaacagccagacaugaaaaaguagcgggacguggcagugugcagcuguaggcccagcuacuugggaaguugaagugagaggaucgcuugagccuaggaguuugaagcaagcaacgaucacuccacugcacuccagccugggugacagagccagacccuucucuuaaguaaaugaaugaaugaauuaacguaugucaacaaacuaaacuacuuugucaucuagcccagaaugcuaaauuuccagggccugcggugaacaaugaaagcaaaagagagcugcuuucuuuuuuuuuuuuuugagacggagucuugcucuguugcccaggugggagugcaguggugcaaucucgacuuacugcaaccucugucucccagguucaagcuauucuccugccucagccucccaaauaacugggacuacagccgcucaucaccacaccuggcuaauuuuuguauuuuuaguagagaugggguuuuaccauguuggccaggcuggucucaaacuccugaccucaggugauccacccaccuuggccucccaaagugcugggauuacaggccugagccaccaugcccggcucugcuuucuuauuugauucauuuucccuagauuauuguaacuggacguucauuguuuugggauccugauccugguuccuacuggguaacaaguugcucuagaaagaaggcggagggggacaguagacauuuauguuuuagauagggaguucuuugauuuuauguuucaaaagaaaaacuaaguuuucuuucugaaaauaagcauaguuuuguuuuuuuuuuuuuuuugagacagggucuuacucugucgcccaggcuggagugcaguggccugaucuuggcucagugcagccccgacccggggcucaagugauccucccucuuaagccucccgcauaacuggaacuacaggcaugugccaucacacuuggcuaauuuuuuaaauuuucuguagagacuaggucucacuguguuuccaggcuggucuugaacuccuggccucaagugauuuacccaccuuggccuccuaaacugcugggauuacaguugugagccaccacacccagcccauaguauuguuuuaauacagacaguauaauaugugcccauucuauguuuuucaaaugaauguguugguauugacagaucuggaagguagaaaagggaccagauggaaaagccaucguggaauuuuuguccaaucuugcucgucauaccaaagccgucaauguugugcguuuuucuccaacuggggaaauuuuagcaucgggaggagauggugaguauugcuguccuucagagauucuucgggaaccagauagauaccugugugucuugugucagauagugagauuugagcuggauaugcuuuuuuuuuuuuuuugagauagaguuucacucuuguuccccaggcuggagugcaguggugcaaacucgacucacugcaaccuccgccuccuggguucaagcgauucuccugccucagccuccugaguagcugggauuacaggcgccugccaccacgcccggcuaguuuuuuuguguguuuuuaguagagacaggguuucaucauguuggucaggcugaucucgaacuccugaccucaggugauccaccugccucggccucccaaaguguugggauuacaggcgugagccacugcgcccggccuggauaugcuuuuuaguucagguguggcugacccucucaaucugucauuuagguaguucaguaaaauacuguucuagggaaugugguagagucagggagggaggacagcaagaugaaaccaggaacaccuguuugaaaacagcugcuuucccgcaagcucccaccaggcuguucuaagacgagauggaaaggcacuuaccauucugucacaucccaagcaaggcgacuguucugguuuuguuggauuguuaguuuaacaucuguggugaucagagucaguucugugucucuguguaauuaauuaaauggcuuuaggacuguguuaguaauuaauuggcuuugggaguuuuuuuuuuuuuuuuuuuugagacagucucacuguuaucuaggcuggagugcaguggcacaaucuuggcucacugcaaccucugccucccagguucaagcgauucuccugccucagccucacaaguagcugggauuacaggcgccugccaccacccccggcuaauuuuuguauuuuuaguagagaugggguuucgccuugucagccaggcuggucucaaacuccugagcucaggcaaucugccugccucggccucccaaagugcuaggauuacaggcgugagccaccgcgcccgggcuauuugggcaugaauucuaaacugggauaugaaagaauucagcaauggcaaaguuccucauggaggugugccaugcucagaagugcagugugcccucccacuggccccucuucagugggcccugaguagcugcucguguuugaucucccuguaagaaaggcaguagcugaaaagcaccuaagcugccaacacuguggaaacccccgcaaugcucccuuucuucacagugacauacuuguuguaauacccauaguagccucugaaacgcuccagcagugccggucgggguaagaucccgcgucgguacccagcuuggcagcuccucugguuugacaucuguguguuuucucccauucccugcugugacugaugcugcuuuggaguccuggugucugcagugccgggcugcuggagggugcuggggagggagcauaccgggagugucauuaaugaauggccuugugauuugugcuugcuuguuuggugggaauagauugauucuuguuuucugccugugcuuaaaugggauaaaacuauauggaaaaaguaaaccaggcugggcgcggucgcucacacauguuguaaucccagcacuuugggagaccgaggcagguggaucauuuggggucaggaguuugagaucagccuggccaauauagugagaccucaucucuacuaaaaauacaaaaauuagcugggcaugguggugcgcuccuauaauccuagcuacucaggaggcugagguggagaaucgcuguaaccugggagguggaaguugcacugagccaagauugggccauugcacuccagccugggcaacagagugagagucugucucaaaaaaaaaaaaaaaaaguaaaccuuuuuaccauacuuuaaaacaaucuagaaacuauuacaaaauaaaacagaaaucuaaaguuuuuuuuugcaggaggaggaaaagagaccugguugaguucagugccaugauacccagagugcaugaagggaugugugugugugugugugugugugugugugugugugugugugcgcgcgcacgcugauuuguagagggaaaaguggggagcaggagcgccaccuggggguggcuaccugcugucugcccugagguugcacauggcagcccccauuuuccaaagucccuuggucuuggaggcccagaaaccugcuguugucagcacguggagaguguucauccaucagggccaauggcauguuaaccaagcucccagacuaaugugugcgaauaggauuccgguuaacuuagcaugggaaugcaggcugggugcgguggcucacgccuguaaucccagcacuuugggaggcugaggugggcagaucaccugaggucagggguucgagaccagccugaccaacauggagaaaccucgucucuacuaaaaauacaaaauuagcugggugugguggugcauaccuguagucccagcuauucgggaggcugaggcaggagaaucgccugaacccgggaggcgaagguuguggugagccaagauugcaccauugcacuccagccugggcaauaagagugaaacaccaucucaaaaaaaaaaaaaaaaaagaaagaaaaacaaagaaugggaaugcguauguccucacaaccucauucauucacuguccugcugugcacauuccuaaaagggaagcuaagggauggucagaagguuacgugguaaucguagagucagaauguggggaguuauuggacuuagacaaugggugaccucaggcuaaaguaccugauaucuauaaugguauuaauagcugacacuuacauggggcuuacuaucugccagccauuguguuguaaguguguuauauacauuggccaauuuaauccucacaacagccugugagguagauauauuguuauccucauuuuugagacagggucuugcucugucacugaggcuagagugcaguggcaagaucaggacucacugcagccuccaccucccgggcucaagugauccucccaccucagccuccugcguagugggaccagaggugugugccaccacaccuggcuaauuuuuuugauuuuuaguagagacaaggucuugcucucuugcccaggcuggucuugagcuccugggcuaaaacaacccuuccaucucagccucccaaagugcuggcauuacaggcgugagccaccccacccugccuauuauccccauuuacaggugaggaaacugagacaucaagaugcuaagugacuugcugaagguuucugagcuaggaacauuugccaacccuugcacugaggguucuuugcuguuuuguuuuucuauucagcuauuuauagguuaugccuucagauuuauuaauguagccagucauuuugcaguggcauuugcuggccuagggacccuucuguuuaaggugauuuuguauagcucugaucuguuaugaauuugauuuuggaguuuuagcucagaaggcaauuugccuacuuucccuguugaaaugcuuggaaguaaaucauccuggccauaguguccacugaacaacauaaauguuguuuuaauacccuaaaaauccugacaugcagcuaauuuuuuuguauuuuuaguagagacaguuagccaggaugguccugggaggcagagguugcagugagccaagauugcgccacugcacuccagccugggcgacagggugagacuccgucucaaaaaaaaaaaaaaaaaugaaaauaaaaauccuaauaugaaggagugugggugaagcguggaucacuguuacugaaucacccugcagaugcugucauccuauuguggaaggugaaugauaacaaggagccggagcagaucgcuuuucaggaugaggacgaggcccagcugaacaaggagaacuggacgguugugaagacucugcgguaacuugggagggaccauggcagugaucucuguuuacgaugagugcauuaaauggaauauaccuuuugacuuuuuuuuucuuuucuuuugagauagggucucauugucgcccaggcuggagugcuguacugugaucacaguacccugcagccuugacuucccgggcucaagugauccucucaccucccaaauagcugggacuacaggugcaugcuaccaugcccugcugauuuuuaaauuuuuuuuuuuuuuuuuuuuuuuuuuuuuuaguauuuauugaucauucuuggguguuucucggagagggggauuuggcagggucauaggacaauaguggagggaaggucagcagauaaacaagugaacaagggucucugguuuuccuaggcagaggacccaguggccuuccgcaguguuugugucccuggguacuugagauuagggaguggugaugacucugaaggagcaugcugccuucaagcaucuguuuaacaaagcacaucuuguaccguccuuaauccauuuaacccugaguugacacagcacauguuucagagagcaggggguuggggguaagguuauagauuagcagcaucccaaggcagaagaauuuuucuuaguacagaacaaaauggagucuccuaugucuaccucuuucuacacagacacagcaacaaucugauuucucuaucuuuuccccacauuuccccuuuuucuauucgacaaaaccgccaucgucaucauggcccguucucagugagcuguuggguacaccucccagacgggguggcggccggguagaggggcuccucacuucccagacagggcggccgggcagaggcgccccccaccucccggacggggcagcuggccgggcgggggcugccccccaccuccuggacggggcagcugccgggcagagaugcuccucucuucccagacggggcggcugcugggcggaggggcuccucucuucccagacggggcggcugccgggcggaggggcuccucacuucucagacggggcggccgggcagagacgcuccucaccucccagacagggcggcggggcagaggcgcuccccacaucucagacgaugggcggccgggcagagacgcuacucacuuccuagacgggguggcggccgggcagaggcugcaaucucagcacuuugggaggccaaggcaggcggcugggagguggagguuguagcgagcggagaccacgccagugcccuccagccugggcaacauugagcacugagugagugagacucugucugcaaucccggcaccucgggaggcugaggcuggcagaucacucgcgauuaggagcuggagaccagcccggccaacacagcgaaaccccaucuccaccaaaaaaauacgaaaaccagacaggcguggcggcgugcgccugcaaucccaggcacucggcaggcugaggcaggagaaucaggcagggagguugcagugagccgagauggcggcaguaccguccagccucggcuuggcaucagagggagacuguggagagagcgggagagggagagggagacgguggagggagagggagagggagaggauuuuuaaauuucuguggagacagggucucacuauguugcccaggcuggucuaauuuagaaguuuuauuuauaugaaacaguccuaagacaauaguuuuaaaggaugaaagcauaauuaaaauggauuuucuuaguuucggcuauacauuuuucuuaguaaaaaguauucaauuuuaaagauacagcuauccuuuuuuuuuuuuuuuuuuuuuuuagauggaguuuugcucuuguugcccaggcuggagugcaauggcaugaucucggcucaccgcaaccucugccuccuggguucaagcgauucuccuaccucagccucccgaguagcugggauuacaggccugcaccacuaugcccagcuaauuuuuuuguauuuuuaguagagacgggguuucuccauguuggucaggcuagucucaaacucccaaccucaggugauccgcccaccucggccucccaaagugcugggauuacaggcgugagccacugcgaccggucagauauagcuauccuugaaaguaguuuuuuauagcuauagcuaauauagugccaguggaaauuuuggaaucucauuuuaaugcuuaguucuggagauuguccuuauauuuuugauaacuuguccguuuuugaguuaauaauugcuuuuuguuuuguuuuguuuagagucagagucucacucuguugcgcaggcuggagugcaguggcaugaucuuggcucacugcaaucucugccugcuggguucaggggauucuccugccucagcccccaaguagcagggacuacaggugugcgccaccacaccuggcuauuuuuuuuuuggcuaauuuuuuuuuuuuuuugagauggagucucacucugucgccaggcuggaguguaguggcgcgaucuuggcucacugcaaucucugccucccagguucaagugauuccccucccucacccuccugaguagcugggucugcaggugugcaccaccacgccuggcuaauuuuuuguauuuuaguagagacgugguuucaccauguuggccaggauggucucgaucucccgaccuugugaucugccugccucggccucccaaagugcugggauuacaggcgugagccacagcaccuggcugauuuuuguauuuugaguagagaugggauuuuacuguguuagccaggcuggccuugaacuccugaccacaggcagucugucuaccuuggccucccaaagugcugggauuacagggguaagcugcuauaccuggggaguaauugcuuuuuuccucuuuguuuuuggauucuaggggccacuuagaagauguguaugauauuugcugggcaacugaugggaauuuaauggcuucugccucuguggauaacacagccaucauaugggaugucagcaaagguaaaugauauauuuuuguuauuagcaggaagaaauauucuaagcaucuauaaaagccuaaaagucuaacuugcuuuaacuuuuuuuuuuuuuuuuuuugagacaggaucucacucugccgcccaggcuggagugcaguggugcgaucuugguucacugcaaccucugccuccuagauucaagcgauccuccugccucagucucccaaguagcugggacuacaggcaugcaccaccacacccaguuaauuuuuguauuuuuaguagagacggguuucaucauguuggccaggcuggucucaaacuccuaaccucaggugaucugcccgccucagccucccaaagugcugggauuacaggcaugaaccacugccccuggcccuaacuuaccuuaacuuuauuuuuuauuuuuauuuuuuuggagacggaguuucgcucuuguccagguuggagugcaaugucacaaucuuagcucacugaaaucuccaccucccggguucaagcgauucuccugccucagcauccugaguagcuggacuacaggugucugccaccacaccuggcuaauuuuuguaucauuaacagagacgggguuucaccguuggccagucuggucucuaucucuugaccucaggugauccacccgccucggccucccaaagugcugggauuacaggcaugagccaccacacccggccuacuugcuuuaacuuuaaaagcaacacaaaaaauuguuuuagugaacuaaaguaggugguuggcucaacaggauagggguuagucccauaugcuauggauugucagaggguaagaggcuuagcacuggugcugcaaguuacugaugcugaagccaggcaaaucccacaugguggggccagcagauaagaugacaggcccgggcccugccuuuauggagguuaggaucucgggaagauuaacaagucacuuauaauuuauagggcauugcaugcuaguugaugggguaggugggaucagguuuccauuuuagaagaucaaggaaagccagggacauucuguucucuaguuggggagacaguggacaugugaaaaguuauaguggugugaaaauagcugugaaaugccaaaagcaaguauggcuaacuccuaaucauuuuuauccccugccauccuuuacucaaacuuuguuuucucccaaaccucuuccugccaauucuacaacucaaguaccuggguagggcaguuguuguuggcugccaccgcagcacugugucagcccaguucucauccagucuauaaaaauuuuugcucuuuuuaguaccaugcuguccagccaagccauccuccauccuccguucugucuuguuuugugugguuuuuuuuuuuauuuuagauggagucucccucaguuccccaggauggagugcaguggugcgaucucagcucacugcaaccucugccucccggguucaacaauucuccugccucagcccucaagguagcugggauuacaggcgcccgccaccacucccagcuaauuuuuguauuuuuagaagagaugggguuugcccauguuggccaggcuggucccaaacuccugacuugaagcgaucugccugcgucggccucccaaagugcugggauuacaggcaugagccauugcgacuggccaggauuuuagguuuuaucauaagugugauggguuguuacugaaccucaccaaaaaccucaaaaaaaaaaaaaaaaaaaaaaaaagaaugacuugucaggcacaguggcucaggccuguaaucccagcacuuugggaggauugcucaagccuaggaauucaagaccagcaugggcaacauggcaaaacccucucucuaccaaaaaaauacaaaaauuagcugggugugguaguacaugccuauagucccagcuacuagggcugcuaagucucuugagccugggaaguugaggcugcagugagcucugacggcgccacugcacuccagccugggcaacagaaccacacccugucucaaaaaaaaaagaaaaaaaaaaaggaauggccaaggcuucauaacucucuugucuuuuuaugcaggcgaucucugugugcuaaauauuuuccccgaagucccuuuuccaucccuguucgcauugucugcucugggcccuccucaucucucuccuggucuacucggucaccuccuaacuagugacccucuuugucaucuucuaaaccuguuucaccuuuaaaaugcagacagcuucucagcuugaauucacagccuuuuccuuacacacaaggucucuguaauacuucuccuuuccuccuuaucuucuguucuuggcccuccucuguacccauuagcaguucucagcuaccucucccugcuccauauucacuucgcuaagcuguuuuaacccagggauucccugacaauaccuucuuccacccuucauccccucuucauccugccugaccuggggaacugaacuuagaucuucucagacccuccgcccugugcugucagcuccccucccccgguccacaugugugauccuugcuuguugaugggucugucugaucugugggcucccugaggguggggacugcaugaagucaucuuugugaccccagagccugacacaggguuuuaguacagagucucucacuuacugccugcugagugaugcgugguaaagggaauaauauuuaagucauaguuuauacuauuugggcucaaacagguuuugguaaugcuguuuuggugcguguguguguguuuuuuuuguaggacaaaagauaucaauuuuuaaugaacauaaaaguuauguccaaggaguaaccugggacccuuugggucaauauguugcuacucugagcugugacagguaaauucagcuuuggcauuuacuuggaauuucuuuguauuuacuuggaauuuucugaagagagguauuuaucguaacuuagccaagauuuaucauagucuaacuuugauucuuuuguucuuguuuucauacucauucuuacaacauaaucagaaauuggaaauuaauuaggacaagugccuuacacgaaguuuguacuuaguaaaucuuuuuuuuuuuuuuuuuuuuuagacacagucucacucugucacccaggcagguguuguggcgcaaucucacaaucucagcucacugcaaccucugccuccugguuucaagcgauucuccugucucagcuucccuauuagcugggauuacaggcacaugccaccaugcccgguuaauuuuuguguuuuuaguagagacaggguuucaccacguuggucaagcuguucucaaacuccuaaccucaaaugaucugccugccuuggccaaugugcugggauuacaggcaugagccaccaugccccgcccugaacuuaguaaaucuuuauuauuauuacuauuuuuuuuuuuuuuugagagaggggcuuacucugucacccaggcuggagugcaguggugcaaucacagcucacugcagcuuugaccuccugggcucgagcaauccucaugcuucagccccccaaguaauugggacuacgggugugcaccaccacacccggcuaauuuuuauauuuuuuuguaaagaugggauuuugccauguugcccaggcuggucgcgaacuguugagcucaagccaucugucugccuuggccacccaaagugcuaagauuacaggugugcuacggugauuuuuauuuuuauuuuuuuuaaauuguuuuuugagacagaaucucacucugucacucuggcuggaaugcaguggugcgaucucggcauacuguaaccuccaccuccuagguucaagcgauucuccugccucauccuccugaguagcugggauugcaaguguguaccaccaugccuggcuaauuuuuguauuuuuaguagagacagaguuucaccguauugacgaugcuggucucaaacuccugaccucaggugaccugccugcguuggccucccaaagugcugggauuacaggcgugagccaccucgcccagcccaguuauuuuaaugacuccauuuaaauggauauaaaaauaaacuauuuuugugcuuucugaaaagaagucuuguugucguguuuacuggcauaauugcauuuaauuguauuguuggaacaaagaguuagaaaaaaugaggagugccuccuauauuacuuaauaguccuuuugaauauuuaucugacuacuuuuaaauaaaacaaauugaauauaagauggccuuggaauaaaagugguagggaggaguuaguguuuauuuuucauagaaucuucuguuguauucuaaaugccauuuauuuucugacaaguguguuuuauucagacagucaucaguaaaacaaucugauuagcuagugggaguaaugugacuuaccaauuuuuuuuuuuuuuuuuugagacagaaucucgcucuguugcccaggcuggagugcagugccacaaucucagcacugcaaccucugccucccggguucaagugauucuucugccucagccucccgaguagcagggauuacaggcgcccaccaccacgcccggcuaauuuuuuguauuuuugguagagaugggguuucaccauguuggccaggcuggucucgaacuccugaccucaagugauucacccgccucugccucccaaagugucgggauuacaggcgugagcuaccgcgcccggccuguaauauccuuuagguuguuaauacuugcuuccuucuuaauuacccaguugugaauaucauugguaaaagcuuuugcaggcugaaaacuguugcggugguaauaggcuguugguaauaaguuguuucugugugaagcauaauucauuuacuagaagugguaaaucagacauguucuuucuucagggugcugcgaguauacaguauacagaagaagcguguggcuuucaauguuucgaagaugcugucuggaauaggggcugaaggagagguauaaaauauuuugccauucuuuuucagcagcgcuuuaacugagacuuaggaagucaugagcuccucccauacccuugcagccaaaucacuggccacaaagagccgauuccagaacuacaauaaggcuuccuuuuggacagucaaggcucaguuacuguggugggcuagucuguauggaaauggggacaucuggagaccaggguagagccacugauggaggacaggacagugguuuucaacccugguugcacgguggaaucaccugggaagaauuacaaauaugggugcuggccgggcgccguggcucaugacuggaaucccagcacuuugggagacugaggugggcggaucacuugaggucaggaguuugagaccagccuggccaacauggccaaaccccaucucaaugaauugcaaaaauuagccagcugugguggugcaugccuguaaucccagcuacucgggaggcugaggcaugagaaucaccugaaccugggaggcggaggucuuagccgugagcggagaucaugccacugcacucuagccugggcgacagagcgagacucgauuucaaaaauaaaaugaaauaaggcugggcaugauggcucaugccuguaauccuagcacuuugggaggcugaggcagguggaucaccugaggucaggaguuugggacuggccuggccaacauggugaaacccugucucuacaaaaaauauaaaauuagccgggugcaugcaugugaucccagcuauucaggaggcugaggcaggagaauugcuugaaccugggagguggagguugcagugagcugaaaucacaccauugcacuccagccugggugacaagagcgaaacucagucucaaaauaaauaaauaaauaaaaauaaaauaaaaauaaaaauauggaugccuuggccccaaccugaguggcgugauucacuuggcuggagguaagcagggccuccaugauucucagguauagcaagggcuggucacuacugaucugggaagaucccuacacgaggcaacagaagacaggcaggucgagcguuggaucugucuggcagcaggcaguuuacuaucuuggcagguagguagagaguuuugcuagcagacagcagagacccagccaaaacacugguauuuaggaauaggaaggauuuugacuuucaaauaauuggcaaaugaaaauaggacccuuuuuguaaaggaaucaaggcuaccgaggcaggcagcgaggugcggggagcaagcugguuacuggcuucacacggggacauggugcaaaugcauccaaggaaccaggguaaggcagugugggcugggcgcugacaggcacugagaggucacaccugugaaguaagaauaguaaugcuucccgggugcgguggcucagccuguaaucccagcacuuuggaaggcagaggugggcagaucaccugaggucaggaguucgagacuagccuggcuaacauggugaaacccugucucuacuagaaauacagaaauuugcugggcauaguggcgcaugccuguagucccagcuacuccgguggcugaggcacgaggaucacuggaaccugggagguggaguuugcggugagccgagauugcgccauugcacuccagccugggcaacaagagcgaaacucuggcucaaaaaaaaauauguguauauauauguuuuuguauauauuauauauaauauauacuuuaauauguuauauauuuauauuauauauaauauauuuuuauauuauacauaauauauauuuuuauauuauacauaauauauauuuuuauauuauacauaauauauauuuuuauauuauacauaauauauauuuuuauauuauacauaauauauauuuuuauauuauacauaauauauauuuuuauauuauacauaauauauauuuuuauauuauacauaauauauauuuuuauauuauacauaauauauauuuuuauauuauacauaauauauauuuuauauuauacauaauauauauuuuuauauuauauauaauauauauuuuuauauuauauauuuuauauauauaaaaauauaucuauuacauauauauauauaugaauaguaaugccggcuuccuuguguucuuaagaauuaaaugcuuguuuguuuguugagacagugucuggcucugucacccaggcuggagugcaguggcacgaucuuggcucacugcaaccuuugcuuccuggguucaagcgguucuccugccucagccucccgagaagcugggauuacaggcgugugccaccacacuuagauaauuuuuguauuuuuaguagagaugggguuuugcuauguuggccaggcuggucucguacuccuggacucaagugauccgcccgccuuggccucccaaagugcugggauuacaggugugagccaccaugucuggcaaaugcuugauguuuauaaauaguaguaaaaacugucccagacagguguuaaagaaauguuguuuuaaaagauuaaugauuaccaguuuaauaauccacuauuuucuuuuuuuaaagggugcauuuguuaauagcuggaugugguggcaugugccuguagucccaggaggcugagacgggaggauugcuuugagcccagaaguucuagguuacagcgaccuaugauugcgccacugcacucuagccugggugacagagcgagacucuguaucuaaagagugcauucaguuggaaauucuaaugaauccacacagauagaaagcagaggucuccuggucaucuucccacugucugccagucucaggccccagacaugccacuauugacccugugguuuguguucuuaagaguuuuuaaaaauaauuuuagaaccacauaaaacacacauauauacauauagcuuuaccuaacaaaaauguguggucaguuuucaugaauguuuacccuugcaguguuguacaauuauuugauuuguaauguguuucaguuucauuuaugauuaugucaacaauaaaugacacuauguaaagaaaaccauaggcacauauagcaguugggaagcguuuauuugugaguguaaagauuuggaaaaauguuuaagcuuuguguguagaaaacaaacaaaaaaaauaauaaaaauaaauuuugugugcgacaggcaagaagcuaccggauguuucacgacgacagcaugaagucuuucuuccguagacugaguuucacucccgacggaucuuugcuucucacgccagguguguuucguagcuuuggacuuaaaggaaugauggccgaguggggaugucugcucccguuuuacgcugcagcuuaucagcucagugaaugcugauuagaguggggguccccgacuuaccugcccauuggaaccuccaggagagcuucaaaaaacacauuggugccuaugucccaucccuagagauuguaguguauguaauuggucuggguggccuggcuuuuggaauuuuaagaagauuuccaagugauuguaaugugcagaaaaguuugggaguaaugaguuuaaaaugauaggcauuuucucuuagauaaauuuaacuuuuggcugggcacaguggaucacaccuguaaucccagcacuuugggaggcugaggcgggcggaucacuugaggucaagaguucaugaccagccuggccaacauggugaaacacccucucuauuaaaaauacaaaaauuaaugaugugguggcgcauacccuguaaucccagccacuugggagacugcggcaggagaaucgcuugaacccaggaggcagagggugcagugagccgagaucacaccacuguacuccagccugggcgacagagugauaucuuaucuaaaaaaaaaaaaaaaaaaaaaaaaagaaacuuuacuauuuaaacccuuucaaugaaugcuuuuucauucauuaacauguguauggaagccauagcgcuaaagccaaagauaaagcuccuuuauuguuuuuauucuccucaauaaagcgcauuugugacaggauuagacucauggacaaacuuguggaagcagcaguggucaaaaucaaaaggucagccaaguagcaaggacuagauagguuuauugucccuaugucccuaggaaggcaaggggcucagcccagcaagauaaggcuaggcauuauuguggccacaguguucucagaggagaaugucugcucauugccguggcuccaggaccauccugugcauagagaugacaacauagcccaggguugggccaaacgggagggcacugucuugguuugccacugagucccaucccagcugagccagggagggccugagaagggcgugaaucacacaugcagcuguguggguggggcuuuaaagaacacugcggaacaugugcgaaugacacuuuggcccaagaagucucaggacuaagaauaaguaguuguuuagguuauauuuacuaaaguuaguuauuaaaaguuauucacuaaacccaguaauaaauccuuuuuuuuuuuuuuuuuuuugagacugaguuuugcccuguugcccagcuggagugcaguggcacgaucuuggcucaccacugcagccuccgccucccaguuucaagcgauucuccugccucagccuccugaguagcugggauuacaggugugcgccaccacucccagcuaauuuuuguauuuuuaguagagacgggguuucaccauguuggucaggcuggucucaaacuccugaccuugugauccgccugccuuggccuccgaaagugcugggauuacaggcuugagccaccacgcccggcccuuuuuuuuuuuuuaaauuauuuauuuuauuuauuuauuaauuuauuuauuuugagauggaguuucgcucuuguuacccaggcuggagugcaauggcacgaucucggcucacagcaaccuccgccucccggguucaagccauucuccugccucagccuccggaguagcugggauuacaggcaugcgccaccacgcccagcuaauuuuguauuuuuaguagagacgggguuucuccauguuggucagucuggucucgaacuccggaccucaggugaucugcccaccuuggccucccaaagugcugggauuauaggugugagccauugcgcuggccuuuuuuuuuuuuuuuuuuuuuuuuuuuaaaaagcagagucucgcucugucacccaggcuggagugcaguggcaccaucuuggcucacuguagccuccaccuccuggguucaagcgauucuccugccucagccuccugaguagcugagauuacaggcgccugccaccacaaccagauaauuuuuguauuuuuaguagagaugggguuucgccauguuggccaggcuggucccaaacuccugaccucaggugaucugcccaccuuggccucccaaaguguugggauuacagguuacaggugugagccacugcgcccagccccaguagcaaauccuuuacuauuuggccacucuaaaaauauuuucaauuaaaaucaaguagcaaauggaugucuguuaucaacguuauuguucuuugugguguuaguaagugugggaaaaacaggaaaaugaaauuacaaagauuggaaaagaacagauaaaaaacugcaauaggauuguauuucuagaaaauccaagagauuuuaaaaauaguauuagaauuuuuaaaauaauuugauaagauggcuggauauuauaaaauauauaaaaauuccuaucuuucgucuauauuggcagugaguacuuagaaauggaaggaggagaaauauuucauucagaguagugcaaaaccugcaaaauacauagaguaaauuuauuuauuuauuuauuuuuugagacagggucucacucugucacccaggcuggaguacaguggugugaucauggcccacugcaucagccuugaucuccugaguucagggaauccucccaccucagccucccuacuagcugggaccacaggcguguagcaccaugccuggcuaauuuucuuauuuuuuuguagagacauggucuugcuauguugcccaggcuggucuuaaacuccugggcucaagcaccccuuccgccucggccucccaaagagcugggauuacaggugugagccaccacacccaggcagaaguaaauuuaaugagaaaggggcaggaccuuuauggagaagucuagaaggucuuacugaagguuauaaagcaaguucugaacaaauggaaagauaugucguguucuaacaauuaacauacuaauuucauuuccaauuagaauugcauuaaaguuuuuuuuuaauuggaugaaaucucagcuuuguuuaguagaauaaaugcugaagaauagccaaagaaguauuaaaaaaaaaacagugauacuugggagggcauuugccucaccacauaucagaagauccuauaacacuacuuuuagccaaucaauaugguguugcuauaggaccaaacaaauagauuaguggaccagaacacagaauccagaaaaagaucucaggauauaaggcgauuuaauauaugaccucaggugcuguuccaguggaaaaaaaucuauuauuuauuuguaauuaauuguauguuacuuaaauaauucucaagagaauuagacacugaaggcagauaggacaagaguaugucauuaagaagguugggaaguguugagauuggacaaagaccuauuccucuuuuuuuugagaggguuucacccuugucgcccaggcuugagagcauuggcgugaucuuggcucacugcaaccuccaucuccugaguucaagugauucuucugccucagccucccaaguagcugggauuacaggcgccggccaccaugcccagcuaauuuuuguauuuuuaguagagaugagguuuuaccauguuggccaggguggucucaaacuucugaucucaggugauccacccgccucagccucccaaagugcugggauuacaggcgugagccacugcaccuggccuccuuuuuuuuuuaauugacagaugaaauuguauguaguuguguaugacaugauguuuugaaguauauauauguuguggaaugacuaaaucuagcuaauuagcauagcauggucucacauaauuaggauuucugugguuugaacgcuuuauaucucuuagcauuuuucaggaauauaauacauuguuaugaaccauaaucaccauguuguacaagagauggaucuugcaaagggaggacucuauuauugaaugaguagugcugggguagccagcuauguggaagaagguaaaauuggaccccuugccuagauguaaaaaauaaauuccaggugaauucaguacuuaaacacaaaagguaaaaauagaaaacucuuguaaggaaauauaggaggacauucuaggaauggagaagacccaauuaagacuggaaacuggcugggcaugguggcucaagccuguaaucccagcacucugggaggccaagguggguggaucaccugaggucuggaguucaagaccagccuggccaacauggcaaaacccugucucuacuaaaaauacaaaaauuagccgggcauggugaugcacaccuguaaucccagcuacucaagagccugaggcaggagaaucgcuccaacccaggaggcagagguugcagugagccaagaucgcaccacugcacucuagccugggcaacagagugagacucugucuaaaaaaaaaaaaaaaaaguauauguucaaggaugcuuauugcaagcauuguuuauagugguaaaaaaccaaaagccaaaaaaauacucauuaacagaggcugggugaaugaaucuugcaguaaauauuaugcagcuacaaaaaaauaaugcaucagugcuaugcaaguuaacuuucaugaguaguugauugaaacaagcaaaauaaggagaagugucaguuuuguaaaacaaauggacucaauaaaaaauaucauagagguauacaugugauugaguuauaacugauuguaaugauuaugugagcauggaggaaauauacagaugacauaaugguuuguugaauguuaaaauggauuucuuggggauggaagaauggagugggaugaaaagaggggccugggugcagugacucacgccuguaaucccagcacuuugggaggcggaggagggcagaucacuugaggucaggaguucgagaccacccuggccaacauggugaaacccccucucuacuaaaaauacaaaaauuagccgggcaucguggcaggugccuguaaucccggcuacucaggaggcugaggcaggggaauugcuugaaucugggagguggagguugcagugagccaagaucacgccaucgcacuccagccugggugacagagcaagacuccaucucaaagaaaaaaaaaagagggcagcuauguagaauguauuaauaauaauaauaaaaaagacuauugauacugucuacugcccucccugguggauaugaaacagucauauguaaaguuacguguguguauauguaucaagaaauagcauaaaacagggagauguuuccaagagcagcaguguaugauggucacucugacagggcugaacuguuuuaaguacagcagggggugaguguagaagagcucucagauggggacuguuccccagagugaagucagguucugaaggaggcuggagguuucagcagagggcaaggucuccuggcagccucauggcuggauagggaaguuggggaaaggcgagucucagccuuuggauggcauccaaggcuggaauccaggaaauagagaugaggguccuagggagaaaggagccugggcagcugaaucuagucacggugcuucaaucgaggaauugccuggaggcucaacggugcccuauggcaaaggcucacuauguucuccucgcccaagaucagaaccagguccccggggauugcccacagguagguggagaugacagguagguagaacuggaguaagggcugagaacagacagugccggaauauauguuuuugugcucugucacaacauuguccagagaauauaacugcagggggaaguauuuugcaaaccggaccugaaggcucuugaguuucuguuggugaacaguuugcugaaacagugacuuuucuuuccucucccucccuucccuguuccccagcuggauguguggaaucuggugaaaauguaaugaauaccacuuauguuuucuccaggaagaaucuuaaaagguaugcagucaaggaaauguuugaaauguuuacauuuuuuuuagacggaguuucgcucuuguugcccaggcuggagugcaauggugcgaucucugcucacugcaaccucugccucccggguucaagugauucuccugccucagccucuugaguaggugggauuacaggugcccgccaccacuccuaguuaauuuuuguauuuuuaguagagaugggguugcaccauguuggccagguugguuucaaacugcugaccucaagugguccgcuugccucggccucccaaagugcugggaauacaggcaugagucauugcacccggcuuguauuuuuuuuuuuuuuuuuuuuuuaguagagaugggguuucgucauguuggccaggcuggucuugaacuccugaccucaggugauccgccugccuccuccucccaaagugcuggguuuauaggugugagccaccgcgcccugccaaaauguuuaccuuuuauuuuugcuuuugcuuagucacagugccuuuuccuaacacugcaauuaauccauuaggcccaucgcucaucuuccauguccuggaaaagccacucuugcuguucgcugcuguccggucuacuuugaacugaggccagugguggaaacagguauccucagagccucagggguguguuauguuuucucuccgaaacaggucaccagagugggguggagauuuggauucugucuuauggggaaagguggguaucuggguuugguucaguucaguuauuuuaaaaauauuuuauuuuuacauuuaaaucuauuuauuuauuuauuuugagaccagguuaucagccugguuaauuuuuguauuuuugguagcgacagcguuucaccauguugccaaggcuggucuugaacuccuggacucaagugauccaccugccucggccucccaaaaugcugggauuacaggugugagccccugugcccggccugguuuaguuauuuuuaaaagcuggagcaaagacugggguuaucaaaauacaugucaguuuuuuuuuuuuuuucuuucuucaggauauauuuucuugcuuaaggcacuuuaaaaggaauggacguacuccuuuuguuugucuaugucucucauuaucaauuuucuuuuucuuuuuuuuuuuuuugagauggggucuugcucugucgcccaggcuggagugcaguggugcaaucuuggcucacugcaaacccugccucccagguucaagggauucucccuccuauccuccagaguagcugggauuacaggcgcaugccaccacacccagcuaauuuuuguauuuuuaguagagaugggauuuugccauguuggccaggcuggucucgaacuccugaccucaggugauccacccaccuuggccucccaaaguacugggauuauaggcgugagccaucaugcccagccauuuucuuuguuuucuugugcuugggguucauugaacuucguagaucuauccguuuauaguuuuuauuacauuugggaaguuucagccauuuuuccuucaaauguuauuucuguuauucccuucucuuauucaaauacucccauuacacauguauuauauuagguccuuugaaauuaguuccuggccuuugauacuacuuacuuuuuuuguuuuuuucuucuuccaguguuugauuuuggaagucucuauagcuguguuuugaguuugcuaacccuuucuucugcaugcucugcccuuggucccauccaguguguuuuucuuuguugugguucucaucucuagagauucacuuuggguuuuccuuauauauucugugccucuccaugcuccauuuuuccucuugcugcuuucuuuuuuuuuuuuuucuugcucuguugcccaggcuggggugcagugguauaaucucggcucguugcagccuucgucucccagguucaagugaaucucccaccucagccucccaaguagccaggauuacaggugugcgccaccacacccagcuacuuuuuuuauuuuuaguagaggcaggguuuugccauguuggccagucugguuucgaacuccugaccucaggugaucugcccgccucaguuuccucuugcuucuuaagcauauagagugcaguuauaauagcucuuuuaauguccuuguauacagguugguuuugauuuuuuucuccucauugugggucauaucuuccuguuuuuguuugccugguacuuuuugauuagauacuagacacugacuuuuacuuuaguggaugcuggauguauuuuuauucuuauaaauauucuuuuuuuuuuuuuuugugacagagucuuccucugccacuaaggcuggaguacaguggugcaaucugagcucacugcaaccuccgccuccuggguucaagcgauucuccugucucagccuccugaguaguugguacuacaggcacacacccccacgccuggcuaauuuuuguauuuuugauagagacgggguuuugccauguugcuuaggcaggucucaaacuccugagcucaagugauccacccggcucggccucccaaagugcugggauucuaggcgugagccauugcaccuggucagaagccuuguuucugugguuuuacuuugucucuguccccaacccccagguguggagcugaugagucugcccuaccgccugguguuugcuguggccucggaggauuccgugcuucuguaugacacccagcaguccuucccuuuugguuacgugucuaauauacauuaccacacccucagugacauuucauggugaguggcugcuaaugagggagagugagugaaggagaccguggcuguauccuggaagacaccccgggguuagggagcauuucauuacuaaagauggcuuugggggacauauucaccaauuuuguuucuuauuuauuuuuuugagaccaaguaucacucugucacccgggcuggagugcaguggugugaucucguuucacugcaaccuccaccucccagguucaagugauuuucaugccucagcuucccaaguagcugggauuacaggugcgcaccacuacgccuggcuaauucuugugguuuuaguagagaugggguuucgcccuguuggccaggcugguaucaaacuccugggcucaacgauccuccugccccagccucccaaagugcugggauuacaggcgugagccaccacgcccggccccaauuuuguuuuuuaaaggaaucaacauuaaaaggaaagccguuucuaguuugccacaauacuugcuucuuauuuucacacugguggguuuugauggcauucagauugccuugugggguuaacuggacuuugauaaacugaggggaggccuuguagacucccuggccauuuggggacuucugaggcccucugggaggaagcccuucccugcaugccccugcugcccaggacagggaagugccccaagcugggccuguguagaggaugucacucagcacuguccuucugccaccuuuugguccccaauucagcccccguggccugcuuggcccagugugagguuuuuuuuuugaaacagagucucacugucauccaggcuggagugcaguggaacgaucguggcucacuacaaccuccgccuccuggguucaagcaauucuccugccucagccucccgaauagcugggauuacaggcgcccaccaccauggcuggcuaauuuuuuuguauuuguaguagagacaggguuucaccauguuggccaggcuggucuugaacuccugaccucaaaugauacaccugccuuggccucccaaagugcugggauuacaggcgugagccaccgcacccggccuauucaagugaaaauugcuaguagcacagauagguugcagcgacuuagcaaaucgcgaugaaacugcaugagugagucgcuaucacacacucuuuuccaguuguaucuuuucccugguuuuugccuucaaacaagcuugugauuuugcucgaacuucccucuucuaaguagaugugagaguguugguaaggucuguaacuuuucccuguuuuggggacgaagguccagcgauggugccuuccuggccauuucuuccacggacgguuacugcucauuugugacauuugagaaagaugaacuuggaauuccuuugaaagagaagccaguuuugaacaugagaacuccugauacagcaaagaaaaccaagagucagacacaucgagggucuucgccaggacccagaccgguagagggaaccccugccagcagaacccaagaccccagcagccccggcacgacucccccucaggccagacaggccccagccccaacagucaucagggacccucccuccaucacuccugcugucaaaagccccuugccggggccuucggaggagaagacccugcagcccaguagucaaaacacaaaagcccacccaucccggagggucacucugaacacacugcaagccuggagcaagacaacaccccgguaagaacuuguuggaacaagaugucauugcaaaaugaaacacaaaaugcagacagaacgcucccacccugcugcaggugaaauuucaggcggugaaugcuucaugccaguagguugccagagagauucuuaacuucaaauccgagagugucauuucuugcauauaggccucuguuuguuccuccaguuucugccugucagauaaagcccaggcuccuaugcacacacacagacugugauuuggcugcagccugucauccaggacuguggccacucucucuccugagucuguggccuucaucuccggccuaguccugaaugucaucuucccagagcacucucugcccuuugaggccucuguccuucccuucucuggggaagcccuggacaccucuuccucuuggugaugccaggagucuccugaaagacccauuucaauguacccucucuguuugcagucuuuguggcccuucagccuuucccuugucaccacacaucagauuccauagcaggugcuuugaugcuccaguuccccugcugguugugagcccccaaggacaggaagcaggucccauuuuuuauuuaugcuguucugcccaggauguaggcaauuccaggagugucuuccugagacugcguuugaugucuccagcagccuggucggugagaaacggagguccugaucugauaacaaauaauccccaggaggugcagagucguuucuucccugcuuacaucaguguggcuggcacgcacgccugugucugccacuucuacuggauacagagccacuuagcacauccuucugccgucaggcagcacagccuccuguuuccauucuuccccugcagcugauguccaguuaccccucugauccuguauaguuccuucuccaccaagcccucugccucccaaccuucccauaaacugagucacgaggagagcugggaagggggaugcagaggggagugguggggauggugagcuggacagaagcgcccugugccucucagccucuccugcgccaauaggucuucuuuggcaaguucauaauauguguauggguugcuggcuuuaacgcccucuuaaaaucucucauuucuuucugcagauuagcaauguauuuuacaauuuuucuguuuguuuuuaugugacggaagguauuccuugaacuauuuuugguauuaaauuauuuuuccccucuugauuucuucugaauuauuuaccaagcuucuugaagauguaaucuuuugcaaacaagaauaguuguugaaaauuaagacucuggguuuuuauuuauuuauuuauucauuugagacagggucuugcucuguugcccgggcuggagugcgauggcaugcucucugcucacugcaaccuccgccuucuggguucaagugauucuccuaccucagccucucagguagcugggauuacaggcaugcgccaccaugccuggcugacuuuuugcauuuuuaguagagacgagguuuugccauguuggucaagcuggucgaaaacuccugaccucaagugaucugcccgccucagcccgccaaagugcugggauuacaggugcgaaccaucuugcccggcccaacgcucuggauuuuaaaaaaguauuaccuguguuucgacgcuuucuauauauagaaaccauaucugacugccuuuuacagcagccagcagaguguucacaagaccgucgguaaugaacagaacacagguuuugaaacuuuucgaugacugguuaugguuuaaguugacuguuauaaaugugaugguuuaacuuaauacaugaauguaauccucaguuauuaaacaagugggcacaucuuacuauuuaaugccuugaaccagaaguucagcugaaaauuuaaguauuuccuuugguaguuuugaagguugguaucauacauaaacaauuccugugauacuaaugagccaucaccccucuacuuuuuuuuuuuuaaaucaaggagaauaaacuuaacacccuuaaagacggacacuccaccaaguucuguaccaaccagugugauuuccaccccuucuacagaagaaauucagucagguaaguaauauuguuacugguuuaauauaaugaaagguagaguaucuuuucuuuuguucuuuuggaaauuaaugccgccuaauuuuaagucaguucugagacagcagggaugcaucuuauuggaaccauuguuuaaacccgccggcugccuguuuacgccucagcagggggcaccuggccagugagagcauccuggugagccagggaguggguucagcaggagauugucuagcucagguuucuccaccugaugacugcugaccuugugggccaggcaauucuuuguuguggaggacuguccuguguauuaugcgauguuuaacagcauccccggcugcuacuucuugcccaugacauucuuuuuuuuuuuuucuuuuuuuugagaugcagucuugcucugucgcccaggcuggaaugcaguggcacgauuucggcucacugcagccuccaccucccacguucaagcaauucuccugccucggccucccgaguagccgggacuacaggcgugcgccaucacacccggguaauuuuuguauuuuuaguagagucggggguuucaccacguuggccaggcuggucuugaacuccuggccucaaaugauccacccgccucagccucccaaagugcugcgauuacaggcgugagccaccgcgcccagcuugcccaugacauucaaaaaugccacuagacauugcccacugucccuugagaggcaaaaucgccccugguugagagccacucuauagaacuuccauuauaucaguauaggaucuugccaggcagcucaguuccgugucuuggcucuguauucuguaaaugucagcccuugacuuccagaauucuucauuuacuugccaaccuuauguuuguuaauguugcagagacgccuggagacgcucagggcagucccccagagcuaaagcggcccagacucgaugaaaacaaaggaggcacggaaagucuggacccuugaugggaccucggcuucugcucgaagccuaccaggcucccggugugugcagggagacgguaaagcuggaggugccugagaccagggcuuccauggagcgggacacacuguaaauggauuucuauaacagaagugacauguguacugauuuuucuccagaaauauggaugcuguuguauucaguauccauuuuuaacuugggacaugaacguuuuaacguaguaaauccucuuuuugaugaguuucugaaacuggagcgguucaacguuauccagugugaaaaucagugaguccucccuggcauccucgugaaagugcacacacuucauggagggacuccuuuucaauaagaauuaggaagaugagaaaguaauuugagauuuuacucugucgaauuuuagaguauuugaagugauuguuagauuucacuucuaaggaguugauugauuaaacuuuggaaggua

SEQ ID NO: 192654 - RNA, 31437 nt, Homo sapiens
uaccuuccaaaguuuaaucaaucaacuccuuagaagugaaaucuaacaaucacuucaaauacucuaaaauucgacagaguaaaaucucaaauuacuuucucaucuuccuaauucuuauugaaaaggagucccuccaugaagugugugcacuuucacgaggaugccagggaggacucacugauuuucacacuggauaacguugaaccgcuccaguuucagaaacucaucaaaaagaggauuuacuacguuaaaacguucaugucccaaguuaaaaauggauacugaauacaacagcauccauauuucuggagaaaaaucaguacacaugucacuucuguuauagaaauccauuuacagugugucccgcuccauggaagcccuggucucaggcaccuccagcuuuaccgucucccugcacacaccgggagccugguaggcuucgagcagaagccgaggucccaucaaggguccagacuuuccgugccuccuuuguuuucaucgagucugggccgcuuuagcucugggggacugcccugagcgucuccaggcgucucugcaacauuaacaaacauaagguuggcaaguaaaugaagaauucuggaagucaagggcugacauuuacagaauacagagccaagacacggaacugagcugccuggcaagauccuauacugauauaauggaaguucuauagaguggcucucaaccaggggcgauuuugccucucaagggacagugggcaaugucuaguggcauuuuugaaugucaugggcaagcugggcgcgguggcucacgccuguaaucgcagcacuuugggaggcugaggcggguggaucauuugaggccaggaguucaagaccagccuggccaacguggugaaacccccgacucuacuaaaaauacaaaaauuacccgggugugauggcgcacgccuguagucccggcuacucgggaggccgaggcaggagaauugcuugaacgugggagguggaggcugcagugagccgaaaucgugccacugcauuccagccugggcgacagagcaagacugcaucucaaaaaaaagaaaaaaaaaaaaagaaugucaugggcaagaaguagcagccggggaugcuguuaaacaucgcauaauacacaggacaguccuccacaacaaagaauugccuggcccacaaggucagcagucaucagguggagaaaccugagcuagacaaucuccugcugaacccacucccuggcucaccaggaugcucucacuggccaggugcccccugcugaggcguaaacaggcagccggcggguuuaaacaaugguuccaauaagaugcaucccugcugucucagaacugacuuaaaauuaggcggcauuaauuuccaaaagaacaaaagaaaagauacucuaccuuucauuauauuaaaccaguaacaauauuacuuaccugacugaauuucuucuguagaagggguggaaaucacacugguugguacagaacuugguggaguguccgucuuuaaggguguuaaguuuauucuccuugauuuaaaaaaaaaaaaguagaggggugauggcucauuaguaucacaggaauuguuuauguaugauaccaaccuucaaaacuaccaaaggaaauacuuaaauuuucagcugaacuucugguucaaggcauuaaauaguaagaugugcccacuuguuuaauaacugaggauuacauucauguauuaaguuaaaccaucacauuuauaacagucaacuuaaaccauaaccagucaucgaaaaguuucaaaaccuguguucuguucauuaccgacggucuugugaacacucugcuggcugcuguaaaaggcagucagauaugguuucuauauauagaaagcgucgaaacacagguaauacuuuuuuaaaauccagagcguugggccgggcaagaugguucgcaccuguaaucccagcacuuuggcgggcugaggcgggcagaucacuugaggucaggaguuuucgaccagcuugaccaacauggcaaaaccucgucucuacuaaaaaugcaaaaagucagccaggcaugguggcgcaugccuguaaucccagcuaccugagaggcugagguaggagaaucacuugaacccagaaggcggagguugcagugagcagagagcaugccaucgcacuccagcccgggcaacagagcaagacccugucucaaaugaauaaauaaauaaauaaaaacccagagucuuaauuuucaacaacuauucuuguuugcaaaagauuacaucuucaagaagcuugguaaauaauucagaagaaaucaagaggggaaaaauaauuuaauaccaaaaauaguucaaggaauaccuuccgucacauaaaaacaaacagaaaaauuguaaaauacauugcuaaucugcagaaagaaaugagagauuuuaagagggcguuaaagccagcaacccauacacauauuaugaacuugccaaagaagaccuauuggcgcaggagaggcugagaggcacagggcgcuucuguccagcucaccauccccaccacuccccucugcaucccccuucccagcucuccucgugacucaguuuaugggaagguugggaggcagagggcuugguggagaaggaacuauacaggaucagagggguaacuggacaucagcugcaggggaagaauggaaacaggaggcugugcugccugacggcagaaggaugugcuaaguggcucuguauccaguagaaguggcagacacaggcgugcgugccagccacacugauguaagcagggaagaaacgacucugcaccuccuggggauuauuuguuaucagaucaggaccuccguuucucaccgaccaggcugcuggagacaucaaacgcagucucaggaagacacuccuggaauugccuacauccugggcagaacagcauaaauaaaaaaugggaccugcuuccuguccuugggggcucacaaccagcaggggaacuggagcaucaaagcaccugcuauggaaucugauguguggugacaagggaaaggcugaagggccacaaagacugcaaacagagaggguacauugaaaugggucuuucaggagacuccuggcaucaccaagaggaagagguguccagggcuuccccagagaagggaaggacagaggccucaaagggcagagagugcucugggaagaugacauucaggacuaggccggagaugaaggccacagacucaggagagagaguggccacaguccuggaugacaggcugcagccaaaucacagucugugugugugcauaggagccugggcuuuaucugacaggcagaaacuggaggaacaaacagaggccuauaugcaagaaaugacacucucggauuugaaguuaagaaucucucuggcaaccuacuggcaugaagcauucaccgccugaaauuucaccugcagcagggugggagcguucugucugcauuuuguguuucauuuugcaaugacaucuuguuccaacaaguucuuaccgggguguugucuugcuccaggcuugcaguguguucagagugacccuccgggaugggugggcuuuuguguuuugacuacugggcugcagggucuucuccuccgaaggccccggcaaggggcuuuugacagcaggagugauggagggagggucccugaugacuguuggggcuggggccugucuggccugagggggagucgugccggggcugcuggggucuuggguucugcuggcagggguucccucuaccggucuggguccuggcgaagacccucgaugugucugacucuugguuuucuuugcuguaucaggaguucucauguucaaaacuggcuucucuuucaaaggaauuccaaguucaucuuucucaaaugucacaaaugagcaguaaccguccguggaagaaauggccaggaaggcaccaucgcuggaccuucguccccaaaacagggaaaaguuacagaccuuaccaacacucucacaucuacuuagaagagggaaguucgagcaaaaucacaagcuuguuugaaggcaaaaaccagggaaaagauacaacuggaaaagagugugugauagcgacucacucaugcaguuucaucgcgauuugcuaagucgcugcaaccuaucugugcuacuagcaauuuucacuugaauaggccgggugcgguggcucacgccuguaaucccagcacuuugggaggccaaggcagguguaucauuugaggucaggaguucaagaccagccuggccaacauggugaaacccugucucuacuacaaauacaaaaaaauuagccagccaugguggugggcgccuguaaucccagcuauucgggaggcugaggcaggagaauugcuugaacccaggaggcggagguuguagugagccacgaucguuccacugcacuccagccuggaugacagugagacucuguuucaaaaaaaaaaccucacacugggccaagcaggccacgggggcugaauuggggaccaaaagguggcagaaggacagugcugagugacauccucuacacaggcccagcuuggggcacuucccuguccugggcagcaggggcaugcagggaagggcuuccucccagagggccucagaaguccccaaauggccagggagucuacaaggccuccccucaguuuaucaaaguccaguuaaccccacaaggcaaucugaaugccaucaaaacccaccagugugaaaauaagaagcaaguauuguggcaaacuagaaacggcuuuccuuuuaauguugauuccuuuaaaaaacaaaauuggggccgggcgugguggcucacgccuguaaucccagcacuuugggaggcuggggcaggaggaucguugagcccaggaguuugauaccagccuggccaacagggcgaaaccccaucucuacuaaaaccacaagaauuagccaggcguaguggugcgcaccuguaaucccagcuacuugggaagcugaggcaugaaaaucacuugaaccugggagguggagguugcagugaaacgagaucacaccacugcacuccagcccgggugacagagugauacuuggucucaaaaaaauaaauaagaaacaaaauuggugaauaugucccccaaagccaucuuuaguaaugaaaugcucccuaaccccggggugucuuccaggauacagccacggucuccuucacucacucucccucauuagcagccacucaccaugaaaugucacugagggugugguaauguauauuagacacguaaccaaaagggaaggacugcugggugucauacagaagcacggaauccuccgaggccacagcaaacaccaggcgguagggcagacucaucagcuccacaccuggggguuggggacagagacaaaguaaaaccacagaaacaaggcuucugaccaggugcaauggcucacgccuagaaucccagcacuuugggaggccgagccggguggaucacuugagcucaggaguuugagaccugccuaagcaacauggcaaaaccccgucucuaucaaaaauacaaaaauuagccaggcgugggggugugugccuguaguaccaacuacucaggaggcugagacaggagaaucgcuugaacccaggaggcggagguugcagugagcucagauugcaccacuguacuccagccuuaguggcagaggaagacucugucacaaaaaaaaaaaaaaagaauauuuauaagaauaaaaauacauccagcauccacuaaaguaaaagucagugucuaguaucuaaucaaaaaguaccaggcaaacaaaaacaggaagauaugacccacaaugaggagaaaaaaaucaaaaccaaccuguauacaaggacauuaaaagagcuauuauaacugcacucuauaugcuuaagaagcaagaggaaacugaggcgggcagaucaccugaggucaggaguucgaaaccagacuggccaacauggcaaaacccugccucuacuaaaaauaaaaaaaguagcugggugugguggcgcacaccuguaauccuggcuacuugggaggcugaggugggagauucacuugaaccugggagacgaaggcugcaacgagccgagauuauaccacugcaccccagccugggcaacagagcaagaaaaaaaaaaaaaagaaagcagcaagaggaaaaauggagcauggagaggcacagaauauauaaggaaaacccaaagugaaucucuagagaugagaaccacaacaaagaaaaacacacuggaugggaccaagggcagagcaugcagaagaaaggguuagcaaacucaaaacacagcuauagagacuuccaaaaucaaacacuggaagaagaaaaaaacaaaaaaaguaaguaguaucaaaggccaggaacuaauuucaaaggaccuaauauaauacauguguaaugggaguauuugaauaagagaagggaauaacagaaauaacauuugaaggaaaaauggcugaaacuucccaaauguaauaaaaacuauaaacggauagaucuacgaaguucaaugaaccccaagcacaagaaaacaaagaaaauggcugggcaugauggcucacgccuauaaucccaguacuuugggaggccaagguggguggaucaccugaggucaggaguucgagaccagccuggccaacauggcaaaaucccaucucuacuaaaaauacaaaaauuagcugggugugguggcaugcgccuguaaucccagcuacucuggaggauaggagggagaaucccuugaaccugggaggcaggguuugcagugagccaagauugcaccacugcacuccagccugggcgacagagcaagaccccaucucaaaaaaaaaaaaaagaaaaagaaaauugauaaugagagacauagacaaacaaaaggaguacguccauuccuuuuaaagugccuuaagcaagaaaauauauccugaagaaagaaaaaaaaaaaaaaacugacauguauuuugauaaccccagucuuugcuccagcuuuuaaaaauaacuaaaccaggccgggcacaggggcucacaccuguaaucccagcauuuugggaggccgaggcagguggaucacuugaguccaggaguucaagaccagccuuggcaacauggugaaacgcugucgcuaccaaaaauacaaaaauuaaccaggcugauaaccuggucucaaaauaaauaaauaaauagauuuaaauguaaaaauaaaauauuuuuaaaauaacugaacugaaccaaacccagauacccaccuuuccccauaagacagaauccaaaucuccaccccacucuggugaccuguuucggagagaaaacauaacacaccccugaggcucugaggauaccuguuuccaccacuggccucaguucaaaguagaccggacagcagcgaacagcaagaguggcuuuuccaggacauggaagaugagcgaugggccuaauggauuaauugcaguguuaggaaaaggcacugugacuaagcaaaagcaaaaauaaaagguaaacauuuuggcagggcgcgguggcucacaccuauaaacccagcacuuugggaggaggaggcaggcggaucaccugaggucaggaguucaagaccagccuggccaacaugacgaaaccccaucucuacuaaaaaaaaaaaaaaaaaaaaaauacaagccgggugcaaugacucaugccuguauucccagcacuuugggaggccgaggcaagcggaccacuugaggucagcaguuugaaaccaaccuggccaacauggugcaaccccaucucuacuaaaaauacaaaaauuaacuaggagugguggcgggcaccuguaaucccaccuacucaagaggcugaggcaggagaaucacuugaacccgggaggcagagguugcagugagcagagaucgcaccauugcacuccagccugggcaacaagagcgaaacuccgucuaaaaaaaauguaaacauuucaaacauuuccuugacugcauaccuuuuaagauucuuccuggagaaaacauaagugguauucauuacauuuucaccagauuccacacauccagcuggggaacagggaagggagggagaggaaagaaaagucacuguuucagcaaacuguucaccaacagaaacucaagagccuucagguccgguuugcaaaauacuucccccugcaguuauauucucuggacaauguugugacagagcacaaaaacauauauuccggcacugucuguucucagcccuuacuccaguucuaccuaccugucaucuccaccuaccugugggcaauccccggggaccugguucugaucuugggcgaggagaacauagugagccuuugccauagggcaccguugagccuccaggcaauuccucgauugaagcaccgugacuagauucagcugcccaggcuccuuucucccuaggacccucaucucuauuuccuggauuccagccuuggaugccauccaaaggcugagacucgccuuuccccaacuucccuauccagccaugaggcugccaggagaccuugcccucugcugaaaccuccagccuccuucagaaccugacuucacucuggggaacaguccccaucugagagcucuucuacacucacccccugcuguacuuaaaacaguucagcccugucagagugaccaucauacacugcugcucuuggaaacaucucccuguuuuaugcuauuucuugauacauauacacacacguaacuuuacauaugacuguuucauauccaccagggagggcaguagacaguaucaauagucuuuuuuauuauuauuauuaauacauucuacauagcugcccucuuuuuuuuuucuuugagauggagucuugcucugucacccaggcuggagugcgauggcgugaucuuggcucacugcaaccuccaccucccagauucaagcaauuccccugccucagccuccugaguagccgggauuacaggcaccugccacgaugcccggcuaauuuuuguauuuuuaguagagaggggguuucaccauguuggccaggguggucucgaacuccugaccucaagugaucugcccuccuccgccucccaaagugcugggauuacaggcgugagucacugcacccaggccccucuuuucaucccacuccauucuuccauccccaagaaauccauuuuaacauucaacaaaccauuaugucaucuguauauuuccuccaugcucacauaaucauuacaaucaguuauaacucaaucacauguauaccucuaugauauuuuuuauugaguccauuuguuuuacaaaacugacacuucuccuuauuuugcuuguuucaaucaacuacucaugaaaguuaacuugcauagcacugaugcauuauuuuuuuguagcugcauaauauuuacugcaagauucauucacccagccucuguuaaugaguauuuuuuuggcuuuugguuuuuuaccacuauaaacaaugcuugcaauaagcauccuugaacauauacuuuuuuuuuuuuuuuuuagacagagucucacucuguugcccaggcuagagugcaguggugcgaucuuggcucacugcaaccucugccuccuggguuggagcgauucuccugccucaggcucuugaguagcugggauuacaggugugcaucaccaugcccggcuaauuuuuguauuuuuaguagagacaggguuuugccauguuggccaggcuggucuugaacuccagaccucaggugauccacccaccuuggccucccagagugcugggauuacaggcuugagccaccaugcccagccaguuuccagucuuaauugggucuucuccauuccuagaauguccuccuauauuuccuuacaagaguuuucuauuuuuaccuuuuguguuuaaguacugaauucaccuggaauuuauuuuuuacaucuaggcaagggguccaauuuuaccuucuuccacauagcuggcuaccccagcacuacucauucaauaauagaguccucccuuugcaagauccaucucuuguacaacauggugauuaugguucauaacaauguauuauauuccugaaaaaugcuaagagauauaaagcguucaaaccacagaaauccuaauuaugugagaccaugcuaugcuaauuagcuagauuuagucauuccacaacauauauauacuucaaaacaucaugucauacacaacuacauacaauuucaucugucaauuaaaaaaaaaaggaggccaggugcaguggcucacgccuguaaucccagcacuuugggaggcugaggcggguggaucaccugagaucagaaguuugagaccacccuggccaacaugguaaaaccucaucucuacuaaaaauacaaaaauuagcugggcaugguggccggcgccuguaaucccagcuacuugggaggcugaggcagaagaaucacuugaacucaggagauggagguugcagugagccaagaucacgccaaugcucucaagccugggcgacaagggugaaacccucucaaaaaaaagaggaauaggucuuuguccaaucucaacacuucccaaccuucuuaaugacauacucuuguccuaucugccuucagugucuaauucucuugagaauuauuuaaguaacauacaauuaauuacaaauaaauaauagauuuuuuuccacuggaacagcaccugaggucauauauuaaaucgccuuauauccugagaucuuuuucuggauucuguguucugguccacuaaucuauuuguuugguccuauagcaacaccauauugauuggcuaaaaguaguguuauaggaucuucugauauguggugaggcaaaugcccucccaaguaucacuguuuuuuuuuuaauacuucuuuggcuauucuucagcauuuauucuacuaaacaaagcugagauuucauccaauuaaaaaaaaacuuuaaugcaauucuaauuggaaaugaaauuaguauguuaauuguuagaacacgacauaucuuuccauuuguucagaacuugcuuuauaaccuucaguaagaccuucuagacuucuccauaaagguccugccccuuucucauuaaauuuacuucugccugggugugguggcucacaccuguaaucccagcucuuugggaggccgaggcggaaggggugcuugagcccaggaguuuaagaccagccugggcaacauagcaagaccaugucucuacaaaaaaauaagaaaauuagccaggcauggugcuacacgccuguggucccagcuaguagggaggcugaggugggaggauucccugaacucaggagaucaaggcugaugcagugggccaugaucacaccacuguacuccagccugggugacagagugagacccugucucaaaaaauaaauaaauaaauaaauuuacucuauguauuuugcagguuuugcacuacucugaaugaaauauuucuccuccuuccauuucuaaguacucacugccaauauagacgaaagauaggaauuuuuauauauuuuauaauauccagccaucuuaucaaauuauuuuaaaaauucuaauacuauuuuuaaaaucucuuggauuuucuagaaauacaauccuauugcaguuuuuuaucuguucuuuuccaaucuuuguaauuucauuuuccuguuuuucccacacuuacuaacaccacaaagaacaauaacguugauaacagacauccauuugcuacuugauuuuaauugaaaauauuuuuagaguggccaaauaguaaaggauuugcuacuggggcugggcgcaguggcucacaccuguaaccuguaaucccaacacuuugggaggccaaggugggcagaucaccugaggucaggaguuugggaccagccuggccaacauggcgaaaccccaucucuacuaaaaauacaaaaauuaucugguugugguggcaggcgccuguaaucucagcuacucaggaggcugaggcaggagaaucgcuugaacccaggagguggaggcuacagugagccaagauggugccacugcacuccagccugggugacagagcgagacucugcuuuuuaaaaaaaaaaaaaaaaaaaaaaaaaaaggccagcgcaauggcucacaccuauaaucccagcacuuugggaggccaaggugggcagaucaccugagguccggaguucgagaccagacugaccaacauggagaaaccccgucucuacuaaaaauacaaaauuagcugggcgugguggcgcaugccuguaaucccagcuacuccggaggcugaggcaggagaauggcuugaacccgggaggcggagguugcugugagccgagaucgugccauugcacuccagccuggguaacaagagcgaaacuccaucucaaaauaaauaaauuaauaaauaaauaaaauaaauaauuuaaaaaaaaaaaaagggccgggcgugguggcucaagccuguaaucccagcacuuucggaggccaaggcaggcggaucacaaggucaggaguuugagaccagccugaccaacauggugaaaccccgucucuacuaaaaauacaaaaauuagcugggagugguggcgcacaccuguaaucccagcuacucaggaggcugaggcaggagaaucgcuugaaacugggaggcggaggcugcaguggugagccaagaucgugccacugcacuccagcugggcaacagggcaaaacucagucucaaaaaaaaaaaaaaaaaaaaggauuuauuacuggguuuagugaauaacuuuuaauaacuaacuuuaguaaauauaaccuaaacaacuacuuauucuuaguccugagacuucuugggccaaagugucauucgcacauguuccgcaguguucuuuaaagccccacccacacagcugcaugugugauucacgcccuucucaggcccucccuggcucagcugggaugggacucaguggcaaaccaagacagugcccucccguuuggcccaacccugggcuauguugucaucucuaugcacaggaugguccuggagccacggcaaugagcagacauucuccucugagaacacuguggccacaauaaugccuagccuuaucuugcugggcugagccccuugccuuccuagggacauagggacaauaaaccuaucuaguccuugcuacuuggcugaccuuuugauuuugaccacugcugcuuccacaaguuuguccaugagucuaauccugucacaaaugcgcuuuauugaggagaauaaaaacaauaaaggagcuuuaucuuuggcuuuagcgcuauggcuuccauacacauguuaaugaaugaaaaagcauucauugaaaggguuuaaauaguaaaguuucuuuuuuuuuuuuuuuuuuuuuuuuuagauaagauaucacucugucgcccaggcuggaguacaguggugugaucucggcucacugcacccucugccuccuggguucaagcgauucuccugccgcagucucccaaguggcugggauuacaggguaugcgccaccacaucauuaauuuuuguauuuuuaauagagaggguguuucaccauguuggccaggcuggucaugaacucuugaccucaagugauccgcccgccucagccucccaaagugcugggauuacaggugugauccacugugcccagccaaaaguuaaauuuaucuaagagaaaaugccuaucauuuuaaacucauuacucccaaacuuuucugcacauuacaaucacuuggaaaucuucuuaaaauuccaaaagccaggccacccagaccaauuacauacacuacaaucucuagggaugggacauaggcaccaauguguuuuuugaagcucuccuggagguuccaaugggcagguaagucggggacccccacucuaaucagcauucacugagcugauaagcugcagcguaaaacgggagcagacauccccacucggccaucauuccuuuaaguccaaagcuacgaaacacaccuggcgugagaagcaaagauccgucgggagugaaacucagucuacggaagaaagacuucaugcugucgucgugaaacauccgguagcuucuugccugucgcacacaaaauuuauuuuuauuauuuuuuuuguuuguuuucuacacacaaagcuuaaacauuuuuccaaaucuuuacacucacaaauaaacgcuucccaacugcuauaugugccuaugguuuucuuuacauagugucauuuauuguugacauaaucauaaaugaaacugaaacacauuacaaaucaaauaauuguacaacacugcaaggguaaacauucaugaaaacugaccacacauuuuuguuagguaaagcuauauguauauauguguguuuuaugugguucuaaaauuauuuuuaaaaacucuuaagaacacaaaccacagggucaauaguggcaugucuggggccugagacuggcagacagugggaagaugaccaggagaccucugcuuucuaucuguguggauucauuagaauuuccaacugaaugcacucuuuagauacagagucucgcucugucacccaggcuagagugcaguggcgcaaucauaggucgcuguaaccuagaacuucugggcucaaagcaauccucccgucucagccuccugggacuacaggcacaugccaccacauccagcuauuaacaaaugcacccuuuaaaaaaagaaaauaguggauuauuaaacugguaaucauuaaucuuuuaaaacaacauuucuuuaacaccugucugggacaguuuuuacuacuauuuauaaacaucaagcauuugccagacaugguggcucacaccuguaaucccagcacuuugggaggccaaggcgggcggaucacuugaguccaggaguacgagaccagccuggccaacauagcaaaaccccaucucuacuaaaaauacaaaaauuaucuaagugugguggcacacgccuguaaucccagcuucucgggaggcugaggcaggagaaccgcuugaacccaggaagcaaagguugcagugagccaagaucgugccacugcacuccagccugggugacagagccagacacugucucaacaaacaaacaagcauuuaauucuuaagaacacaaggaagccggcauuacuauucauauauauauauauguaauagauauauuuuuauauauauaaaauauauaauauaaaaauauauauuauauauaauauaaaaauauauauuauguauaauauaaaauauauauuauguauaauauaaaaauauauauuauguauaauauaaaaauauauauuauguauaauauaaaaauauauauuauguauaauauaaaaauauauauuauguauaauauaaaaauauauauuauguauaauauaaaaauauauauuauguauaauauaaaaauauauauuauguauaauauaaaaauauauauuauguauaauauaaaaauauauauuauguauaauauaaaaauauauuauauauaauauaaauauauaacauauuaaaguauauauuauauauaauauauacaaaaacauauauauacacauauuuuuuuuugagccagaguuucgcucuuguugcccaggcuggagugcaauggcgcaaucucggcucaccgcaaacuccaccucccagguuccagugauccucgugccucagccaccggaguagcugggacuacaggcaugcgccacuaugcccagcaaauuucuguauuucuaguagagacaggguuucaccauguuagccaggcuagucucgaacuccugaccucaggugaucugcccaccucugccuuccaaagugcugggauuacaggcugagccaccgcacccgggaagcauuacuauucuuacuucacaggugugaccucucagugccugucagcgcccagcccacacugccuuacccugguuccuuggaugcauuugcaccauguccccgugugaagccaguaaccagcuugcuccccgcaccucgcugccugccucgguagccuugauuccuuuacaaaaaggguccuauuuucauuugccaauuauuugaaagucaaaauccuuccuauuccuaaauaccaguguuuuggcugggucucugcugucugcuagcaaaacucucuaccuaccugccaagauaguaaacugccugcugccagacagauccaacgcucgaccugccugucuucuguugccucguguagggaucuucccagaucaguagugaccagcccuugcuauaccugagaaucauggaggcccugcuuaccuccagccaagugaaucacgccacucagguuggggccaaggcauccauauuuuuauuuuuauuuuauuuuuauuuauuuauuuauuuugagacugaguuucgcucuugucacccaggcuggagugcaauggugugauuucagcucacugcaaccuccaccucccagguucaagcaauucuccugccucagccuccugaauagcugggaucacaugcaugcacccggcuaauuuuauauuuuuuguagagacaggguuucaccauguuggccaggccagucccaaacuccugaccucaggugauccaccugccucagccucccaaagugcuaggauuacaggcaugagccaucaugcccagccuuauuucauuuuauuuuugaaaucgagucucgcucugucgcccaggcuagagugcaguggcaugaucuccgcucacggcuaagaccuccgccucccagguucaggugauucucaugccucagccucccgaguagcugggauuacaggcaugcaccaccacagcuggcuaauuuuugcaauucauugagaugggguuuggccauguuggccaggcuggucucaaacuccugaccucaagugauccgcccaccucagucucccaaagugcugggauuccagucaugagccacggcgcccggccagcacccauauuuguaauucuucccaggugauuccaccgugcaaccaggguugaaaaccacuguccuguccuccaucaguggcucuacccuggucuccagauguccccauuuccauacagacuagcccaccacaguaacugagccuugacuguccaaaaggaagccuuauuguaguucuggaaucggcucuuuguggccagugauuuggcugcaaggguaugggaggagcucaugacuuccuaagucucaguuaaagcgcugcugaaaaagaauggcaaaauauuuuauaccucuccuucagccccuauuccagacagcaucuucgaaacauugaaagccacacgcuucuucuguauacuguauacucgcagcacccugaagaaagaacaugucugauuuaccacuucuaguaaaugaauuaugcuucacacagaaacaacuuauuaccaacagccuauuaccaccgcaacaguuuucagccugcaaaagcuuuuaccaaugauauucacaacuggguaauuaagaaggaagcaaguauuaacaaccuaaaggauauuacaggccgggcgcgguagcucacgccuguaaucccgacacuuugggaggcagaggcgggugaaucacuugaggucaggaguucgagaccagccuggccaacauggugaaaccccaucucuaccaaaaauacaaaaaauuagccgggcgugguggugggcgccuguaaucccugcuacucgggaggcugaggcagaagaaucacuugaacccgggaggcagagguugcagugcugagauuguggcacugcacuccagccugggcaacagagcgagauucugucucaaaaaaaaaaaaaaaaaauugguaagucacauuacucccacuagcuaaucagauuguuuuacugaugacugucugaauaaaacacacuugucagaaaauaaauggcauuuagaauacaacagaagauucuaugaaaaauaaacacuaacuccucccuaccacuuuuauuccaaggccaucuuauauucaauuuguuuuauuuaaaaguagucagauaaauauucaaaaggacuauuaaguaauauaggaggcacuccucauuuuuucuaacucuuuguuccaacaauacaauuaaaugcaauuaugccaguaaacacgacaacaagacuucuuuucagaaagcacaaaaauaguuuauuuuuauauccauuuaaauggagucauuaaaauaacugggcugggcgagguggcucacgccuguaaucccagcacuuugggaggccaacgcaggcaggucaccugaggucaggaguuugagaccagcaucgucaauacggugaaacucugucucuacuaaaaauacaaaaauuagccaggcauggugguacacacuugcaaucccagcuacucaggaggaugaggcaggagaaucgcuugaaccuaggagguggagguuacaguaugccgagaucgcaccacugcauuccagccagagugacagagugagauucugucucaaaaaacaauuuaaaaaaaauaaaaauaaaaaucaccguagcacaccuguaaucuuagcacuuuggguggccaaggcagacagauggcuugagcucaacaguucgcgaccagccugggcaacauggcaaaaucccaucuuuacaaaaaaauauaaaaauuagccgggugugguggugcacacccguagucccaauuacuuggggggcugaagcaugaggauugcucgagcccaggaggucaaagcugcagugagcugugauugcaccacugcacuccagccugggugacagaguaagccccucucucaaaaaaaaaaaaaaauaguaauaauaauaaagauuuacuaaguucagggcggggcaugguggcucaugccuguaaucccagcacauuggccaaggcaggcagaucauuugagguuaggaguuugagaacagcuugaccaacguggugaaacccugucucuacuaaaaacacaaaaauuaaccgggcaugguggcaugugccuguaaucccagcuaauagggaagcugagacaggagaaucgcuugaaaccaggaggcagagguugcagugagcugagauugugagauugcgccacaacaccugccugggugacagagugagacugugucuaaaaaaaaaaaaaaaaaaaaagauuuacuaaguacaaacuucguguaaggcacuuguccuaauuaauuuccaauuucugauuauguuguaagaaugaguaugaaaacaagaacaaaagaaucaaaguuagacuaugauaaaucuuggcuaaguuacgauaaauaccucucuucagaaaauuccaaguaaauacaaagaaauuccaaguaaaugccaaagcugaauuuaccugucacagcucagaguagcaacauauugacccaaagggucccagguuacuccuuggacauaacuuuuauguucauuaaaaauugauaucuuuuguccuacaaaaaaaacacacacacacgcaccaaaacagcauuaccaaaaccuguuugagcccaaauaguauaaacuaugacuuaaauauuauucccuuuaccacgcaucacucagcaggcaguaagugagagacucuguacuaaaacccugugucaggcucuggggucacaaagaugacuucaugcaguccccacccucagggagcccacagaucagacagacccaucaacaagcaaggaucacacauguggaccgggggaggggagcugacagcacagggcggagggucugagaagaucuaaguucaguuccccaggucaggcaggaugaagaggggaugaaggguggaagaagguauugucagggaaucccuggguuaaaacagcuuagcgaagugaauauggagcagggagagguagcugagaacugcuaauggguacagaggagggccaagaacagaagauaaggaggaaaggagaaguauuacagagaccuuguguguaaggaaaaggcugugaauucaagcugagaagcugucugcauuuuaaaggugaaacagguuuagaagaugacaaagagggucacuaguuaggaggugaccgaguagaccaggagagagaugaggagggcccagagcagacaaugcgaacagggauggaaaagggacuucggggaaaauauuuagcacacagagaucgccugcauaaaaagacaagagaguuaugaagccuuggccauuccuuuuuuuuuuucuuuuuuuuuugagacagggugugguucuguugcccaggcuggagugcaguggcgccgucagagcucacugcagccucaacuucccaggcucaagagacuuagcagcccuaguagcugggacuauaggcauguacuaccacacccagcuaauuuuuguauuuuuuugguagagagaggguuuugccauguugcccaugcuggucuugaauuccuaggcuugagcaauccucccaaagugcugggauuacaggccugagccacugugccugacaagucauucuuuuuuuuuuuuuuuuuuuuuuuuugagguuuuuggugagguucaguaacaacccaucacacuuaugauaaaaccuaaaauccuggccagucgcaauggcucaugccuguaaucccagcacuuugggaggccgacgcaggcagaucgcuucaagucaggaguuugggaccagccuggccaacaugggcaaaccccaucucuucuaaaaauacaaaaauuagcugggagugguggcgggcgccuguaaucccagcuaccuugagggcugaggcaggagaauuguugaacccgggaggcagagguugcagugagcugagaucgcaccacugcacuccauccuggggaacugagggagacuccaucuaaaauaaaaaaaaaaaccacacaaaacaagacagaacggaggauggaggauggcuuggcuggacagcaugguacuaaaaagagcaaaaauuuuuauagacuggaugagaacugggcugacacagugcugcgguggcagccaacaacaacugcccuacccagguacuugaguuguagaauuggcaggaagagguuugggagaaaacaaaguuugaguaaaggauggcaggggauaaaaaugauuaggaguuagccauacuugcuuuuggcauuucacagcuauuuucacaccacuauaacuuuucacauguccacugucuccccaacuagagaacagaaugucccuggcuuuccuugaucuucuaaaauggaaaccugaucccaccuaccccaucaacuagcaugcaaugcccuauaaauuauaagugacuuguuaaucuucccgagauccuaaccuccauaaaggcagggcccgggccugucaucuuaucugcuggccccaccaugugggauuugccuggcuucagcaucaguaacuugcagcaccagugcuaagccucuuacccucugacaauccauagcauaugggacuaaccccuauccuguugagccaaccaccuacuuuaguucacuaaaacaauuuuuuguguugcuuuuaaaguuaaagcaaguaggccgggugugguggcucaugccuguaaucccagcacuuugggaggccgaggcggguggaucaccugaggucaagagauagagaccagacuggccaacggugaaaccccgucucuguuaaugauacaaaaauuagccaggugugguggcagacaccuguaguccagcuacucaggaugcugaggcaggagaaucgcuugaacccgggagguggagauuucagugagcuaagauugugacauugcacuccaaccuggacaagagcgaaacuccgucuccaaaaaaauaaaaauaaaaaauaaaguuaagguaaguuagggccaggggcagugguucaugccuguaaucccagcacuuugggaggcugaggcgggcagaucaccugagguuaggaguuugagaccagccuggccaacaugaugaaacccgucucuacuaaaaauacaaaaauuaacugggugugguggugcaugccuguagucccagcuacuugggagacugaggcaggaggaucgcuugaaucuaggaggcagagguugcagugaaccaagaucgcaccacugcacuccagccugggcggcagagugagauccugucucaaaaaaaaaaaaaaaaaaaguuaaagcaaguuagacuuuuaggcuuuuauagaugcuuagaauauuucuuccugcuaauaacaaaaauauaucauuuaccuuugcugacaucccauaugauggcuguguuauccacagaggcagaagccauuaaauucccaucaguugcccagcaaauaucauacacaucuucuaaguggccccuagaauccaaaaacaaagaggaaaaaagcaauuacuccccagguauagcagcuuaccccuguaaucccagcacuuugggaggccaagguagacagacugccuguggucaggaguucaaggccagccuggcuaacacaguaaaaucccaucucuacucaaaauacaaaaaucagccaggugcuguggcucacgccuguaaucccagcacuuugggaggccgaggcaggcagaucacaaggucgggagaucgagaccauccuggccaacauggugaaaccacgucucuacuaaaauacaaaaaauuagccaggcgugguggugcacaccugcagacccagcuacucaggagggugagggaggggaaucacuugaaccugggaggcagagauugcagugagccaagaucgcgccacuacacuccagccuggcgacagagugagacuccaucucaaaaaaaaaaaaaaauuagccaaaaaaaaaauagccaggugugguggcgcacaccuguagucccugcuacuugggggcugaggcaggagaauccccugaacccagcaggcagagauugcagugagccaagaucaugccacugcacuccagccugcgcaacagagugagacucugacucuaaacaaaacaaaacaaaaagcaauuauuaacucaaaaacggacaaguuaucaaaaauauaaggacaaucuccagaacuaagcauuaaaaugagauuccaaaauuuccacuggcacuauauuagcuauagcuauaaaaaacuacuuucaaggauagcuauaucugaccggucgcaguggcucacgccuguaaucccagcacuuugggaggccgaggugggcggaucaccugagguugggaguuugagacuagccugaccaacauggagaaaccccgucucuacuaaaaauacaaaaaaauuagcugggcauaguggugcaggccuguaaucccagcuacucgggaggcugagguaggagaaucgcuugaacccaggaggcagagguugcggugagccgagaucaugccauugcacuccagccugggcaacaagagcaaaacuccaucuaaaaaaaaaaaaaaaaaaaaaaaggauagcuguaucuuuaaaauugaauacuuuuuacuaagaaaaauguauagccgaaacuaagaaaauccauuuuaauuaugcuuucauccuuuaaaacuauugucuuaggacuguuucauauaaauaaaacuucuaaauuagaccagccugggcaacauagugagacccugucuccacagaaauuuaaaaauccucucccucucccucucccuccaccgucucccucucccucucccgcucucuccacagucucccucugaugccaagccgaggcuggacgguacugccgccaucucggcucacugcaaccucccugccugauucuccugccucagccugccgagugccugggauugcaggcgcacgccgccacgccugucugguuuucguauuuuuuugguggagaugggguuucgcuguguuggccgggcuggucuccagcuccuaaucgcgagugaucugccagccucagccucccgaggugccgggauugcagacagagucucacucacucagugcucaauguugcccaggcuggagggcacuggcguggucuccgcucgcuacaaccuccaccucccagccgccugccuuggccucccaaagugcugagauugcagccucugcccggccgccaccccgucuaggaagugaguagcgucucugcccggccgcccaucgucugagauguggggagcgccucugccccgccgcccugucugggaggugaggagcgucucugcccggccgccccgucugagaagugaggagccccuccgcccggcagccgccccgucugggaagagaggagccccuccgcccagcagccgccccgucugggaagagaggagcaucucugcccggcagcugccccguccaggagguggggggcagcccccgcccggccagcugccccguccgggagguggggggcgccucugcccggccgcccugucugggaagugaggagccccucuacccggccgccaccccgucugggagguguacccaacagcucacugagaacgggccaugaugacgauggcgguuuugucgaauagaaaaaggggaaauguggggaaaagauagagaaaucagauuguugcugugucuguguagaaagagguagacauaggagacuccauuuuguucuguacuaagaaaaauucuucugccuugggaugcugcuaaucuauaaccuuacccccaacccccugcucucugaaacaugugcugugucaacucaggguuaaauggauuaaggacgguacaagaugugcuuuguuaaacagaugcuugaaggcagcaugcuccuucagagucaucaccacucccuaaucucaaguacccagggacacaaacacugcggaaggccacuggguccucugccuaggaaaaccagagacccuuguucacuuguuuaucugcugaccuucccuccacuauuguccuaugacccugccaaaucccccucuccgagaaacacccaagaaugaucaauaaauacuaaaaaaaaaaaaaaaaaaaaaaaaaaaaaauuuaaaaaucagcagggcaugguagcaugcaccuguagucccagcuauuugggaggugagaggaucacuugagcccgggaagucaaggcugcaggguacugugaucacaguacagcacuccagccugggcgacaaugagacccuaucucaaaagaaaagaaaaaaaaagucaaaagguauauuccauuuaaugcacucaucguaaacagagaucacugccauggucccucccaaguuaccgcagagucuucacaaccguccaguucuccuuguucagcugggccucguccucauccugaaaagcgaucugcuccggcuccuuguuaucauucaccuuccacaauaggaugacagcaucugcagggugauucaguaacagugauccacgcuucacccacacuccuucauauuaggauuuuuauuuucauuuuuuuuuuuuuuuuugagacggagucucacccugucgcccaggcuggagugcaguggcgcaaucuuggcucacugcaaccucugccucccaggaccauccuggcuaacugucucuacuaaaaauacaaaaaaauuagcugcaugucaggauuuuuaggguauuaaaacaacauuuauguuguucaguggacacuauggccaggaugauuuacuuccaagcauuucaacagggaaaguaggcaaauugccuucugagcuaaaacuccaaaaucaaauucauaacagaucagagcuauacaaaaucaccuuaaacagaagggucccuaggccagcaaaugccacugcaaaaugacuggcuacauuaauaaaucugaaggcauaaccuauaaauagcugaauagaaaaacaaaacagcaaagaacccucagugcaaggguuggcaaauguuccuagcucagaaaccuucagcaagucacuuagcaucuugaugucucaguuuccucaccuguaaauggggauaauaggcagggugggguggcucacgccuguaaugccagcacuuugggaggcugagauggaaggguuguuuuagcccaggagcucaagaccagccugggcaagagagcaagaccuugucucuacuaaaaaucaaaaaaauuagccaggugugguggcacacaccucuggucccacuacgcaggaggcugaggugggaggaucacuugagcccgggagguggaggcugcagugaguccugaucuugccacugcacucuagccucagugacagagcaagacccugucucaaaaaugaggauaacaauauaucuaccucacaggcuguugugaggauuaaauuggccaauguauauaacacacuuacaacacaauggcuggcagauaguaagccccauguaagugucagcuauuaauaccauuauagauaucagguacuuuagccugaggucacccauugucuaaguccaauaacuccccacauucugacucuacgauuaccacguaaccuucugaccaucccuuagcuucccuuuuaggaaugugcacagcaggacagugaaugaaugagguugugaggacauacgcauucccauucuuuguuuuucuuucuuuuuuuuuuuuuuuuuugagaugguguuucacucuuauugcccaggcuggagugcaauggugcaaucuuggcucaccacaaccuucgccucccggguucaggcgauucuccugccucagccucccgaauagcugggacuacagguaugcaccaccacacccagcuaauuuuguauuuuuaguagagacgagguuucuccauguuggucaggcuggucucgaaccccugaccucaggugaucugcccaccucagccucccaaagugcugggauuacaggcgugagccaccgcacccagccugcauucccaugcuaaguuaaccggaauccuauucgcacacauuagucugggagcuugguuaacaugccauuggcccugauggaugaacacucuccacgugcugacaacagcagguuucugggccuccaagaccaagggacuuuggaaaaugggggcugccaugugcaaccucagggcagacagcagguagccacccccagguggcgcuccugcuccccacuuuucccucuacaaaucagcgugcgcgcgcacacacacacacacacacacacacacacacacacacacacaucccuucaugcacucuggguaucauggcacugaacucaaccaggucucuuuuccuccuccugcaaaaaaaaacuuuagauuucuguuuuauuuuguaauaguuucuagauuguuuuaaaguaugguaaaaagguuuacuuuuuuuuuuuuuuuuugagacagacucucacucuguugcccaggcuggagugcaauggcccaaucuuggcucagugcaacuuccaccucccagguuacagcgauucuccaccucagccuccugaguagcuaggauuauaggagcgcaccaccaugcccagcuaauuuuuguauuuuuaguagagaugaggucucacuauauuggccaggcugaucucaaacuccugaccccaaaugauccaccugccucggucucccaaagugcugggauuacaacaugugugagcgaccgcgcccagccugguuuacuuuuuccauauaguuuuaucccauuuaagcacaggcagaaaacaagaaucaaucuauucccaccaaacaagcaagcacaaaucacaaggccauucauuaaugacacucccgguaugcucccuccccagcacccuccagcagcccggcacugcagacaccaggacuccaaagcagcaucagucacagcagggaaugggagaaaacacacagaugucaaaccagaggagcugccaagcuggguaccgacgcgggaucuuaccccgaccggcacugcuggagcguuucagaggcuacuauggguauuacaacaaguaugucacugugaagaaagggagcauugcggggguuuccacaguguuggcagcuuaggugcuuuucagcuacugccuuucuuacagggagaucaaacacgagcagcuacucagggcccacugaagaggggccagugggagggcacacugcacuucugagcauggcacaccuccaugaggaacuuugccauugcugaauucuuucauaucccaguuuagaauucaugcccaaauagcccgggcgcgguggcucacgccuguaauccuagcacuuugggaggccgaggcaggcagauugccugagcucaggaguuugagaccagccuggcugacaaggcgaaaccccaucucuacuaaaaauacaaaaauuagccgggggugguggcaggcgccuguaaucccagcuacuugugaggcugaggcaggagaaucgcuugaaccugggaggcagagguugcagugagccaagauugugccacugcacuccagccuagauaacagugagacugucucaaaaaaaaaaaaaaaaaaaacucccaaagccaauuaauuacuaacacaguccuaaagccauuuaauuaauuacacagagacacagaacugacucugaucaccacagauguuaaacuaacaauccaacaaaaccagaacagucgccuugcuugggaugugacagaaugguaagugccuuuccaucucgucuuagaacagccuggugggagcuugcgggaaagcagcuguuuucaaacagguguuccugguuucaucuugcuguccucccucccugacucuaccacauucccuagaacaguauuuuacugaacuaccuaaaugacagauugagagggucagccacaccugaacuaaaaagcauauccaggccgggcgcaguggcucacgccuguaaucccaacacuuugggaggccgaggcagguggaucaccugaggucaggaguucgagaucagccugaccaacaugaugaaacccugucucuacuaaaaacacacaaaaaaacuagccgggcgugguggcaggcgccuguaaucccagcuacucaggaggcugaggcaggagaaucgcuugaacccaggaggcggagguugcagugagucgaguuugcaccacugcacuccagccuggggaacaagagugaaacucuaucucaaaaaaaaaaaaaaagcauauccagcucaaaucucacuaucugacacaagacacacagguaucuaucugguucccgaagaaucucugaaggacagcaauacucaccaucuccucccgaugcuaaaauuuccccaguuggagaaaaacgcacaacauugacggcuuugguaugacgagcaagauuggacaaaaauuccacgauggcuuuuccaucuggucccuuuucuaccuuccagaucugucaauaccaacacauucauuugaaaaacauagaaugggcacauauuauacugucuguauuaaaacaauacuaugggcugggugugguggcucacaacuguaaucccagcaguuuaggaggccaagguggguaaaucacuugaggccaggaguucaagaccagccuggaaacacagugagaccuagucucuacagaaaauuuaaaaaauuagccaagugugauggcacaugccuguaguuccaguuaugcgggaggcuuaagagggaggaucacuugagccccgggucggggcugcacugagccaagaucaggccacugcacuccagccugggcgacagaguaagacccugucucaaaaaaaaaaaaaaaacaaaacuaugcuuauuuucagaaagaaaacuuaguuuuucuuuugaaacauaaaaucaaagaacucccuaucuaaaacauaaaugucuacugucccccuccgccuucuuucuagagcaacuuguuacccaguaggaaccaggaucaggaucccaaaacaaugaacguccaguuacaauaaucuagggaaaaugaaucaaauaagaaagcagagccgggcaugguggcucaggccuguaaucccagcacuuugggaggccaagguggguggaucaccugaggucaggaguuugagaccagccuggccaacaugguaaaaccccaucucuacuaaaaauacaaaaauuagccagguguggugaugagcggcuguagucccaguuauuugggaggcugaggcaggagaauagcuugaaccugggagacagagguugcaguaagucgagauugcaccacugcacucccaccugggcaacagagcaagacuccgucucaaaaaaaaaaaaaagaaagcagcucucuuuugcuuucauuguucaccgcaggcccuggaaauuuagcauucugggcuagaugacaaaguaguuuaguuuguugacauacguuaauucauucauucauuuacuuaagagaagggucuggcucugucacccaggcuggagugcaguggagugaucguugcuugcuucaaacuccuaggcucaagcgauccucucacuucaacuucccaaguagcugggccuacagcugcacacugccacgucccgcuacuuuuucaugucuggcuguugcccaggcuggugucgaacuccuggacucaagcgauccucucaccucagccucccaaagcacugggauuacaggcguaagccaccgcgcccagccgacacugguuuuaaguaaaagaaugaaaacuauugcuucaagcaguguucccggaugucuaucucugccccaguuuacccugacauugguguccacgccggcagacgccagucuguggauccucccagccgucccaugcuggaaguccaggcuguacacgggcuccuuguugugccaggcuauuucacaagugaugacuuucauccuccugagucucgaaggggaaaaacguuucucgggcaccguucuacuucuucaagacaggagaaagcugcaaaaugcuggugauggauuaaacaacaguguuaacagcagcaaaggguuauugagcgcugaauaggggccaggagccauuuaaaaugcacacugcauugggaaaggauguuaacguugccaucugacaauaacaccuugcuagcuccaccuaaaaugcuucgcuggguccugacauccacaaguuuaugauacgccgcuacauccagaaaagcaaaacgaaacacccagguaaaggcuaccuaggggccccggccgucugcacggccuguccccgcuuaguaggggcuaggggcgcgcccugagagcccggggaggggcccgccccgggaggagccucccggaagagggggccaaacgggguaggggaccggggcggcggggcgagaggagaaccccgccuuucccagggaccgggcgcugggcccgggaagcugggacugaggccgccgggaggaggccgcgcggggccggggguggacggggccccgccgccccaacgcgcgccgcuccggagcuaucccggggcccaggggcccgcccucggcgagggccucuggcccggaccgacgcgaccaaaagagccgcggagcugcccgggccagggaagccguaccuggagggacccggacagucagaggcaccgucaccucccgcgcagcgcgcgccgcuucccg

SEQ ID NO: 192655 - RNA, 44108 nt, Homo sapiens
ggggugaaccgugacagcgcuucggcccgcacuaaggccggcucuugugccggaaggaggaaggcgugggcauucgccccucggagcuagggagugugugcgacgccgcugcgaggucacgugagccacugccggcagagagggaaaggggcggggcccagaacgaagcggggaggcgccccuuguuucccuggggucacgcgcagccggaaguggcggcugcugcggagaauuggagauggggaccgcccuggacaucaagauuaaaagagcgaauaaaguuuaucacgccgggguaagugggggcuggggguggggauggaggugggguugggcgggucugcagguuccgcugucuccaucgcucugcgcacgucccgcgucccuaggcggggcagggcugucccgccaggugcgucuccgccaaggugggugcguucccgccaggugcguccccgccaggugcuucccgcgcgaggcuggcugcccugcgaggaggccccagggcaggcgccgccgccgcaucugcgggacgugcagggcaggcgcccagcuccggggcugcgcucuucccaucuggccccuugaacacccggcgguguuggguucucaggcuugagcucccucagugagcgcugagggcggaggaguugacgaccaaacuccccuuucccucucuccuaaggugaccgcaaaggucuaaugaacgaaagcuaaaacaaaccuuggaagcagaaauggguaugucuggcggcagcauauauuagaugguagucacuuuuaacaacauacuaacauacuacgaaaguuacugcuuuuucugguuuuauucuucgacugacacaaaggaauggcuauuaaaaugcaaguauaaaaaaguaaaaucuugacuaugccauuaacagguuuugugacauuggccagucauuuaaccuccuugggccucaguguccuuauuugcaaaugaggguguuguaagguuccucuaacucggggaaucucaacccuuacucuacaucagaaucagucauccuggagaauuuuaaaauaugauugcuuggguuccacucccagcgauaccggugauauaugugcagcuaggguugaaaucacagccccaacacucuuuggaauaaaauugaucgcagugguuggucauauuaaugcaaaguaaucucaaaagggacagaauuucagacaaaggucuuggauggaugcuaaaacuuuugggcaaaagacaacuagggaagccugcucuuauuuacacaagcucaaauggucauccccuugaugguuaauuacaaagggaaaaaucuggcccgcgcgguggcucacgcuuguauuaccagcacuuugggaggccgaggcgggcggaucaccugaggucaggaguucgagaccagccuggccaacauggugaaaccuggucucuacuaaaaauacaaaaauuaaccgggcgugguggcggacgccucuaauccaagcuaccagggaggcugaggcagaaaaaucgcuggaacccgggaggcggaggcugcagugagacgagauugugccacugcacuccagccugggcaacagagugagaccccgucucaaaaaaaaaaaaaaaaaaaaaaaaagagaaaaagcuaccuuuauaauggagaaaucugguagucacacuccucuagccaagcacaacaaugaacaccacuucaccaucacaacuaaugagacgacugacauucgguaccccuuggcaugaugcacagagaaggccacaacucaccuauguaguauuccugccaaaaauguuuaauccguaucaguucauaaggaaacaauaaggaauauccaaauugaagggcauucugugaaacaaguagcguggauucuucggaaauaucagugucaaaaaauaaaggcgagauaauuuuucuagacuauaagacuaaagggacaugagaaccaaauagaaugcuuaauuucugauaaaauauaaauucgacuauggacuauaauuguuguauauugguguugaauuucuccaguguaauauuuauauuuugguuauguagaauacuccacaugcugaaguauuuaggaucaaagugucaagccguagacugugcacauauguuuaugcacauauguguauaggagaaagaaagugaauguggcaaaauacuaacaauugcugaaugaaguuaaaagcuacaugggucuacuuuguauucuuuuuaaaaacagcuuuauaaagauaauuuaaaauacgaaauuuacccuuugaaaguauacaauucaguaguuuuuuaguguauuugcagaguugcacacccaucaccacgaucuaauucuagaacauuuucaccccaaaaagaaacccugaacccauuagcugucacuccucauucccccucccuccugaccccuggcagucacaaauugacuuugucucuggaguugccuauucuugacauuucauauaaauggaaucguacacuauguggcccuuuugacugacaggcuucuuuuacuucgaguaauguucaguguucaugcuugucauagcaugagucaguuccucauuccuuucuguggcugaauaauauuccauuguauggauagaucauauuuuguuuaaccacuggucucuugauggacauuggaguuauuucuaccuuuucgcuauuaauaauguuaugaacauucuaguacaaguuuuuaugugagaggauguuuucauuucucuuggauauauaccuaggaguggauuuugcugagcuacuuuaacuuuuugaagaguugccaaauuauuuuccaaaaaugucugcaccacuuuacagucuaccagcacuguaugacgguuccaauuuuuccacuacuuuguauucucguaacuuuucuggagcuuggaaauguuucaaaauaacaaugggagggcagugacaggagacuauauaugcauuuaacuuuaguauucauuauuucauuaacaaguuagcauguucucuucagaaauguuacuccagcugggaugcugagauauuuucugugguuuuaaauaugauacaaguaaugaaaaguacauuagaaaagacacaagcaguggaaugguaaaguugccccagcagaagucauacacagccaggaccacuuccugcgggucacagaguugaagacagagucagcucugucccuuagacuacaucuccuggugcuaguauaaggaacagcaucugcaauugauggcugaaggcagcuucucucaaccuucagucacuuuuuauacuuacaugcauuuuaaaggaaaccuuauauggugaauauaaaagaaaaaccaguauaacuuccaaauagaugguugcuauguuuuuuuaaaaggcgacagaaaagagaaaguuauuaaacuaauuaaucaauugacaaaaaucucugacaugugugcccaugacucaugugcuagacuccaugaucuguaauucaggguagguggaguaggcagccagcacugucauggcuguuuuccaagccucacguagcaggauccuugcugucugguccuugaggaggccucauugacugcagacagugcauaugucacaucuaguuugcgcugugguugugggagaagcggcccuucucuccuauccuccucacccuuagcuggcugcaauggagcugauagcauacacauuuucucuuuucuccguacaucucaacagugacaguaaagauucaguuaccaaagauuugacuuaccuauggaccugccagagcaccaugccuacaauucuuauggguugcuugaggugacugccaccuacuuuagccugauccuaagcaguacuaucccaggcuugaggucauuaagugauugucuuucaagugaaacguguuugucagcguaagcacauaaggcaagcuuauguuccagcagagguucugggguaggguuugacagccaggcaguaucacucucauuuuucuaaugaggaaaugguggcuuagacaaguugaugaauuucauaacccaacuagacaaguugaagaacuucacccgacuaauuggacagagucuggauuccaacucagaucaguuccaguucaaagcauguccauugaacacucuauuauucugccucccuaggaguggccauuuaugcaaaauggaggaauuuguaauauagaaauguuguuauucauuucguaggagugcugugaauaacauugugauauuucaauaaaaagagacugauaugacuucuacuuugaauauaugcugauucuguuauugugcuuuucaguaucuuaguuguggaagcauuugaaaauggcuugauucuguggacaccagagaaaccuaaguuauacuuagauuuaaaauugaccuuuuuuuuaagaaaaaauacucacugacaaaaugauuuuuuaaaaauuacaguugaagcauuuaaaaaauauaaacguuaaaauguaauaucccagcugggugcggugacucacaccuguaaucccagcacuuugggaggccgagguaggcagaucacuugagcccaggaguuugagaccagccuggccaacguggcgaaaccucaucucuacuaaaaauacaaaaauuagcuggguguggugcacgccuguaaucccagcuacuugggaggcugagguuugagaaccacuugaacccgggaggcagagguugcaguaagccaagaucacaccacugcacuccagccugggcaacagagcaagacucugucucaaaaaaaaaaaaaaaaauuaacgugcuacagaagaagguaaaaugaaaagugaagucuccuuacucuuccugacucccuguucugcccuuggacguauccacugaugauuuguguaguguuccagacacacgugugcacacacacgcaacuuguucucuuaauaauguaccuuuaucuuggauaccuuuucauauuaacauuuucaucagucccauucuuuuuuauauuauuuaaucaaucagcuucauucagccaauguauguugaucucaugaggguuacagguuaguagagauaggcaaauauauaaaauaaaagaugauuaaaaagaugaucaagugcucaaauaagagcaucugugauguaugaaggagcauaaaguaggguauagucaucuggggggaaaagggagaagcugggggcccuucuggagcuucaucaaaccuaguuuugaaaacugaguguuaaacuaagugcccaccaugcacugcugguuucagucaugaggaauagacaauguaaaccuggugaagaagaguuugcagacauuugggacgcaaccugaguccuuuagacuguuucuuuuacuugguugaccagguguuuauaguugcucauccucaucuaaucuggcagcaacagcaguuuuuuaaugugacuuagguugacugucuuuccaaaauauuucuguuuucuuaggguuuauuauguucuuuuuuuuuaaacuuuguaaguuggcuguucagcauauugaauuguagccuccuuuuuaaaaauguagacauuucccacuaaguacuacucuaaguaguacuucguaccuuaaguuuuauuuuucuuuuuaauaggugagugaauuauuguaaggcaaacccuuguaacccuacccacauccugcuggagaggagacuggaaguaggaucacuccaucuagauucugggagaagacccugcuccaaaggaccuugaugagguuucaugguuugguaaccucaugcacugugggaaugucagaggaccccgagauaaugcuucacugccaagucugaaaauuguguccacaagauuugauugguaguauuuucuaucauuguacaacuuaaaauaucuucuaauuuccauuuuuuuuuuugacaugaguuguauagaaaugugugcuucaguuucuguuauagcaacaacucuugucacccauagccuuacaaaaauuccuaauuuuaauauuuaaauuuuagaaacuuucuuacaagcagaauuacaaaaagaguaacuaacaagaaagugagauugugaugggauaacggaaugucaagucuaauugucaggaaaagacaaaauaacaugggaaugacaaucaaaauggacuaaggacuuagaagauccgaaacuaugaagcuacuaaaagaaacauuggggaaugcuccaggacauuggucugggcaaagauuucuugagcaauaccuuaaaaggacaggcaacccaagcaaaaauggacagaugggaucacaucaagcuaaaaaacuucuacacagcgaaggaaacaaagugaacagaauaacaugggaauguuuucuguaauuuaguaguaacuggcaauaguuuacaaacacauuuuguguauacugcugucauugcacugauuaccuucuguuguagugacuuuguucuauuaguccacucaauuaaaauauuugguuuuguuuaucuuuguauuccugggccuggcaguacucaccacuuaauaggugcucaaaaacuuuauuaaaugaugaguugaagcccugaaacauuuaaacaaaaugcagaagacugauaauuuuauaaaugcauugaucagaaaggggaaacuaugguauuguaggcacauuauggauuuugcuucguaauuauaaauaauauucuagguaucaauuucagacagauguugauaagauuuauucuuauuuugacauagccccagagcuacacauugcacccaccauuacuuguauuugcuuuaaaauagucauucuuaagaucaugauucaaauaaauugggaguagagauuccagaauuccuauaaauaugguuuucucucugauucaggaauggaauauaauagaaaauuguccaagguuugauuuuccagggucuucaucccaguuccuguggcucagcgugaauauagacccuuucuccaagcuugcagcauugcuguuggggcaccuucucccuaagcauccuuccacuuggguagaaaacuucuuuuuuuaaguauuuuauuaagauagagaugaaaucacgcuauguugcccaggucggucucaaacuccuggccucaagcaauccuccugccuuggccugacaaaaguguugggauuacaggcaugagccaccacaccuggccuaaaaacuugacuucuguuuccaaagacccaugggugauaugagauaaucaggaauuguguuaaacauucccuaauucccuacuuccagugaaagauuaaauuucccauggaaacaccuaacuaauacuguuuuauaacuagguagacuaggauagccuuuuccagcucacagagugcuuuaauccuccauauacuguuaagagguagcguuuucuccguuuugugguucagaagacugaggcccagagaauucagggacaugccagggggacugaugauagcaaauauuugaaguugcaucuuuuuauuccuaaauccaggauucuuugugccuucucugggucuuaauucucaucuguagaauggagaugauaccuacucaaagguuguauuuuaaaaauuaaaugagauaguguuuuaagacacuuauccuagcuuccaacaccucgugggggccgcaguaauaggugguggcauugucauguucuuuuccacgcuccgaagucuguucacccuuagaauugcccuuuguaugccacaaugcuaguuacguuaguacacccuccaaauggcauaaugagugcuugucagaugcuucacagauugucaaauaugugcccacugucuaugucugcuuggaggaaggagagucagugaccaaggagaacauacggaggugacggcgauuuuggccgugagagccaagugugauuuugguguugcugcaacuccuuugcuuagugcagcagauguguucuugaucaaaaaguuggacucaaaugcacuguaaauuacuuugugucuuggaacgcuguaggggagcuuauugguuagaaaaauccugcaguaaaucuuucuguaguguaaauauaauucauuuguuuuuauaaauccagaauguuuuacauucuuaaauucuggcacauguacucaugaaaaugacauuguuaaauauuaugguugugaaaaacauaaauaagagauuuacuccccagcauagccagguuacagugagaagaaauuuauacacuguggacugaguacuguuaccuuaagaaccucaauacuaccuuaauugggcaugcccguaauuucuuaugaaaaaaaaaggagaaacccuauacauaacaguucauuauuaugaagaaaaauugcaaagcuaaaaugcuaguuuuuuuguuuuuuuuuuuaagcuuaaauauucuacuuuaaccugcuggauucuuaguaaaugaaugaucaguuguaacagugaaugcuuguuguaaggacuuaggguauaaaaauuuaaaucucugagccagaagagaucuuaagguaauuuugagagguaugaaccuuuuaggaauacagucauccaaacuuuaaguaggucucuucuucugccaauaaccuaauacuccugaaaaagcuugucuguuaaaucauaaccuaaacucuuauauaaugcauaagaagcauuuucagaauuauccgagauugucugaaaacugggaugcgaucaaaaguguucauguaguucuccacuugguguuuguugcugcaaaucuuguaccagccugcgccugagcaugguaaagccugcuugaccaccgcggcguguuucgauacuggacaggucucagccugcuuugcacacacuucacccccugcaagcugcuugcuagaucucccucggccacgguggugggcuuuuccucugccuccuccuaaugccgaguccccggugcagacucgccuccguuaugucaucuaggagucuacuccgugucgccagccaugcccucucuuaggcccgaaaccugcagccuacaccuucugccuguuaacaaaggaagaaaaaaggagaaaacuuuauuuuccagguaacaauauguagacugaggacacguagcuuccaggaaaacgaaagcacggaagccugggguccccaccgcgcguucaucagguucggggcgcugggaaugcccggcgcaugcgcagagguaacacgucacaucgcauguuccuuuuggcgccagguuuuaacacugaaaagagggguugcggcugugucgaaaggugaauggcagggcacggagacgcuuugugugcgcagucucugugaaacggcugcaaccggccugggaacugcagcgcggaucaggaaagguuguuugcaaggugccuccugcgcaaucggugcugcugccggacgccggggcggaggcgcccgggucaguggcacucacugaagucacugggcaacguuuuccuagaacggguuucugcuggcugcaggcagaucucacggcaguuaaccucguagugugagcaguaugggguuaugugagcaacccuucccccugcuguggccgcuuagucucuucacgagggucucaucuccgccacacacuggccagcuggggccgcggguaccaugugcagcgcagcgcaggcuggugggcgcugccggcuggugggcgcugcauggugcuucacuguccccugccucguggccccgcuccccgcuuggugccccacccggaggcagcagagcccaucguucugucuggacuguuuccaauccagcuaacgccgacuuuccuuuccgccggucccuugcugccccuuuguccccguccucccacgccucugguacccucgcuccccaccccuuucccuccccuccaguccuuucuuccgcccgugcuuggggcugaccaugagcaaggcaggguugugaaaagcuggaaggggaagccagcuugccauuugcuuucugcuuucauuucaaccacacuggaguuugugacgcccuaacacuccccauuucacgcguuccuuuuuucaucaggucguuguuauacagacaggcagugcuuuuacugcauguggcuacacccccaccccaacccaguuacuuuucuagguuuaagcuuccguucagaaaacaaacugacuuguuagccaucggcuaggugggcugaccugcguccccuccccgagagcacacaggccagacgcuucggaagagcgugguccacacgucaccugcgaacagggacucgcccacgagaagccgcuacggccucagagggaaccuugccuguuugccuguccagagcgcagggagaggucaguugaccucagauccugauccuuuuuuacuuuuuccagaacauuuucuagaucaguuguuuacagaccucauuuugggaaaccgcacuuccuauuuuuacauauauuugcuuuuuuuuguuuguuuuuuuguguuuuguuuuuuugagacagagccucacucugucacccaggcuggagugcagugguacagucucagcucacugcagccuccaccucccaggcucaagcgauucuccugccucagccucccgaguagcugggauuacaggugcgugcuaccacgcuuggcuaauuuuuuauuuguagagacaggguuucugcauguugcccaggcuggucucaaaccccugggcucaagcgaucuucuggucucagccucccaaccaccaugcccaacuccauauuuacauuuuuaaauuauaaaaugguaaaacuuuauuaucaggaauaaaagaaaaaaguaugucauacaaacgcaaauauguaaagauguaauuuuuguaaaguacuucuucuuguccucuaacuuagcuacacagaacacuuuauggacauguuuacauggugagcagccaugaaaaagacugccugggcuuuuuacucucuguaauagagagcuugugccgucacuuguuggcagaaaacaaauccaggcucagagaaauagugccuuuccaaggugauagaaaauagauuuuaccuuucaucugguaaguuacaaaugguuguuuccuuauaaauaagucaauaaaaugaacaucguuuagcauaaagauuuuccaaaaaagcaaugaaacccuuuuauuaaaugaagucuuauauaaaauucuaaugucaauuuuaauaauacauauuaaaauacuuuauuuuauaaacagauaaaagcagagcuguucuacuuuaagugagaauaucuauuuccucccucccuucccugacucuuccucacaucccaaaguggcugcugaggugucuucacaggccuacggccagugguucucuuguaaaguauuaguuauaggauguugugacuagcaagaggcaacaaaguugaaguuuuuucaugccaacccauuuaauuugguccugugucaaaacuuacaaguucuguuagcuuucagauauaauacagugccuagggccgggcacgguggcucaugccuguaaucccagcacuuugggaggccgaggcaggcagaucaccugaggucaggaguucaagaccauccugaacaacaugaagaaacccugucucuacuaaaaauacaaaaauuagccuagugugguggcgggcaccuguaaucccagcuacucaggaggcugaggcaggagaaucacuugaaccugggaggcggagguuauagugagcugagauugcaccacugcacuccagccucuaucuaaaaaaaaaaaaaaaaaaaaaugcagugcauagaaugaggcuuuaaauauuuugccuuuauuuacuggagcauuuaagccaaaaagguacagacccaccaguuuacugacuauccuuugauaguuucugccauuuuccuccuggagaauuuacucagcuggggcucuuggacuagcagucucagcaaaagcuggugggcucuggagaccuucacuguuguccuacuuacuuguccugggaacuugagcugggaaggacaacaugagauuguggcccuuuugcuucugauaggaacaagcuguccugacccuggauuacugaugcucagacagaauugaccucuggguagcugugaggguuacaccugcugugugugcucugauccguugggcaggucucugguggccaguagcauuggcucacaugcuuuccagugauggucgcggucccuucauccucacuaccguucccccaugacagugucuuauuuacguuuaugguuuuacugucacaugccaggcaugauuucagcccaaaauuagcucuuccuuuguuuuaucagaaagaauuauuuaagacaauuucucuaaaacccaaaucuucaccuuugggaaaggagcagcaagcaguccugucaauggaaaauuaggaaccgaugggcagaaaucccauucuucaguaaucaucaggaaaaaaacuaagcuuuuucuaaucuaaaaaaaauacagucaugauaguuugaccguguguuucagauuuuaaaaaaccauuuuguaaauugaaaauauauauuuuuacuugcuaagaaaaugcaacuaauacaaaagaaugucuucugccccuucuccucugcugccccaugaacagugcccagaauuaaccacaugacauucucugcaucucacaguaguuucauagagcagccuuaggugaucuguccccagagccuacccuggauuaaccugaagcagagacccuguuccguacugcuuaauuaacacgugaucuacccuacagugcucuuuuugcugagcucuuuuuuucuuuucuuuuauuuauuuuuuuuuucuagacagaguuuugcucuugucacccaggcagaaugcaaugucucagcucacugcagccucugccuccugguucaagcaauucuccugccgcagccucccaaguagcugggauuacaggugcccgccaccaugccuggcuauuuuuuguauuuuuaguagagaugggguuucaucaugcuggccaggcuggucuugaacuugugaccuuaggugauuccccugccccagccucccaaagugcugggauuacaggcgugagccaccgcacccagccugagcucuuucuuucuuuacuuacuuguuuuagagauggggucuugcacuguuacgcaggcuggagcacaguggcacaaucauagcucacugcagccuuaaacuccugguuucaggugauccucccauccuagccucccaaaguggguugggauuacagugcgagccaccccaccuaaccgugcucuugcuuucuaacaagggcccuuuaggcuguuagccucauuugcugcuagacucaucucuuguccucuacucugaaguuugccugcauccuggcuuggauuugaaugcugcacuaucgugauucauacaugauuucacucugggauuucaaucugcuggcucuuugguuguucauauauaagugugggcuggcucuacagagcauuuucuuuggcggacucccuguguuccacggucauuacuuuggccuguaauuaugccaauuccaggcuccuuuguaauuggagcccuccuaaauguuugguuuauagucuggagucuuuacaugcacuuaugccaguaguuccaaacgaaugucaacuuuguaaaccuacaaguuggaauguuauuucuugaauaguccuuauccgaaaugcuugggacuagagguguuuuggauuuuggaauuuuuucagauuuggaguauuuguagauauuuaaugguugagcaucccuaauccaaaaauccagaauccgaaaugcuccagugagggucuucuuugaaugucaugucagugcccagaaagcuuuggacuuuggaacguuucagauuucagauuuucagacuagggaugcuccauccuauugaaaucugaaaucagguagucucuauuaacauaauuuuguuaauaugugcuaucuaacuccugaagccacgcaacacaccaugauuagaauuuaauacucugcugcuaaagauccugcauauacuuacuuuuauuaauguuuacuuuuuaugaauaguauuuuucccuuucuuuuaaacuuuuguucaguggcuucaguuucuuuuccaggcucucaagaaaguuucagauuuugaaguuucacaucacacuauuggacaguaugcuuuuugucagcccauuuuacuuaguauugacgccuguguguauacuauaccauacguagaaggaaccagcuauguuuuaccauguugguucugccccagaaugugauacuaaaacauaagcccccagagcaugggcuucaccuguuguguucccugccauguccaagugccuaaaacagugucugauacagcaagcaugccaaaaaaguugucaaaugaugguauuauuucucuauauuggcagcacauguauguaagccauguaaauugauaucuuguuauuuuguuacaguuucauugcuagugaacuaacuuuuguagauuuuacuuaaacauuaaucaauuuuagaauaugacucaauuguccagaaaguaauauaacuauuuccuccuauacgugauaauuucuguguuuuuuaaaaacagguauaauuacaaacaguagaugacucuuuucaguauaaaguuccuugagacuguagccacccacaauucaagauauggaacagaucugacaccccccaaauuccccugugcuccuuuguagccccuguuuucagucccuauaguuugcuuuuuccagaaugucacguaacuggcauaaauaugauuaugugcuuuguagccuuugaaucuggcuuuaucauuagcguaaugcauuucguucggauucauccagguuguguguuaauaguucauucguuuugauggccgaguuguccacccuugcauagauguaucacaguuuguucaucuauucaccuguagaagacguuugggugaugaugaauaaagcucccagaagcacuugggcaugauuuuugugugaacauagcuuucauuucacuuggguuuuaaaaucuaggaaugggguugcugaguggcauugucuuaguuuguuuguuuguuuguuuguuucuguaccaggaaaugaacugcauuggaguaucucaguuuaaaugauaguuuggagauaguguauuccaugcaaaauucucuuuccuggaacuucaguaaauuucacauaauacuggccauuacuuaccauguggagaacuaucugaggauuguuuauccuguuuuuucagacaagauggaaacaguuacauaaaauaguggagauggggauaccuaacacauugaaaucucuuuaauguuucugauuuccgcuuucuaaucaaaaugggucucucagugcuacuaagaaaggguagaguguuucaacaagcaauuaauugucucacucauguuuucccacccagcucaguaacuuaccuugguguuuuguuuucauguuaguucacuacuuagugcauuugguccucauugguaaauaaaaaggcaucucacuauagguguaccggaucuuuagaccaaaugggauggcagaaucucaggugguuuaggagggaaggccuuguucagauauaugcacacgacuguggggaacgaagaugggcugucauggugcaucccacugccaggaccauuggaaaggaaaagcauugcagagagaauggcugaggcguugagaggcuuuuacuuuucuagcaguuguguucaaguccaaaauaagaacuaacccaaagaaaugugacuuuuuaacacacaaucuucagaucuuuuccugaggagagacuauuaggccuauagguuaucaaaauuuaagaggcuuagaacuuuguacauugaggucuaaaggcuacccacucugggauuuuguuuuauuuaaaaauggauucauuauaauagguaaucaauucacaggguucaacauucaugaauuucaagaucgauacccccugccucacccacccuauucaucaagggcuucuccuguggggcaaccacagcuaucaauuucuugugauuccuuccaaagauacuguaugcaucuacaaguaaauauguacaaaugugcuuuuucuuccucuuuuucacaaauggugcaauauacagcuuaaauuuuaaaaaaaaguagaauguaugggagugagggggcguagacuggacaugcugauucauaugcaauaaggagucaguucuuaagauaaaugaaggaaacuagcccugcauccccauauguacuaguguaaaugaucuccacauuguugaaagaaaacucacaauuuuccuauuguuggaauuuaguuugucgaccaucuuuuguuauuuacaaacaguguugcagugaauaacuauguucauaagucaucucacaucugcaaauguaucugcugggcccauguguuuguaaaauguuuuuggucuugccaaauagccggcacgagguugcaacauuucagguuauccccagcaaugcagagaaggcuuauugccuccccucuggcaacacaauguaaugacauuuuuuuaucuuuguuuuaauugcuauuuaucauauuuuuguugaaauugagcauauuuuucuguguuuaggaacaaucugcauucccuuuucugugagcucuuuguucagaucauuugcccuuuuuuuuuucauuuuucuucugaguuaucuuuuucaucgaugucuuuuuuuuuuuuuuuuugaaauggagucucacucuguugcccaggcuggagugcaguggugugaucucggcucacugcagucuccgccucccggguucaaguaauucuucugccucagccucccgaguagcugggauuacaggcgugcaccaccacacccgacuaauuuuuauauuuuugguagagaugggguuucaacaucuuggccaggcuggucuugaacuccucaccuccugauccacccaccucggccucccaaagugcugggauuacaggcgugagcaccgcgcccagccuuucauugauuucuuuuaggcauucuuaaaauauuagggaaaucagcccuuugcuaauuuguuauauuaaguuguagguauuuuaccuaguuuaucauuuauauagugguauuguucauagucauauuuguggccauauuuauucagaguuuugaggcauucauagaaaggccuuucccacuuagaugugaaaaaaauuauucucuaugguuuuguccaaaacuuuuauuauuucaguuuuuacauuuaaguauuugcuacauuugucauacacaaaaaguuucaguaugguccaacuugauuuuuuuuuuuuuuuaagagagagucuuacucuaucacccaggcaggagugcaguggcgugaucucagcucacugcaaccuccaccucuugaguucaagugauucuccugccucagccucccaaguagcugggacuauaggcauguaucaucaugccuggcuaauuuuuuguauuuuuaguagagaagguguuucaccauguuggccaaguuggucuugaacuccugaucucaggugauccgccugccucagccucccaaagugcugggauuacaggcgugagccacccugcccggcccaacuuaauuuuuuuugguugaguucucuggccaguuucccaguaucacuuauugaauauucccucucuucccuaaggauuuuaaaugcuaccuuuaucaaacauuagcuucccauacugucugggucuauuucuagacuuuuguucuguugaucuuucagccugaacaugugugcuguaugacacuuuguaaauuauagcagcguuguaauaucucacagggcuaguuucuccaauuuccuucuuuucagauuuaucauugcauauaaacuucagaaucagcuugucuaguguaucccucccacucccgccaucucccccucaaaaaagaaaaacaauugugguguuauuuucuuuuaagauuagguugccuuuauaaaccaacuucugggaaaguagauuuguuaagggcauuaaaucuuucccauucaaaaucuggcaugguuggccauuucuucaaauuuucuuuuguggcuuucaggcauguuuuaaguuuugucaucugggaguuuuagacauuuccugugaaauugacuuauaauauuuuaacuuuuuguuccuuuugaaaauaaggccauuucuuccauuguaucuucucacuaguuguugguuuauaugugauaccuauuggguucucuguguuaauuuuguacccagcugucaucuuuucugaaacucucuucauguugauaguaguuuuucaguggauucccuuggguuucuucagguauacacucauugugcaaguagugaucauuuuaccuccugccuuugaauuaccucuuucucucucuaguuuuauuguauuaacuaguacuugcagaacguuaauuguggugauaguggacauccuucuuuuauuccugacuuaaauggaugauaucuuguuuucucauuaaguuugaugcuggcuuugggguaagguagauauauuuggucauccuucuauuauuuuacuaagaauuuuaucaagaaugcauaaauuuuuucaaaugccuuuucagcaucuauggagaugacuauauauaauuuuucucuuaauagcuauuaauaugaguuguauuaccaguuuucucauuauuaaacuaugcuuauauuccuugacugaauucuacuugguuauguauaguguuguuuuaaguugcuacuggauugcauuugcuaauauuuuauuuaggaccuuugcacugguauuuacaaaugagaauaaucuaguuuucucucuucucucuccugucucucucucugaguguguagacuuuugucuuauuuugcugucauuguuauguuggcuuuuuuuuuuuuuuuaaguucguugcuuucuaauaguuuuauaguggaauuuucuguucuucacacagaaaaauucagggaaugaucuccugugaagcugucggguuugggggccuuauuuagaacuuuauuuuuucuaugaugauugauuugcuuggauuucaugucucccuuggagugauuuuggauaaauuauauuuucccagaaaaauaauucacuuagucagcuuuucaaauuuacuuauauacaguugaauaguguugaauauuaucuuuuaauuaccuccauuuuucuaguauuucugcucuuauuucuuauuuuggauauuuguguuuuucuuuuuugauuagauuauuuaauaauuugcuuuguucccccccuccccccacccccagaagaaagaccuauuggacuuauuaagggaucaguuuggccaguuuuuaaaaguauaucauggacacugaaaagagcauauucucuguuuucaggguauagagaucuauguaugccaguucauuauacccuguugauaugugacguaggucuucuguauccuuguuucuuucugucuacucuauuggucaugaucuguaaauuaaugucucccacaacgaauuuguuuuacucaguuucuccuuaaaucuauucccuguaguuuuugcuuuacaaguguggacacuguuugaucugcagauaauaauaccacgucuuuuucuuuuuuuagagacagggucucgcuaugcugccuaggcuggucucaaacuccugggcucaaacaauccuccugccucggccucccaaagugcuagaauugcaggcaugagccaccacaccuggccucacaagucuuuauugugaguugcuccuuuagaauuguaaaguccccuuugucuuguuuaauccuucauucucggaauucagcauugucugauauuaaggugacaauccaugccuucuuucuuugccuuuguuuauccuuucuuuuuuauccucuccaaauccaccccugccauuuuaggugcuucucugucauacaacauaaaauuggguuuugccuuguaauggaauauucaugucuguuuuugaauaggcauuaauuuggcucauuuguuaauaugacauacguuuggcauuaauucugucauuccugcuugguuggggggaauguguuuuuaaguagcuuuugaaacaucuuuuuacagucugucuuguuugcuuuaguuguuuguaugauuuucuagucaucuggaguuuuauuuuuguuuuaacuguuacccuugcaacuuuuuauuguaccugaaucuucacauuuuagacauuauuuauuaauuuccuacugugaacaaugguaaauuagcauauuuccucuuuccuuuucccuuucuucccgcuacuaccugaucuuaguuacuuauaguauucgucguuguuuacuucuguuaaguuuauuuguacgacauuauuugacuuauuaacuuuaaaucagcacuguccaguagagcucucugugaugaugugaauguacuucuuaucugcucugucucuuaugauagccacuggccauaguguggcuauuaaacacuugaaauggaagguccugaauuuuaacuauuaauauaaguuuaaguuucaauagucacauauggcuuacagcuaccauacugaaaaguguagaccaggugcaguggcucacaccuguaaucccagcacuuugggaggccaaggcaggauugcuugagcccuggaguucaagacuagccugggcaacacagcaaaaccccaucucuacaaaaaauacaaaaauuagcugggugugguggugugugccuauagucccagccacucaggaggcugaggcaggaggaucacuggagccugggagguggagguugcagugagcuaugaucacacuacuguacuccagccugggugacaauaagacccugucuuaaaaguauggaaguaugguuugaauaauacauuuuuaaaucccagccaucaaagaugggaaagccauguacauuauacuacuuccuagauucuaguucucuuagucucccagcuagugucgauuacauucuacauugucaggacuuauauuuugcauucucuucuuucauuauaaucaucacuuaucucagucuucuucuuacaauuaaauggaguuaauccucacaguugguucuuuugacauaguuuuucuagccaucucuuggauagcuauaguuuacuauuuaguacauuccucaagaaggacuuuuauauaguauugcuugggauauguuuuuuuuuuuaguuugguuggguuuuuuuauuuuugcacauuuaaaacuuucaguuacacuggaaugacagauuaggugaguauaaauucuagggucacacuucacugccuugagcauuguuguaucauucugcuugcauuuugaauuccauuuugcuauggagaaauaugguuucuuuuccucuuaugagugacucgaucuuuuuuccugacuccaaaaggauauuuucuuuuuugaaugagaacacuuuugcuacagaguauuuucauugagugcuccuaauuccuuugcccuugacuguuuuugaauuaucacaguaaauauuuguucugcuucauuauuucaguuuucuuauuuggaacuuaauuaggcauagcuguguguuuguuaccugucuccaauuuuaucucuuugugguucuuuuugaauucuuucuuaaauuuucauuuaauuuauuuggauuuugucauuucugcccugcauauauccuuagacccuuuuaaauuuauuuucuguggugguuugauuuuuuccuuuuacuucuuuucugagcuuuccuauauuuuuaucucuuccuuuugccucaccauuuccucccugagcucuuauagcucuguuuuguguucauccuuuauagaagcaauugucucaucggacuuuacaaauucauggugaaaugcacauucaccauuuucaucugcuugaugguauggauuuuucuucuggugaaugaucguuuauucauuuaguaaauguucauugaaugccuacuguugccaaucacucugcccugguggaguuuauguucaggggcaggagacagacaauaaauaaaauagggaggcacuuuugucuuauuuuggaagguguaagugucacagagcgcagucagucagggaggggggauaaugagugcuagggagggaguaguacaguuucaaaugugggcucacggaaccgaguccugcagguaucugagaagaacaagcagguggagcaaggaacgugggcaguugccuaaggcuggaaugugcaggccucugaaaggaauggcaagggggccagggcaggagcgagggagcagagggccccauaugagggccgucagguaaggagagggcgggucccccuuuguaggcugcuguggcucuuacugugugcuugagauggugagcugcugaaaaaucuaaguggaacagugaccugaccuggcuuucgcauucaucugccacucguauuucucuccuuccucacuuccccuccuuccuuucccuucccacucucauuuuuuaauccauuagaugucaugugcuccucugcugguuccuuuuaaccucuccuugcaggagaugaauuuauuccuagaccaggcuggcuggaguguucuaauagccggaggauuuacgugagaguuucuuucaucuugacuuugcaugagcccaugcaguaaccagcugcagggcguuugcaccuugcagaggggcucauugucuccaccacugcagagaccgacugcuuccagcauggggcggguugacaggaugccucucuggguguggccucagcuguucccagguguacccucacuuuccagaagaagcacguuugcagagcugggggccuucuuuccguuuuucaucacgucccccugcucagucuucacuucuuuuaacagcucuuccaccuauuucaugguauuuagcuaucuccuugccucgccgaaaaugcaguuugugguuuugguucucauucuuugggugauuuccaggaagccaagaggggucgcggacuugaugccacuauuuucaaauccagaguuccaauuaugguuuuggcauuuuauuacagagaacaaauaagaaaaagaguuguauaguuugguaguggccuuuuacauuuagagaauacaaaguuaggcugggugcucacaccuguaaucccagcacuuugggaggcugagauggguggaucacuugaggucaggaguucgagaccagccugaccaacauuggugaaacccuacuaacaauacaaaaaauuagcugggugugguggugcaugccuguagucccagcuacuugggaggcugaggcaggagaauugcuugaacccaggaggcggagguugcagcgugccgcugcacuccagccugggugacagagugaaugaggaaaaaaaagagaauacaaaguuagaaaaugugguugcuuuugccccccuuugaacaaacuugccagugguuuccgcugugagagccagcaaagcugagaagagcaagguggccaguagccuuuggaaugcuuguuuccaggcggcucuuugggcugagguugaagaugggcagcuucaggccucucuccagacuuagcuccuccagggcagggacuuggaggagccccucgaagcaggcucugaguggugugguucuugggugcauggccucuguccaucuaaagcaaagcagcugaggcacaaaguauaauaaagagcugacucgagccaaagagaggacagcugcccagaagauacagacccagugacccuggauaugaacuccguuccccuguguuacaaguagguuguuaaggcaaagaaagggggacacggaguggggugauacaaaguuguuugccaggaauucucauaggcuuacagaaauggcauugaugggcgauuggcucuccauuguuaagcucuagggugcgggcuguagucucggauggggugugauugagggaauuuauagcuuagcugcugguggcaaaagcagguaguuucgagagaugagcacaacccagagaaggggaggacgggacugccgucuccuuucagugucucugggcuggauaacugaaaaguauucacauuccuccaaugaaagcucuuuccuuuacucacccugaagagggguuggcucuuggugacgcgagugggucccagugucugugcuggcuucucugaugagcacgcacaccacacggggcugcgccucuuccuccucccacuugacaauauggccuuucccaggccaggcgccuccuccaugaugagacagaagcuacggcucuucucccaaaacaguagcacccugcacacgauuucgguguauacguucuggguucguugccagucugugaacggucccucuuuguagucacggcccccaguugaaggccucugcuugugauguuggacgagguauuaguacuaucuggagccauaaaucuuaugucuuccugaugaaagucuagacgaaaaucugagggagaaguucuuggugagaucuuggguuuuccuuaaugucuguucuaccaguguauccuaucuuccucugccaggaucaaucaagcauuguguagacagaucuugccucucuguuaaaccgucuccuguuucuaaaucccuuggcccucggccucaggugggcuaauucccuauccuucuuucauugguaggaguugaauaaaccuguauauuauaagaauaucuaauuuauccacaaauguuaauuuuguauuuucuguacuauauugugucucgagucauaaaauauuuacucugcuuacuuccgagguaugucacuacuuuuuuccuccuacgcugcagggauuaaggagggaaaaggcuuuacugaugucauaguuagaauaugcccaucagggagacccagagaccuguucccgugagacugacggaaaggguuaugacugcauaggaacgggaccauccucaggcgcuacugugugguucaauugauaaagcucacaaauuauuuugucucauuuauuugugggacauauucgucaaguaaacuuuaaaaaauauacuaguggauuuaaauuuuuuuuucuuuuuuugagacagggucucacucuauuacucaggcuggagugcaguggcucauucauggcucacuguagccuucaccucccaggcucaagugauccuccugcccucagcuuccugagcacaccaccacgccuggcuaauuuuuaaaauuuuuuuauuuguagagaaggagucccacuaugcagcacaggcuggucucgaacuccugggcucaagugauccuccugccuuagccucccaaagugcuggauuacaggcaugagccauguuaccuggccugaauuuuuaauauuaaauuuccauuugaauuugggcuauacaaaaaauuaauagaauuaauguuaauuaaacuuagaauuuaaguuacuucacaggaauuuuuauuuaagucugcuuaggaauuuuuuaggaacauuaaauuaaacauuaaacauuaacauugaaacaaacacagucaucuccauuuuaagcagaauucaaggagaacucauuuuauucuuaagauugcuuaaaauggagaugaucguguuuguuuuaauuagacuucaaggcuuugggauggggaguggaaacaaaaacaaaauacuuagcacauuuaagggacauagaauauuucuugcuuccaaaauucaaguuaaaguaagaacuugguaaaaauuuuucacuggauaacuagaagaaauaaaagauaagcagauuuaaacaccaguaggacagauguuuuuuaaugguuugaucugcaggccaauuuuuauuuuuacuguuuauuuuugagauaggguuuugcucugucacccaggcuggaaugcaguagcguagucacagcucgcugcagccucaaccacccaggcucaagcaauucucccaccucagccuccccaguagcugggaccacaggugggugccaccacacucagcuaauuuuuuuucuuauuauuuguagagauggagucucgcuauguuacccaggcuggucucaaacuccuaggcucaagcaaccuguccaccuuggccucugaaagugcugggacugcaggcaugagccaccacgcccagccugagacguguuguucuguguggauuguggauucagucuuucuguuccgcuugauacuauuucauccccucaauuuccucuuccacucgagccccuguaacagauugagaccauccaguucuauggugacaggaagaaacugcucuccaauagcgaaugcaguuacuauccguaaucuauuacucaguaauuaucuucagauaaaugcacagaugaucuguugugaagucucucgaugaugugugaaccaagggaauggaggcgccgaugccuccuggugugagcaggaaccacagggacagggcaguccuucuggaaaguggcaugcugcugccucguggguggcaccaauaaccuccagucuugcucacaguaggcauuucugggcagaaaggacaccaggcuaaccaucguguuaaauuacucaugcauuugcaguugugcugucauuuuagucagcgcuauugagaaagagccuaacgaacagaguuuuauuuucuucuguuccuuuugaagggaccucauccaugcccaugugugauaucacugggaacuuacauuugcccuggcccuucuccuugcacucuugaauucagacaucuguugagauuccccaaccaggaaugaagacaugucugagaggcagugacgggacgagguuucucauccccacacccgggugcuccccgucagguguguccaggcugccacgucauuaucagugggcaucuguccccuaccaggaccugggccuucuccacccugguauccaggugucucagugaaugucuggaucuuuaaacaaauugaugaugaaggagaccuacguuugcuaauaaacaagguagaauggaggaagcaugcuaauuugauugguggcugucuuuucucucccaggaagugcucucuggcgugguggucauaucgaguaaggauucaguccaacaccagggagugucuuugaccauggaaggaacuguaaaccuccagcucagugccaaaaguguggguguguuugaagcuuuuuauaauucuguuaagguaagaaagaaugcuuagauugcaaguuuuuaguucaauauugaaauguugggcugggcgcaguggcucagggccaggcgcaguggcucaggccuguaaucucaguaauuugggaggccaaggcgggaggaucgcuugagcccaggaguuugagaguagccugggcaacauagcaagaccccaucucuauaaauaaacuuuaaaaauuagccgggugugguggugcgugccuguagucccagcuacucaggaggcugaggcaggaggaucccuugagcccaggaauucaaggcugcagugagcuaugaucacagcacucuacuccagccucagcaacagagcaagauaccaugucucuuaaaaaaagacauguuuaugguggguuucacuugcugugugccuuuauuguuaucuguuguuauuuugcaagggauggugguaguuacacuucugauauuuacuaaucaaccugcgaaaauggagauacuuuguuucuaaguauauccuguuauugaaagucugcuuauauuuauuccuauuugauaaauaggauuaggagaacuauaaauguauuaauuucagccauuaaaaagaucacaccugggugcaguggcucacgccuguaaucccagcacuuugggaggcugaggcagacagaucaccugaggucaggaguucgagaccagccuggcuaacaugguaaaaccccguuucuacuaaaaacacaaaaaauuagcggggugugauggcgugugccccagcuacuugggaggcugaggcaggagaaucgcuugaacccaggaggcagagguugcagugagcugagauggcgccauugcacucuaguugaggcaauaagagcaaaacuccaucuccaaaaaaaaaaaaaaaagaucacagcucuucugagaaguugugccuguggcuuauguuacaugccuuccaaaaucaaaacugucauuuuauuagcugugucuaugcuacuguugauuugacacuaagguaagaugaaaauagagcaaguaacuguuguuuuugucauuuaggguagaguuuuguguuccagaauguaaacucuuucucuauucuuguaguugccuuuuccugaaggacauauuaacgcuuuaaguuuugcagggaaaagagugaagacagagaaaggugcauucacaguguucagauuuaggggcuuccuauguuuucuacaacuuuauuuuaauccauuaguacuuaagagauucacuuccuaagucaugggucuucuccgagccacugauguuaaacuauaaaugcuuaaaaagcaugaauacgugccuugaaggcagguuccaaauguuaguacccuccugcuccuccuuggaggcccagcugaggaggucugugcaggccacagggcuggaggaaaggccugcucucccugagcggcugcagcaggaaggcuccgaggaagcuggugggcugucaggagcagaggcagcgcugcccagaagagcacggggcucggugagggggagccguggguucacacgucaacccuguuagccaggcagccucacugugcugggucugcuucuugauccugaagaucggggucguuaaaacaguuaaaugagauaccuggggaggagagagggauguaucaguucaguucccaugugucucaagcaccuaugugucucauguuguaaaugaaucauuauugugccagagucuuaaaaagcagagccaagucacuguucaucuccagacccagcgcagagcugccgaagacagcaggaugguggccuccagggggucggggugcuguguccuucagaacguuauuaguaauuggaaaggacauuuccaagugugugcugauggacugaacugauuuuuguuuacagccuauccagauuaucaacagcaccauagaaauggugaagccggggaaauuucccagcggcaaaacagaaaucccuuuugaauuuccucugcacuugaaggguaacaaaguucuguaugagacguaucauggcguguuugucaacauucaggugagagcuuccuaguccuacgcgacugacuucacaaguuuucuucugacaaacgguguggucuuucucucaacguuaguagacgggcccaagaauuuaauacuguguuuauugcugagaccucgcauguauauucgacguuaauuucucauuucccugauaaaugcauuugauguauggccguuauuucugaugggagccucaaggcacucgugcuguaacuucuuuucccucuguuucuucugggcucuuuucaggccaccucacauuguaagggaugcuuuuauugucugguaacagauaugcccuaacuucuuucuggcacuagcauuaacuugucuguuuuauacuuacaaguaucucuuuguuuaacacccaaaggcuacuacuuugacauaggcugguguucuuuacugaacaaaccuugucaaugaggggaaguggauuaugacuuccugucuaccucugcugguuaagggacgucuuugacagucugcuguuguugucucaggagcaguggaguccacgcggggugagauagccuuuccuuuaugcagcagaaagaaagauacuuuugugauagcagccucgcagcacuucccuugcuggaugagacacaacucuucagucuuauaugcaagagggaugaaagucaggaauuuuuuugauuuauuaaguuuuggucaauaauuuggccuuaguagauacauuauccugcugaaaauaauagaaccuuuaaaauaaaagccccccaaaccccugugaguguuuaaagauucaucuguaugggaguuuuaugaauugccuaagagaucuguccagaggaaacacauguaguaugauguacaucuucugugaagaaaagaaguguuucuaguccuuuauuguuagcaccaaaggcuuuggacagccccaaggaagcagcagugaugacugaguaguaccuggauucagaggaagcugcguacguagccaugcagauaccaauugcugguaugugggugggagucuucugaucagcuuucuagguugggacuguuuccacccugaaagaaacugaaugaaaaaugccuuuuuggcaauacugaagauaucuugaacauugauuuuggaaauuauuuuuauuaucuacccagaaucaguaucgacuugcuuuauccacacggcaguucuuuaauaugguugauuuaaaaauacaagaauauguucauuagaaacuggaauaagaucacguuuucagugaucauauuuguuaacuccugcguucaucaagacuuaccaaaagaagaugaauuuguuuaaagucaaauuggaaaccccauccuuuuccacauguugccaagacagauguucagauauacauagaaaacgugugugcuggccaggcacaguggcucacgcuugucaucccugcacuuugggaggccauggcaggaggauugcuugaacccaggaguucaagaccagccugggcaacaacgcaagaucucaucucuacaaaagaaaacaaaacaaaaagcuugugugcuucuguugcugcagagcuguguguacauuggaggcuacuuaaaauauaguaggagaguuaacaggugguggguuccuuaguaaagggaauaauugccccuacccucgucuuuucaucaucagauuuuaccauuugaggguuaaccucagaguacuacaauuuggaauucaguaccuccccaacuaucucaccgauuucuaacaaugaagagauuucuuagcuuaaccucugauuuccaugacuuuaucacacuuauugucauucagcacuuaauaguauuuugccaucuuuguucaccuaaaaauuuagauuuuuuucuaaaucauuuuaaaguuaguuucagagucuugauacuucaucucaaaauaccucauugcgcaucuccaaaaacuaaggacguuugucucuauaauuacaguuaacauuugcacaccuaucagaauuuguaaaaauucucaaguauugauuaauucuugauucauaucaaaauuugucgucuuuugagaaaauaaauuuaagagaaacuaagauuauguuuuuuuaaaucugucaucauccauccauccauucauucauucaugccauuauuuggcaggucuuuuucuuacaguuuuauaguagagcaagugccgcccagagacggcagugacuuccuguggucacacaggccagccucagccugcggguccagaccagcacuccucggcccgcacuguuuaccgcacuuacucuaaagguuaacauaggcacauuucuuuggauagaaacuuuuguugcuaaacccuaauaucaucuuucuuaaauuaugugccaagaaauuuuucauucauaaauugaauuguguuguaacaaucuaaaacgguaaaaaucauaaaucagaauaaaggauuuaaaagauagacgugcugggugcagcggcaugcaccuguaaacccagccacuugggaggcugagguaggagaaucacuugagcccagaaguucaaguccagccugggcaacauagcaauaccucaucucuuaagaaaaaaauuuuuuaauuaaaaaaaaaaauauauauauauauauauauauauauauacacacacauauacacacauauauauguauauguaucaaaugccaguauuauauuccugacuuccagaggcuuggcuuucuugucauuuuuuagaugaagagcuugacauucuucucagucauguugcguucauguuugucuuuguuacuagauacuucauaugaucaucagagucuuccguaguugcccuuugugcaucuacuucuucuuuuuacaauaauuuaaauuguaggcaaguuuuauuagguuuguucuacucuugcuuuacucuuguagcugugcuagcaagcguuuauccuaucacauaaaacaugucugcugaaauuguauauucagcacucauuucuagagauccuagucaucccuuuucaaaguuaaaaauuccuuuuauaggaaucuacuuuaaaacuauggacagggcugggcaccguggcucacgccuguaaucccagcaguuugggaggcggaggugggcagaucaccuaaggucaggaguucgagaccagccuggccaacauggugaaaccccguaucuacuaaaaauacaaaaauuaggccaggcacgguggcucacaccuguaaucccagcacuuuggaaggccaaggcauguggaucaccugaggucaagaccagccugacuaacauggugaaaccccaucucuacuaaaauacaaaaauuagccgggcauggugguggaugccuguaaucucagcuacucgggaggcugaggcaggagaauugcuugaacccaggaggcagaguuugcagugagccgagaucacgccaucgcacuccagccugagcaacaagagugaaacuccaucucaaaaaaaaaaaaauuagccagccaugguggcgcggccccuguaauuccagauacucaggaggcugaggcaagagaaucacuugaaaccaggagguggagguugcagugaaccgagaucacgccaccgcacuucagccugggugacagagugagacuccguauuaaaaaacaaaaaaagaauauauauauuguauauauauucuacauaaagauccuugcagacaaggaugauucuuuuaaacaauguuuuacucucccaguaguaccuuaaauauauauaguaacuucuuauuucaugcggacagguuguucauacgaauauuagcuucuuggaagauucaguuaugcauagaguccgaguuaugaaaauuauuuuugacauaauucugaaguuuuuccuggacgauuaaaacaacaacuaacuuuauuaaacguggauuaugugauuuuuuuuuaaagacuggcauuacaacagugguccugcuguagaauuacauuuuuaaauagucucucagcucacggacagggauuugaagcaacagucuccguucaaagccugcuuuaagcucaauaccagcucugcaguggggcuccccuugggggaauagagcucaccuugcaguaggcaccaugguagcaaccagcucagaaaacuaaccuagggacagcagagaaauggaaugcggcucugccacauuaaaaaagcaagugugcaagugcgaugcuacauuguuuuccaacccacuuuuucuuugaggugcaggcuacaucuguguguuggcagauggagagagaccucagaugucucgagaaauaagauuagccaugaguugacccuuguggaaguugguugauggauguguggguuacugcauauucaguaaacuagaaguucccugaggaccaggugugaccuugagcuuggcucuggugcccagggcagugcuaugcacucagagcaggugcccagcgaggaaggguugugacaugcugggugcugucccaggguugcaguccucacugcauggauuuucuaaucccgcuuacaaaguagcugcuguuuuccagcauugcuuugugccagcccugugcugagugcuugucacacaugaucucauuggagucucgcugcaggugggucuuaagagccccauucuacagaagggaagcagaagcucagacaaguuguguuaucugucugggcucgcacaguaaggcagacaacaacgggaucuggccuggcgucugcuccugagcgcacugcccuuucugucucgccagccugcucccugcuacaggugggaccgugcaccuguuugccaguggguccaacugcaggccagcugugcaaacagauugaagaauaaccuuaaagugguucauuuuuaaaacagaaaugccuuuauuuugaacauuaacuauccuauuauguauuauauuauguauguuaauuuucuauaaugcacugauuguacaacauuucccuaaaauauguugacugacuugucucuuugaauauaauuccaagaugaaagcaaaucccacuaaaaugaacuuuuuuccuccaacucuccccuuuaguauacacugcgcugugacaugaagcggucucuguuggccaaggacuugacaaagaccugugaauuuaucguucacuccgcuguaagcuucacucggggacucuggugcuuaaugauaggaaucucccauggggucugagaguuuacccuauuuacaagcucaccauuuagccucuuacuguuucacgggugcuggcagaagacacaagacuucugggucagagacagucgguggcaugcgcaucacgugugcaucauuguccugggcccagagucccccagcugaggccgcgggccagagggacuccacgucggcacaucaggcaggaccuuuccucccccuggcucucuggaugguagacuggcccuuugcaucccagccccuggauaaaaaaugccaggcaggcucucaugaagcucggcuguaucuguagauucugaaauuauguaacauggaggugaucacuguuacugcuguuuugguaacguuuaaaguaugauucuucaggugacagcucuauagcucagaggccaauagcaaccugaccuccuggguucaaugcucagccccccagcuccaccacugagcugagcaggccacugagcucucugccccgcuugccucgucugugaagugggaccaucugggaggugugaagagcccuuuggagggucacugugcugagguuucaaauaaguacuugccaauaacacuguucuguuucuuagaucugauuuuaaaauucugaaucugaaaggcacguuggagauuaagacaucucuccccucauuuuacagaugaggaaacugaguuucagcaagauggggaaauuugacagaacuguguucaggacccaggcuugcgccucuuaguuccccguccuuccugcaucgccaggcugccguugguuuauuuuugaaagggaaaagcuauuugaccugcagaacucuuggccuucaccuacugauuucgguuucaccucucguuuuagccucagaaggggaaguuuacucccagucccguggacuucacgauuacaccugaaaccuuacagaacgucaaagagguaagacguccugcacaggcgaaugccguggguaucuucccagcagccagaccccacggacuagcuauugcccggguggucuucauuuggaaaucacgucaucagccggcagagauuucugauuguacccaaauuacucaguauuuuccauuugauuuccuuuuuaagcucaguaaagcagcuuagaagaggacugcuuuugaaaaguuccucagggaggguccaugucuauuaaucucaccauuuucccucaguuuuacugcaucaugggcccccaagacccccugcugcccaugacacggccacgucccuucauuucucaugguuagccggggccugcgcccggcccccuggccuguugucauccuccauggauguuuaguuugcaguuucuuccccagcauucccaucagacagaggccgggcagcaacgugcuuuucaaagauuccgcagugcccuccgugguggacgccucacggccagggcagguacagugaggacacagacgccugggcagugccagcccagcucccccgccuccugcaucaggacagggcugucuggcugucaguggcagccgcugguggagccucagcuggucccucgagcugcacggugaacuugggcccguccaaaacucugccuggccccggccucccugaucuugcccucucauccacugccaugcauuucuccuaaacaguggaguccuguaguucuuccuggauguaacuuuucauccuuccucuaauucuuuauucugcugucuggaccacacugacuaggaucaagugaaggacaagcugggaggccugggcccugggaugucauuggccucaucccucagaggcuggacaugugucguggggagccuuucagacaggugagggaggaaaggccacuccucugucuguucugcacgucucccuucuccgggcucugagggcacgcgaccccagugggccacucagacucccgucucccaccucuguagccugucuucggaagcgcugaccucagcaguaaugugauucauuucuagacaccguuucuucuucgggauagcugcugcuuccaugacggacgcaguggccuuucaucuccuuuuccuguauugauucuguuucucagggguugguucuguuugucgagugugugugucuuuuucuugcuuuuguuuuccuuaaauguguauugauccucgguugucaguuuacauuuacaaaugaggaucuaauguguguggugguguuguagaggcuguauccuuagcccaggugagaaccuguucuccugguccucagcaccugcucaucagaggcgcucugcccuggguguggcacguggccgggguguuuguaggcagcuugucuccugaguccagaggcucgcugucugcauuguggcugugaaugacgugggacacuuguccuaccuugccccgagucugcuuuuccgggugggagauccccuuugcaggaagcuguggugccagucuguggcagcuucccccaucuggugagcucaccugugauaccugccuacugcccuucgcaggcccccgcccgauggcaggcugaccacacgcccugcgagcacacccgcucucaccgcucccccugccaccuggaggacgggugccccgaacucccgggagccggauugucuguccacuuucugccggacagaaacacuucacuggggugguccccacggggcguuccuuguggcuuuucuagguauagguuuauuuguaaacacgaagaacuuuucuuuccacagaaccauucagguuuauuguuggaaaauaagaaaauaacacauaaagcaaauaaaauaaaauugcuuauucacaaaaugccacuggugguuuuuuguuuugcuuuuuaaguagaaaagagauguauuguagaaaaucuuguagauuuuuaaguagaaaagagauuuauuggaaggauauaagacagcuuuacaggaacuacuaggcuggagcucagacucaaaauaguauagguuuauuuuauuuguauauguuaauaucaugucagugggaggagagggaaaaugauuguuuagucaguaucuugagcugaauguugaaagcuauccuuuuucaucagucgccuaaaagaauuuuaauguguacugcuacugcuuuuuguuuuucuacacaaauagcuucucuuaguuauuuuuaaaacucugucuuggccaggcacaguagaucaugccuggaaucccaccacuuugggaggccaaggcaggaggaucacuuaaggucaggaguucaagaccagcgugggcaacauagaaccugucucuacaaaagaaaaauguaaaaauuagcugggugugguggcaugcgaucguagucccagcuacuagggaggcuuaggcaaaaggauugccugagcccaggaggugaggcugcagugagccauguacuccagccugggcaacagagcaagacccugucucuaaaaauguuuauaauaaaaacaaauaaauaaaagcuccaucuugaaugcagacuucuucagaggucuguaccuuuggggacugccagguccagagucccgggcuuuucagguccagagcuucacugccugaucagguggccaccagccacacaucaccauugacccuggacacauggcuggaccaaguagcugaguuggauguguaaauacugaccagauuucaaagacucaggaugaaaagaagaauguaaaacaucauucauauuuuugauauugauuauauguggaagugauaacacuuuugauauauucguuaauuuuaccuucuuuuuuaauguggcuaccagaaaauuccaaauuauauauguggcuuccacucgcagcuugcauuauguuucuguuggacaguaguaugccaauaucugauccuuucaguaacugggauccagccagagguaaagauuccuagaaaaauugucucugucuagaccaagcccauucaacccacagcccaccggccaggauggcuuugaaugugacccaacacaaauucauaaaccuuaaaacaugagauuuuguuucugugauuuuuuuuuagcucaucagcuaucauuaguguuaauauauuuuaugugugacccaagacaauucuucuucuuccaacguggcccagggaagccaaaagaguggacaccccugcucuagaccaucaucaguccuuccuggccagcgucaggugugcagaguaaagguuuguaggcuucucaucaagcgucaaagaaacuaguuuucuucaaauuuccaugaaauaaaauaaaugucuuggguuuuaaaaauuguacaauugggaacaucuuugaauguuuuuuuuuuuaagagacagcaucucauucuugucacccagacuggagugcacugguguaaucauugcucacuggagccucaagcaauccuccugccucugccucccacguaacugagacuacaggugugcaccagccugcccagcuaauuuuuaaaacauuuuuuagagauggggucuugcuguguuacacaggcuguucuugaacuccuggccucaagugauccuccugccuuugccucccaaagcccugggauuacgggccugagccacugugccuggccaggacuuuucuuuuuaacugugugugugucagguugucuugaacaccauggcgacucccucagacuuuuucaugucuuauuccuugguaagaaggagcuuucuagcucugagacuaggcaauuaggaugguucucugaggcauucucuguacacagagugucagucaggugccauauguagagagucguugaauaauucagccggcuaauguccaagacgucaguacuucgcuccuuucuucccguuuugugagacggucccgguggacuguguaaccacuauccaacuucgcuuccagguuuuauuugcaccaaaguauggagcacuuuccccccuugccugcauucugauguauuuguuuucauuuuguuuuagagagcuuugcuucccaaauuucuccuucgaggacaucucaacucaacaaacugugucaucacgcagccacuaacgggagagcuggugguggagagcucggaagccgccaucagaagcguggagcugcagcuggugcgcguggagacgugcggugagggccgugccaccaggccuggcgcuugccugucccccucgacugccacccucacguuccaugguuaagaggaugcuggggggcugggcacaguggcgcaccccuguaaucccagcuacucaggaggcugaggugggagggugguuugaggcugcagugagcugagaucgcaccauugcacuccagccugggcagcagagcagaccaugacccugacucuaaaaaacgagaggacgucggggaagcaaaaguaagagcguggcugugccuuagcaguagccgcgugucuaaggaaagugaggggaggggacccuggaggauucuuggagcagacugguggguggugccggugcggauguggaccccgcagccucugcuggcccugaccgcgugauguggccucccucccgcagggugugcagaaggcuaugcccgcgacgccacggagauucagaacauucagaucgccgacggggaugugugcaggggccucucuguccccaucuacauggucuucccuaggcuguucaccugcccuacacuggagaccaccaacuucaaaguggguaaguggcacucgccucccagcccucaugggcccaugggaagggccgcucagcgccagggccugcugugggucacagagcucagaaccugccgcccuucggucccucagugccagggccugccacaggccauacagcucagagccugcugcccuucggcugcucaacaaaaccuuguuaaggagcugcugugccgcacaggggacacacccacaggcaguccuggugcuugugggacuuccacugucacauggggaaacacacagacccacaucaguguagacaugggcaggugacgcugagcucuguguagacaugggcaggugacgcugagcuccguguagacaugggcaggugacgcugagcucuguguagacaugggcaggugacgcugagcuccgugaagaaaacucccgugaacgagcaccacaggaguggggggugguguggauacugagaaaguggcucugugugaagguccaggacccgugaaaaccccagagugagcgcucagaagcaggaaggccuugagccccgcggccuagaugccucuagugaguuuccaugaaccuguguguucauauuuuaaccaugggaucugaaucaggucacagacacccuuuuauauucugccuuuuucccuuaacauuguaucaugaacauuuccauguuuuuaacucuuccuauaaauauuguaaugggaccuccaucuuaauaagaaucauguuaauugggagaucacuccacacuacgaagaaguagaacagagagacccaguaggaagggaccgagccuucucaguagcaggggacugugauucagagaggcucggggaccucuagguuggaagucaggagugagcacugcauccacaucaagagcagcaccucuguguguuccccuccaauuccgugcgagugaccucaaaugcacggucaggcccgagacuggaacucacucggacucuaagcagcgccuggguaucauggcggcuccagugcagcuguuuuccugcuguaaaggaaagcccccgccagcucccuaucuugccugcugggcaucccucucuguccacuccagccacacccuccacccuucuggggggcacaacaagagggguggagaacccauugaagggagugguggcaggaagugcccagaggacucuaauguagugacaauaaagugaggaaggacaggccggccacugcugguggccgacucuucuuguggcugauguuugggcggagguggacacucccacacggggauguuguccugcagaccccagccacaggugggcacugacuccaaggccccuuccacagcugagcugccacaguguggggcucagcacagggugcccucugcccacacgaugcccuucccaccccuccucacacuggggaaggagauggugcuuguuugucgucaggugcuuccucuucacacacaucccuuuuguuaggaucaacaaggcucacccauaucagcugaagagucgguggagaaggaauccuguuugcugaaaggugauggaugaauaguauccaauggagcaacaaugaaauuguugcuucugaagacuguuucucaccuggggauuggggacaugggcccagacagcuaugcgcugguucacagucugcuauuucauuaagaaccguaggaaauguaaaaauaaggcaaaggaauacaaaugaauugaaaggguucuagaauauccuuuuuaggaaagcaaagggacagggaaaguguaguuggugaagccugaucacucauguuccaagaugagaggacaaaaauucacuuagagaaaguugacagagguagucagacaucagcauagucaucuccacugaaaguuuggcugaaaggucaggguggcgcugaggggacagcaaugaaacccacccgcaccgggugcuccuucgccguuagagcuuccugcgacugcagugguggcggcgugugguuucgcugcuugguaacagugagcacaaacccacccucucuucucuucucagaauuugagguuaacaucguggugcugcuucacccugaccaccucaucacggagaacuucccgcugaagcucugcaggauauagcccggaggagggaagcauagagaacgggaguggccaucuggaaauccagcugguuauccaaauccuaaggggagcuacagccagcggcauauacuuguuuuugugauuauucuguaucagaaaugaaacagacccucaaauuaacuuuccuuccucauuucuugaggcuucugcuuccaacaggcaccucuaaucagaccuuuucuuugaaauucaacaagauuucuuaaugcuauuugccaagaccauuucacagaaaacauugacuguggcucuugccuuaucuguuccuuuuuagguacaguaaaacaauugugacagcaguuugagcuugcuggagaguggcaucauggggacaaaaggaaaccucugacuugcuaauggauguagccagggacuccccauagcaaagggucuguggccaguugacauccaggauggcugcaagcgcacuugauggucaggaaguuugcagauacucgccaaggcagagcgcaaagugcuagccacuggaaaugcaugacuucccuccaccccuacucuauucuguaguuuuuugguuuuguuucugagacggagucucagucugucacccaggcuggagugaucucagcucacugcaaccuccaccucccagguucaagcgacucuccugccucagccucccgaguaguugggauuacaggugacugccaccgugcccggcuaauguuuguauuuuuaguagagacggggcuucaccaucuuggccaggcuggucuugaacuccugaccucgugacccacccgccuuggccucccaaagugcugggauuacaggugugagccaccacacccagccucuguaguucuuuuuacaacauuuuucauuauaacuuuaaauuuuuuaagcaacuggaaaaguguuccuugcucucuuggggggauuuggcuggugccgaaguguuucugaagucucaagaacugccauaaaaucucacgcugccauuucccugaacagauacauacauagagagagacaguuuuccaaacugugucacgcaggcugagugcacuggcaggaucacagcucacggcagccucaaccucccuggcucaagcgaucccuccccucagccuccugaguagcugagacuacaggugagugccaccacacucagcuaauuuucaaauuuuuuguagacagggucucccuauguugcccaggcuggucuugaacuccuagacucaagugauccuccugucuuggccucccaaagugcugagauuacaggugugagccacugugcccagcaguuucccagaauauauuuaaaugcaaaguuacaugaggggaaaacauguauguuugcuccuguuguuacuggguagguucugaacagcagaaacccaugugcagggugggcuggugaaggccccucuccgcaaggugguagcaggaaaagguccuugacuugaugaauuuggucugccucugagccacuggaggaagcuguuuugagccaggguuuuuuggccuaaagccagcauuuccucagucucccuuugugguucgaaggauauggacuauugcaauacauuucuuccuucaaauccugccacuguuuuguuggcccacaacuaauaggaccucaaaauaagccaugcugcuuugcacacacacuagccuucuuuuguacuuuucauucuggaugggcuuggccaaaacaggcucaggccaaagaccucccaagcuguauguacuuccaguauccugaaacaguguuuggugacauaaugccaaggguaaacaagccugauuuaggcacugcuuuauccaggggcuucacccaugaaauuaauaaaacuuaucugagucacuugaaacuugguucccagaaaacacauuucugguuuauaaucuccuuuuaugcucaccugacauuaauuaucuauccuugaugauguguuuaaacugaguagcagaaaacagaggccacacuuucugggaaauuuuaaaggaagaaaccauuuuuaaugagaugaaaauauuuaacgaauuuaaaaagcuaaugacaauuuugagaaaagguuugggauguauauugcuauguaauuuaauaaacugauuuuauggauau

SEQ ID NO: 192656 - RNA, 17350 nt, Homo sapiens
gaguccccggaggcagagagcugagcgagguucgccuccccgggcgggacacgagcuccgguccucucuuggcgcaaacccccgccccccgcggagggacuacuuuucgucucccgcggaggaacuacuuccucccccgcggaggcgucgguccaggcggcgcgcacgguauggcggcggcggcggcggcggcggcgcgcgccugagaagaggggacgccagcccggucaggccucggcgcggccuacacgcuccgcucgcucgcucgcucccgccucccgccccgcgcccggccauggcggagccgucguccgcccgacgcccggugccucucaucgagucggguaagacgcgaggccgugccacccccgcccuggcgcucccggcugcuucggcuuccccggcuccccgggcucccccggcuccccuggccccgucccccuccccuccccgccggggcuugaccugacuccuugucuucccgcagagcuguacuuccuuaucgcccgguaccuaucggcgggcccgugucggagagcggcccaggugagugcgggcccgcgggcggcugcggacuuggcguccccaguguccccgccgccgggggucgcggguggugggcgggggugaaacgggagcgccccgggcccgaccccaccccugaccgcgcgucucucggccgcaggugcuggugcaggagcuggagcaguaccaggucugugcgcgcccguccccgcgcucccucggguuccuccugccgaccuugcccugagggaugcucgcccgcgccccccgcccgccgcccgccgcccgcccccggccccccgccccccgccccccccgcgccggagggguggucacucgugugcguuucgugucuuuccaguuguugccgaagagauuggacugggagggcaacgagcacaacaggagcuacgaggaguuggugagcauugggcacguuugcuccccggguuuuccgugcaccgccccccgcccccgccccuuccccucgcggggaccccggcccguggggugcaaagugugacccgcacuggggggcggcccggggauagcugcguucccggcugaagauuuuguuuuguuuuugaggcggccagguuuguuuuggcaggaaacagucauugggggcggcgcggggcggagcggugggggcgacucgcggagguccugcggcagggguggggcuccaggugcggccgccucugcggggguguggcgugcgcagccagccauucaacugggcgguuucauucgcuuccccgcuccaccgcgcuuguaacucgcgcucugauuggccucgcugcucuugccccgcccgggucuguccccccacuuguucccuaggaauagaaucauuggucucugaagguggagaaauguucuuguguugagcuuuuuauuuuuuguuuugucagcagcgucauaaaaaucuugcagcuguaugaauaugccacuguagugcuugugcuccuuucuacuguacaauauuuguugaacgcaguaguugauugaugaguuucacacugaucuuguagauaacacaauaaagugcuuuaaauaggcacuuuucuuuugagcucgguuaaucuugcauuacagucucauuucuuuugugaacuugguuaauguuucuauauaacuugcuuuuaucuauaguuacagcaguugcagggauucguuuguuuuuacuggagacauuuuucaggaauauauuuuugccguuucguuauuaggauaaaggaauucauuaauugccaggccauauucagcaucuuguauaaggaaaacaauugagaaagaaaagagcuucugagugaucuuuuaccacaguuggaagaccuguaacacuugagugguagaguaugguggcaagugaaaagaagaaaaaaaagugguagaagauuacugguuuugaauuagacaacagaagagaccagaggauguguuauuuccaugaacaguuaacacuugaagccuggugcaaguaauaaauaauuuuaauauuugcuuucuuagauuuugaaguaaacacuuuaacaguggauguuuucaagggaaugaguucuaaaaauucugauggcaauguguugaguuugacauuuugagauaguuuauuuuuguaaacguugaggaaacauuuaaaggaugcccucuuuuaguuuucuucacggauaauauagccuuaucggugaagcggaaaagcauuacugguuaugacgcuguugucgugcuaccugagagaaaauaacuugaaacaaauguagugcuguaacuacuggaaaaguuacuuuuaaaauacauuuauaggggcugggugcaguggcucauggcugcaaucucagcacauuaggaggccgaggugggaggaucacuugaggccaggaguucagaccaacucuugucuccacaaagaauaaguaacagaaaauuaggcggcugugguggugcgugccuguagucccagcuauuucggaggcugaggcggaaggaucacuugacucugggaguuugaggcugcauugaacuauccuccugccacugcauuccagccugggagauggagcaaggccuaguuucuuuuuuuuaaaaaaaaaauuuauauaaauuuuuuggcuuuuguugguagaauugcuuaaaacccuacuuacuauuguuuaaaaucacuuaaauucugugauaauauggcugugauuuggcuaugacauauggcaucuaucauugccucccugauuuggucugucugguggguguccuuucuuuuuuuaccuuccucucugcccuccagucccccaggacugagugaugaugagccucauguguagagaauuauucuuuuguuaaugguauauguaucguuucuaaacuuucaaagucuuuuaaaaauaccuuauuaagaaguauuccaggccagcugcggugcuaacaccuguaaucccagcacuuuggcaggacgcuugaggccaggaguucuagaccugccuaaagugagguugaggauguagugagcccugaucaagccacugugcuccagccuaggugagcgagacccugucucgaaacgcaacaacaaaaaagaaguauuucagauguacacaaaugagaauaauguaaugcaccgcuguauaucaucaaauuugaauaauaauaauuuuuuuuuuugagacagucuguuuugaggagcagccucggcucacugcaaccucugccuccuggguucaagugauccuccugccucagccuccucaguagcugggauuacaggcaccuggcuaauuuuuguauuuuuaguagagaugggguuucacccuguuggccaggcuggucucgaacuccugacuucaggugaucugccugccucugugucccaaagugcugggauuacaggcaccuggcuaauuuuuauauuuuuaguggagaagggguuucaccauguuggccaggcuggucuugaacuccuaacuucaggugaucugcccgccucugugucccaaagugcugggauuacaggcgugagccacugcgccuggccaacaaauuugaauuuugaaaguuacuaacuugcuauauuuacuuugguuucuguuugagguauacauauguuuuaagaaacuaucaauggacaucuucaaacaaaaauaauagaauaaaugacccacccacuaggugcccauuuuccaacuucagugauuaucagagaauguugcauauugucugcucccuuguuuuuaagcaaauuccagaaagccauucauuucacugguuaauguguuggaauguuuuaaggcagauuccagacacuacauuucaucucuaaguuugucagaguucaucucuaaaaaauaaggacugcuuauuauaucaucaagugccaauaucacagaguccauauccagauuuucuuuuuguucccugggugucuuuuuuuuuuuuuuuuuuuugagacggagucucgcucugucgcccaggcuggagugcagcggugcgaucucggcucacugcaagcuccgccucccggauucacgccauucuccagccucagccucccgaguagcugggacuacaggcguccgccaccacgcccggcuaauuuuucuguauuuuuaguagaggcgggguuucacuguguuagccaggauggucucgaucuccugaccucaugauccgccugccucugccucccaaagugcugggauuacaggcgugagccaccgcgcccggccucccugggugucuuuuuacaauuaguuugauuuggucuugagaaagguccauacaugcauugacugauugauucucuccccgccccacccugggucucacucuauuacccaggcuggggugcaguggugugaucacagcucacugaagccuccauuucccaggcucaagcaaucuucccaccucagcccuccaccuccugaguagcugggaccacaggcaugugccaccacaccuggcuaaguuuuuuuuuuuuccccuagagaaaaagacucgcuauguuguccaggcuggucucaaaugcuccucccaaaguuggaauuacaggugugagccaccacaccuucccugauuuuuguuuuguuuuuuuuugagauggagucucacucugucgccaggcuggagugcaguggugugaucucggcucacugcaaccucugccucccggguucaagcgauuugccugcuucagccucccaaguagcugggacuacaggcgcacaccacuaugcccagcuaauuuucguaguuuuaguagagacggcuguucaccaugugggccaggauggucuccaucucuugaccuugugaccugcccgccucggccucccaaagugcugggauuauaggugugacucaccgcauccugccccuucccugauuaucuuaaaucucuuuuuaucuugaauagucuuguuucuaugccauugauuuacuggagaccaaaucauuuauccuguagaauguuuuacauucuguauuugucuuauuguuccuuaugaugguaacuuguuccuuuuucuuagugguuuucaucuucagaugagaaucaucuggggagcuuuauaaaaucugguugcccagaguaugccccaaaccaguuaaaucagaaucuuuguggugggacuggacaucaguauuuuaaaaagcuuuuuagaugauucuaguauuaguguuuguaaagccacaauuuaucuuaaacuugugaccaugcuguuauuccaaccuguauuugggggcaagaguauuuuugguacuuuugcuuuuuuuuuuuuuuuuuuuugagacaaggugucauucuguugcccaggcuggagugcagugguauaaucuuggcugacugcaaccucugccucacagguucaugcaguucuccugccucagccuccugaguagcugggauuacagacauguaccacuaugccuggcuacuuuuuguguuuuuaguagagacgggguuucaccauguuggcccggcuagucucgaacuccugaccuucagugauccaccugcauuggccucccaaagugcugggauuacaggcaugagucaccuugccaggccuacuuuugcuucuuauaagaauugaagccaagugugguggcuaaggcuacacagagacuugagagucugaggugggaggaucacuuggugccagggguuugagagcagccugggcaacauaagcaacaccucaucuguagaaaaaaaguuuacaaaaccuugguuuacaggugugagccuccguguccagcucccaaguuucuagucucuaccugcacugcuauauugcuagacuguagcucaucaaucacacuaccaugaucauuaaguguccccaaguuacaaaugaaauaccuauagaaugauagaucucuauagucaaggacaauacagaaucuauagaggaaagaaauuagcuacccucaggauggaagggucuuuuagaguuccacugugaaaauuaaaugauaaugggauuaguuucaagacuugugggaaauacaaaauuguaaaagagguuuuuguuuuaaagggguuuuacuauuaaaaaaggcucagccuaagacuuaaaguaucuggcagugcacccaaguuccaagucauagccuauaaucuucuaucauaaccugauuccuuaauccuguagaguacuuaaaaugguaauaccagucuccucccaguuuggguaauuaagucauaacccaggaagguuaacaagcgaagaugaagaaaaaggaaaguacaaauguauucacacaaguauauauacauauaauaugugcaauauauacauacaaacauauauacauaaaauauauacauauaauacauugauauucauacaaguacauauucugauguaguaacaaguuuuguaauuacugaguuacauuuauuuguuugauagaguaaaaaaaauuacaaaauaaauuugaaaucuauuuacaaguuuagucuuagaaaauucaugguuagguuugucuaaguuaacccugcugaggugauuaaaauaacuguacgcuucuaaguguagugaaaaaugcccaaggaaauuugauuaaauguguaagugguauaaaauauuuuaugauuaaauuuucaauuauaaccaggcucaguggcucacaccugucaucccagcacuuuaggaggcugaggcagguggaucaccugaggucaggaguucaagaccagccuggccaacagggugaaaccccgucucuacuaaaaauacaaaacuuagccgggcgugguggcaggugccuguaaucccagcuacuugggaggcugaggcaggagaaucacuugaacccaggaggcagagguugcaauggucugagaucaagccauugcacuccggccuaggcaacaagagcaaaacuccaucucaaaauaaauaaacaaauuuucaauuaucaauuaaacaguaaccaaagaauaaaaguaacuauuuguuucuggauuuauaaauaagauuuguacuugaagguuuaagaaaaaugacuacuugcaauucuaauaaaccaaauucugauuucaguauaaauaacuuuuaagucuguuccucacacaaaaggacuacuccaauauauuucuuuaaaucuuaaugaguuuucuaaugauacacuaaauauaaggaucuucugguauuuuuuccggucaaagaaaauggcccacaaaaauguaacacauuauucaauuauuaagucucuuaaucucuuucccuuuaaauaaaccccucuacaaaccuaguccuuccgaauucuuaggcucaguucuguaguuauauuuccuuccuccucugucuuuaccacucguauacaugaaaauuacaauuaaauaacauggauuugacaggcccaaugcagggugagauauuuaaagauaucuaggccaggugcgguggcucacacuuguaaucccagcacuuggggaggcugaggcggguggaucacaaggucaagagaucgagaccauccuggccaacauggugaaaccucaucucuacuaaaaauacaaaaaauuagccagacgugguggcgggcgccuguagucccagcuacucgggaggcugaggcaggagaaucacuugaacccgggaagcagagguugcagugagccaagauugcaccacugcacuccagccuggugacagagugagacucggucucaaaaaaaaaaaaaaaagauacuuaaagauaacuagucucaauucuuuguuuuuugaguuugggucucuuguuguccaggcuggacugcagugacccaauaaugaauggcucacugcagcgucaaacuccugggcacaggugauccucccgauucagugucccaaguagcugggacuacaggagggcgcagccacaccccgauaagguuuuuuuuuuuuuuuucuuuuugagacagucuugcaccgucgccaggcuggagugcaguggcgcagucuuggcucacugcaaccuccgccuccuggguucaagugauucuccugccucagcccuccugaguagcugggacuacaggcacaugccaccaugcccagcuaauucuugaauuuuuaguagagacaggguuucaccguguuggccaggauggucucuaucucuugaccuugugauccacccaccucagccucccaaagugcuggaauuacaggugugagccacugcaccaggccuaauuuuuguauuuuuaguagagaugggauuucaccauaauggucaggcuggugucucaaacuccugaccucaggugauccaccgaccuuggccucccaaagugcugggauuacaggugugaacuacugugccuggcuggcugugcuaccuuaaaagagaguaguuacuaguuuccauaggcucacccaacaagaagaaguuauuuguaucuaagggauaaaaguugagugacuuguuuauuuucagaucauauguauccuuauggauuuuugcaagcuuacuguauugauuccugagaaagauuuguuaaaaucuccaacuacggccagaugugguggcucacgcauguaaucccaacacuuuagggggccaaggcgggcagaucacuugaggucaggaguucaagaccagccugaucaaccuugugaaacccgucucuacuauaaauagaaaaauuagccaggcauggugguacaugccuguagucccagcuacuugggagguugaggcaggagaauugcuugaauccaagaggcggagguuacagugagcggagauugugccacugcacuccagccugggcgacagagcaagacuccaucucaaaaaaaaaaaaaaaaaaaaucuccaaauaugacuguggauuuguugcucuuuuuguccuuuuuugaagcuguuauuagguacauucaaauuuaggauuuuuguuuuccuauugaauugaccuuaaauauuagaaaaugcuuuauucauuauaaucuucuugucuucccaucugcuuugccuuacauuaauauagccacaccaacuucuuuugguuagcaauggcacaguguaucuuuuucuguccuuuuccuuucaaccuuuuuguguucacauguuuaaaguuuaucucccguaaacagcguguaguuuuaugugcauucuuuuagugauguuuuggucauuuguauuuuuuuuuuguuuuccagacaaguucucacuuuguugcccaggguggagugcaguggcaugaucauggcacacugcagcuuugaccuccuggguucaagggauccuccugccucagccuccugaguagcugagucuauacguguaugccaucauggccggcuaauuaaaaaaaauuuuuuuuucuagagacugucucacuauauggccuaggcucaucuugaacucuuggacucaggcaguccucccgccuuggcuucccaaagugcugggauuauaggugugagccacugugccuugcucauuuguauuuaacauaauuaaacauaauuggguuuaagucuaccuguucuuuaucucauuuuuucuuuauucuuucucucacuuuuuuuuuuugauuaaucaaguauuaagaugacagcaggauuucaaaaagguaaaaaguauucuacuuauucuguauuucucuuuuuuuuuuuuuuuuuuuuugagaaagaguuucacucugguugcccaggcuggagugcaauggcgaaaucucggcucacugcaaccuccgccucccggguucaagcgauucuccugccuaagccuccugaguagcugggauuacaggcgcccgccaccacgccuggcucauuuuguauuuuuaauagaaacaggguuuaaccacguuggccaggcuggucuagagcugcugaccucaggugauccacccgccucaggaucccauagugcugggauuacaggugugagccacugcgccuggcaacuacucuguauuucuuuucuuuuucuuuuuuuuuuugagacagggucucacucugucacccaggcugaaguacaguggcaugaucacagcucacugcagccucagccuccugggcucaagccgucuuccaaccuuagucuccugaguagcuggaaccacaggcaugcaccaccacaccuggcuauuuuuuuuguagagaugggguuuugccauguugcccaggcuggucuggaacuccugagcucaaaugaucugccgucagucucccaaaguggaccucgccuggccuaacuauuccuuuucuucauuuuuuuaauaauuuuuuuuuuuuuuuuuuuuggagauggagucucgcucuguugcccaggcuggggcgcaguugugugaucuuggcuuacugcaaccucugccuccugggcucaagcgauucuccugccucagccucucaaguagcugagauuacagucaccugcuaccaugcccggcuaaucuuuguaguuuuaguacaaaugggguuucaccacauuugccaggcuggucuugaacuccugaccauuagugauccaccugucuuggccucucaaagugcugggauuacaggugugagucacugcacccggccucuuuauuucuuuuuaguuauauauccuuuuauuauucuuuuggugguuucccuagagguuucaauauacauuaccaauauacauuacuuuacauuaguuccuuuaccacuucccaaauaaauaaaguuauaacuguuaguugucaccauccugucgcuuugagcuaguaaucuuuuuuuuugagacggagucucuguugugcaggauggagugugguggugugaucucggcucacugcaaccuuugucuccuggguucaagcaguucucugccucagccucccaaguagcuggaauugcaggagcaugccaccacacccagcuacuuucuguauuuuuaguagagaugagguuuugccauguugcccaggcuggucuugaacucuuggccucaagugauccgccugucugggccucccaaagugcugggauuacaggcaugagccaccaugccuggccuuacuuuuuuuuuuuuuuuuuuuaagacggagucucacucugucaccuaggagugagugcaguggugugaccuuggcucacugcaacuuuuaccucccagauucgugauucuugugccucagccucccaaguagcugggauuacaagcaugugccaccaugccuggcuaauuuuuguauuuuuaguagaggugggguuucaccauguuagccaggcuggucuugaacuccugaccucaggugaucugcccacuucagcuuuccaaagugcugagauuacaagucugagccacugcucucagcccggccuuaccacauauuauaaaaguuucaagauguuguuacuguuguuuuaaagucaauaaucacuugcuuaccuaccuauacaucuuuucugguauuuuaaauuuuuuccuccacuuccaugggaccuauuugugguaauuuuucuucugucugcagaacuuauuuuguuauuucuuuuaaugaagguuuggcugggcuugguggcucacgccuguaaucccagcacuuugggaggcugaggcggguggauuaccugaggucaggaguucgagaccagccuggccaacauggugaaaccccuucucuacuaaaaauacaaaaauuagcugggugugguggcgugugcuuguaaucccagcuacuugggaggcugaggcaggagaaucacuucaaccugggagguggagguugcagugauccagcauuggggccacuacacuccagccuggaccacggagcaagacugucucaaaaaaaaaaaaaaaaaaaaaaaacacacaaagcuuuuuaacaaagguuuguugacagugacuucaguagcuauggaauucugauucauaguccuuuuuuuuuuuuuuucggcacaguaaagauguucuacugccuuaugccuuccuaauguuggaaauuuagcagucuuauugcuccuuugaaaauaauguuguuuuuggucugguugcuuuuaggauuuuuauuuugucuuugauuuucagcaguuuuacuauguuguccuguagucaugaucuauugcuguauaacaaauuaccccaaaauuuagcagcuuaaaacuacacuaauuuguuguuaucugccaguuucuguaagucagcgguccagacacagcucagauggguucccugucuccuuuucucugaaggugcagucaaaauauuggcagaacugggguuuuagcugaaggcuugacgggaggaauaggcuuccaagcucauguaguuuuggcaggauucgguuccuggaggguuguuugacugagggccucaguuucuaccugacuauuggccacucucaguuccucgcccuuuuggucuuuccagugugauagcuugaguuaucaaaagaugaaagcugacgaggcaguagagucuuagcaagacagaagucacaauuguaaccuaaucauagaaguaguauccucucaauguuacuguuuucugaaguaaaugaggaggggauuucacaagucugacuaccaagagguuugggcacuauuagcgggcaugucagaagcugccuuucacaugugcaccuaggugguuuccuuuuuuuuuuuuuuuugugggagccuugcucugucacccaggcuggagugcaguggcgccaucuuggcucacugcaagcucugccuccuggguucacgccauucuccugccucagucuccccagcagcugggacuacaggcaccugccaccacgccuggcuaauuuuuuuguauuuuuaguagagacaggguuuuaccguguuagccaggauggucucgaucuccugaccucguaaucugcccgccuuggccucccaaaguggguuuucuuugcauuuauuuuucuuggguucucugagcuuuuugaauaagugguaugauaucaaauaguuuaauguguaauuaaagucccaaguggaaaggauagaggggagaaguaguuugaagaaauaacagcuaagcauuuuugaacaucugggccaucucuaggucugcuucuauugaccauuuccccucuugaccaugggucauauaucuagcuuuguuguguaucucaucauuuuuuugagguaugcuguaacuuuuuguguaaagaguagaggcugcaguaauguauuuaccucugguaaagaugugcucuuuucucaagcaguuagugugugagacagggucaaucuaauuuguaauugaucaucucugagcuuuguuacauucaguaaaucacuggcuuuccaugcuuugaggguggcaucaauacuuucccuuccagcagaguuugacauuuggcccucaugaaauuucugagaugucuuauuuuuuacacuggaguugccaccuuuccaaacuuugugagaucuuuuucuacuuuguaccugacugccaacuuuuuagguugcuacagaguucgcucugccuugccguccugcucuaggcuuuccaugucagaagagaucauucuccacccuguuguccuaucucuagccuuaggagggccacuacagugcauuucuuccagggcugcccuggcuuuaguguuugggcccuaugcaguuggugaaggccuaugggaaaaaauugugguaggugugcagacucacuguaacugaggcgccuuaggauucuaaucagucaugccggccacaaguagccauuaaguuuguuagagguuugagugguuuuuucuuauucuuuucugaggucaguucuuccugccucucugcuagggguguaagcagcuaugagucccuuuucuuuaacuuuauuuuuuuuagauggaguuucacucuugucgcccaggcuguggagugcuauagcaugaucuugguucacugcaaccuccgccucccagguucaagugauuucauaccucagccuccuaaguagcugggauuacaggcgccuaccaccacacccagcuaauuuuuguguuuuuuuuuuuuuaguagagaugggaugucaccauuuccgccaggcuggucucgagcucuugaccucuagugauccaccugccucggccucccaaaguguugggauuacaagcgugagccaccgugcccagccugagucccuuuucuguucccagaaaagcuuguacuuugugggauuaguuaauguagauuuuucuuuguuucuucagcugugauggguuuauacauuuuuuaaaguuuauccagccuauucucauugucgagaugagagcaauaucuuuuaucucuuacguuggaguaaauaaaugauuauuuuucauuuaaaauuauaacagacauauauuugucuauaguaauccauagguauauccacuuauggcuccuggcaccuaauaggcugucaguacuuacugaaagaauuaauguuuuuuacugccuaguauguuguugagaaccaguuauccaugauuuagauacuaaaugaugucuuauaggaucuuugauaucuuaacaucucucucaaagauguaugcuucacuuacaggccaguuagcauauauauauauuuuuuuuuuuuugagacaggcgaguuagcguaauauguauauauauuuuuuucuuguugcccaggcuagagugcaauggcacgaucccagcucacugcaaccuccaccuccuggguucaagugauucuccugccucagccucccaaguagcugggacuacaggugugcaccaccaugccuggcuaauuuuguauuuuuaguaaagaugggguuucaccauguuggucaggcuggucucgaacuccugaucucaagugauccaccugccuuggccuuacaaagugcugagauuacaggugugagucaccaucccuggcccaguuagugcaauuuugaguaaagucuugauuucaagucuugagauuaaguuuuguuagcucugcaaccuuuuuucuuuuucagaggugcuuuuccaggucauuugcauauaaauuuuagaacaaaauugucaauuucuacaaaaaaaaauguugcugaaguuuugaguguuacagguuugaaucuguagcucaaaucuguagaucagcuuauuguuuauuuaagucgucuuuaauuucucucagcauguuuuacaguuuucaguguauguuuuucacauuuugccagacuuaucccuaaguauuuaauaguuuuugauauuauuaagcuguugucauuaaaacuugcucuccaacuaggucuuguccaauaagcauguggcuccugaucaucuuuugcaaaucugccagcgcaucgguccuauguuggauaaagaaauuccacccaguauuucaagagucacuucuuuacuuggugcaggaaggcagucuuugcuacguacagcaaaagguaccuuaauuugaagaaguguucugcuuuguauuaauagccuaauaauuauuauaauugugaaguaauguaagcauuguggaagaaaggugauaauguaacuauaaaucaugcuguggacuauaaaauucucugcauuuagcauagaacauugaauuuuauuacauaaguguuuaauggguccuucugcauuaaaaaguugauaaagauauagauguuaagcuaaaaagcuugaauuuauucugagauguuguuugagguuuuaucaaugugaguucuuaauuuuccauuuuguagcucacucauaacuucauugaauguaauuguaugugucuaauaaacucuuuaaaugcuagagguauuucauuugauauuuagcuucugaaagcccuuuguuauaaagggaagugauuuucuaaauuugguagcagcuugaaaacaagcaccacaaauguaaaacugcaugguucuuuuuuuacuaauuuaauuuuuuugccaaguuaugugcuagcaaaauguuugaaauugcuauucuuuuucuguuagcuugguauauaugacuuagacuaaguauauguaugugauauaauauauguguacauguggcuaaacugcuaaugggcaaagauuguugguucuucugaugcugaguauacaucaaguucaucccaugauuauuuuuuauuacgagcuauugcugaugugaugcuacucuuagcugcaccaccaguauaaagcuuaacugagaaagaacaccccucccucuuaguuccgugccagacugguuuguuagcuuuaguuguuucuuagugcucuagccaugucacccuguggcacuaaucaggacacuguuuauauucuuccucuucugugucccuauucacuuuguaauuauucuauuuuagcugguuauaugguaguuaauugguagccuguuuuccuuuguuuucuuuacuugugucaagcuccaugucguuguuuugugaugagcagugauuuagaacuggccagaccuuagaagagucuucagcaagcugcccuaggguaggggcguauucucuguuuguuuuguacugguaccccaggaggaugccuuguaacugcucuuuggucaugauagugguaaugaauccauucauguaaaaugcaauaugucuguuaguuuggggcacccgaggcucaguagagguuuaguaugaugccuucccuuucuucuuugaguuaugaagaaacuaauuucuggcacagugugacugcuucaaaccuauguucugcugcuaucuccuauagaggagggcagacuuuuuuuucuuagugcauuugcugguaggucaaggagggauggacuuugaauuaguguucagagucacagauccuacguaugugcucuucaguagaggauuuucugugauccuacaaugaagggaaagcuauauaauuuauugguacuuccuaaagauagagacuaaagucaugguaguauuggccaaauuaauuuuaaaacugaacaagucaugaauuuucauauaaaucaaagaacuuuuuccuuauaaaagcuuccauuuuugaaaaguuggaucaguuguaagaccuuucaucuuuaguauuguaugauauaauucuacauugaaaaauaaacacuuggcauuaaaugggacuuggagucaaaagaucugguuuuaugguccaucuuuuaccaaucauuugcuguggaucucuuuaaagguccuggaaccuuugagccucaguuaccucacuuguaaauuggcaaaaauaccuaccucacaggguuguugugaggauucaaugagcuaauguauguugaaagcacuuugugaauuguaaagugcuacacaaauguuaguuguuguugcugcuguaucugagaugucuuaauuuucuuuuucuucagaaauagucuaauaaaccuccagggcuuuucuguuaaaguauacuaguugguaaaauguugaauaaacaguuuauuacaauaua

SEQ ID NO: 192657 - RNA, 10124 nt, Homo sapiens
ugcgcagacacccucaggcgacuggcgggucgcggcuuccaagcucuaaauggagaguugucccuacugugcggcaggcggaggagaccuguaagcuggaagggggagggggggggaucugauuuauugugugccaggcacacuuuagauacacuauaacauuucgucuuuauuaaucuauuuuuaaaauuucgaaacaaacacaaaugugcagaaaaguuauauacagucaauaccgauaacugauuuuguuuccugaaccauuuggaaguugucaacccaaacccccucauuccgagauacuuugguauucaaaagaaucuugggggccgggcacaguggcucacgccuuuaaucccagcacuuugggaggccgaggcuggcggaucgcuugagcucaggaguucacuggcaacauagugaaaccgugugucuacuaaaacuaaaaaaaaauuagucgagugugguggugcaggccuguagucccagaugcucaggaggcucaggugggaguaucgcuugagcccaggaagucgagguugcagugagccgagaucuaaugcaggcgucaaguacguuaccacgaucugauccucagaccccaugcagguuccccacguuucgcaguaauguccuuaacagggaaaggacccaguucggaaucaugcauugcauuucccggccucuagccuccugucuggaggaguuucccagucuucccuugacuuucauggcugucauuugugggugucagaggccagugauuucgcagaagggacgccuacuggcaugucugauacuugguagggauuucugagaggcagugcuguguucucauugugucucauccgcuggugugggacugggauuuggggauguucgcugaucccuugggguaggugccagaggcgccacugagggaucuggucuuggggcgcccgcgcaguccuuggacuaggccuucccggcagaucugcgggcgccaccuggcggucacugccgacuccuccguugcgcuccagucaccucucccaucccggugccguggccgggccguucccuggagaguggacggcuggggcuggugcagggaacaggggccugcgggggcugcgcaggcgggccuccaggucaugcggggccccucugcucacagggaccagccaggccagccuggggagcgugcuucuuuguuuaugucuguauuucucugccuaucuguggaaaccacagaucuccaauugaagccaacaccacaagauucauucugcuucucuccgagacgccugccugccugccuuccuuccuuccuuccucccucccuuccucccuucuucccuuccuuccuucaccagguuaugaaaguggcuaauuuuucauauuuuuuguagagacaggguuucaccauguugccaaggcuggucuugaacuccugggcucaagcgauucaccugccuuggccucccaaagugcugggauuauuggcaugagacaccgaaccuggccuuuuuucuuuugucccccuuuuuuuuuugagacaaggucucacccugucgcccaggcuggagucccauggcaugaucucagcucacuguagccuugaacuccuguauacaagagauccucccaccccggccuccagaguguuaggguugcaggccgagccaccaugccaggcugaggcaucuuucuaagugucuuuguugaaagugagaagacuggcuuccguuacucucaauauguuuauuucugugaucacccuuuuguaauuaaucucugguguccaccgcccacuguuacccaagugaaugcaugccucuccccaccugggcuccgacccuggcaggguuccuucuugucuuguaugucugucucccucacccuacagacccugacuccugugucaggcugcccuuucuuggggaccccuguaucaccaugccuggcccugaugccucuugccagggugccauucugugggaaggcccucugcacugagcuugggcacugacauucugcccugggccccugccucaccacuguuacccugcaccugcaccuugcucugccccgucuaaucuaggacugaauucuucugggaggggagagguuacauguucccugucacuggaauaacagcucuggugauggaauugguuuucauuucacaauugcaauuuuauuuauagugaaacagacaaacauuuguauuggagcaaauucaugggcauaucuguaaaaggaaaaauauaguuugaauagcaauuugaauaugaguuuuuuuuuuuuuuuuuuuuguggucguuauagggagccgaaaaaggcagcagaggcuggcuguguagguagagggcagcuugcccaguuggcagaggugggaguaggauguuggaggaagguguaccgguucugucuggccaaacccaugcuggagucaccucaaaagcaguggcaggggaguucccucaaggggcugcuccagacugccuggagauggggcuggcuuggauuccaaagaaagaagcacuaaacgccagggugauaaguccacagcauucaugacgggaacuuacaagagcugcggcagucccgggacagccagugagagaaagggacauuuaccuagggcugucugccacccggggguugggguauggaguguaugugggaguuuaaggacuuugucaugguggggcuaguuuguagguguuucucagcaggaugaaucucccaguguucuccagcaacagccuuugcucuuuaucaguccugggaacguucacggccgcaguuugcauucaguccugcagggacgcacacaacuggcugggucacagaguggucagggcauagacagaaaguagcgggggacuggggaacccuccugugacccguguuggaaggugcugauccccguuguccgcccugccagauguccagggugcugcagaaggacgcggagcaggagucacagaugagagcggagauccaggacaugaagcaggagcucuccacagucaacaugauggacgaguuugccagauaugccaggcuggaaagaaagaucaacaagaugacggauaagcucaaaacccaugguacugugucccuugcagccuggaggcuucaugagagcggaugaauagagaagucuguaugugaagauuaguagaauacauacuuugcuucuuggauguucugaauauugauggaaacuuaaguuaucuggaggaaacucaguaauaaguauuacuuuccucuuauuugcuggugaaccuuugcuuucuaagcacagaaauaucuaagauccucucagauuuuccucagagccaacucuuuaaaauuuuaagcuaacucuuaaaaauuguagguuuucauuuuuaaauucaucacuuuucugagagaagcccagaaaaaaagucucacaguggauucccagaggcuuuuguuccacucucuagaaaaaugcccagcaguguccucuucugagugucaccucccggguccaguguccugugaugaagagcgcuuucucagggcagcccgugugcugagggaccccggucacagugugugcacagucagagagcugucucuguggcuaggaaaacagacagaggggccuguccaggcccaggacaagcuggacucccaccagggguucguguacugugcacacugggaaauaaggaggaaaauuuaguccuguugguaagugguaacuguauuauacaaagaaucuuugauuucaugagucguuuuaagaguuuucaaaauuaaagcuauucaaaucucaaucugagucggauacuauuuuaaauaauggcauaaugagauggugggugacuuaaaaauucuauuuuauauuuucuaaauauguugagcgauuguuccauuuauaaucagaaaguguauuauaagggaaaauaacauuucuguguauuugaauauuuuguuaauuuuucaggacugacauaauuauuuauccuguuuuuccuuucagugaaagcucggacagcucaauuagccaagauaaaaugggugauaagugucgcuuucuacguauugcagguaagugugcuagagcgucagccgggucauuggaguuggugaccccggccuccagagccgugucugcagauccagggcugggaguucgggcuguuccaccuucagcugucgugucgugugucccugcccacauggagcucuaaacacucucggucucuaagucagacuaaaaggaagccuuucucuugaggagaguuguuaaaguuugggacuuuuuggcagauggacugugaaguaaguucucggagagcuuucaccaugccugcaucccagugugguuugaagggccuggugggaugaagcgagaggcuuauagaugacaucaguuuuuucugagaucuucaauacuuuuggcccuuacuuguuaccugguguacuucaugcacgcucuccacccuccagguagagaaccagcuuuuccgacuggaauuggcuucuagccucccugccuggggcuuaacccucauagccucuccuggagcuguugggcucugcucugccccgagagugcaguugugcugcccagacaccuuuagcagcugccguaaauauccgaguugcaguaccaugugauccgguaaccaaggcaaaggauucaagcccacccccaaaaaagcuuaguuuggcaggguauauugaaggaaauuaauucugaggcacugucauuugcuaagagauaaguuuccgcagacaaaggaguuaggccagcaacccucuuucaugucucuucugagcggccuguucaagccaggaaggggacagaugacaaucgaaggaaugcuguggggggauggagggaaauaaagcaucccccaccauugaaacuuacacagggcucaccucugcgucccuugcuaacacugguguacgugggagaauucacuauuuuuuccaaggauggcuuucgucacuaauaagguguguugagcauacagucuggcuacucaaacgagauacucagugagaaaagcacacccguguuaugggagacuuugguuaguuuaucagcuaauuuaaauuauguguagauuguguucauccuaaaacagugaaaugccaguucacauaggaaggcucgccuacuuguuggcaguguucagacaugcugcugagcucgucuuuaauuugacuuucucauucaagguuucaccaagggacauuaguggcugugcgugcucaucuguugucuguggggacuggguuccuaggcuugaggugcucagucuggagaguuuuccugguuuuauuuucgcauuucccuguccucccuucuguguggucgguugugugauuggcaggcugcuuugcucaccagaggugucuuuacaggcugcccugaugaucucacucauuuggaaguauuauucugucccuguggcugucgugccgaguaaauggauaaccccucuagaccgccugguagccuuuccuacuagaguagcagguaagaauuuucuggaagaugcaguggaagagugugaauaggcuuauguagaggugugugguagaagauuaaguuagccugacauccuccucaccguccauuuagugagcgggguuuugugucucagccucacaugaggcuucccaugaagaaacugaggucugaaaaaguuacuucacuuguccagugucaccaaaauguuaaggagcaaagcuaggauucaguccuaggucuguuuccgggauccaugcccaauacgucaagucugauaccccauugaaacacuagccguaguuccaaaauuauguaucuuuucaaucccuauuaugguuggcuucucuguagcacuugcugcuccuggcuauucuuuuauuuuuuauuuuuugagacugagucucacuccgucacccaggcuggagucaguggugcgaucuuggcucacugcaacaaccucugccucccagguucaagcaauucuuaugccucagccucccaacuagcugaaauuacaggcaugcacuaccacgcccagcuaauuuuuguauuuuuaguagagacagcguuucaccauguuggccaggcuggucucaaacuccugaccuuaagugauccucaugccuuggccucccaaaguacugagauuacaggcaugaaccacuaugcccagccacguucuuuuauuuuugaagauaaauuuuuuuuagauauuaaaaguaguacaugucacuauagaaugauuagaaauauagcuaucaauuaaaaaucccagcugggugcaguggcucacgccuguaauccuagcacuuugggaggccaaggugggcggauugccugagcucaggaguuugagaccagccuggccaacauggugaaacccuaucucuacuaaaauacaaaaaauuagcugggcaugguggugcgugccuguaauuccagcuacuugggaggcugaggugugagaaucacuugaauccgagagguugcagugagcugagaucacgccaguguaccccagccugggugacagagugagaaucugugucaaauaaaauaaaauaaauaaaaaauaagauuccuauuagcuuuuaaugcugugauauguuuuucuuugccuuuuuuuccccauuuauuuugauauaguuaaggucaccuggcacaucacauguugugccuccuuuuuacuuuauaggguaagccuauucccacauguuuuaguuuguuaggguuaagugaaauacuauaaacuggguagcucauaaacaacagaaauuuauuucucacuguuccggaggcuggggaguccaaaaucaaggugccggcagauuuggugucugaugauggcccauuuuccaguucauggauggugucuucucacuauguccuugcaugguggaaggacaagcuccuuuaggccucuuuuauaagggcacuaaucccauucacacggacucugcccuugugacuuaaucaccucccauaaggccccaauucuuaaugccaucacugugggggguagcauauuagcauaugaauuuuagggggauacaaacauucagaccauagcaccauaucaguacauuucuuuucuuuuuuuucuucucuuuucuuuuugaggcagggucuugcucuguugcccaggcuggcaguggcacccucauagcucacuacagccuggaacuccuuggcucaagcgguccucccaccuuagucuccugaauaguuaggaucacaguugcacaccaccaugcccagcuaauuaaaaaaaaaaguuuuuuauagagauggggucuugcuuuguugcuuagguuggucccaaacuccuggcaucaagcaauccucccuccucagccucucaaagugcugggauuauaggugugucaccuugccuggcaaauuucuuuauuaaggaauuuucaguagcuguucuucauuuagauaucucauuugcagauuuuccugaugaaggauauuuauuccgguccugauuuuuugcuauuaaagauaaugcugcagcacacauacuugcuggucuuugguugugauuugugauuauguuagaggugaauacuguaucaaaaggaaugacuauuuuuuuuuuuuuuaagaccgagucucacucugucgcccaggcuggagugcaguggugugaucucugcucacugcaacuuccaccucccagguucaagugguucuccugccucagccuccccgguagcugggauuacaggugcccaccacacgcccgacuaguuuuuguaguuuuaguagagacaggguuucaccauguuggccaggcuggucuugaacucuugaccucaggugauccaccugccuuauccucccaaagugcugggauuacaggugugagccacugugccuggccaggaauggcuguuucaaagacucccaauuuagcuaccaccccuguccccuuccccacccuuuccuuccccucuccuuuguuugacacagcugggccuaggccaggagcucugcacugcggccagagaagcauccagccacccuuccaugcauccagcagguccaugggucacucuugcagccugucuuccuggacagggggauauguaugccucuccauuauugguggggcaagaaaggcauagguagacauugcuuuguuuauaaugcuuucugagaaaggaaaaauaaauaaucuuacagguuugguuuuggaaucuauuaauaucauaaauaguaaugcacaucucucuggcaggaaagggaaauucagcccaggguccaccguucacugcaauuccugcuuaguaaagaauacagcccuaugauucuauagaaagugacaaauucgggcugggaaugguggcucacaccuguaaucccagcacuuuuggaggccgaguuaggcaaaucaucugaggucaggaguuugagacuagccugaccuacauggugaaaccgugucuguacuaaaaauacaaaauuagccgggugucggccgggugcgguggcucaugccuguaaucccagcacuuugggaggucggggcgggcagaucaugaguucaggagaucgagaccacggugaaaccccaucucuacuaaaaauacaaaaaauuagccgggugcgguggcgggcgccuguagucccagcuacucgggaggcugaggcaggacaauggcgugaacccgggagguagagcuugcagugagccaagaucgcgccacuguacucccaccugggugacagagcgagacucugucucaaaaaaaaaauuagccaggugugguggugcacaccuguaaucccagcuacucgggaggcugaggcaggagaaucgcuugagcccgggaggcagaggugcagugagccgagaucgcaccauugcacuccagccugggggacagagcgagacuccgucucaaaaaaaaaaaaaaaaaaagaaagugacaaauuugaaccuaugaaacauaaacuucacuucagcccagcacugcucaaaaagaauggaaauacucucuuugcugugaguuaaagacagcagagacagaugggggcagcacugcugguaugcgcucucauggugaaugucuuuguuuucaggugguguuggaauuaccuguuggauuuuagucuguaacaaaguugucgcuauugugcuucauccguucagcugaacaggaggauggauacagccgcgaggcuaaaaaacggauuuccucuuccuagcuuaaaaucugauuuacacuguuuuguuuuuuaagaaacaaaagugcauaguuuagauuuuuuuuuuguugaauauguuuguucuuggacuuuaugagagagucuuauaagaaucacgauuuucuacaccugucauugagccaagaaaguccaguuuaugacacguauguacuagugaacaccguccucgaucuguacgaaaugugaaauguuuagggacaucuccaugcugucacuugugauuugcccucuuauguauuuuggucauauugccaacuggaaagucaaaauuuucuaacaacuuuaaguaaguucuuugaagacuuagugcuguuuuuaauccaguuuagaaaguaacuuaauuuuaauaccacuacuaaaaauucgaaaauuucuucuuuaaucacauucaauaugguuaaaagaacaacacuaauugacauugcgugggcuuuuucucccuuuguuuaaaaugucauuuguugagcaagaguuguauaguauuaucuacuuacuugaggcuguuaauuuuucauuacaguguuuuguaaauguauccacgagaccaugaugcauuguuuugugcucaacuuguguuuuguauuuaaagcauuuugaaugaaguguauuuuauaagcauuuaauauuuaugcucuuuagaauggaacacagaaaacaaaccuuauaaguccugauuaaucugaaccaauaaccuguguggccuacaaaguauaauucuauuaaauguuccuuaaaacacuuuuuucuaauuaaaaucuuugcaaaugcuuguguaacuuccugccuuacagcuacuuguuugcugugagccacccgcaacugacaaguggcuguuaacugagucaccauaucccaguaaagcugaauuuucucacua

SEQ ID NO: 192658 - RNA, 10124 nt, Homo sapiens
uagugagaaaauucagcuuuacugggauauggugacucaguuaacagccacuugucaguugcggguggcucacagcaaacaaguagcuguaaggcaggaaguuacacaagcauuugcaaagauuuuaauuagaaaaaaguguuuuaaggaacauuuaauagaauuauacuuuguaggccacacagguuauugguucagauuaaucaggacuuauaagguuuguuuucuguguuccauucuaaagagcauaaauauuaaaugcuuauaaaauacacuucauucaaaaugcuuuaaauacaaaacacaaguugagcacaaaacaaugcaucauggucucguggauacauuuacaaaacacuguaaugaaaaauuaacagccucaaguaaguagauaauacuauacaacucuugcucaacaaaugacauuuuaaacaaagggagaaaaagcccacgcaaugucaauuaguguuguucuuuuaaccauauugaaugugauuaaagaagaaauuuucgaauuuuuaguagugguauuaaaauuaaguuacuuucuaaacuggauuaaaaacagcacuaagucuucaaagaacuuacuuaaaguuguuagaaaauuuugacuuuccaguuggcaauaugaccaaaauacauaagagggcaaaucacaagugacagcauggagaugucccuaaacauuucacauuucguacagaucgaggacgguguucacuaguacauacgugucauaaacuggacuuucuuggcucaaugacagguguagaaaaucgugauucuuauaagacucucucauaaaguccaagaacaaacauauucaacaaaaaaaaaaucuaaacuaugcacuuuuguuucuuaaaaaacaaaacaguguaaaucagauuuuaagcuaggaagaggaaauccguuuuuuagccucgcggcuguauccauccuccuguucagcugaacggaugaagcacaauagcgacaacuuuguuacagacuaaaauccaacagguaauuccaacaccaccugaaaacaaagacauucaccaugagagcgcauaccagcagugcugcccccaucugucucugcugucuuuaacucacagcaaagagaguauuuccauucuuuuugagcagugcugggcugaagugaaguuuauguuucauagguucaaauuugucacuuucuuuuuuuuuuuuuuuuuuugagacggagucucgcucugucccccaggcuggagugcaauggugcgaucucggcucacugcaccucugccucccgggcucaagcgauucuccugccucagccucccgaguagcugggauuacaggugugcaccaccacaccuggcuaauuuuuuuuuugagacagagucucgcucugucacccaggugggaguacaguggcgcgaucuuggcucacugcaagcucuaccucccggguucacgccauuguccugccucagccucccgaguagcugggacuacaggcgcccgccaccgcacccggcuaauuuuuuguauuuuuaguagagaugggguuucaccguggucucgaucuccugaacucaugaucugcccgccccgaccucccaaagugcugggauuacaggcaugagccaccgcacccggccgacacccggcuaauuuuguauuuuuaguacagacacgguuucaccauguaggucaggcuagucucaaacuccugaccucagaugauuugccuaacucggccuccaaaagugcugggauuacaggugugagccaccauucccagcccgaauuugucacuuucuauagaaucauagggcuguauucuuuacuaagcaggaauugcagugaacgguggacccugggcugaauuucccuuuccugccagagagaugugcauuacuauuuaugauauuaauagauuccaaaaccaaaccuguaagauuauuuauuuuuccuuucucagaaagcauuauaaacaaagcaaugucuaccuaugccuuucuugccccaccaauaauggagaggcauacauaucccccuguccaggaagacaggcugcaagagugacccauggaccugcuggaugcauggaaggguggcuggaugcuucucuggccgcagugcagagcuccuggccuaggcccagcugugucaaacaaaggagaggggaaggaaaggguggggaaggggacaggggugguagcuaaauugggagucuuugaaacagccauuccuggccaggcacaguggcucacaccuguaaucccagcacuuugggaggauaaggcagguggaucaccugaggucaagaguucaagaccagccuggccaacauggugaaacccugucucuacuaaaacuacaaaaacuagucgggcguguggugggcaccuguaaucccagcuaccggggaggcugaggcaggagaaccacuugaaccugggagguggaaguugcagugagcagagaucacaccacugcacuccagccugggcgacagagugagacucggucuuaaaaaaaaaaaaaauagucauuccuuuugauacaguauucaccucuaacauaaucacaaaucacaaccaaagaccagcaaguaugugugcugcagcauuaucuuuaauagcaaaaaaucaggaccggaauaaauauccuucaucaggaaaaucugcaaaugagauaucuaaaugaagaacagcuacugaaaauuccuuaauaaagaaauuugccaggcaaggugacacaccuauaaucccagcacuuugagaggcugaggagggaggauugcuugaugccaggaguuugggaccaaccuaagcaacaaagcaagaccccaucucuauaaaaaacuuuuuuuuuuaauuagcugggcaugguggugugcaacugugauccuaacuauucaggagacuaaggugggaggaccgcuugagccaaggaguuccaggcuguagugagcuaugagggugccacugccagccugggcaacagagcaagacccugccucaaaaagaaaagagaagaaaaaaaagaaaagaaauguacugauauggugcuauggucugaauguuuguaucccccuaaaauucauaugcuaauaugcuaccccccacagugauggcauuaagaauuggggccuuaugggaggugauuaagucacaagggcagaguccgugugaaugggauuagugcccuuauaaaagaggccuaaaggagcuuguccuuccaccaugcaaggacauagugagaagacaccauccaugaacuggaaaaugggccaucaucagacaccaaaucugccggcaccuugauuuuggacuccccagccuccggaacagugagaaauaaauuucuguuguuuaugagcuacccaguuuauaguauuucacuuaacccuaacaaacuaaaacaugugggaauaggcuuacccuauaaaguaaaaaggaggcacaacaugugaugugccaggugaccuuaacuauaucaaaauaaauggggaaaaaaaggcaaagaaaaacauaucacagcauuaaaagcuaauaggaaucuuauuuuuuauuuauuuuauuuuauuugacacagauucucacucugucacccaggcugggguacacuggcgugaucucagcucacugcaaccucucggauucaagugauucucacaccucagccucccaaguagcuggaauuacaggcacgcaccaccaugcccagcuaauuuuuuguauuuuaguagagauaggguuucaccauguuggccaggcuggucucaaacuccugagcucaggcaauccgcccaccuuggccucccaaagugcuaggauuacaggcgugagccacugcacccagcugggauuuuuaauugauagcuauauuucuaaucauucuauagugacauguacuacuuuuaauaucuaaaaaaaauuuaucuucaaaaauaaaagaacguggcugggcauagugguucaugccuguaaucucaguacuuugggaggccaaggcaugaggaucacuuaaggucaggaguuugagaccagccuggccaacauggugaaacgcugucucuacuaaaaauacaaaaauuagcugggcgugguagugcaugccuguaauuucagcuaguugggaggcugaggcauaagaauugcuugaaccugggaggcagagguuguugcagugagccaagaucgcaccacugacuccagccugggugacggagugagacucagucucaaaaaauaaaaaauaaaagaauagccaggagcagcaagugcuacagagaagccaaccauaauagggauugaaaagauacauaauuuuggaacuacggcuaguguuucaaugggguaucagacuugacguauugggcauggaucccggaaacagaccuaggacugaauccuagcuuugcuccuuaacauuuuggugacacuggacaagugaaguaacuuuuucagaccucaguuucuucaugggaagccucaugugaggcugagacacaaaaccccgcucacuaaauggacggugaggaggaugucaggcuaacuuaaucuucuaccacacaccucuacauaagccuauucacacucuuccacugcaucuuccagaaaauucuuaccugcuacucuaguaggaaaggcuaccaggcggucuagagggguuauccauuuacucggcacgacagccacagggacagaauaauacuuccaaaugagugagaucaucagggcagccuguaaagacaccucuggugagcaaagcagccugccaaucacacaaccgaccacacagaagggaggacagggaaaugcgaaaauaaaaccaggaaaacucuccagacugagcaccucaagccuaggaacccaguccccacagacaacagaugagcacgcacagccacuaaugucccuuggugaaaccuugaaugagaaagucaaauuaaagacgagcucagcagcaugucugaacacugccaacaaguaggcgagccuuccuaugugaacuggcauuucacuguuuuaggaugaacacaaucuacacauaauuuaaauuagcugauaaacuaaccaaagucucccauaacacgggugugcuuuucucacugaguaucucguuugaguagccagacuguaugcucaacacaccuuauuagugacgaaagccauccuuggaaaaaauagugaauucucccacguacaccaguguuagcaagggacgcagaggugagcccuguguaaguuucaauggugggggaugcuuuauuucccuccauccccccacagcauuccuucgauugucaucuguccccuuccuggcuugaacaggccgcucagaagagacaugaaagaggguugcuggccuaacuccuuugucugcggaaacuuaucucuuagcaaaugacagugccucagaauuaauuuccuucaauauacccugccaaacuaagcuuuuuugggggugggcuugaauccuuugccuugguuaccggaucacaugguacugcaacucggauauuuacggcagcugcuaaaggugucugggcagcacaacugcacucucggggcagagcagagcccaacagcuccaggagaggcuaugaggguuaagccccaggcagggaggcuagaagccaauuccagucggaaaagcugguucucuaccuggaggguggagagcgugcaugaaguacaccagguaacaaguaagggccaaaaguauugaagaucucagaaaaaacugaugucaucuauaagccucucgcuucaucccaccaggcccuucaaaccacacugggaugcaggcauggugaaagcucuccgagaacuuacuucacaguccaucugccaaaaagucccaaacuuuaacaacucuccucaagagaaaggcuuccuuuuagucugacuuagagaccgagaguguuuagagcuccaugugggcagggacacacgacacgacagcugaagguggaacagcccgaacucccagcccuggaucugcagacacggcucuggaggccggggucaccaacuccaaugacccggcugacgcucuagcacacuuaccugcaauacguagaaagcgacacuuaucacccauuuuaucuuggcuaauugagcuguccgagcuuucacugaaaggaaaaacaggauaaauaauuaugucaguccugaaaaauuaacaaaauauucaaauacacagaaauguuauuuucccuuauaauacacuuucugauuauaaauggaacaaucgcucaacauauuuagaaaauauaaaauagaauuuuuaagucacccaccaucucauuaugccauuauuuaaaauaguauccgacucagauugagauuugaauagcuuuaauuuugaaaacucuuaaaacgacucaugaaaucaaagauucuuuguauaauacaguuaccacuuaccaacaggacuaaauuuuccuccuuauuucccagugugcacaguacacgaaccccuggugggaguccagcuuguccugggccuggacaggccccucugucuguuuuccuagccacagagacagcucucugacugugcacacacugugaccggggucccucagcacacgggcugcccugagaaagcgcucuucaucacaggacacuggacccgggaggugacacucagaagaggacacugcugggcauuuuucuagagaguggaacaaaagccucugggaauccacugugagacuuuuuuucugggcuucucucagaaaagugaugaauuuaaaaaugaaaaccuacaauuuuuaagaguuagcuuaaaauuuuaaagaguuggcucugaggaaaaucugagaggaucuuagauauuucugugcuuagaaagcaaagguucaccagcaaauaagaggaaaguaauacuuauuacugaguuuccuccagauaacuuaaguuuccaucaauauucagaacauccaagaagcaaaguauguauucuacuaaucuucacauacagacuucucuauucauccgcucucaugaagccuccaggcugcaagggacacaguaccauggguuuugagcuuauccgucaucuuguugaucuuucuuuccagccuggcauaucuggcaaacucguccaucauguugacuguggagagcuccugcuucauguccuggaucuccgcucucaucugugacuccugcuccgcguccuucugcagcacccuggacaucuggcagggcggacaacggggaucagcaccuuccaacacgggucacaggaggguuccccagucccccgcuacuuucugucuaugcccugaccacucugugacccagccaguugugugcgucccugcaggacugaaugcaaacugcggccgugaacguucccaggacugauaaagagcaaaggcuguugcuggagaacacugggagauucauccugcugagaaacaccuacaaacuagccccaccaugacaaaguccuuaaacucccacauacacuccauaccccaacccccggguggcagacagcccuagguaaaugucccuuucucucacuggcugucccgggacugccgcagcucuuguaaguucccgucaugaaugcuguggacuuaucacccuggcguuuagugcuucuuucuuuggaauccaagccagccccaucuccaggcagucuggagcagccccuugagggaacuccccugccacugcuuuugaggugacuccagcauggguuuggccagacagaaccgguacaccuuccuccaacauccuacucccaccucugccaacugggcaagcugcccucuaccuacacagccagccucugcugccuuuuucggcucccuauaacgaccacaaaaaaaaaaaaaaaaaaaacucauauucaaauugcuauucaaacuauauuuuuccuuuuacagauaugcccaugaauuugcuccaauacaaauguuugucuguuucacuauaaauaaaauugcaauugugaaaugaaaaccaauuccaucaccagagcuguuauuccagugacagggaacauguaaccucuccccucccagaagaauucaguccuagauuagacggggcagagcaaggugcaggugcaggguaacaguggugaggcaggggcccagggcagaaugucagugcccaagcucagugcagagggccuucccacagaauggcacccuggcaagaggcaucagggccaggcauggugauacagggguccccaagaaagggcagccugacacaggagucagggucuguagggugagggagacagacauacaagacaagaaggaacccugccagggucggagcccagguggggagaggcaugcauucacuuggguaacagugggcgguggacaccagagauuaauuacaaaagggugaucacagaaauaaacauauugagaguaacggaagccagucuucucacuuucaacaaagacacuuagaaagaugccucagccuggcaugguggcucggccugcaacccuaacacucuggaggccggggugggaggaucucuuguauacaggaguucaaggcuacagugagcugagaucaugccaugggacuccagccugggcgacagggugagaccuugucucaaaaaaaaaagggggacaaaagaaaaaaggccagguucggugucucaugccaauaaucccagcacuuugggaggccaaggcaggugaaucgcuugagcccaggaguucaagaccagccuuggcaacauggugaaacccugucucuacaaaaaauaugaaaaauuagccacuuucauaaccuggugaaggaaggaagggaagaagggaggaagggagggaggaaggaaggaaggaaggcaggcaggcaggcgucucggagagaagcagaaugaaucuugugguguuggcuucaauuggagaucugugguuuccacagauaggcagagaaauacagacauaaacaaagaagcacgcuccccaggcuggccuggcuggucccugugagcagaggggccccgcaugaccuggaggcccgccugcgcagcccccgcaggccccuguucccugcaccagccccagccguccacucuccagggaacggcccggccacggcaccgggaugggagaggugacuggagcgcaacggaggagucggcagugaccgccagguggcgcccgcagaucugccgggaaggccuaguccaaggacugcgcgggcgccccaagaccagaucccucaguggcgccucuggcaccuaccccaagggaucagcgaacauccccaaaucccagucccacaccagcggaugagacacaaugagaacacagcacugccucucagaaaucccuaccaaguaucagacaugccaguaggcgucccuucugcgaaaucacuggccucugacacccacaaaugacagccaugaaagucaagggaagacugggaaacuccuccagacaggaggcuagaggccgggaaaugcaaugcaugauuccgaacuggguccuuucccuguuaaggacauuacugcgaaacguggggaaccugcauggggucugaggaucagaucgugguaacguacuugacgccugcauuagaucucggcucacugcaaccucgacuuccugggcucaagcgauacucccaccugagccuccugagcaucugggacuacaggccugcaccaccacacucgacuaauuuuuuuuuaguuuuaguagacacacgguuucacuauguugccagugaacuccugagcucaagcgauccgccagccucggccucccaaagugcugggauuaaaggcgugagccacugugcccggcccccaagauucuuuugaauaccaaaguaucucggaaugaggggguuuggguugacaacuuccaaaugguucaggaaacaaaaucaguuaucgguauugacuguauauaacuuuucugcacauuuguguuuguuucgaaauuuuaaaaauagauuaauaaagacgaaauguuauaguguaucuaaagugugccuggcacacaauaaaucagaucccccccccucccccuuccagcuuacaggucuccuccgccugccgcacaguagggacaacucuccauuuagagcuuggaagccgcgacccgccagucgccugagggugucugcgca

SEQ ID NO: 192659 - RNA, 121816 nt, Homo sapiens
ccagcggcugggccugagcgucgagacucggggccgaggcggaggagcggccgccgcgccggggcccagccggagccgccgcccucgcccuugccuuugccugcgcggcucagaaucaccauccgcggcgcgggagacgagccggccgucccgggccgggggacccgcccgccauggccaccaaggugaggggcgcgcggcgcaggccgggccggucgcucaggcccggggcggcgcggagagggucggggccggggccgcggggagggucggggccagggguggucgaggggccacuccgcuuccucgguggaguccccgggcggguccgcggcccagccagucccuucugggcaugggugcggcgggcagugcagacagaccaccaggaucgcaccgggggacggcgucgggucugggcgcggguugggaccccgggcgcagcgagguuugggaaguuugcaccugagcgugggcugcggcgggcucgccgggaggggccgcgggacggaaacuucccgcagcccggggaggcccccgaggcgacuggcgcucuguggcguccggcguccccgccgcccccacguccccucccgcugccgccugggggacccucgcccccgcggggcgggugggggucgagaccucggcggagaggacgcggcgcuucccgucccggccugcgggggcucgcggccggggagggaccgaggcugggacgccccgcgccccuuugccuucgcugcuguuauuuuuuucuuuuguuuugcuaccuuuucauugugaauggcauugccggcaugaauaaaauaucaagagggaaaugacugugcuuucgauuacguguuugccugaaaaaaggcccaggcccgaauuacgugguggaacuuugacuccugcuucgucauuggcuaggagcggugguuugcuuguuuuacguuauuguuuaugaaauuagcagucacucuuggcuaccugaauuuucaaaagccacccucccccgcuccuuuuccuugggcguuuucaguaguuacuugauguagaauagccacuggggaagucacggucacggaagggaggaccugggggaggaggcucuauaccugagccauuaacugaucugugauacacugugaggaguggguuuacuuuugcacuuaguuuuuguaaugucacuuuguuagcaucagcaccccuuugucuauuuguuuuugagaucucugagcuacuuuuggguugcuagaaacguuauuuuuuauuuuucgauagguguuugcuuuuuuuguggaguguuaagguagaaaaugguaagaaaugugaaaucucuuugaaagaucagcauugcuugacuucggucugcuagauguugugcugugguaaauuuugugcucugaauccaucuaggugcagcguuuguagagaaauggggauucuccuccagggaaccuguugcugcuguuacugaaauaauuaccuucuuguuaauauauuauugccugugcugugcuuugguuuuauuaaugcgauagaacuugccaccuuuuuaacguauuaauuuuguguugaccuuuuuaaaaauaaaacuuaggccaaggauuucuaaggaaauuugauuuugagguuuguugccagacauuccagaaauuaccaguuacacauccuaguacaugcucaucuugcaaccuuaaaagcgguuuauaggccgggcgcgguggcucacucccaccuguaauuccagcacuuugggaggccgcggugggugguucaccugaggucgggagcucgagacaagccuggccaauauggugaaacccugucucuacuaaaaauacagaaauuagcugggcgugguggcgcgcgccuguagccccagcugcucuggaggcugaggcaggagaaucgcuugaacccgggaggcggagguugcagugauccgagaucgcgccacugcacuccagccugggcgacagagcgagacuccguuugaaaaaagaaaagacgagacuccguuugaaaaaagagaagacgguuuaugacauagagaucugucuagugguggucaguguguuuuuacacucuggucuacugaggcauguuaucuguacuguccuuuaaguggaaugcaguuuagcaacuagugcagguauauauagugaaauuuuuauuucauaguuaauccugaacuuaauuuuuuuccaaaaaaucgaaaagugguucuuguauauuaaucucgaauugcaugugucuuugauuaaacacgagccuuaaagcaugcguaaggacuuccuacuucguuaucuacaccacuccaaaggcaaauuccaguaguucuguuaguuucuuucggcugccuaaucacuguuccacauggugcucauuuccauguuuacauugugacaaaccauuuccauuuuaagaaaaagaagagcaacgaagcaguuauuaaaagaagacccuuccuuuguuuucugacaugcuggugauucuugugucaaaccaaagucucauuuuuuaauuguucccagagagucaaguuggugcuuuccucccuucccccauaugcacacuccuuccccacaccugaguaguuguguuuuuucuuugucuucuucaagggguggggagaaugugcuuaguaguaaugacuaacuuuuaauaaaaauguaggcuccaguggcacucaggcuguugcuauaaguauuaacugaugaaaaguaaauucaguaucuggauauuuuaagggaugucgauuucccuuugaauuuaucagagacuuggcuauaguaucuucagauacaauuuucuuguuuguucuuacguauuaaggaugugguuaucacugaacuauugggauuuuuaaaaacuccacuacuauauuuuacaauaaaaaaggaaauuaucuuuuagaagaagaacuuuaguuugacaguccuucacugcuaaagaaaguuaaucagggucgggcgccgucucacgccuguaauccuagcacuuugggaggccgaggcgggcggaucacgaggucgggagaucgagaccauccuggcuaacacggugaaacuccaucuauacuaaaaauacaaaaaaaauuagcugggcgugguggcgggcgccuguagucccagcuacucgggaggcugaggcaggagaauagcgugaacccgggaggcagaacuugcagugagccgauuuugcgccacugcacuccagccugggugacagagugagacuccaucucaagaaaaaaaaaaaaaaaaggaaaguuaaucaguaacugcacauuuuaaggggauuaucuauuuucuauuucuacuccuuacucaguagagugcugcauucaguuuaaguguauacacucacucagugcaaucaagucuuguuuuacaaauauuaauacaaaagcugcagagcauuuuagucuugaccuuuauuggaagccuccaaagguuauauuucgacccagccaaaauauaaccuauuuauauuauagguuuuauauauauaugauauauaaauauauuauauuauauauauauauuauauuuuauauauaaauauauauuauauuuuauauauauauuauauuuuauauauaaauauauauuauaguuuauauaauauauaaauauauauuauaguuuauauaauauauaaaauauauuauaguuuauauaauauauaaaauauauuauaguuuauauaauauauacauauauauuauaguuuauauaauauauacauauauauuauaguuuauauaauauauacauauauauuauaguuuauauaauauauaaacauauauuauaguuuauauaauauauaaacauauauuauaguuuauauaauauauacauauauauuauaguuuauauaauauauacauauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacauauauuauaguuuauauaauauauaaacuuauaguuuauauaauauauaaacuuauaguuuauauaauauauaaacauauaguuuauauaauauauaaacauauauuauauuauaguuuauauaauauauaaauauauauuauauuauaguuuauauauauaugagauauauaaauauauaauacauugucagucauccuguuuuauuuaaaagaucaaguucuggaaaagaaaugaagaauuuuuuuucagugucugucaaaggggacaugaagaaaauuguuaguggagguuaauccauaucuauauaauuuagcuguaauuucuacgucaaaguuaaccuucagucacuaauuuggauccuuuugugcuuacauagucaccuuuaggcuaacuauaacaagauucuaggaguuccugaugcuuuuuuuuuuuuuuuaacucuucgguuccaauaccuaaaguuauacacauguguuacacagcuugucugguuaaauuaaguggguauggaauguuaaaaauaaugguagggaauaaaugaauuacuuaagacuuguuuauuccaugcauagauuagugagaacaauucagaaggcauacuuuguagccccuccagagcagaaacuucuuuauuugacgacuagaauagaaauaucuuucuaacaggucuuaaggauuaaaguugauuuuuauggcuuuuaaaauguuuggaaaaugcuaaccauuuaacuuuguauaacaguaguauuuucuaugugucuuaaguagagugugcaguauuuguauagucaaagauaaguucugugacaguagaaagaugaacaagucucauuaaagaaggaauagauuagaaagcauaaaaauguugcaguuuuucuacugugccuuguuuuuauauugaccaucugaaaauuaaauuauaguuuuacuuuaauuguccacuuaaaacuuuguagcuuugcaguacugcuguuucuuuucuggaaugcuguucucccuuguccuucccuagguacuuuguuuuuagauguuaaguuuuuaugauuaugauuauuauuauuuuuuuuuuggagacagggucucacuuugucauccaggcuggagugcaguggcacgaacacagcucacggcagucucgacuucccuggcucaggugauccuuccaccucagucucccaaguagcugggacuacaggugugcaccaccaugcccagcuacuuuuuguauuuuuuguagagaugggguuucaccauguguccugaacugaggugauccuuccuccucagccccgcaaaguauugggauuacagguuugagacacuacgccuggccacauauuaggucuuaaugcgucuaagcaucacuuccccgggaaagccuuuccugauguccccgccccuguuucagggucacauuacacaccccgacugccauuuuauauuuguuucuauaacugauggcuggcuccuuugaaugcugucagccucaagaagcugagacuguuugugaucacuuuuguaucuucaaugacaaguuuaaaagagcaaaaauauauucuagugagauaagugacucgauuauugaaguagaaaacuauuaauccccagcuguaagcuuuuguucuuuuaaucauguguuuuaguguauuuguuaaaaguguauacagguacaacacaaaauuuacaucugcagcuuagguauuggcaauuauauuuuuuaaaacauaaucaauuuuacuaaugauuacaugagaaauugccugauguuuuaagguaguuggaacaagcuucauauuucugagacuuuaaagaguugucuuuaaccuacaaguugucagaauugucuuuaauuuccaaauguauuggguuuuucucuuucuuguuggugauuucuaacuugauugcauugugaucagggagccuaauuaaaaucaauacuguaccuggaaauuuguugaggcuaacuuuauucccagcauacagucagcuuuuauguuucaccugugcacaaaaagaguauacauauuauugaugugugugucuauucuguaugcucuauguccacuagacuuacugugcuguuuauauguauauccuuacuaauuguguuccucuauuugaucuguuguaucuaacugauccucugucuacuugauggugaugcuaaaauggugaauuuaaaaauuuucucuacauuuacaauuaguauuauuuucuaggugaauugaaguuuuuaucauuaugaagugaaccucuuuaccucugguaaugcauuuuuucuuaaagacuauauuucuaauguuaaugugauuucacuagcuuuugguaaauauuucccagauauauaaaagccaauagcugaauuuuaccuuuuuauccagucugaucuuggugccugccuguacagcauuguguuuacugauauauuuggauuucugucuaccaucuuauagauuguaggagcccacucccaacuuuguggaagguuuguguuauaagucucuuuuuuccagugguuaucauaaggauguuaacauuaaagucugaaauuacuuaauaucauuagccuuuuccugaauuacaaaaagacauaagguuauuuaacuccagucaucucccccaauaugaucaauuauugcccaguauuuuaguuauaucuuuuucaccacaaauugaacauuauuuuuauacaguuaaauguuuuagaucuaaucauauuguacugugucuuugcuuacuguuucuucuuacauuucagucuuuucuugagauaauuucccuuccaucuaaaaugaauuggaauuuccauugagaagguauguuguugguaaaucucuuauaugucucuuagguaugaaaauuacccuggucuugaaagaguucuagguugacagcauuuucuccuaguacaaugaagguauucuuccuuuguuuucuacuggcuuugacauuugcugcugggaagccaguuagcuaauuauuguuccuuuguccguggugugacuccucacuggcuguuuuuaacuuucucaguuuuaguauuuugcaguuugacuguaguguguccauguguggauuuuaguugcacagcuuggguuuccuggguaucuuggaucugaggacaggugcuacguuaguucuagaacagugcuguucaguguacucuuugugaugauguucuacaucugugccguccauaugguaacugccugccucuuguggcuaacaagaacuugaaaugugguuagugugacugaggaacuguguuuaaauuuuaauuucaguagccacauguggcuaauggcuacuuuauaggugagugcagcucuagaaaauucucagcgguuauucaugaaaauugccuuuucuccauucuuucuuucuggaacucuaguaacaugaaaaggaccgauggaaaucuaacuucccaucugucaaccugucauguuuucuuugugcuacauucuggaugauuucauuuguucuuaccuucuguucacuauucuuuccucagucaggccaaaucugcucuuuuauucauccauuuaauuuucaguuucgguuaucuucuauuuuuagaaauuguauuugguucuauuucaaaucugcuuaucauucauuauaguuucugguucuuugcucauauuuuuaagcuucucuuaagcaugucaaaacauuaauaguuuuccguccuaaucucagaagucugauucagccauccguuucugcacauucucacucauggugcuuuguuuucuuguguguuuugugauuugauuugauuuuuccuugaguugcuuguuuuccuuggaacuuccucugugggaauccuauuaccuagauugagguuguauccuuccagggaggauuugugugugcugauaccagucuccuggggacauuacauccuuggagucacuauaucuuuaauuccuggcuuaauguuuucucagccauacuggguagaauaaauauggaccuggcaucucaggagaaauuuuccucauccccacuacucuguaucaaugaugagacauuuccuugcacacagguuuuccucuuuacccuuaugcugagguccuuuuggagucccagcuuguagcuuaauacaggacacuuuguguguugccuccccugcccccacacaguccccagagcacagagccaggcucccagguuuguggagucucccagcgggaaauccugccucagcacauguguucucccaggguuucugcuuucacuuccuuuguggccucuccggagccuuuccuuuugugcuaacucagcaguguguuucaaaagguguuuaguuuguaucuuuugcuuuuaauauuuuauucagcacuucaguuguuucagucuggcaguggcucagguauuagcuugcucuaguugcuggaacaaaauccaagucagagcaucuuuauagcagacugucaagugaagggaguggaauaugugcaugaaaguguuaaucugaucuuugcagagggaaaggucaaaaaguuguuaagcauuuugguugaaaccaaaccuucagucaagcugucaaacugugggcauuucaaaacuuuccaauugauauuucuuugucauuuuucuuuugacuauuaaaagcacaugauagacuacuuacuaauuucuaggcauuguaaaugcaguguuuaaggaugcuauucagucugacugaauuuuucuaaguuauuuguaguaucugaaaaucgagucauaugguauuauuacccacagggacaguacucagaagucacagauuugugauuguucauuaagucagacacuuaacuuuagggauaaauuaaagagggggaaaugcagcuucauucuguugccuaucacccguugucauccacaacucauucauuugaacuucagaugugccagguccucugggaugucaguaugaaaggccuguccuuguacucaaagggcacaaugucuugaaggagggcaggcugucugcaggggcacagugcaggcuccuggcacaguuccucaagcccagaggcuuucaaaggacccaagucuugaaaugucuguguauuagucuguucucaugcugcuaugaagaaauacccgaggcuagguaauuuauaaagaaaagagauuuaaaugacucacaguuccaaagggcuggagaggccucaggaagcuuacaaauccaugguggaaggggaagcaaacauguccuucuucacauggcagcaggaagaagugccgagcaaaagggggaaaacccuuauaaaaccaucagaucuugugagaauucaugagaacagcauggggguaacugcccccaugauucaauuacccccaccaggugccucccacaacauguggggauuaugggaacuacaauucaagaugagaucuggggagacacagccaaaccauaucagucuguuacuuaguacuuugagugaguuuuaaaccuuacucuaucacuucaguugcuucaaaaauacuuccauaguacagcuccacagucugcaaguccagacuuugccuugucagaucccagauauucaguucagcagacauuucaguagcuauuuugugccacuuggaugcugggaauaaagauuuggauccucccuaggacaguugacauucagauauuaaugaauugguguauuuaaaaugugcgaguuuaaauguauuuccuaauuuaaauucacagaaaaaggcuugaaaauuuagacguauguauaaauaguugccuauugcauaguggcugcacauaagaaguuuuuuuauguuuuaguuuguuuuauagucucaagauuuuaaguaaugaauauuugcugcuuuuguaacaaggaaaaaaaagauuuuuuuuuaauuaaaaacuuacugucuuuaggccucuaaagcagauucccaaacuuauauaccuucuguuaauuuguuucaaauuguacuagguuggaaaaauuuuuuaaugcuuacacauaguaagggcacuucaauagaagaaugcuaaugcauucaggauuacaaauauuauuuuguaauuuucuuaaguaugguacuuaaggaaauuuucuucuuccaggggaaaaaaagaguauguuuuaaaaguagcuuuaaaacauaacugaaaacuuacugaacaacuagcacugaaucugaagguguuacaaauugcuguuucauaaauacauugguaauuuuaccugccaccaugugccuucucccucaggagcuuagaagaggcagggugguuaauucuuugugguuaggcaggguuuccagcacugcacuucuccucccgccuuccuaaaccaugacucagauuuuagagucaagaguugaauaauaugauuuuacaguuguuuuguugaugcaucagauuuacuuugucccgugacuaucuaccaguauugccgaacugaacuggguccauuugcccauguaguggaaagccaaacacugaagcaccagguuuuuguagugagagaggcuuauugccagacagcugagcaaggagacaggaguuggacuuaagucugucucuccacgcugggggcuacgucagguuuuguacuuagagguaaugaggcgugaucugauuggaucuugcaguggggugaugcuggaggcauaaucugacuggauccugccauggggugacaccagggcuugaucugaucggauuuuggauccugccaugugguguccacugugguuuuuuuuuuuuuuuuuuuuuuuuuuuuuuuuuuugagucagggucucucuucuguugcccaggcugaagugcaguggugcaaccuccacugacugcagcucaaccuccugggcuccagcgauccucucaccucaacauccugaguaagcugacaccacaaagugcgugccagcacaccuggcuaauuuaaaagaauuuuuuuuuuuuuuuguagagacggggucucagucuguuccucaggcuggagugcaguggcaugauaauaacucacugcagccuugaacuccugggcuuaagugauucucccaccucagccucacaaguagcuuggacuacagcugugugccacccccccggccaauuuuuuaaauuuuuuuuucuuuaguagaauugaggucucgccauguuccccagguuggucucaaacuccuaggcucaaacgauccuccugugucagccucccaaagaauugugauuacagccucccaaacuguuaguguccacuucuuaauucagugcucauuccucaugcccauuccauuccaagugcccaucugagcacguggguucuauccauggcugcacacuuaguuuugggcaugcucuggugaugugacguucaaccuggagguccaugccaacugaaaagcagcucauaacuuuguuacauaaaaguugaaccagauuagucugaugcaauuccaacaguauguaaagcguauucaauguccuugcaaccccuaaaagcuccaaaacccuaggaaaucaauacccguuagguuacugagaucugugguuacaauagguugagcugucugaaucaucuaaagccaagaugauaccaaaaaguauagacauuuuaaauuuaauuuuauuuuugagacagagucuuacuuugucacccaggcuggagugcaguggcaugaucucagcucacugcaaccuccaccuccuggguucaagcaguucuccugccucagccucccaggcaacugggauuacagaugugugccaccacgcucagcuaauuucuguauuuuuaguggagaugggguuucaccauauuggccagcccaguuucaaacuccugacaccaagugauccaccugccucggccccucaaagugcugggauuacaggcgugagucaccaugcccagccaagauuuuuaaaauauucuaauauuuacuucuauuagaguucaauuacuauauaaugaccaaaagcaaaguuuucagccuuuaaaaacccauuccccuucuuuuuuuuuuuuuuuuuuuaaauagagucuugcucuguugcccaggcuggaguccaguggugcaaacauggcucauugaagccuugaacucccacacugaagcaauccuccugccucauccucuugaguaucugugauaugguuaggcuucguguccccacccaaaucucaucuugaauuguaaucgcuguaaucuccaagugucacaggagggaccagguggagguaauugaaucacggggucgauuucccccaugcugacugagcugaugguuuuauaagggguucuuccaccuucacucaguacuucuccuuccugccaccuugugaagaaggugccuugcuuccccuucacuuuccaucgugguucaugaggccucccuagccaugcugaacugugagucaauuaaaccucuuuccuguauaaauuacccagucuugggcaguucuuuauagccgugugaaaacagacuaauacagucugggaccacaggcauacaccaccaugccuagccauuuauuuuuuauuuugguugagaagggucucacucuguugcucaggguggagugccguggcgugaucugggcucacagcagcagccucgaccucccaggcacaagcaauccuucugccucagccucccaaguagcugggacuacaggcacaugccaccagagccagcuaauauuuaauuuuuuguuuguuuguuuguuuguuuguagagacagggucucucuaugugcccaggcugaucuugaacuucugggcucaaacauuccuccugccucagccucccaaagugcugggauuauagccauuacccuuuuugauaaguggaaacaucuugugcacguucuggaguuuucauuaugaaagugauagauagugauucucuaaaaugcuacaaguauuaaauuuuuuucucaaacuccccucuucucugauucauuaggacucucuucuauacagaaagauauggcaaugguaauaagcuuccaucugagagagaaauugaacucuugcuaaagugaugauauuuccuaaggauuaggaauuaaugguagagcugugguacucuaacuagcuguaucacagucaccaacccggggagcuuguuaaaucacacagaguuucugauucaggaggucugggguggggcugagaacacacauuucuuuucuuucuuuuuuuuuuuuugauacagagucuuacucucgcccaggcuggagugcaguggcgcgaucucagcucacugcaaacuccgccucccagguucacgccauuuuccugccucagccucccaaguagcugggacuacaggcacccacuaccaugccuggcuaauuuuuuuguauuuuuaguagagacgggguuucaccauguuagcccggauggucucgaucuccugaccucgugauccgcccaccuuguccucccaaagugcugggauuacaggcgugagccaccgcgcccggccgagaacacacauuucuaccaguucccaggugaugcugaugcugcuggucuagggaccuaacuuccagaaccacuauugugagggauggaaaaauaaaagaaagaacuuggguucuguccuugguuggucccuaagaucugugaggccguaaauuggguggcugcacuagcaugccgugugcagugaacacuugugucuugcuuaaaggauuauuuuaucuaacuggguucauaugaugcagaaaaucacagauccguaaaauauucucagaagcuauuuaguuucucgccaacuuguaguguugucaguaacuuuucaguucuuuugauugaucguugguauuauaugcaaaaugucucaacacuguuacaaucucacauuaccauggaggcugguuacuacucuuccuauugccuuuuaaguuagccagaaaacaugcgauacaguuuuguguguuauuaaaacaguaaucaguccagauuuauuugcauuguauaauauguuccuaccgugauuauauaaugaaaauaacuuuuaauucacuaggagagaagaauccuguucuuaaauuacuuauaagucagauaauacaugccuuuguguaaauccaguuuuuaauguuauuugugugguaaguacccauaccuaauuuugaugaauuugaauuucagcggcuucauuuuuccuguuugcccacuuagaagcuuuaaggaaguaaagaaacaaauguuugucaaagcuagaaaaaagaauguaguccccaaacuagguaaaucuaccucugaauaaucaaauccacccauguauuauuauaggacccauaugcaugaaggcaugggcaugcugucuguguucauaugaccugucucugcagucaguaagaaguaacgggugucuaaauaagagaagggcagcagaucgugaagccgucguuggcauuuaaacaagguggcaacugaacugcacuguucaguuucuuguggguuccgugaacagcauaugcuguaccauuaauuauggaaggaauacauguaauuguuggcugugguuaacauuagaauauuauuaugcaugaacaucaagggauauugacagaaauauucaguaugcuacauugcuuccaaaaaucaaauuuuguuuguuuuuuugagacagaaccucacccuguugcccaggcuggaguacaguagcagcucacugcagccccaauuucccgggcucgaacaaucuuuccaccucagccucccaaguagcugggacuacaggcaugcaucaccaugccuggcuaauuuuuguauuuuuuauagagaugguguuuugccauguugcccaggcuggucuugaacuccugggcucaagcagucugcccaccucagccucccaaagugcuaggguuacaggcaugaaccacugugcucgaccaauaauuuuuuuuuuuuuuauucaacagucucucucuagaauuuauacuguaagugaaaaugcauguauauuuuucuauccagagaauuuacagucuaauggagaacacagacacuuagauaucuuccauuagguguacgguugcugugguaaaaguauguauacauaguguacagugagauagcucaguauuuggagucagaaaugagacccucugaccuguuucccuccauuuagccauuggaaacuuaagaguaaaaauaaauguauaucaauaaagagccauagugugaaaauuuuauguagaagugcuaaauauucugacauuauguuacucaugauguagaagaggaucauuucucuaguuuagggaaugguguuaaauacuugaaggcauguuuaguuugaggucucauuuaaagagcuccuauuuuagugacugaccuugcaggacagaaaguacauuuuagagaaguguaaauguccacuuucccugguuguacucuaaaauuuuaucuggcacugguuaaacuaagccacucuuaggaaccagugaacauucgaggcaaguagucugugcccaggcuuguucuaaauccuuuguggccgaggacauagcgucuuggaaugguuaaaauggaucugcuccuuuugauuuccagguaagcuguuguuugauguguuuuguuuaccugguuugcaauacccagagcuuauucuagagaagggauucccagcuggugaauugucaggggaucuuuaacucuuuaaaauguauauagauucgguuaauaaaauacagguuuacuuaaaaacgcuggacuucauaguaccuuuuugguguuagguaucaaugaauuguccuuguguauaauuacuguuauauguguguggggauguauauauguaaugaauuaauguugaggucauuggcauuccucugugauucauuauagcuguuacauaaaagccuauuuccccuauuaguguuuuguuucucuugaauuuuauauuuagaauaaaagagaaauuaugucuuuuauuagagaugcaaugaaugaauaaaauuaguucuaccugauuaugaagcauauguauuuucauguaauggugauauagcauagagauuaggagccuggguucaaaucccaguccaguuauuaauacauuacuuugaaaaguuacuuacugcuucacuuuccuuaucuguaaaauacaaauaauugaauggauucaggugugaauuccauugcacaguccaagugggggaaaaauuauaauuuugcuuuucuguaauaauuuacaacaaauuacauccccguccugcuggggaagcagaccuauaauauuuuaguucccaggccaccgccucuugcccagggugaagcauaauuugaggguggggaugguaaccuagugccauggccuugaaggugugaccccaucuugcccuccagucuccucuuuaggccuuuccuccugccccucaguuuaguaacucucuccaccacuuccuugcugugcugcuugaggacaugguaaccaccuugcugguugugcgcaguauuggggcgugaaucucugcaaagcucagaccuuucugucuuaaugugauacauagcuguuuggauucuccuauccucuccgguuguuucaugguuucacuaggguucugaaagcaggugaaaaaaaacaagaaagccucacugggaaggugacacucagguagagaucugagggaaggugggggugucuuuggaucucgggaaagagcagacccucaggcuggugcuuggggugucuuuggaucucgggaaagagcagacccucaggcuggugcuuggggugucuuuggaucucgggaaagagcagacccucaggcuggugcuuggggugucuuuggaucucgggaaagagcagacccucaggcuggugcuugcacagugaggccagagcugagggagcucagggaagaggggcugcuccccaggcugaggaggcccaggcgaccacgggggcuuugacauuuauuuggcaauaaaaccauuggaggguuuucaccacacccaaaaugacugacuuuuacaaaaaauacuuucuuucuuucuuuucuuucuuuucuuuccuuucuuuccuuuccuuccuuccuuccuucucccuucucucucucucucucuuucuuucucuuucuuucuucuuucuuuuuuaaagaguugagcuugccuuuauuacccaaagcuaacugcaggaguuaacagucaguuugcuuugauacuggauuuaagccuuauuuuaucccuucuuaaaacuuaauugauuguaucuuauuaaagccacacuaggaaaauccugugcuccauuuaagucaaucaguaagagagcuucagaaggauugacacaguauccuucucuauaugaggaauaccccagucaaaucagcugggagaaaaaacuuuguaaagaaauuuuuaaaaaccucuauuauuuugcauucgagauuuugucugauagaaaauuucagauuauguuuccuggauauacugaaagugaauacaaacggcucaucagaccauuuggcuguuaccguuaugcuguucacucgacugguggccacauagacauaagcaaaguacuugcagacugcuggauuucugacugaugaaaccauuucugaucagcgacucacugcauuucucuuccgaugagggucacuguuugcagggugucugguauaaacuuccugaagccccagcagucuugagagcagcaguagaagaaagcagcuggaacccugagaacuggggcagaaugcuguuaugggcuaagaagaaauggcaucaucuuggcuuagaauuuggagauucaaugaaucuuuauucuuucaugguuccauuaagugauuauuuuuaauaugaauuagaucacuggaauuucauauuagucaugcugaaaaauuccacaucuguguguuuuaauuuagggucuucaagaugaagggcaucccccaaugauuaggagaggcacaagauagaaauacagauuuuauuaccuacaggcccugggaguacacagcaauccuggaggucacacacaggauggucagggagcuugaaggucaggaauugugaagggagagagagagauugagaccuaccuagagacccaugggccuucaugggguccaaacagguuucccccagggagguuuaauugguuccaggaggucacacugugacugcacagcccaugugggguguggggaucggggccagugaaguaggcuguguguagcuuucccauggggaggugguugccaggaggaaguugucuaaggcagguaucuguauuagucauguugaggaacugggaggagguguagaacugcacccucugccauguccagggugacagagcccugcuucugcuacgacaaggucccacuuaucuucaaagugcaugcugaggcaacauaaaaugauaagaauuuacuacacugugacuuuuaaacuaucaucucaaugguuuggcaugauucaauauuuucuauuuuaacuuuuuauuuauaaaaauuuuaaacauggacaaaaguagaacagcacagugacacuccccuguguacucaucacccaccuccacagugauccuggcccguuuuguuuccucuagccuccccuccccuauuuuccccuuuccucauuauuuugaagcaaauuccagacaucguuucaugauaaguauuuuaauauauaucuccaaaacuguagacuuaaauaacuguaauuccuguuauacuuaaaaauucagaauacauucuuaauaucuucaaauauccagucuguugguaggcaguguaaacauauucauaaauuaaguuugcuguaucuauuaaguugcuugauaguauuaaggugagaacagugccaucucuuacugguugacauuuguaugagucugcccauguuaauguaaaacagauuugccacagguaaugugaccauacagguaacauaaucuaacaguuaaaaaauauaugcaugucuugcuuuuaucuuguugacuccagugcucuuaucaaaauccucaugaugcaacugcccaauggguucaccaucaccacugccuagacagaaucgauuuaucaagacagggggauugcaauggaguaagaguaauucacguagagcuggcugugcgggagaccugaguuuguuagucagucuccccgagcauuuggggauuggaguuuuuaaagauaauuugguguuuuuaaagauaauuugguggguaggggcuugggaaguggggagugcugauuggucagguugcagauggaaucuuaagggguugaaguuagguuuucuuaaugucuucuguuccuggguuggauggcagaacugguugggccagguuacuggucugaguccaucaagugcagggucugcaaauaucuuaaucacugaucuuagguuuuacaauagugauguuauccccaggagcaauuuggggagguucagacucuuggagccagaggcuacaugaccccgaaauuguaauuucuuguaguuauuuuguuaguccugcaaaggcagacuggaccccagacaagaagggggucuuuucaggaaagggcuguuaccaauuuuguuucagagucaaaccauggaucaaauucuuucccaaaguuaguucuggccugugcucaggaaugaacaaggacagcuuaaagguuacaagcaagauagaguugguuaggucugauuucuuucagugucauaauuuccucaauuauaauuuugcaaaggugguuucaaggagaugaagccuucuaagccuuucuguacagcuuagguggugccagcaaugggaggaugcuuaggacaaggguugaagaauugacgaaaaugaaaauugaaaaagaaauauagcugacccuugaacaauguggggguuaggagcaccgaccgccugcccaguugaaaauuaaaguauaacuuucgacucccccaaaacuuaacuacuaauagccugcuguugacuggaagccuuauaacgcaaacaguuaacacauauuuuguauguuauauguauuacauacgguauucuuacaguaaauuaagcuaaagaaaauguuauugagaaaaucauaaggaagagaaaauauauuuacuacuaaguggaaguagagcauuaggccuucauccucauugucuucacauugaguagguggaggaaaaggaggguggaguggcagaaauagaagaaacggugcauguaaaguggaccagaccuguguuguucaaagguuaacuguacugauuaucuuauuuuaacuuaaaauguauaaugugcauuuacucaccaauccuuugauagacagacagcuauggucuuuguguacuucugauugcagugcuaagugauccauuuugcauaauccauacucaauucauugcaauucuaauuuuuuguuucuuuuagaagagcuuaaauaguuugaagacaauuucaaagcaucgugaguacagaauucuagauuuuaaaaaauuauuucccauuugucuuuuuuuuuuuuuuuuuuuugagauggagucucacucuaccacccaggccagagugcaguggcaugaucuuggcucacuguaaccuccaccacccagguucaagcaauuuuccugccuuagccuccugcauagcugggauuacaggcccauaccuccucaccugccuaauuuuuguauuuuuaguagagacaggguuucaccacuuuggccuggcuggucucgaacuccuggccccaagcugucugcccaccucagccucccagaaugcugggauuguaaccgcccaauggguucacuuugccugccaauuucuuagagccgauuucucaggacaagcggaauugcaauagagaaagaguaauucaugcagugcaggagaccggaguuuuauuauuacucaaaucagucuacccauagaguuuuuaaggacaauuuggugggugggggaagccagugagccaggagugcugauuggucaggggugaaaucacagggagucaaagcugucuugcacugagucaguuccugggugggggccacaagaucagaugcccaguuuauugaucgggguggugccagcugauccaucaagugcagagucugcaaaguaucucaagcacugaucuuaggagcaguuuagagaggaucagaaucuuguagccuccagcuacaugacuccuaaaucauaauuuuuaaucuuguggcuaauccuuguuuuuuuuuuuuguuuuuuuuuuugagacagagucucacucuguugcccaggcuggagugcaguggugcaaucucggcucacugcagccugcaccucccaaggucaagggguucuccugccucagccuccugaguagcugggacuauaggcacccgccaccacgcccggcuaauuuuuuguguuuuuaguagagacagcauuucaccguguuggucaggcuggucuugaacuccugaccucaaaugauuuacccaccuuggucucccaaagugcugggauuacaggcaugagccacugcgccuggccgucguccuuguuuuaaacaucuuuguuucaaacuauaaauucccaaaguucguucagccugcguccaggagugaacaaggacagcuuggaaguuagaagcaagauggagucaauuaaguuagaucuccuucauugucucagucauaauuuugcaaaggcaauuucaggauuacaggcuucagccaccgcaccuggcccuuucccauuugucuuuuuuuuuuuuuuuuuuuuaagacggaguuccgcucuugucgcccaggcuggagugcaaugguaugaccucagcucacugcaaccuccaccuccuggguagaagcgauucuccugccucagcuuuccgaauagcugggcuuacaggcacccgcuaccaugcccagcuaauuuuuuuuguauuuuaguagagacggcguuucaccauguuggccaugcuguucucaaacuccugaccucagguggucugccugccuuggccucccaaagugcugggauuacaggugcgagccaccgugcccggccccauuugucuuaacuguugucucacuuacacuuauuuugacaguaaacuuuuuagccaucuacuuacauuucuuggaaacaauuacucuuuuuugaacucauguuucauuagcuauguaauaauucaguugcauagcuauaguaacuuacuguaaucacaacugguucaugguaaguauaugauucagaugguggggucagaauuuccuguguauacuagagaguauccugcaaaaugcaggaguucaacaugccacauauuuuauacaaagcauagacggcauuggugaaucugguaaauugauuguguagcauacaggcugugugauacucucccauuagucauaguuuugagauuuauggcugguuccugugguugcuuagguuggaguaugguucuugugaacugaauauuggacuuugaaaagaauugauaguagaugcugaauuugguauuguuuuguucuuuacucuuauaacuugauugacucccuuaauaaaucaguauccuagugccauaucauaauuuacaaaaugaucagaggugcuuuuguaacacuuucaguguuauugauuugcaagaaggaucagcuggaaggcacaaaggauccuggcaaaauucuggugagaggcgcccguccugcugugcaggugucucuuacggcccuccugaugagauugucuucggcuucucugccuucgcaucugaugcaucccucacuuggucaccuuuuccccucugucagcugcuguuaggcaaaaucucuuccuuuguccaaguaugauucauucuuccauuuuuauguaauaaacuuuaaguuagcucuucaaauuuuauuuuauuuuuccaacuuaacucucuuuggcagucuuauuuuaccauauccuuaagccuacauuugugcugcauuaaaagccagcuguaguucuguggugagguuuauguuagcucugugaaucuagaaaagaaauugcccugaagaggaacugcugauaaaaauaaaucguaguuaagaauacuggccucaggccaaguauggcuuaaagcagagacccauauuccucauguaaccuaguuguauauguauuuaugucgaugaccuuaaggggaaguaucauuuugaguagcuuaaagaucaguauguuucacuuuaguaauguucuuuacauacuuugauauaaaguauuuaaauucuuuaaaaaggcccagagacuugcagaucaucuaggcugacccugucauuuuucaugugugaaagcugagagcugggaaauaaguauucagugucuuucaccuuacacaauaauucaugguuaugauggugaccuugagucauaagaaaagguucuucuuggcggagugugguggcucacaccuguaaucccagcacuuugggaggccaaggcaggcggaucacuugaggccaggaguuugagaccagccuagccaacguggcgaaaccucaucucaacuaaaaauacaaaaauuugcugggcauggugacgugugccugcagucccagcuacuugggaggcugagggaugagaaucacuugaaccugggaaguggagaagugagcccagguagcacuacuacacaccagccugggcaacagagcaaggcuccaucucaaaaaaaagauuauucuuaauuauacuuucagaguaagcuuuuuaugaaacuaggagagucugcagguuuuuguuuuugagacagggucuggcucugucucccaagcuagaaugcaguagcaugauaccagcucacugcagcuuccaccucuugggcucaggugauccuccuaccucagccuccaaguuagcugagaccacaggugugcaccacacugcuuggcuaauuuuuguauuuuugguagagaugggguuuugccauguugcccagacuggucuugaacuccugagcucaagcgaucugcccaccuccaccucccaaaaugcuagaaucacaguugugagccacugcgcccagccuuguaguacuuauuuuaaaaagaccaagaaaaaugaugaggcuaaaguuuuccugaugguguagaucuuuggaaaagcugaauaacccaaaugcuauauauucuauaggaguuuucuuucugaaaaauauauauuuuuaaauuucauccauuucgauuguugaguuuuugggacuaaaguggcaagcaggaauguggggaggccuugcugggaaggagccaggcuauguauaucugugcugauggauuaauaauuuccacgugggcccaggaaggagggaggaagcuucaucauagguuacacgucgucuauucugguuuuaguagugcuaaaauccuguaacauauuuuucaguauauuuuacuugucgguuguguaaauacuccuuuucaucucugaaugcuaauuuauuugcacaaaaacagcagcagggaagcccuguugaaaauaagguauuaauuuuuauaacucucuugguaaauguaccuuugcauuauuuggccucuggcauuguuuugaccuggcuuuacacaguccuuuaucugggccuccugccaccuccccaccccacauucucccuagccccuguuccucacuggcaagaccccuccucaccugccugcuguaaagcccuuacucugucgcaucaccugauuaacuucuguaauugcacucaccaccaccuggaauugcuuugcguguugauggcugugucuccuccuaaaacaaugcuucugagagaaggagaacaucuuguuccuggcuuuucaccacuaugucccccuagaacagcauucaugguacuaacugccuauucaauauguguugauaaaauauaaacauaccggcuaccuagcuucaaucugguagcuagucauuggcuuuacccacccagagaaugcagaauuuuagaauuggcucugauggcuuuaagcagaaaaaacugggcaggcuauuaggggaaaauucuucccccaaaccgugguagagauuuagaaaaaguguaauuaagacaugaaaaggauaagcguuggcauuuugcaaaauaaaguuuaauuuguaaauuuaaaaguuuaaugauugccuguuaaaguauuggcuuuugguucuuuuagcuggggcaguaaaccuagaugaagugaaguuuuuuauuuaaaagaaacuguacuuucuguacuuugaaaacugaacuaguaagauugaauuuauuuggaaauggcagugaaacuugaacucuguaagcaccucuuagguggcagaugccgugcuaccugguaaauggcugugucagguacugugcugagcaggacugacagggagcuuacaguuuagagaaugcagacauguccacaagcaacgauaguacagcagccguaaaaugauaggggaaggguaguguuauaaggccguccaugggagggauagauacguaaccgauuuugcacgucauaaaaugcuucccacuggugacaucuaagcugagaccugaaaggugaguaggauuuggucaggugaagaaagagggaagguugugacauguuuauggaauugaaaauaguucaggccgggugugguagcucaugccuguaaucccaguacuuugagagaccgcagcaguaggaucacuugagcccagaaguuugaggcugcaguaagcugugaugcaccacugcacuucagccugggugacagugagaccuugucucaagaaaagaaaagaaaauaguucaauaagucuggaauuuaucauugaagguaagaauuguaagugauaaggccacggagguguucagggucaggugaucauauaauuuuuuaguccaaacuggaauacuuucaagaaaaaagaggguacaguuaauuacacugagauaacaggcauaaacuggggcuggccuggauagaugaggauacauggucagccucuuuauaagccaugcuuauuaacauugggguuuauuuagugaacagauagauguugagcaccuacuguguuccaggcauugugcuugggcuuucuuguaagagcugugggaagcacuggaagguuugagucaagagcggcaaugcuuagugugcauguucaaaagguccuuggcgcugcaggcggaagaugaauuggagcaaggcgcagcaggugugcagaggcuggaggaggcuuuugaagugaaugaaaauaauuaaagaugacuuggacuguggaacucacacaugggauggagagaagugaguagauuguagcaguauuuagaaaguagauuugccaggccuuucuuagagguggaaaggaaugagaggaggagucaagaguaccuuucaguuucuuuuugggugaguggauaggagaaguuccaucuagaaggcuggggaaugcuggagagaaggcagggucugugcuggaaugcugaugaggccuugcuugguguguugugugcucuuggaacugcaugcaggaaucugauaggugacagauuuucaagucugaaccucaggaggaaagaucuaagaaauggacuugggauucaucaguauaaagauggcaggugacguugucagaguggauguuacccagggagaaugucuagaguaagaagaguguaggacccuggaaaacacagacauuuacaguguggccuggcuaaugccugggcaaggagagaagguggaaaggaaggaagaaaaccagaggagggcagguguggaggggcgaggggaggagaguguuucaagaaggaagaguggacagcaaugucagacgcagucaggcagucagguggguugagggccuagcauggugauuggauuuagcaguaagaaagcugccgguauccuuggccagagcuguuucaguggugucagugugggcaaggcuugacuagugcagggugaagagugaguagcagaugaaguagacccggggcauguggaaaacuucucugaaauuugaauuucuugauguuaagagaagguauuauucaaaggaauaugugggguugagggaugguuucuucuuccuuuuuaaggaugugacagacagguggguuaaacacuaaugggaaggagagcguggcgaaguuguaaucagugcguggaugggaggaguaaccaacagucccagugcaacugggugggcucacaugcacauuaucuuucgaguuugcugggggagucucuucccuuggcuucucuuuuuuuuccacuuucugaaguugggguaaaggucaugggccuguuauguaacccccaagagcucccuuaaacaaaaauuugauagugguguuucauugucaagcuccauacaucugauaaugcuuggugacuguauuuaaaauauuuuauuuuuccugaaggcuccuggcaggucacuuuuaagagcauauaucuucuuugccuuuucagcucauggcacugcuggcugccaggggcugggccugugcuggggugcaccagcugucagcugaauaaggcuaacgccauagaaggaaggagcaugcaguuaggauaccauucugguuuauuccacaauuguacauuuuuacuuauuucuauggucuuuugaaaauagugauaaggcugggcgugguggcucaugccuguaaucccagcacuuugggagacugaagugagugaaucacuugaggccaggaguucaagaccaaccuggcccacauggugaaacccuauuucuacuaaaaauacaaaaaaauuaguggggcaugguggcacaugccuguaaucccagcugcucagaaggcugaggcaggagaauugccugaaccugggagguggaggcuacagugagccgagaucaagccucugcacuccagcuugggugacagagcaagauggucucaaaaaaaaaaaaaacccuaaaauaaauaaauauaaauaaaccucuacaaaguauacaaaaucuuaguuaaaaaagaauaaaaauagugguaaaaauacauaacauaaaauuuaccauuuuaaguauaugauucagugacauuagauacauucacaaugauguguaaccauugccacuauuucuagaacuuuuuucaccaucccaaauagaaacucuguauugcauuaaacaauaacuccccauuucccacucccuguagccccugguaacccccauucuacuuucuggcuucauuugccuauucuagguaucucacauaguggaaucauauauucguuguuuuuuucuuuuugaaacggagccucacucugucacccaggcuggagugcaguggugccaucuuggcucacugcacccuccaccuccaggguucaagcgauuuuccugccucagccucccgaguagcugggauuacaggcguucgcuaccacacccagcuaauuuuuuguauuuuuaguagagacggguucaccauguuggccaagcuggucuugaacuucugaccucaagugagugaccugccucugccucccaaagugcugggauuacaggucugagccaccgugcccggccuguuuguccuuuugugucuggcuuauuucaauuagcguaauguuuucaagguucgucuguaauguagcauguauccgaacuucauuucuuuuuauggcugaauaauauuccuuuguauuuuguuuauucauccguugauggacauuugaguugcugccaccuuuuggcuauugugaaugguguugcugugaacuuuggcuuacaaguaucugagucccugcuuucaguucuuuugaguggaauuugcuggaucauaugguaauuccguguuuaacuuuuggaggaacugccaaacuguuuucuaccguggcuguaccauuuuauauucccaccaaccauugauuuaguuugacuucuguuguuuaaagaaguauaucugaauuuuacacauacuccaaaacuguaauuauuugaauuaauuggaguagaaauuaauuugaaauaaugaaaugucugauuacuggacaucaaaagcugcuuugcauuaggccaugguucucagaauucacaauccuccuuuccauuuuuuccucccucccucccuuccuccucucgcuaccauggucacucucagcuucacaauaagcacguguaucuuagggcauuugaacuucaaauacuacagcaccucacacguaagaacucuguaacaguagaccucuauuucccuuuccuguccuaugugcuacuuuuuuguuuuguuuuuuugagacagggucuugcuuuguugcccaggcaggagggcaguggcguaaucacagcucacugcagccucaaccuccuguuuaagcgauccucccacuucuaccugccaaguagcuaggacuacagaugcagaccaccaugcccggcuaauuuuuguauuuguagagacagggucucuccacggugcccuggcuggucuuaaauuccugaguuugugcgaucuguccaccucggccuccaaaaugcugggguuacaggcaugagccacugugccuggccuuuguauuuuugucauacauuuuauuucccaguauuauagacuccagaauauguuguuguuauuguuuuaaaagucaguuaucuucuuaguuuucuuucagaaaaauuaaauggugaguuuuuuuguuuguuuguuuguuuguuuugcauggcccauguauuuaccauuccuggugcucuuccuucuuuuguguggauucaguuuuccaucuaguaucauuuucguucugguaaaagcauguuugacauuuccuguaguauugcuuugcuggugacacauucuuccucagcuuuugucugaaaugccuuuauuucaccaucauuuuugaaggauguuuuugcuggguauagaauucuagguugguaguuuuuguuauuuuucagcauuuuuaaggugacauuuggcuuguacauguuguucuugagaauucugcaguuauucuuuguuccacuguauguaauaauauauguuuuucuccuuucucugauuuuaagguuuuucucuuuguugcugauauucugaaacuugacuaugaugugucuuugugugguuuucuuugugguuuuuuuccuguggaauuuauucaacuucugggaucuguagguuauaguuuucacaaauuggaaauuuuugacauuacuucuucagacacuuuuucugucuuccccuccaucauucugggauuugaauuacauguauacaguaacuguuguuguuucauaggugacuaacuggguaggggaaugucugguucccuuacuauccggugaaguagcagaaccaccuuuuguaggaaucaguuaucaggcccuuuacuuucccuugaacucuaggcuaguuccagaaccuuugguggacuggaaagaggaaauaguuaugccacaauuuuuaguacaugcaaauguacauguaauguuuaaaaaaaaaaaacaacaaagguggugauagccugcauuuacugggccauaugugccggucccuauucuaugggcuuuauuuuuauuacuucauuucuccuuugugucacaaggcacaggcaguuugagaccaagacuuuaaggaauugguccaaguuuucaagacuggugaaacaguggugugaggauuugaaccuaugugccuggcuucaaagccagcuuaucauugguauguugccaguaauuccauuuccucccccuuuggggaagaagugagaccuuguaaauacacacacuggugagggugugggagauggguacucucaacugggaguaaguuucugccaguugucucugggguuugguauuugcuacuguuugauuuuaaacuuuacuauauuuguauuccugucuccccacccccagugagcaugcaguuuuacaauugggaaaagcaauaaagcuauuuuaauuugggggcugguggugaaguuauuuucuuagccacagcaaaguaaguuuuaaugugccuugcccuaggcguuaaauaguggguuaguaaccuugcagcugugauaaagaacaaaguagcuaugcugaugugaagaguccuaagagaaaauaugaauaaauaaaaguccuaaauaaaugaaauguagaagagcacauaagaaauguuaagaguauguaagcauauacugugauucuaauugcuucugugcaugugugugcuuugacuaguuguguacaugcaaacacguauggcaaauuuauaacauuuugagggauauuuuaaaaaucagcacuaaugcccuuuggcacuuuuagaaacuguuccuuuuuaacuucauuguguugcuuuuguuguuguauuaauaaaaguguagguauguauuuauauacacugaaauuauugguucucagaaugaaaagucuaggaauaugguuuacccccuuuuauguggccuuuaaugcagauucuguuugccaucuaaucugcuuuuuaguuacacuuuggaguguuuugugcuuuguuauaaucagggaagcauucuuucauaaauuuugauguuugcaacaugacucugagcauccuagguagagacaauccaagacagugcuuuaaauuuuuaauuuuuuugacgggauaauagguucauguuaaaaaaaaaaaaaaaaccccacaacacuacaaaagggcaaaaaaaccccacugaaaauuccuuuccuaucucuccucuccuuuagccaucuucuuuccucaggggcaguguuacccauuucuuuuacauuguuaccgagauuuccugugcauacacaagcaaaugcauguacugcaucgcugggcccucuuucuuacacaaguggugugccugauuuguuuucucacuuaauacauauauauuagagaucauuccacaccagaaaaguaagcaaaucuuguucuuuuggcugcgguauaguacuccguuucgcagagaucccauacuugaugaacuaguccugccuuuuagguuguguuuggucuuuugcuauucuggguggcauugcaguaaauaugaauaaccauguauauaugucaguuugcaaaagucuauuucuagaggauaaguuccuagacuuucucguuaagauacauguguguuuguaauccugauaggcauuaccaaauugccucuucuguuagcgcgauguaaggauaccuguuucccuaaaccuuaugcccuuaccagcaugguguuagcagaguuuugcuuucguuuuuugguagacugauaggugaaaaauaaacuguuucauuuuauauucuuuucugaguacaguuuuacauuuuaaaaaccauucuuuucuuacugacucguacucuuuauauagaguagcaggagcaaucuuuagucuguguuaugaauugcagacauuuuccccagauugucauugauuuuuguuguuguuguuuugagauggaguuucgcucuuguugcccaggcuggaguggagugcaguggcacagucucggcucacugcaaccuccaccuccugaguucaagugauucuccugccucagccucccaaguaguugggauuacaggcagccaccaccacgccaagcuaauauuuuuuuguuuuuuuguauuuuuaguagagacaggguuucaccauguuggccaggcugcucuugaacgccugaccucagaugauccacccgccucggccucccagagugcugggauuacaggcgugagccaccacgcccggccugucauugauuuuuaucuuguuuauguuggcuguugccaggcggguauguuuuauuuugggugaagagacauuucucccauucucccuguaaaagacuugucgauuuuauuucauaaagucuccucuacugcaagaguauuuuuagaaauucuccuaagauuuucuuugguguuuuuuaugguuuuuuaaaaagacauuuuauuguggagcaugccaaacacauucagaaguagaagaguauaauaaagcuguuuguaaccauuauccaccuuuggcaacuaaccagcucauagccuuauuucaucaagaccccaucagugucucuugcuccugcauuauuuuugaagaaauggcagguauuuuaacacuucaucuguaaguauuuucauguauaccucuaaagauggggaggaaagaggaaagucuuuuaagaauauaaccacaaugcugcuuugaucccuaaaaaaugaauacuuuuaaauaucacaguccuuuaagaauucaaauuucauaaucauuucugcaguuggacucagaauccuaauaaagucugcauauuacuaucacgaucaaucuucucuucauuuauagguucccuuaccucacucccaacccuuauccccuacuuguuuugucuuugggacguauuuguugggauggauuucuguaguaccuugauuucuuaccuuacccucauuacauaguuuaauauauucuuuuguauuucuuguuacuaggauuuagagggugaauagauucacauucuuuuuuuuucaaguauauuucauaagcaggauuguauuccaucagaaggcaaguaaugucugcuugucuuugugaugcacuaugcuuagaugaauuaaaucuuuggggauugaaaaaaaugaucucauucuauuauuccuucauuuaucagcugaaaugcuuguaaaagagaaacuuuuaucuacuacuugguuacuuaauaguacaguucuuaaaggauaaaugguugauuuuuuugccuuuauuuaccaguugucaaaaugaauucauuuccuaccauucuauaaugaugaccaauuaguuuuaucaucaugaacucaugaguuuaagcaaauuuaauguuucaguccauuguggucauuaucccuauugaugcuuguauucuuccacauuuggacagcaagcucaucuucagguugguaccugugucuuuuugacacaaccaguaggcuuugcuaguagugucuuugauaaucugauaggaaaagauguuccaggcccaucuuguauguuuuauaugggauucuuguuuuuucccacugaaaccuggagucaacuauuucucuaaguaaaucugguuccuuuuaaugaaaaaugcugcucggaauucccaaucugggcacuagauaugugauuaccuuuuuuaaaaaaaaauuaaucuuugacccauuauaugauuuauuuuguugggagaagugagguaggaauucauuuuuuuccuucagauaguuacuuauuuguucuaaaacaauaaaaugccaucuuuaucauguuaccuacguuucuauaugucuuugggacuuguuguggacuucguacuuuucuaguuuuuccuuguuuuuuuuuuuuuccaugaaaaagauugggggccauucuuguuuguuuauauguccaauugaauuuuaggauuaguuuguccuguuucagaaaaaaaaaauccuauuuguauuuuuauuagaauuauugaaggagaggggagaggugcuauugaugauauuggggcuucucaucuaaaaauauggggagacucuuugaauccauuuguauuguauaacaaacuaccccaaaacuuaaugacauaaaacaacaaauacuuuguauuucuuacaguucuguggacugacaaugcgugguucuuguggucuggagagcccaucugaggcuggauagucuuagguggccuuuccuucauguuagggucucaccuuacacagcuaggaugaugcgggccucuuuccauauggucucggaucugcagaguuacuaacccagccagguucagugguagcacaggugauccuggcagcaagagauggcagcccccaccccauguauaagugcuuuucaugccuauguuaguaucacauaugcuaucguucuguuggccagaguaagcacaugaacucguccggagucuuuuuucuuuuucuuuuuucuuuuuuuuuuuuugagauggaguuuugcucuuguugcccaggcuggagugcaauggcgcaaucucggcucaccgcagccuccaccacccggguucaagugauucuccugccucagccuagcgaguagcuaggauuacagggacguauguuuaguagagacggggucuguccauguuggucaggcuggucucaaacuccuguacucacgugauccgccuguuucgacuucccaaagugcugggauuacaagugugagccaccaugcccggccauuguccagagucuuaaugggaggagugacaaagucauauugcaaauugguauugauauaggggugggaggauuuacuguggccauuguuacaaucuaccuugauguauuagcauguucucacacugcuaguaaagacauaccugagacuggguaauuuauaaagaaaagagauuuaauggacucacaauuccacauggcuggggaggccucacaaucaugguggaaggcaaaggagaagcaaagggacaucuuacauggcagcaggcaagagagcuugugcagggggacuccccuuuauaaaaccaucagaucucaugagacuuacucacuaccacgagaacaguaugggggauaccacccccaugauucaguuaucuccaccuggcccugcccuugacacaugcagauuauuacaauucagggugagauuuggguggagacacagccaaaccauaucacauacucuccauuuuuuccaauuuucuguguuauuuaagaaauucuaaaguuuuuuuccagauagguuuuacacauuucuuaaguuuauuccuaaauauuucaucuuccgccauuacuguacaugaugucuuuuuccucucauuuuaauuuagaauucuuggacaggugacauacacacacacaguuaaaauuaaaugauaugaaaagaaauauaaugagaaacgucacuuccacuuguguuaucacugaguuucuucucccauguuucuaggugaccaauuuaaaauuaauuucuuguuuuauuuaauguuucuuuauggaaauacuggcaaauauaaauauucugcucaugaaaaagguguagcaugcuauaugcccuguuccauaaguuaccuuuuuugaccauguauucauuccaugucugaguauauagauuguucucauucucuuguugcuguauaauauuccauuuugacagcauagccugguuuauuuaaucaguugccuguuaguagaagcuauauugggguagcauuccuuagcaucagauuugcagaaaucgaaaaguggagugauuuauucuguuugugaagcuguagaaaaauguuacuuucguauauaauacugguagaaguuuaaauaguacaaccccaaauuguggccguggggaucuggcaaugucugccagauuaauuugucucucuuagugugugagauugagcguuuugucaugcauuuaagggccauuguauucuuuaaugaacuguuuguuccucugcccauuuuuguauuagguugcuggucuuuuucuugaguuccagaaacucuuuauguaucagaagauuaacacuuugugauaugaauugaaaauacucuuuccuuuaugacuucugcuguauguuaagacuagugauuuuuacauaauuuuguuccgggucauguuauaggagucagcaaauuuuggcccaugaacaaaaucuagccugucaugugcaguuuguaaauaaaguuccacuggaacguggccauauccauuuguuuauauauugucugugguggcuuuugcacugcggcagcagagacagacugaauggccugcaaacucgaaaauauuuacuaucugguccuguacagaaaaaggaaaagcaaccccucauuuaaagcaauaaaaucaaaguguuuuguaugauacagccauuuugacauggccuuaaaaaaauagccuaggcaacauagugagaucucgucucuuuaaaaaaauuaaaaaauaaaauauuagccaggagugguggcaugugccuguaguccugucuaucaggaggcugaggcaggagaauugcuugagcccaggaguucaaggcugcagugagccaugauugcaccacugcccuccagcuugggugacagagcaagaugcggucucucaaauacaauaaaauauccaauuaaauucaaguuuuguguguuuaauuaugaaguaaggcacagcacaggcagucacacguagguuucagaaguaucuguuuugacacauuacuugguaaucgugaugguacaugugauauggccaguugaugccaccacaucaaaucacuguuaagauaucuuugucuaauuguucuugugugcaccgcauauagaagcuuugaucugggugaguguggguagaaugacucuuaaaaucaucccaaucucuagaaguuugguuacaguguagccucaguuuguauuuccuguggucuuaaguacuuuccagagcuguucugcacgagugaacuacagagagagggagagcaguuuggaagaguaugguacaauuugauuuauguauuuuaaguacucagaacucugcuccccuagaauuguacagucgccuuuuguuacacucagauuuaaguuuacacuaaguauuucuugggaauuuguaauucuacucagggaauuucuauuuacauuucuguuugacuuggaaauuucccaaacugcuugucuaauugaccaucaguuuaaaaaauuccucuaagugcauuuguuucagaauaacagauauaaaccuauuuuaggaaaaaacauuuuuaaagaacauaucaauuuaccaguaguuuauucuugaaaauuuuacauacagaauauuuaaaaauuuuuauucauucucaauugcugcuaccaauucuuuuuagaaauuucuucuguuuggaaaagaucuuuugcuagaacaacuguuaaaauguucuaucaucuugacuauacuuuugaauggauuauuaaagaaauugcuucucaacauuuaaggaaacuucauuuccuucuuuggaaauuuuaagagcaacauucugagaacaugauaauuaauugacccgcauccccuuggagcuucuuaucuggugcagcugacuuggcccugccauaguuuaacaguuugaauaaugacacuggugaaacuguagaaagcgugcucaucaggcuuuccgaugacucccagcaagaaaagauaagggagaauuggaugauggcuucagaauucagaaagcucuuaauagguuggagcaguggguugaaucuaauagcuugaaauuuuauagcgauaacuauaauauucuguauuuaguucacauaacaguggaguaagcgcaagguugagcaaaagcuguggaaaucacugauaugcaguagucccccuuuagugacgggggauauguuccgagaccuccagggaugccugcaaccaaggauaauaccaaaccuuauguguguacuauguuuuuucuauauaugccuaugacaaaguuaauuuauaaauuagauacaguaagagaugcacaagaauaacuaauaauaaaauagaacaguuauuauaguaugccagcaacaccacucuugugcaucagggucauuauuaaguaaaauaaggaugaccugaagaugagcacugccauaccugauagucagucuacuaaaugggacggcuacuacaugacagucaggugggcagugucuaugguguagagaugcuggacaaagggaugauucauguccugagugggagagugugagauugcaucaugcuacucagaauggcauggacucuaaaacugauaaauuguuuauuucuggaauuuucuauuuaauauuuuccaacugcauuugauagcaguucacugaaaccgaggaacgugaaacuguggaggagggacuacuuauauugaaaagcauuuaugccuucaccauuuagauuaaggacaaauacaucaacauauguuaauagcauaauaaugcucagggucugugaaaguaaguucuguuucuucugaugaucuuaauaagucaagauaagauugaggaagacguuaaauauuauacaauuuuguaagucaugaaugugcuuaaguuaaacaagcuugccauuuaaagagguaaacuaguuauacauagaaauauuaccuacucuuuaugcaaaacuucacuucucgagggugucaaaucauucuuucccuggaauuucugaagauuuacauauuuuauuuuuuaauuguacuuuucuguuuuaaagaugaggagcaacacuguugaagauuuacugcuuuuuucccuaagauguaauugugauuuauaugcaaucagagagguagauacuuaagaauggggccuuagcuuuugcauucuaacucccauaugaacuuuuuuuauugccaggguuuugugaauuuuuuuuccuuccuauuuugaacuguuuuauucucuauuguugugcauuuuaggaucuaguuuuuugguuuucauuuuugcuuaauaaauacagguaguucuuaguucuuauggccaguguuuuuuuaaauuagaauguuuccuuaauaaauucuuugguuugggguuauugguuuguauuaacuuggacucucuagguugcaagugacaagauguggacugacaguuuaauaagcucaugaggagauacauuggcuccaguaacagagaagucuuccauggggagaaugagugucaaguuuguccuucaaacaggacacuguuucucuuugucauucugugcuacauugacuucguuuuucagacagacuuucuccacaccucagccaguuagccauugacagcaauaccagagagaaggagcacuguccccaacucccauaccaaagagcucugagaaagaauucugauuauccaguuuccaaaaggaagggauguggggcagacagaauaacagauauguacaacauaggucagauagaauguguauggucauacuccucucuuuucucagaagaggagguauguguuaagaauggauuaugcacauugugggcagaugugugcuugcacacuugguauucuagugucuggagcauugaauggagagcuuugaauccacuaauguuuauuuuacugauaaguagauuaguaguuaauggaacagauacgugagauugaugucuaguagccauucaugucaucuguaauacuuuuugaaaggaagagauuaguugugguugacaauauauauugaauauauaguuuggaguuauccacugaccaggacuagguggaaauuuagcucuuagaaauaguugaagaaugaguucuugaaguauagcuaauaguggaaaaugcaguauaggaaaauggaccauuucuuucaaagaccacauggaaaauagauggcaguugggguugaggccagcaccucugucuguuuggauacuguuagugguagacaagaggggugagaaggggaaagugagaaaacagguggaggcaaaaugcaaggauaggaaagagaaaagaggggugcugggagaugacgcccaaaagcuuucaguuuaauugaagcuuuagcaucucuaggcugaauggucaauauguuuuuuuauugacauguuauacuuauuuggagauaugguuauuaaauccuuuuuucuccaaaauuauucucaguucagauuucuaagaagcaucuguuuaagucuuaauucaguguuuuagauaaacuuacaagguuuauaaacauuuuucugugaauguccuugucuguuuugugcuuacaacaggagaucuacgacuggguaacuuauaaagaacagaauuuauuccucauaacuguggaggcaggcgguucaagaucuaggugcuggcaggguagggcccggcucugcuuccaagauggcgccuugagugcucccuccuccagggguaaggguguuguguccugacacagcagacgggugagcgagaguaaacccacucccacgagcccuuuuuguagcaguguugauccccucuugaggacaaagccuccgugaccuaaacgccccccauuugccgcaccucccaauaccacugccuuggggguucaguuucaacaugaguuuuggaggguccaaacccucuaaccuuagcagugaguaagugcuuaguaauauuuaagugugugaggcuguuuccauuucuuucuuucucacuuguuucacauucugcuucacuacauucuaaguuuaguaaacaagaggcuuagguauucuauauuuggaaacuaauuggauucagcuggauuuuuaaaaauuucagcaggauucuugaggaccaauaacacaacagcagguuccucaugcccgugaguguggcuuugcuucucccaggcuccacucugagggcucgcuuccuuccagcccguccccugcccgcauuucuguccugucuguccucauggcaggaaggauccagguugaugcaauguguuuuuaaaaaacaccagccgggcaugguggcucacaccuguaaucccaguauuuugggaggccgaggcgggcagaucaugaggucaacagaucgagaccauccuggccaacguggugaaaccucgucucuaccaaaaauacaaaaauuagcugggugugguggcgcaugccuguaaucccagcuacucgggaggcugaggcaggagaauugcuugaauccaggagguggagguugcagugagcugagacuugccacugcacuuuagccuggcgacagagagagacucuggcucaaacaaaacaaaacaaaaacaaaaacuaccgcagccaggcaugguggcucacgccuguaaucccacacuuugggaagccaaggcggguggaucaccugaggugaggaguuugagaccagccugaccaacauggugaaacccugucucuacuaaaaauaugaaaauuagccaaguguggugguaggcgccuguagucccagcuacuugggaggcugaggcaggagaaucgcuugaacccaggaggcagagguugcagugagcccaaauggcaucacugcacuccagccugggcaacaagagcgaaacagucucaggaaaaaaaaaaaaaaaaaaacaccacauaacaugacaagcagaauucuguccacuuuugcagccaugucaggaaaacaccucagcauggcugcuuuguucuucaugacgcccugaggggagccguccugcuggccugggcgcccugccaugaucuccacucgggucccagccuccaaggauggagguggggagcugcugggaugucuugacucacaggcuuucccaccauuuguuucuucccaacaguuuacuaggagaaauuucagacauggagaaagguuggaauugaauaccauagauccaccaucuagauucaguaccugcuuugucacauauucguccaucaguccaucuuacuauuuuuuauguauuucaagauagcauuuuggcuuuuuuuucuuagucuguuaucacuaaauaugaaccuuuauucucauuaaaauaauuucaggcaucauuaagcaaauacauagaaagggcaauggccaacaaaagggccuuucaaguucuugccauaugguggguguucaguaaauauuguuaaauuagugcacuugcauuagcccuguuagacuagcccugucgcuaaacuugaauuugccuuugaggacaaacaauuacuuuuaaaccauauguuuccuaggcgcaugugauccccaguuuauaggauggacuugaggaagauagucugugaaagacaaucacuuagaauuugaaaaggauuuaaauuauguauuauauauuauaaagguauauauaaaacauuuuaaacacauaccuuguuuuuaccacggugauucucucuugggauacaugcacagcaguguuccaaggagucaguguuucuggacccugucucaaggauccucuugaggaagagccugcaagagcagucccuccuuacuccagccagaauagcuuuguccuagucugucuuauaugaaauaaaaauuucauuuagggcuggucauaguggcucacaccuguaacccaaauacuuugagaggaagaucucuugagcccaggaguuugagaccagccuaggcaacauggugaaaccuuaucucuacaaaaaauacaaaaauuagcugggcaggguggcaugugccaguagucccagcuacuggggaggcugaggugggaggauugcuugagccugguaggucgaggcugcauugacccaugauggcaccacugcacuccagccugggugacagagugaaacucugucuggaaaaauaaauaaauaaaagcuuuuauuuuaaggaaacguuuuaaaaucauggcuguuuagguaacucgaccagcacacacugcccuauguaagucuugguaugguggaagaguacccaaaucuuaaauuucugaguuaauguggcuaaagaugcugcauuaucauucuuauuagauaaggagcagugaacauuuuaauagcaagcgauucuucuaaagaugugugaaucuuagaugugugugcguguguguaugucucugucuucaguuucugagagucaguguucccagaaugaacaguuuguguauuuccacuucuuaccuccuaagagaaagaagauagucuguuguuguuguuaaugaaauagguguuuguuuguuuguuuuuuuaagagacugcagggucucacugucgugcaggcuggagugcaguggcaugauccuggcuuacuguaacuuugaccuccugggcucaagcaauccucccgccucaguuuuuucaguagcugguacuacaggugcuggcuacaaugcccagcuaauuuuucuuuaauuuuuugguagagauggaaucucgcuuuguugcucaggcuggucucgaaccccuggccucaagcaauccuccugcuauuuagucucccaaguagcagggauugcaggugugagcugcugcacucaaccaaaauagguauauuucgaguaacuuuuuuaggguugaucucuaaaugcaaugugggcagcugccagaaaccuucccugccuccggaacagaacagggcuaucaccguugguguuauucuuccucagaguagagcagaugagucauuuugguaaugucuuccuuucuuccaaaacagccacagccacuaucauguuuguaccagcaugcuuagaaagugaacuguacaccuuuuguguuuuuacuacucuguuuguguuuguaacauccucuuuuccucuccacuccugauaggcucggguuauguaugauuuugcugcugaaccuggaaauaaugaacugacgguuaaugaaggagaaaucaucacaaucacaaauccgguaagagaacuguacauucgagucugauugucccauguggacuuauuuuuaacaaauccgguaagagaacuguacauucgagucugauugucccauguggacuuauuuuuaagauuuuauuuuuuuguaaguuaaucauucaaacccacaugauuuuuuuccuguugcuuaugaaauauugauggugaaguaagaagcuguuauauaaauacaggaaaaaaguucccuaaagacaguuauguauguaauugaguuuauuaugucugcuuauuuuguaucuucuucgauauguuuaucuuacaauuuuuuaaauuacuuacaaccuuuuagguaccccauaguuguccuggaacaugguucaguguguuuaccccuagcaugauaauacuguaucucuagaauaaguaaaagaugauggugauuuuccuaaaugucuuaacugauugauccuaucaucauuuuucuaagcucuuuuccuaaaucagauuagguugccagaaagcaauauacuuagaccagcuccaguggaguuagcucagcucccaguggaguucucuuugcugaauuacaaguuauugccucagcuuuuauucaaacaagaagcaacucuauguauaaaaagcauuucugcaucuuuaccaaacccuguuugaaauuguguacauauacauacacacaugcaucuucagguacacucauauguauacauauguacacauagauacacucaucuucagaugugugucucugcuuauauaacuggguuuauuaugcccucccagagaagcaucuaugugaucucuuaucucagguucuuucuccuggagauuggguacauuuuguuucauaaagucaaaucuuuguagacuauuggauuucuguuauggucuguguugucaggaagcuuagaggcaaacauaauauucauuuguguccaaucuucuuugcccaagauucuguuacaguuuuuuccauuauuucugugugauacuugucucauuacauuuaauuguccuuuuuacauguaacuuuauuguaacuguucuuaaaauauguagcaaaauuaugagaugaacaucauuugaaauaauguaacaaaaauuguaucaauuaauaguauuucauugcaggcuuauauagauggagaaggaacaaaagcagauagggagaauuugucuuuguaaacugaguaaaacuugaacccaucguuaccugcuuucuucaccuggcugauuucgugacacugcccugugcaugccuguccuugguccacgccuccgccucugggccccacacugcaacgugucucuucuguguccucucccucgugaccgucacucauacuuaaugugugugcagucuugggagagguacccuggagauacaaagacaggaaaccuggcccuugcccugugcuccuuguuuuccagagaggucugcaugccaguguuucuuacugaauguuuccagaagggaacuuguugugucugugcuguagaacauguuggaucccacacaccucuccccggccucacuggcuguccucuugugucccuccccucucugccucacgaguguugggguucccacgucauuccaccuucagcccauuucuuuacacuaugcggucucagauuuuuguauugccgucucuguggugaugacuuuaaaccuguaucugcagcuuccuccuguggcuccagccucagaggaggccagacaccuucaccuaguuuuuucacaagcacuucacacugaccacguccagacucagcucaucacccaugugaugcucagccuacuccuacuucucuguauuucucuguauuucuguuguggcgccuuuccauucagugaaccaaggcccccaaggcuaagucacuuaaagccauugguuucucucccuagaguuuuacucuguccagccucuucucuccacccugcgcuuccugccagcgcccugagcuaagcucucauccucuugccuggaccaugcaccuuccucacuggccuugccucaagcccagggucugucuaaacggccaguguggccaggucauuccucgcuggcagcauuuucugucagcuguaggucugugagacaccccaccaugggccccaucagaccucgccagccuuucccugugcacgugcacaggcacacacacgugcacccauguacguacucucacgcacucucucacauuaugcauacccccacacacacucgcacacacccuuaugcgugcacaugcacacacaugcgcacacaccucgcacccucauacaccucucaugcucucauacacuuuacauacucuuucacgugugcacucuuacacacacguaccuucucacucucaccucucaugcacacccacagucgcaugcucacacacauaggcagcacucacacgugugagcacgcacacacacccucuucacucucacuugcccucauccgcacucaugcugucacacauacaccugcacucacacaugugagcacacacaccccucacucaccugcucucaugcacacccacacucaugcucucacacauacacauaugcacucacacaugcaagcacacacauccccucagacacucucaccugcucucucacauccccacgcucaugcucucacauaugcacucacgugugagcacgcacacacaccuacucucucaccugcgcucacacucacacucaugcucucacacaugcagcacucacccgugugagugcauguaccccucagacacugucaccugcucucacacacgcacacucacaugcugucacacagaugcagcacucacccgugcaagcacauacacccugcagauagucucaccugcucucacacauacaugcacucaccugugcaagcacgcacaccccucagacacucucaccugcucucacacauauaugcacucacccgugcaagcacacacaccccucagacacucucaccugcccucacacauacccacacucuccugcucucacacagaugcagcacucaccugugcaagcacauacacccugcagauagucucaccugcucucauacauacaugcacucaccugugcaagcaugcacaccccucagacacucaccugcucucacacauauaugcacucacccgugcaagcacacacaccccucagacacucucaccugcucucacacauacccacacucuccugcucucacacagaugcagcacucacccgugcaagcacgcacacaccccucagacacacucaccugcugucaugcacacgcacacucgcaugcucacacagagcuccuguggaaggagagagugagaacuguggcagugccaagaucgaggagggagaaugaggaacggcagaagugaugguaguuuuugaauagugagcauauuuagaaaacguacuuuauaugucuuggauugaaaaaagaaucggccaggugcaguggcuuacacuuguaaucccagcacuuuuggaggccgaggcagggggaucgcuuugagcucagcaguucaagaccagccuuaguaacauggcaaaaccucaucucuacaaaaaauacaaaaauuuagccgggugugguagugcgugccuguaaucccagcuacuugggagacugaggugggagggucacuugagcccaggaguuccaggcugcagugagccaagauggugccacugcaugucagcuugggagacaaaaugagacagugucucaaaaaaaagaaaaucacuggguagaaaaagauuauguaguaauuuuguauaauaugcuaggugugcauguucucauucauaggugggaauugaacaaugagaacacuuggacacagggcggggaacgucgcacaccagggccugucgucgggugggaggaggggggagggauagcauuaggagaaauaccuaauguaaaugacaaguuaaugggugcagcacaccaacauggcacauguauaccuauguaacaaaccugcacguugugcacauguacccuagaacuuaaaguauaauaauaauuuuuaaaaauuuuuaaaaaugcuagauguguauaaguuaaauagauucaguuuuaaucauagcagagauuaaagauucuucagucuuaccuuuuuuuuuuuuuuuuuuuugcagacaggcucucacccugucacccaggcuggagugagguggugugaucuuggcucacuguaaccucugccuucuggguuuaagcaauucucaugccccagccucccgaguagcugggauuacaggugugagccacuguacccagccucaucuaauuucuuuauugaaguauuuaauuuuucuugguaaaauagcaacuuguccucaaguugcuauuguggucagaaagugacaaaaguuguggcuuaaagugauuuuuuaagagaaugugauuauucagauucagauuauuaacuaauuagggcauuauuuuaaaacuguaaaaacucuuacuauguuaagaugagaaagugggaccugccccuuaacauuguuaauaauuaauaauaauaucaacauuaauaguuuaauauuuagauaaaguuucuuccaaggauagcaacuucuauucugaauaaaaguuacaauuuuuccuuugaucauagauugaaauggcaauacugggauauagaguucuacuuuauuacuuaguuuauuaauauuauuuauccagaagaacugaggaaccauggaucaguucacuuuuucugcauaacaauccuaaaacuuacuaguuuaacccaguaaccauuuguuacugcuuaggaaucuacaagucagcuugaugguucuccugagcugcacugcgugugucugcaaucacuggacccugcuggggacugacuggucuaagguagccucacucaugagucugccaguucucuggguuggcuggcuuugaauggggcaacagggagacugggucucugucaucaucuagcaacccacauuaauucguauagcgacuugggugccagaagagucagcugaagugugcagaagcccuugaggcaagguucuggauucccuggaggauuuccacuugauucuguugaccagcgagguggcagagggcagauuccaggccugggaugcgcaucccaccgcuucacauucagagcugcaagccacuuuuauuaucugccgcagaccaguacacagacaagaugagggucaucuaaucaucagcuguuuucaaucuuugaucacuuauuauugaaguuugauuuuucuuguuuuuagguuacaucauuuucugaaguaaagagaaggcuuaagaauuuaagauuuugaacgguguucucuaggaaugaaaagcuuaauguuaauugcuuuuuuuauguauaacaauuccuccacacaaaauuucuccaggaaaucucaacuguaaucuuuuucuuuuuuuuuuuuuuuuggugacuuauuaggauguagguggaggauggcuggaaggaagaaacaucaaaggagaacgagggcugguucccacagacuacguugaaguaagagcuuccugucauucauucauuagagcucaucuuugccaggcaucuuuuuaugaauuaucaacuuacaagaagucagcaacuuuuugcaaaacaaaauuuccauuguaaauauaauaaauguuaacuauauaaaauauggaaacuacauugaaauagaacuaagaaaaauauuaccuguagacccaagcuucaaagaaugacuacagauauuuagguuaaguuucuuccagggauagcaacuuuuaauuggucugaauaaaaguuaguauuuuuccuuugcuaauauuaucuauauuauaaauauauauuauaaauuguauaaauucaauaagauauaugaaauuauaucucaauauaucuguuaauauauacauuuuaaauauauauuuauauuuuuauaagcaaaauauauaaauuuuauaaaauguauuauaaauuauauaaauuauaaauauagauauauauuuauaauaugacacauauaacguauuuuuccuuugcugauauugcugccaucuauaauauuguuuauuguacaauagacucacaguuuaaauagauuuuuuuaagugcauaucucaguuccuucucccauucccauagacagaggggugucuugggggagcugcuguggggaucuccuggguagagcuguuaggauggauacccaggagagcaacacagcagccugggcugguccugccugggacacccccaagcugagccaaccaccuggcgcccccugcugguugucuuucggucccuccaaaccgagcgaagguucuugguaagcuugucuuucauguugggugacagaaagaagcgaagguuuccugaugcccugugaguacaacuggagcuagaucaagaauaaagguaccuuugguucaccuccaggagaaaagaauuccccccagaggauguuuaccugggaccugucugcagagugagaucuaaggccguccuucuguuguugauagacagugaggguggggagucaugaccccucagagaauccgaugcaaucucuaggcuuucccucagaaacgugugcccaugcacacaccacagccuuuuccauacaacugcaacccccuauucacaggccccuggccucacuccguaggucuuauguugaagucuuguuuuacuuguaugcacuuugcauccaggagcccacaaauugacaagauugagaaaaaucugagaauuuaaguugauauuggcaguaauuggauuuucuaggauucugcuuauauaaaggaauagugauuacagauauucuuggguuugcuuaccuuuaagaauauaaaacccccucuauuagaaauagauccugcaggcagaaaaucaguaaggacgugguugaacucagcaccaucaauaaauugauguccacuuagggacaucuauagacugcuucaucaaaccacagcagcauacacauucuuuucaagcuuacauggaacauucucuaagacagaccacauauucugagccauaaaacauaccucaacauguuugaaagaaaucauacagugucugcccugagaccacaauggaaucacacuagaaaucaaaacagaaagauagauggaaaaucuguaaauacuuagagauugaacaauccacuucuaaauaaugcauggaucaaagaagaaaucucgagaaauuaaaaaauaguuugaacuaaauaaaaaugaaaauacaacccauuaaaauaugaguaugcggcaaaagcagugcuuacagagaaauuuguagcauugaagaauauaaacccuuuuugacaauucuugcuugcccucgaagacucccugaagugaccguaaucuaugaaaauaauugcggcucuuucuccuauucagauuuuacccagugauggaaaagaucaauuuucuuguggaaauucaguggcugaccaagccuuccuugauucucucucagccagcacagcucaggccaguucgucggcugccagcaacaaucaccagguacgucucacuuccuccuucuggauguggcuggcuuuacggaaaacagagcguauuugugaaggcuugugaugcauuauagcuauugccauuccccaaaagcaaaaacaaagucgcuuuuagguuguucuguggcauuucuguuggguacuaacaaagaaaucaccuguuaagccugauaaugacuguuugcaaaauuuauuauaagagaaaaggcaggguauugaggguugcuuuuagaagucugucaugauaugaacacagaccccagaaacugcaaauacccucuuagauaaaggcauggaaagaagaggaagaagaggaggcucuuguuguugaggaggucagugucagagccucggccuggaucaggaaauagaugcccuggcccuggcauguugcuuacacucucagagcuagaggcccucauccugcgaguagaagcagugccugugaaagucuaccagauccaggcacucagcacuugguacucuuauuguauugcuuccaggaaacuuagaauagugggauaacuugagaagaauacaaggaaauuuuacauuaauuuuaauuaaaauuugacuaguuuaggugaauuugucuaguucauuuauugccaaaugaugacacagaguaagugacaagaagaaaauugagaagacagguaucaaaauauuguugcugcugggcacaguagcucacgccuguaaucccagcacuuugggaggccaaggcagguggauugcuugagugcuggaguucgagacaagccugggcaacacgaugaaaccccaucuccacacguuaaaaaaaaaguuaaaaaaaaagaauuaaaauauuguuaacugcuuacaucuuuagaaaugaaugggcuuuaggagauguuauuucuugauuuuuuuuuuaacuacauaaaagguuuuaaauucuaucaggccugaugauaaucauaucacuuacaaguauuugcuuauaaaauaucuguuuauuagccaggcacaguggcucacgccuguaaucccaccagcacuuugggaggccgaggcgggcggaucaccugaguucaggaguuugagaccauccuggccaacauggugaaaccccaucucuacuaaaaauacaaaaauuagcuaggugugguggcaggcaccuguaauccaagcugcucggggggcugaagcaggagaaugacuugaacugggaggcggccacugcaguaagccgagaucgugccacuguacuccagccugggcgagugagacuccucaaaagaaaaagaauaucugucaauugaccuuccaagugaguuuauauaaguuuaucaccauauacuaacugcagguuuuauacauuucaaaacagcuuuuuguagacauucugaauuacaaauuagacucagauauuuaaaauuugcaggcaaggugauugaucacuguaauugaagaauucucuucuguauuuuauuauucuauacuacuugagaacauuggccagguaaggguuacucacugugaaacgugaauaguaguuauaccucacuggaaguuuucccagggguucucaaccugagccucauugccguuugaggccccgcgcccuuuccuaguggggcgggcccauccugggcacugcaggauauugagcagccuuccuagcuucuaccuaccaggugccagucacaugcacgccaccucaguugugacaaccaaaaaugucuccagauauagccaaguguugccuaggagcaaagccaagccaguugagauucacugaguuauacagaagcacccaugaaauggguuugcauuaauaaaggacaagauuuuaauaaaagaauuguaaugagguaaugagaucauagaauaagugaggcaaacaaaaaauagaaauauuuaucuuauuuuaauucuagggacugaccagcuauuaucucaagauagguggaggcaguuuagcuaaugaaaagaaauuaaaacucagauuuaagucauguucuguuaggaaauauauuccuugguauuuacuuguaguuuaauauaaacugguauaagucuaaaauuuguuucguuuagguuauuuagaagguaauaaaagaaaaaaaaagcggggggggcaucuagucuaacauugaaucuaaucagauccuuugaaagcaaagaaaaaugaacugaaacuagaauuaacaaaaugcagaaagcauagccgucauuaauuugagcauuugaauuuaauguaaaucaaguaaaaauauuuuaacugcuaucucugcccucuguuaucugggauaugagaacaauuuaaguaggccaaaauuuggguacauuuuguaaauaccaugaaagaugucacgaguaggaaaccagaugaccauuaauugguagcuuuuuaaacauuuuccuaucagguuugcccauugcuuucauuuucugaaugcggguaggaagaugugugcucugaggugagcugcuugggaggcucugauugccugugcucucucccagggucgguuuuguuuugagagcgggaaccucagagaagcugggccucucuccuguccaucaggcccaugggcacauccccucucaggcaugcaucucuucagcuuggcacacucugccaacuucugagccagugucucuuuacucaucuuagcaucaguaaguuuaaauuugacucuccucccacacaagcaaguugaagccccacauucaguugguuauccaacuuccugagugucguauuuuucuuuaaguauaucuuuuuaaagaucucuuugaauaacuuauuucgagccugcuacucuuuccuugacuuuguauucuuaaucugugcugcauuucagaguaacuaguucauaaauguauaaccuacuauguaagauagcacuuucuuuugguuuuucuuaaaacuccuaauuucagguugcuugggggacccuuugguucuagauucuuacugaguagucucaggugagcagaguugcuggugucaaggcaguguugcugcauccaggucccuggcccacugugauugcuuuccucuuuugguggugagaaaacgcuuuaucagccaaaacgcaguucagcuuggcugcaguuuagacuagaauugucagugugaaaggaauaugaugaguuguucuuuaaauggacugaaacaguuugauuuggaaaauuauaaagcuguuuauuaaacuacuuggagaaaauaauagacagcauuuuuuuuaugaucuuggaauauggaagcccaccauuuuuuuuuuuuuuuugagacggagucucgcucagucgcucaggcuggagugcaguggcgugaugucagcucacugcaaccucugccuccuccuggguucaaaugauucuccugcgucaaucuccugaguagcugggacuacaggugcccgccacuacgcccagguaauuuuuguauuuuugguagagaugggguuucaccauauuggccaggcuggucucaaacuccugaccuugugauccgcccacuucagccucccaauugcauccggccuauggaagcccuuucugagacugacagcacaaagucuaguggccauuaaggauauaauugauacauuuaaguaaacaaguaauauuaaauuagcaaaaauacuucugacuuaugacggauacaggcuaauuccauucauauacauacacucuugcuaaucuguaagaaaaagaugaagaauucagaaaaauagguaaaguguauaaacaggcuguccuuuggugggggaagguacuaauaguuaauauacuugggaaaaugcucauuuuaagauucuucuaucaaacuagcagagaaugaaaacaguuuaaaagcuagugucauacagguguggucagacaggcaaugucauacaaagcgagggaaaggauaaagugaugaagcuuuucggggcugguucgguaauguauaugaguauuuacaaugcauaucucuaaggcccagcgguucugaguuccuccugcagaucugcucgcagaacgcagguuucugggcaagaacguuuccuacggcauuguuuguaacagcagaaaaccggaauguaaaugucugucagcaggggacugaucagaugaacuauaggcagccacgcaguggaaagcugagcuucccuuagggagagugaggguagauuuagauguacagauagagguaugauuuuuuuaaaaggcaccucaguauggguaauguuaucuuucuuguguuucagugcacacacauacacacacaccauagaugcaaaguguguagaaaauguauugaaggauacccaggaacugaaucaaacucucuucauuuucuuauucaaauacagauuuuauauuacccagauaaggacaaccauuuuauuaccuuugaaaagaaagcauaguuuuuagugguuaauauuaguuucauuauuaguuacuuaucgguuauuucacaguuucaagaguauuucacguuaguggcugaaccacuagaaugaauggaccagcugaugggaaugaaucucaauuguuaaaaaucucuacuccugugugugcuagucuuguuuuucaucaguuauuguuguuuagauuacaucacugcugugauucugaaaagguuucaguauagaucuuaaacucucagauuacugcuucuuuagaguacuuacuuuugagaaauuaauagaaaguuuuuguuuguaccuuucuaaagaaugagaacaaugagguuuaaaagcuacuuaaaaguucuguaaaccuagaugucuuaucugaagguuuucuacuugagagguuuguuuucugucuccuucaaauacuagaaagauguguauacuuggaauaaagcugcuuuuguuuugcugagagcccuucuggccucugucacaugcucucccuggcaucucucuguuuuucuguuucacaccccgccaguccccaggugagugguguggugggaagcauguaagcuuugcuguuagauccaggcuugccagugcggcuccacuguguaagaauuguggcuuuggcauaagaccugccuccugaaccuccugaauagucaguggauuaggccaccaauauaaaguagugccggacacauggaagauauuucauaaauauuuuccuucuuuucccacuucuucccuccuuuaaaagggggucuucaauccacuuacccuuuuguguuccagccucucucacuauucuacccucucuaaucguguagauucccuuauaaagugucucucuaaucuugaauuuucucuuugauuugcccaauuucuagcuuuuuguugaacaguucuaucagcaugucuccuuuguaucugaaauucaucuucaaccgaaucacuuauuuccccacaaaacuaguuucucuuccugacuuuccuguuucuguuucucugaaauguuacuucuuucugugcccucuuuuuauucugcuuuaaaacccuaaccgagugccaucgugagccacaguuauugagaggcgugcucugcauccuugagauguggaaagagggaacugauugagauccauuguucuaacagauuuccugucuuuucucuccuccuuaagaggcaaccuagcuuggugucaaggcagugaguuuaggagccagacugucuagguuuuaaucccagaucucacacauccuaugugaaucaggguaagcugcuuagcaucucugugccucaucuguaaaaccucaugggauuuuuggaaaaaguaaaugaaaaaagaguucuaaaguauuuagaagaguacaugguacuuaguagugguuuaauaauuguuaauuauaguuaucucauauaccacugcuucuaaaacaagacauuaaggacaggcacacuucauuuauugcccuuugcuuuauugcacuugacagauaaugcauuauuuacagauugaaaguuuuuggcacccccugcauugagcaagucuaugggcgccauuuugucaacagcauguacucacuuggugucucuguuucacguuuuguuaauucuugcaauguuucauacuuuuucaucauuauuauaucuguuuugaugauucaugaugagugaucuuugauguuacuauuguaauuguuuugaggcaccacaauggcgagcuuaauugacauguuuuauguguuccgccuguucuacccgccagccauacccucgucuuucucccucuccuuggaccucccuauucucugagacacaaccguauuucaguuaaccaauuauuaacccugcaguggccucuaaguguuucagugaaaggaagagucgcauuucucucacuuuaaaucaagagcuagaaauuauuaagcuuagugaggaaggcuugucaaaagcugaagcaggccaaaagccagguccucuugagccaaacacuuagccaaguugugacugcaaaggaaaaguucuugaaggaaauuaaaaguaguaguccagugaacacuugaaugauaagaaagugaaauagccuuauugcugauaaggagaagguuugaguggucuggguagaagaucaaacaggccacaacauucccuuaagccaaagccuaaugcagagcaaggucuuaacuaucuucaauucugugaaggcugagagaggugaggaagcugcagaagaaaaguuugaagcuagcagaaguugguucaugaggcuuaaggaaagaagcugucuucauaauauaaaagugcacggugaagcagcaggugcugcuguggaagcugcaauacauuauccagaagaucuagcaaagauuauugaugauggugcugcacuaaacagauuuucagagcagaugaaacagccuucuauuauuggaagaagaugccaucuaggacuugcacagcuggagaggggaagccagugccugcuucaaaguuucaaagaacaggcugacucucuuuaaggggcuaaugcggcugguaacuuuauguugaaaccagugcucguuuaccauucugaaaauccuaaggguccuuagaauuaugcggaaucuacucugccugucuucuguaaauugaauagccaagccuggaugacagcacaucuguuugcaauaugauuuacugaauauuucaagcccacuguugagaccaacugcugagaaaaaaagauuucuuucaaaauauuacugcucauugacaaugccccuggucaccuaagagcgcugauggagauguacaugaagauugauguuuucaugccugcuaauacagcacuuauucuacagcccuuggaucgaggaguaauuuugacuucuaaguccuauaagaaauacauuucgcaaggcuauggcugccauaaauagugauuccucugauggaucugggcaaaguacaucgaaaaccuucugaaaaggauucaucguucuggaugccaugaagaacauucaugauucauggaagaaggucaaaaugucaacauuaacaggaguuuggaagaaguagauuccaacccucauagaagauguucaugaaggaaguaacugcagaugugguagaaauacuaagagaacuagaauuagaaguggagccugaagaugugacugaauuucuucaaccucaugauaaaacuugaacagaugaggaguugcuucuuauggaugagcaaagaaagugguuuccugagauggaaucuauucguggugaggaugcuaugaacauuguugacaacaaaugauuuagaauauuccauaaacuuaguagauaaaauagcagcaggauuugagagaauugauuccaguuuugaaagaaguucuacugugggcaaaaugcuaucaaacagcaucacaugcuacagagaaaucuuucaugaaaggaagagucaauugacauggcagacuucauugucuuguuuuaagaaguugccacagccaccccaaccuucagcaaccaccacccugaucagucagcagucaugaacaucaaaacaagacccccccgccaccccagcaaaaagggugcagcuugacuaguggaaggcucagaugaucguuagcgauuuuuagcaauaaaguauuuuuaauuaagauauguauuuuuuauacauaaugcucucgcacacuuauacgguauaguguaaccauaacuguuauguacacugggggaccaaaaaaguccacaugacucacuuuaacgugauggacuggaaccaaacccucagcauugcugacguaugcuuuuaugucaucuccuuguuuaagaaacuucagagucuccucuauugccuucuggaauaaucauuugcuacaugucagcagggcuaucccaggagaaggucuuuguguaucagaguuaggcaagcagacgcugaacgguucaugguagggaaacuguagaagaaauucaucugaauuugagguugaaguacuuuuccaagcucaguucuauuucugugaugccucaguguggcuacccaucaucaccuuaucuuuaaguuauguauuugucuccaggcaaacugaugauucuccaaauaugucccaugcugucucaccuuuuauuuguaccuuuggcuugcucuucugagaauaacagagugacuccuuccaucuuucagaagcccaucucuucagguucagcucaaauaccaugucuucuauaaaaccuuuuguuuucuguuuuacuucucuggauucccuuagcacaauuugugacucuuauacaaauuauauugcuuauuuguaaauuguuaagcuugauaagcaaagaauuuaucuuuuuuucuauucccagugaccuauaagagacuuuguaccauaauacucuguucuuguuugaauaauuuuuuuucaguuauaaauacaucaaaagguacuuuacaauguaagguauuaaaagacuuacagauuuccugaaucccugccuuggagaaguuuguguucuuaacaccgaccacaggccuaggagcuguccaucacuggccuguuauucucccaucugacgggcuacccaaucaaaaaugggaagauucucuuacagaaaauucucuggcauuguuauuuuuuuaaaacaguuuggauauuaaacaaaugcuugaaguuaagugguauuuaaggauauaacauuuuucucuacagagauuuuccauguaauuauauuuguugcaaaggaauuuuuauugguuauaggaugaggaaggcaaugguaauuuuauguuggaacuacauuuugcuuucuuaguucucaaaagucuauuuuuaggccauuuuaggccuuuuuugguaguccauuuaaaaauaaauugauaaaagaaacccucacaaagguucaguauuagaugugcuuauaccuucauuaacucacauaagucuuauaaugccuuagacaucucguaauugcuuauugagacuuucucuuuacagaacuuuauugaaaagguucuuuccaucucuucacucucacucccacccccccguaugaauucuuuuuaguugguaauagggcuuuuuaaggaagaucauauaccaguguuagaggauuuauggacauuugccuucagaacugcaugaggcugucauuacuaaccuugugugcuuuuucacagaucccugacaucuaugagacagcuuuguucaucucaggaaccuuucaaaaauacaugcuggugaaguuuguuauauagggugguuuuuguuuguuuugucuaacuggaaacaaacuauuaaagcaaagucuuuuuuuuuaaccuuaaaacugcagugaugaaggaccagccagcauuguuauacguacauccugucaucagcacaguguaaaagcuuauuucacauggacuucucuuaggucugucuggaagcaaauuauuugcugauuguagcgccauccuauucuguacucaaagcuaccuauuuuaggacuuugagcuaucugaguaaguagacucucuaagcuaauacaaacauuauccauuuaccuuaaguaaauuuuuaguguuuuaauuaucuuuauuuaaaaaauaaacaccugaaauugacaucuguagguucagaauaugacuuaacaaaggauuuguuaaauaauuucaccucuuuugguaauucccaaucaguaauguugauaugacuggcuauaaauagauugagucugcugugaucuaccuucauuuuuagaagaauguacaaguuuuauguuccaccagugguuuucuaacgucaguacagauucaucuguagaauuaggucauguccuuugagccaaagaucuguaaagaacaaaacaggaaacuugucaaauucuuccguauuuugagcuaaagugguuagauuuuuuuauauaagagaauauuauaaccucuucagucccuuuugaggaaaagaguuaaauuuuugucagaaauucugguuuagauguucucugguuuaagaaucagauauuauuugcuuucuauuccuacuuccuaacacaguugcacgugguauagucguaagaugggccguggcaugauaggccagaugacaucaucacaggugguguggaaggaugugacaggcacagugaggaguuccuuauguggugauaggcggaccccugaaugccuacagggccccaucccaagauaauaacauagaaaguaguuagccugcgauugggaacuccucuuaacugguggacuuaccagaugggaugaucuguacugaccugaaguggacguuuggugucugcuggaaggaauuagguggcccauaagagcugcgaccacucacaguauguuuugagcuuucauagacccuuuguacauguuugguagaaagccaaacggaaagcagcuuuaauuaaauauguuaccauuuucauuaauucuuaaaccuagcccuccuucgaggccugauguaguuacgauggagacagacagacgucguggugccauugcucaucucugccacgccacaguugcuguucucauggucugugcagugagaacucuuccucuugggccaugucuuagcugcuuacuaggaaaccagugaacugagucaggucuaaccaugucauccaaacaagcgcuugcccugcuuacugcauuuuuuuguugucagaaguagggguuuauuucuuacuggucccaguuccccaaggaugucauaugaggagcaagaauacaacauaaaaaaaaaauaacaaaaccagaaacuacuauuuuuguggucagcaguugcuaauuagcauuauuacugucuuuaaaaacaauuaguaaaguaaccuuuuauuuuauuguuacagaagcaguacauaugcauuguagaaaauucagacuagaaaaagaaaaguaucccauuuccacaaucacuacucuuuacacuaggugucuuauuuucucucugugaacguggguauacacacaaacauacagauauaaauuguauauaaaugguaaugguuuaccaccaguugguaauccuugccagaaucagaaauguuauuccuuccacgcuuagcugguuucaucuagaaagcagcacuuuccuguaucagcuggagcuaguuaauuaugucgaauuccaauuuggaauucaggauagauggcuaauuccaccucuccuuaauugccauguuucaaaguaagaaguuauuuuauagcuacuacaaauagugaccaaugaagaaagcauuccugucuuuuuuucugacaguagcauggauguauggauuuacauugauuucauaauguguuuuguuuuuuuuuucuuugugcuuaaaguuaucaccuuuuggaagcccauucaagcugagucuucuaccucauuaauauuugaaaccucucuugcucuuaaauagugcuaagucuuucaucucugucaguacuguaucagcuuaaucuuucucuucauuaugggucauauuuuccuugcuucuuuucaugucugauaaauuaugaguggaugucagacauugcaauuuucaccuugcuauaugcuggauauuuuugcauucccauaaacauuuuugagccuuguucugggaugcaccuaaguuacuuugaaauaaucugauuauuucagguuuuauuuuuaagcccagagcaacauuuagcuuagggauauuuuugccccuuuccugaaacaaauccuuuguaguauuguacccgaugccccgugaaucaugaaguuuuccaucuaggcuggugggaauagcccugugugagggguugcacucuugauucacucuugauucuuccgugugugucuuucccugaccuuggguagaccccucacgugaugggcugaucagugcagaucugcaguguccucugcagucuccagagcucucucucugcgucucugucuuccccagacucuguauccucccaccacagagaccgccgagcuuuguguggguuuuccaugccugcuccguguccuggagagucucuccacgcagugaaugggcacuugugggcuuacucugucugucucccguaucucaggaucacuucuucacugucugguguccagugauuugaacacgguuuccuauauuucaucauauuuuuuguuuucauugggagcauaaacugggucccuguuacuccaucuuuguugucugcuuugcguauuaacugauuuucaacuccaaguuuauuuucaucucucaggugagaauaauaccaccgcuuauuucacaggagaguugcgccugaaaaggaugcugucguccacuauauaaauguuuguaguacugacuucccuacaggacaguuguggaaccgggauuugaagccuggaagcugggcuccagaaugguccucuuaacacaucugcugcaguuuacccaucaauuggcuucuuggaagcgcaucagucaguuaccucuucucacaagaugcuguauuguaggccaguuagacccuaagagcacacaccgggagacauuguguucacagaccagcugggcuguugugucauucacagcugcgauugguaggacucacuguggcucugugguuagcuucaaguugaccagguggcuuugcugauuuugucuggacucucucacauacaugucuaaugccucugaaagcaaaagguucagaauauuaacauuuuuuuuaacuuggcuauuucuguuuuuuccucuggaguuuguuucucuggcuguaugacuugcaugauacuuaauccauucuuucugugcugcuuauaguuauuuuuaggguuucauuaauacuguaucaugaugccaaacaacagacuuuagaaaauauaaugcauugaagauaacccauugcuacacaguuggggcuuuuugcauguaauguuugugagugaguggcaugcuagaguuuucuggagaauuugguccugccaugaaugugcugguuuuaguuaaaaacuuugaccugcuuuuucacucuuguucacugggcaccuuuuuuauuuuaagguggauauuuuggcucagauugguugugucgaaagucucagccagucaccaccuucuucuccuucuccuucuccuucuuccauauauaagguaaauuucaaacuugaacacaagaggaaauaaacauuuaauaaacccuaaaagucaucuuuuuuucccaagugaagugauuaugucagguaaaguaucuuacaggagcucuucuuggggcauggugaugugggauguggaauauguaggaacugggaagaucgugaggauuuacaccguggaggccucuuagaggaggcuugauuacugaauucaucccacgggcagugagaucuaaugaaaggucuuuaacucugugguugacugugaggaggagugugguaccacggagagagggaaaagaagaggagaaugaagacauuguccuguaaaaauucaagaggaaggggagguguaaggaaagaaacgaagaggcaucucagcauuggaaaccugagugaaggagccgaggggauuauugcaugaccaaaugucugcaguugagagaccaaagggguuguggggauggagaacaaaaaugucagagacaucaggcgcaguggcucacgccuguaaucccagcacuuugggaggcggaggcaggcagauuaccugaggucaggaguucgagaccagccuggccaacauggugaaaccccaucucuacuaaaaauacaaaaauuagcugggugugguggugcaccccuguaauccuagcuacuugggaggcugaggcaggagaauugcuuaaaccugggaggcagagguugcagugagccgagaucacaccacuguacuccagccugggugacagagcaagacccugucucaaaaaaaaaaaaaaaaaaaaagacaccaaaggauccuucaaccagaucauuguagucuaguuuguuacaguaaagcuuagguuuugaaaaaagucaagaucucagcauuuagcaacagaaaauauuugugcugaaagucccaagaauuaggaguugcuguuguugaccuuuacaguaaaaauauuucugucuucuuccucuuuuauguaucugaagguaacagaacguuggcuggaauagaaaauaucuuaagccuguuaucucuucaauuaaaagucucuauuaauaugaccuggcugugcagcuauuuguaaauauaacugucuggucuuuuccugcauagcauaagcuaauagguauguuacuuagauggggauuuacucaaagaaaugcuagucuuuauucuuuucuuuauauuuuagaugagcccucacauauuaagauaaccucuacugaaugcauacugugggcuagaugcuuuguaugcauuaugucauuuaauccuuacaggaggauaauguuauagccauuguauaaguguggggacuaagagagcuaaguaaauuacccaaggccacacagcuagugguaagugauaaagcugggauucaaacccagauagcaggcuuugagccuaaguucuuaaccacuauccccaugugguauaaugauuacuugagucaauuccaauagcuuccuaaagggaguuaaacuccaccuaguguaccaggauucgucuugccccuuuuuaucccauauuguauauuuguaccaugugcagcuuuccuacacucaccacacagcaccaccaugggugugcguguccgucucccccaccccucguggccauucucagucuguucugugguccaguggcucugcagucagguacaagccagucuacuuucugaagaaauuuagcuaaugcuguaaauccuuugagugaauguguuuaaauaagucucccaaugucaagccugcauaaauauauuucucuauuugcauuaugaggagaggauagcuuuuaaauuuagaacguuaaaccagcaaauuguuaguauauugcuccugggccuaaaggggcauuugauuuagcuggggugggaguuaggaagagagucggacauaaucaucuaccuguggugauuacauagauuuaagcgugucccagagacccaaccagacaugcuguaggaguguauucauucaacagauacuuaauuuacaaagcguuuacccagggccccacguucacgggcagcaggagauggcagguuacccugauggacacagcccuucucuguguccuucuaauggagcucagacgagagugauuguauaugucgauuuuguuuguugcauuuuccaauguuuguuaaaauuucaagcauagaagaguuaaacgaauuucauagugaauaaucauauacccaccuucuagauuuuaccauucccauuuuacugcucuugcuuucucucauauuugcccauuccuccaucuccugugccugucuguaucauccacuuucagaacucagacacuguuauuuuaaggguacucauagugucacaugcuaaaaauucuuuuuucuuucucuuuuuuuuuuuuuuuuuuuuuugagacagagucucacucugucacccaggcuggaguguaguggugugaacucggcucacugcaaccuccgccuuccagguucaagcgauucuccugcuucagccucccaaguagcugggauuauaggcuccugccaccacacccggcuuuuuguauuuuuaauagagaugggguuucaccauguuggcuaggcuggucucaaacuccugaccucaagugauccuccugccucagccucccaaaauguugggauuacaagugugaaccgcugcgccuggccaaaaaucauuuuuucuguagucacaugcugaaaaucacuuauucugugaucgaccacaacaaguuaauuuuuucaaaaagacucaauuuagucuuuuuauacauaaggcaaagucuuaguauacauagucuuaguauacauaaggcaaaucugauuuccuccuuuuggugaucaugucaugaagguuagaggucugacaaagaguaagauauauuucauacaaaugaucaagaacaucacauuuaaaauauuugaguccuugccacuuuaugcaaggcauuuggagaaucuuuugggggaaacauucuccggguaagacagagcuguccccgugauucacuggugggacugaccaucugauuugcaaauaaugaagaaagugaaaggaggcggcuggaugucagccagcaggcugugggaaggccagagcccuucugaugggguagggcuuugcuaaauugaggaagaugaggugugcagauaagaguacaguauagugugaggaacagcagagauguagaaaaguuuggggaaaugugugaaguuugaagcuucagagugaagguuaguggcagguagggagaauggggaaugcagcacgaggcaaaguugagaccugugcugaagaaacuccugauugagccacaggaagcuuggaggugacucuaggggcagugagugcuaaugaagggauuuuaauuacccaugauggacaguuaagagcuuugcaaaauaaggagugggaagagaaagaggaugaagaugcugcucaguagaaaggaagaggagggaaagguggaaggaaaggacagagaggcgccacaggauggaaaccucagcccaggagcugaauagguuuuaccgugacgaggugucuguaguuagggaacuaccaaggggauuugggaguugagagugaagaaggcagagaucgacguaugggaaggauggguucagagagaaagccagugauugguuacaguuaagaggggaagggaccugccagggcaguaaaaggccaucugcugagggacugaguccgagggccgugacggaagcugcaggaaagaucuccaguugguaggguuuugagaaauguguuaucagcaggaguuggguugaaacaagauaaagagagcguuccaggaaaaaaaaaaacaaaaccaaagagauagaaacaaacauaaccacaaagauuucauaacuuagguggagagcuaagaucacauacauaaccaacuaguaugacaguuacuacacaccuacaaauuauugaccaagugauuuucaaagaacaauuauuuguuuuugcccuaauuaaauggauuuuaauuuuuugaggacacuugcuaugaauaguucaccuccagguuuuuccuccaucuugaugaaaauccuuccuggccaguuugcuaagacugaacugucuucuggaaggccccagcgaacauucacucuccuguucuagcucacaguccuguguuccuuugugauguaccucacuuagcuucuggcagucuucugaauccagaccacucacuucugaacucuagcccgagguuacacagcggaagagagguagagcuguuaacggaauuccaacucacuaggcucuugacuguggcccuccgagccccuccauuucacagccgguccuugauggaaaccaggcugaggcugcuguaccaaugauagucugucccuagugucccaaacuuugguacuuuuucaaguucuuauuugaaaaaacuuguaacuuagaguuuggaggacacggaauauauugcuaaauaggagaauaaaacuacauuuccuuaaagaaaacuguagaaggaaggguuucucuuagcugaagugugacugccaggcccucagcaugauugccuucauuuccagcguccacuggggucaucugagaguccaucccgaagccgaaugucaccuuguaaagcuguguguuugagaagucacagucuuguggaugaaacaucuuucuccuguuaguauuugacauagaguaaaauaacaaguaacuucaguuuuuuccuuagagguauauagggcaguagaaugacaucauacuugcacaucaaaagcauguagucuguuuuugaugcaccuggcacgugacagccagcugucugccccaugugucgguuggugaagagucaaaacagaccagccacuagggugucuguccuacaacauuaggggcuauauuagacaggguggguaauuuucuugcaauuauauuuuuuucuuuuuuuaacuagcaccauuuguguguguguguguguguguguguauaagacucaaauaaaggggaagacuugcuauuucauguuaugaaauagauucaguacugaaauauuguggagugaaaggcaugaauaauuuuaaucaauuuucuaugaauucaguaaacagugauucaaaugaaaaucaguauuuuaacucaacauucuaaugugaaaguucagauuguuuuaguuuaaauauuaagcugaugcuaaaguuuauacauaaaaauaaacagcuaagagauguuaugcuaaaguauugaugguuuuucuaugaaagugugguacuaguacaaauagaucacuaagaaacaagagaguccagcuauagacccaaaucugauaugugaugaaggcggcauuucaaaucaugggggaaagauggauuguucaugaaaugguauuagggugaccgacugaggacaagauguucagcuggaucccuguaucauuucuuuuucuuuucgcuuuucuuuucuuuuuuuuuuuuuuuuuuuuugagacagagucucucugugucgcccagucuggagugcaguggcgugaucucagcucauugcaaucuccgccuccuggauucaagcaauucuccugccucagccucccaaguagcugggauuacaggcgcccaccacuacaccugacuaauuuuuguauuuuuaguagagaugggguuucaccguguuggccaggcugaucucaaacuccugaccucaggugauccucccgccucggccuccgaaagugguaggauuauaggcaugagccacugugcccggccccuauauuauuuguuuuacuuaacucaguuccagacagauacaagauuuaaauguuaaaaaaaaaaaaaaaaaaaaagcuaacaaaaaacuguauuugccucaagggugggauggugggggcagggcuaauaggugcuaaguguacucucuacuggaauauucuuugagauugggugccaucuauuucccauuccaaaaguuuauuuguaagauuaauaauuaaacuauuaaauuacucaaaggaauuaugggagagaaauacuuuuuaaaaagaaguaugaaagucccuuucuauguaagacaaaaccccucagcgugacaguugucagaaugugggaauguuauugcauucucuuucaaaagcaauuugacaaaauccaucgguucuaaauacacagucuccuuaagccuagcauuuuuucuucuggaaauuucagagaccuuuuggauugcaguuuucaucuaaagaaccaccaggauggcugauuaauagaaaggagagguuuauaggcaguaacauuuuacagacugggaagagaccuucucuggugugugcugaagaugaagggacacauuggguuuuaugccucacagggccuguaucacacuagagucacauauauuuaggaguuugggggcaaagcgauacguauguaugagaggagucaagagcaugugcaguagguaaacauauguaacauccauccuuguugacuuugaggugagauuuuagcauuaaaaugagguggaauugggcucuuuaugugaaaaggugaacugugggacacaguuugugcacagccucagcgagcugcugaaacuggcuuuaaggccugcaguugcuugucagaagaaaauguuucuaaggccaguccucugcccagucagaguugucuuggucuggguuguaaaucagaguuaggaggggucugauagguccuguucuuagugaguuuagagcccuaguaauuuaaaaaguugcucuauucccuuaaccuuaggauccaucuuaguugauaaagcagugucuguuuuggucuguccgaucacaugguauuauaguacccaaagacugaaaacaagauaaaugaacaucagcauauacuggucaaguuguaggaaauauauacaauggaauuuuauggagacaaugugaaagaauauuguguccauaugugcugauguaccuugcagaauguuuuaugcuguuaagagaaaaaaaaaaaguaccgagcaaaaauaauacaauuuaggccaacuuaguguuuaaaaacaaaaaggaucuaucucuguccaugggauguuugaguaaguauauacaaggaauuuguuaguagcaugaaacaaaaauuauaguaggccauuguuucagaguuccugcacuaggccccagcagaccaggccaaaccagaauggaguuccuugugcuagaugcuccauagucaaacugaaacuugaaggaagcagauaggucccaaaacaaacugauuuuuucucgagaacaggagaucccagucuaccugaguuagcauaauaaggaguccccucugcuuuaacccuuacgaaaaaguaaccugaaguaaacugauguuaaccaucaacuuuuuuucuguuguucuauuuccuuauuaacccauccuuaaaaaccaaguguucuguuaaugcccagugggagugcucguucuagauuguaggaaggaggcugcccagauucaugaaucucaaguaaaggccaagucgaucuguaacugaauuuguuguaauuuugugucuuuugacaguaguaguuccuuagaaugacuagcaucucaggauguuaggcguauuucucaaauugcauauacuuuuauuguuugaauuuuuuuuauuauacauguauuccauuucaaauuaaaaagccuacuuaaaaauacaacagaucgcuauaaagcaguuagaaauagguccucauguugagugggaaaaagaaaacuugcaaagagauacauacaguaugacauccuuuaggucaauuuuaaaaauauaaagcaguuguuugugaauguguacaugugcagcugaaguaugaaaacacacauaggaauggauacagguucagaaaaguagugguuacuucuggagagaaagaaagagagggcuguagcugcaucuaauaguuucuuuguugcuguuuucaaaguuccuaagcaaauacgguaaaauguguucacaucaguaaaauuagauugaugcuaccuuuugugcuuuccuacauguuuggaaauuaaaauauuauguauguaaaauuguuuugaauacauuucuauuaauuguuuuuaguacuccuguuguauucaauugugucaguucauuauugaauugagucaugguuuccaaaagucacaaaaauucuccuucuuuuuaccccucucaauagguuggcaguggcaaugaccccuggucagccuggagugccuccaaaucugggaacugggaaagcucagaaggcuggggggcccagccagagggggcuggagcccaaagaaacacaaacacucccaacaacugggacacugccuucggccacccccaggccuaccaaggaccaggugaggagaggggugcaaggucccacccugcccgcccauggcugagugggagagacagggaagaccgaacuguuuuugcuguucccacacucagcacaacacagaacaguuuugugaccacagcaugggaagggaggauugccccacccaccaagcagcugugcagcagacaccagcugaguguccuacagucaugacacugucuaccuggagucagaucaaggggguucccaccacucccaccuuggguucaauuaaucugcuggagcggcucacagaacucagggaaacacuuuacuuacuacugucaguuuauuacaaagcucaauuuacaggaugcaaauaaagagccagaugaagagaugcauagggcgaggcauggggaagggacgcagagcuuccaugccccccugccccaggugccccuacauguucagcaccccagaaucucuuuuccuguagcucaaggauuuuuacggcgguuucaucacauaggcaugaucgauuauuguuauuauuauucuuugagacagaguuuugcucucguugcccaggcuggagugcaguggcacaaucucggcucacugcaaccuccgccucccagguucaagugauucucucaccucagccuccugaguagcuggaauuacaggagcccaccgcccaccgccacacccggcugauuuuuuguauuuuuauuagaggcaagguuucaccauguuggccaggcuggucucaaacuccugaccucaggugauccaccugccucagccucccaaagugcugggauuacaggugugagccaccaugccuggccggcaugauugauuauuaacucaaccucuggccccacuuuucuuuccagagaaugggagguggagcuggaaguuccaagcuucuaauccuggcuugguccuucuguugaccagcccccaucccaccaggagucaccucauuugaacaaaagaugcuccuaccacccgggaaauuccaaggguuaggagaucugugucaggagccagggucagagaccaaauaucagaacaaaagauacaccuugcacaccuaacauucaggaaguuacaagaguuuuaggagcucugugccgggaacuagggacgcagaccagauggcuauuucuuaccucacaauaccacucugggucauugaguugaaaauagauuuuauucaaaagaacugcuugcaguugcccuuauucacuaguagcaaaccuggauucaauuguagauggucauuaacucuaacuuuaguucagucuuacuuaucugugugaagucacagauucaaacgcuggguugguaaaguaaaagcagaaugggcgguggaggcugcagaaggcugagggccccugcugucgcccguggaucacugcauuugcagggaagcugagcccacguucugaucuccacaucuucagagagaugagaagucuugguuauuugucaccuucugauuuuaacaucucagcagcuaacacguuuguuuuaaaaucuugagccagaaacguguauguggaugggauguggcucauccugcugguuuaagaccucugcauucacuguuuuaacuuccuguuugacuaggcuaugaauagaaauacugaggcagaagagaaauguguggaaugggaaauaauuugggaauuaaggguauuuaugucugaucugaaauuaaauaagaagguagucucccauuauuuuuuaacaauuccugaacccugucuccucuguaagcacauugggccaagaauugaaugucuguucuaaacagcaaggaccucacuuguaagcccaaagcagggugcaggucccggcugaaggcuggcagucauagacaggagcugccugucagcaggaccaggggugugggcuggguagaagcguugggagacuccuggggucuggcucucuggucacuuggcccacauccuucucauaguuuguucuucucccauuuggcauuugucucucggcuucuccauaauggcacucuuaggaccugacacuaaaggacacucaggccguuagaguaggggaggaaggagaaggaggagagcccacaggggaggaaggagaaggaggagagcccacaggggaggaaggagaaggaggagagcccacagcaccuuaucugacacggggauuauugucagaauaguagcuacugaugcugcuuaauuacuucuucacucucaucuuuuucucccacaccccaacucggucuuuuuaaugucccccucguugcccuucucuccccuuuauuguuaguguuaaacagcugcuuuucaaaguucugucgucccuuucguccuccccaagccucuagaauuaaaggguauucugcuuauuuguaaauguauaagacuagauuuaucagugucuaggccucuagaagucuuuucuacuguguaccacuuaacauucuuacagucugcauuuaucugaagugauguggacugacagcccuuuaaaaaaauuaucuauauuuucacgccuguaaucccagcaguuugggaggccgaggcaggcggaucacaaggucaggagaucaaggccauccuggcuaacacggugaaaccccaucucuacuaaaaauagaaaaaaaauuagccgggugugguggcaggcgccuguagucccagcuacucgggaagcugaggcaggagaauggccugaacccaggaggcggagcuugcagggagccaagauugcgccacugcacuccagccuggccaacaaagcgaggcuccgucucaaaaaaaaaauuaucuauauuugagguauacagcgugauguuguaauauacauguauauacugaaaucauuacuacagccaagcgcuuaacauaucccucaccucacaugauuaccuaagugugugugugugcgcguguauaugugcaagugcgugccugugggugugugugugguaagagcaccuaaaaucucccucagcagguuucccaaauauaaugcaauaucauuaacuguaguccucaugcuguacaugagaucucuagacuuauccuacaugacugcaacuuuguaccuuugaccugcaucucccuaguuccccgucucccugccccugguaaccaccuuucuacuuucugcuucuauaaguuuuuuagauuuuuuuaaagaccuguuaaaaguuccacauguaaauaagauccaugugguauuuuucuuugugugugauguugagugcauuuucauauaccucuuggccauuuuuuggucuucuuuggaaaaaugucaauuuggguccuuuguccauuuuuuaauugagcuuuuuuuauuugcuauugaauugugcgaguucauuauauguuuugaauauuaacagguuaucagauacauggcucgcaaauauuuucucccagccuauugcgggaucuggccagcagcccgcaaugcaacgggguucucuuuguguucccaggcggaucggcccguugagaaauaauagacacacacaagauagcgaaagcuggguccgggggggucacugccuucugguccugcagugccaacaaugcacuggauauaccagcauuuauuauuaaguuuagugagggcggggguagguuagugagggauuuagggucauuugauuaugaggugagauggucacauggggaugaaguaauucuuuaacauaacaucuguaugcagaaguacaguauacagagauaagaauuuacaauauaguguaugcaucaguaauuucugacagagccuuaaaacagaaacacagucuuuccauaaccuaugauuagcaagauauuaaucagcaguaacaguugcagcaaaagcugguuacaaacaauccguagaaacaggacgugaagcuagacaaccuguuagaccagaaauucucagaagggaguaugccuuaacccuaaagaggcccagaagagcccuggcaagaugagggcguuuauagcccuaucuuauccauauggacggugcccccaugugucuguuuauaggcucuuuacaagggucacuuuccauucccagagcuaugaauaucugcuuuucugggauaggaaucuuggugaugugaaaccucccugacugcacauccauucauaggcucucugcagggggaagcacaucacaugcuguuggcucauucuggcagucccaccuggcacugucuuuacacaauccugcaugcaauuuuguauuuacaauaaucaggagcauuucaucuuuuauuccauagcaauaguuucagggggucucccuacaccagcccauaggcuaccuuuucauuuugauuguuuccuuugcuguucagaagcuuuuuaguuccauguagucccgccuguuauuuuugacuuuguucccugugcuuuugguguaauacucaaaaaaacauuugccaaggccagcgccaaggagcuuuuccccuguguuuccuucuaggaguugugugguuucaggucuuccauuuaggucuguaaucuauuuuaaguugauuuuugugugugguguaagacaagguccaguuuuauucuuuugcauguagauaccugguuuucccagcacgacuuacuaaagagacugcccuuucuccacugugucaucucggugcccgugucaaaaauuuaaaaguaaucugauagcccucuuuaaguugcuucugauuugucuuuugcacuaaaagaaucuguaauucaaggcuuaaaauugacuacacagccuuuacucuuaacauccauauuauacuccuauacuauacccuuuucuccaucaaaaaaaaauugauuugcccaguagguaguuacugucagaaaauuaaguaauuucauuuuuauuuuggucuuuuuuuuuuuuuuaacugaugaucuuccauuuucaccucuagcaacuggugaugaugaugacugggaugaagacugggaugggcccaaauccucuuccuacuuuaaggauucagagucagcugaugcaggcggcgcucagcgaggaaacagucgugcuaguuccucauccaugaaaauuccccuuaacaaguaaguuuaaaggggagccagggaaccagggccgugguagaaguauacauuaauacaaaguauauacccuaccaagaggcagcuggccuuuucccuuuccagugaucuccuaaguuuuggauaugauucaguuauuuuuauuuggaucuuaacugagaagcuuacuuaaaaaaaaaaaaggauuuuugauuuacaagguuaauaagugaaauauuuauuuuauuuaaugauuucccaaacuguuuucauuacuucuagcuuuaucaauuuaugacauauuaagguuucauugcuaaugucacaggaaagcuaaaaagaauaauaauaacaacucucuuuuaaauguuuuacuguuuuguuaaucacuugccaugugccaggcauugugcagagagguuuguaucauucgcauguagcccucauaucccuuugugguacauaaaaccccuguuuuacugcaggcaaacugaugcccagagagacgcaucgaguguuccagucaggaagccaggcccucaggcgccaaagcacguguuucagcuccugugccuaaaaacgugguccggagcuuuguguuagcuuagguuucucuuagauuuaaaacaaaaaaaaaaguguuguguuuuauuuuuuuguuuugagacaggcgucucgcucugucacccaggcugaagugcaguggugcgaucuugguucacugcaaccccaacgucccggguucaagcaauucucgugccucagccaccugaguagcugggauuacaaacaugugccaccgcgcccagcuaauuuuuguauuuuuaguagagacgagguuuuaccacguuggccaggcuggucucaagcuccuggucucaagugauccgcccgccucuaccucccaaagugcugggauuacaggcuugagccaccacaccuagccaaaaaaaaaaaguuuuuaacaguacuuguagauacccuacuuaacaggaaagcaugugggcaccagugaccacuguaggauucuuuggagagaccuaaauaaggcuguagucuaugccaguguagcuugaaggagauauauuaguaauuuaugacuuccaucagaauuuucaaguacuccuuccagcaguuauguuuaguuuauuuuuugaaauuacuaauacuuuuucccaauauuccaauuccaugauucaaggcagauaucaaagaauguuaaucugugucuggaaaaauuaaaaacauaacauuugacauauauuuagacaucaagaucuaggucuagaucuaguuuaauaaguccuacaaguucuccaaaguauauuuaaauagcuucagugauuaaaugaguucucuuuugacugcacacuuuugcugccucuuacccaguuucuuccauuauauauuuuccugcucaauugcaugcauaauaaagugaauaauucucugucuuguuagucaacugugucuuguuucagagucaaauuugaaguuuucagucauggucaguagugaugugcaucauugucagcuguucuuuaaaugugaauauaaaguauauugaaaauucauauaaauuagccccauuuugaaaacgaaggaagcagagacugagaaaaaugaguggccacguuuucauggcugaugagugagguuccagcucaugccugggggucucugacucugguuuuuggugcucuccucugcuccacacuugcucucugauuugcuuauaaccuuaaggcaaguuucgugaccuguuggaaccucaguuucuucaucucgaaagcaaggagguuggcuuuaagaauucuuucugcucuaaaauaucauuccaggcugaaaccacauuaaagcaguccuaacuugaaccugugccucugaggcaucucugucucucuguagugcugugaacgauuuaacacccuguguauuuguauuuaacuaaacuguauaaaugagucacuuaaacuuaaaacaauuauaaaaaauguuuuuaaguauuaacacuuuuucagcaauuaauccauuuuauaugacagcuguauucuagucauggaacauaaaucuuauacuagaaaaagagaucugaaauuaaauauacuugagcacuauaagaauucaccuugggccaggugcagugccucaugucuguaauccuagcacuuugggaggccgaggcaggcagaucacgaggucaggaauucgagaccagccuggccaacauggugaaaccucaaucuguaccaaaaauauaaaaaaguagcugggcgugguggcacgccuguaauccuagcuacuuggaaggcucaggcaggagaaucgcuugaacccgggagacggagguugcagugagccgagauggcaccacugcacuccagcuugggcgacacagagacucugucuccaaaaaaaaaauaaaaggcaucuugaugaugcugaaauaauuaauacauugcuguccucaaauuuuucugugguccauaacagugcccaaaaauugaaaugcuuacaagcuggucaaggaguugucaugauauauaauccccacagaagcgcaccuguagucccagcuacuugggagacugaggcaggauaaucgcuugaaccaggagguggagguuacagugagccgagaucgcgccacuguacuccagccuggcgacagagugagacucugucucaaaaaaauaaauaaaauagaguaauuaauaaauaaaaguguugcagguuagccuaauucauuaagcauucaguaugcucccaaaacuccuccagguccugaaaacacaaaugcuuccucuaagucccucuggcugcuguaauagguaaauggauagcggcagucaggugugaugaauagaaucacaaaauaugcucaaaaugccuaggaagacucuaccugcggcugcagggaguacuuccaaagagaggaugacuuaguugccaaugacugaaauguacugaguacauacuagguucuuuacauaaaucuuuaauucccuuaucaccuuagaagguaggucauucuggucucauucuuccacaaggagauuucagccccuaaggcuaccuaaguguuggagucagaauucaaaccccaugccauccagcugcaggacacaucuggucucuuguguaagcugcguuuuaaaggaaugucuagagaaaggagacucaagggaagucagcugagaaugcaggaaaagaagacacgggccccugagagcaucacacuggccuuuggcuuggcacaugaaugaaaguagaagcaaugcgacuggaacuucguagaaauaagauuccuuuucccauuguagauauuuugcuuccuuuucuucuguuuacuaaaagaaaaauucuaaaacccaaauuaaucuugucuuuuucaguagcccuuuggauggcuauguucuagcuguccucuaauuucagaaauguccuuuggauauagaugugauuucuggaaguagucaaguuuauuuaaguuuuugagucuuaagugaccucccccccacccccuccccauagccaaauuuauugauuacacuuugggucucuacuaaagagacuuguuuuccgcugucaugaacugcuucugaaggcaauuccaaaagaaacaagcacauaugcugaugagcaggacagccccuuugggacaguuguggccucuggagagagccuguugaaaggcaacuuuaauuuggauguagaaaugccagcauguggcuauugcccccuguggccaacucagauuggcgugcucacuacucacugccccagggaacuaggggggcguuuuuucaggucugcccuucacucuggggugaccgaauguuucagacacagucaagcaaauagagugcccguaaacaucacaccuucuggagucaaacuguucuguuuaccagaucaagcuuaauuaaaugccuaauuggccauugaacaaucugauuacauuagguuucauuuaccacaguuuccaguucuagugcacccgaaagacaggacaagguuaaaacugguaaguaaauguagacgagaguuguaaaauucuuacaaggaaagucuuaagacugaugaacauuuauauucaugauuagauuuccuggauuugcgaaaccuggcacggaacaguauuuguuggccaaacaacuagcaaaacccaaagagaaaauucccaucauuguaaguuuguuuauuuuuguuugcuuucuuucugauuaagcucuuucuuauaccguacuuuaaagcuaagcgaguuauucaucuuuuggaaaguauuuuuaaauauauuuaaugccccacauaacugauaauauauguuaguguuguaggaguacugaagauaauuaacacaaauuaaugccugucauuauauuguuuauucuuuaucuuucagacuuuuaguauugaacaaauauacuauuuugaucauuuuuuucuaaagugucuugaaguguauuuuacauaguuuuucugccagcccuauauguuuaacugaugaacucaauucaaauauuuauguuucuucccuuguaaaguacauguauguuaucagaauaagguacccuuucagauauauggguaauaguguuuuugguaauaguguuuuuuccaguaaaccagcugucaaauugagauaaggagcuaccaaauggaagcugggaguuaaagacaucauugagaauaucugucuuagaauuacuugguuauugcauaaugugacacaagcccuucgguuucauuccacauuuugauuggugguagauuuucugucuaggugauauuuaguuguagauucccaaaugaaauucuggaaaagagaacuguagcuaucuucugauccuauugacuuaacccuguaacaauuagauugggaaccugaagccuugaguguucucauccuggacucaaucgaggaugaggaaacaucuggucuuauucuguagucuuuggaaacuugauaaaauugcaggaauaguauuagauucucuaauuacuugugccugcauguuugaaaaacuccaaauccuggaagccuccaagcugaagagcuguaaccaagagcccuuuuuaugcuuuuucccucaaagcaaauuugggauaauuaacuucugaguaguuauauuaaagauuuuuuuuuccuguuuucucuggacuuaauaaaaauugaacauguaccauuauucuuuucaugacauuuaaaacuccucaaaaucaagagcgcacagcucugccucaguuuuguuuuuuuguuuguuuguuuguuuuuaagacagagucucacucugucacccaggcuggagugcaguggugugaucuuggcucacugcaaccucugccucccggguucaagcaauucuccugccucagccucccgaguagcugggauuacaggcaugcaccaccacgccuagcuaauuuuuuuuguauuuuauaguagagacgggguuucaccauauuggccaggcuggucuugaacuccugaccuugugauccgcccacauuggccucccaaagugcugggauuacagguaugagccacugcgcccggccugccucacauucuuaaaggggacuuugucccagguuugcaguggugguacagagcuaaggguuccagccuuucauugaccggcaaguuuuaaguagaacugcacccaugcacccaguaggcaggucugccugugugggcgucuauacauggaagaagcugaggaaagccaccgcgucuucaggaggcccagagaaagcagagacuaacucuuugcucuaaaagugcaguaaccuugcccacucaugaaacagagccccgugaaauugggccuuagccaagcacaguugcugcucucggcccacucacugagggaggucccgaaagucaucuccucugcagcuuucagcuaguuucuuggaucugggcucucccugaggggguuauaguaauuguucucagagauuuuagucucuuuuuaaacuacucuuauccuuggaguaggucaccuuccugaccuaacagccucugaacuuuaauaucccaauccgcuuuucccaucuuccucuuaaaaaaaaaaauuaggacuggguauaccuuuuuuuccuuuuuaugucugucuggccuugccucucugaggucucagccgaaacaaaucucucuuccuucagcgcaaucugugugauuuuucucauuuucuuuuuacuuucuuaugguacuuuuucaagucugcaagaauaaaaccuguuccauaaauuauuucauucuccuugaaucucugaaugaaucucugagugaaucugcuuccugaauagugguccuuuuacaguccauguguuuguuuuuucauucucuucuuggauuauaacucaauuauuuuucauuuucaagccaagaagauagauaacauucucaguauaauaaggacuucuauugcucugaaauguguuuugauaagagcuacuguccugcagucugaaccucuagaaucugucauugugaucaaaguuuaugaaaugaaugaggcagaaccaacuugagacuauuggugacucagguagugauuccagaagccuguacaugagcuccagcauccagguuccucugcagcugcccccauggccuuggaugcuguuuuaaauaagaugaaaaaaccagguuugggacagcagaccuauugucaccuagcagugccuagaagaaaugauccucaggcucaaaacuuacacgaggucucuacacccccacauagaauuuagcugguuucccuuccucaccucccaccacaacuaaaaccccagugagcuaguguaagccucgccugaauuugugaacuuuugcccuagucacagauagaagagaaggccagugagaaaagaauggaggccuacccucuucaggcaagccuugcccagguggacgugauacccggggguuggaagugagccagcccacugugcuuaggcacauagcaguccacggaagaaaacagcuagccugguucuugcuuuuaagauguaguaccucccccuccccccaccuugccacuaguaguaaaacaaugacuaucaggcucuggccaaucugauuaaucguuucuaugagccagaacaaugcuacucaaaguaugguccacagaccacuugcccaucugaaaacugcuuguuccugauccaccgugagauagguacaguacaugagaauauuuugaaaacuugaggacaauuugguauuguugaaaaaucaaaauguguaauguuauauuucaccaaacuauuagucugugauagauucgaaauuuuuaaaaacuaguccuucaucacguguagcuugagacagcuagacuagaaagaaacauugucuuguaaccagcacuguccuugggagagggaagcuggugucuccucuccaugggcugagcuacucacgugggagcagaaggguuucccacagguguguucuuuaaacauaauaucuaacaggaacagaaaccauugaaccauuuauguaccuuucaaagaggaacaagaaugacccuccaaaggacuucucauucugaaaagaauuacuugcugauucacaucaauuguauuuauuauuuuuccauguaacaaaauuacuucuuucuggaacauuggcauagguuggagauuauggcccaauguggguuuauccuaccucuacuuuugacugugugguagcagaucccaggaaaggcuccaaaauguauggucuaaagagcuacaucgaauaucagcuaacaccuacuguaaguauccacguuaucaaaagcagaaucauguuuggaucacugauugcagcuugcuuuuuucuucauuuucuagaguuggcauugguaaccuuuucucuuucccuuauuuuguagaacacuaaucgaucuguaaaccacagguauaagcacuuugacugguuauaugagcgucuccugguuaaguuugggucagccauuccaaucccuucucuuccagacaaacaagucacaggugaguguguguaaugcuaaacccaggaugacaaauagaaagacuccagucagauuaucuuccuguaagucagugauggcauuuuccauccuguagagcagcaggaugcaggaguuggaaacaguaauuaaauacagcuaugaagagagaaccauugcauguuguacaucuaucuggaaguugccuaaacgucucacaagaacguuuaaugugcaaaucacagguuuugguaugugucuggaauuccagcagucauugucuucauugcuguaccuuuucuacaaaagaaauguguacauuuaaaauaugugaaaaaugacaccugaaaaaauagaaauaauucaaauagccuaaaauggaaauaaaaauguaugacccacaugaugcaaacagguuaugcagaugagcugcauuauuucauuagaugagugagcacuggacagagaagccacagaacuacuaaguguuaaugaaggaagaagcugccagguuuucuacuuauuuugauuauuacccucucccuuuucuuguuuuuuaaaagugccauuuucuauuuauuuugauuauuacccucucccuucucuuguuuuuuaagugccacauucccuccccucccccagccccaagaaucuuuugguaaguaacccauaguguuacuagagcaccuuguaaguaugcagggcaccuuguaaguaugcagguagaaaggguuuguuuuugugucagggaauuguuuuuguuuuuaaucuccagccuaggguagacucugcuacucuauguagucacugagggacucagcauguguguguuaaaauaaagguugugugccaggugcaguggcaucccagcacuuugggaggccgaggcgggcggaucacgaggucaggagaucgagaccauccaggcuaacacgguguaacccugucucuacuaaaaaauuagcccggugugguggugugcaccuguagucucagcuccuagggaggcugaggcaggagaauggcaugaacccgggaggcagagguugcggugagccgagauugcgccaccgcacuccagcccaggcgacagagcgagacucugucucaaauaaauaaauaaauaaauaaauaaauaaauguugugaagaaacagacuuaaagguuagacagaguuuuaguauauugcuagaaaauguucacauacaugaacuagugaaaauagaaaggaguggauugugagaggaggucuucaaaggucagagccagagaggccuguaagagauguaaaagagacacugagaugcucaccugaaccuagggagaagaaacauggagggcugaaggaaggguucuuuccccaaaggucagggaagacaagaggcgguggaauucucacugcacucgcaagagucgagagaaacaguucagggagggccugcgacccuucacagccagguggcagugccagauggaaacaugucagcacugccguggaguuugucccacguguuccuggacacuucccgagugccucucaucuguccucacagauaggcauuuucaucuucacuuuauagaugaggaaacggaaauccacagacauuaaacagguuccccucucuauugcugaaaaaggaauucgaaucugaucccauagcuuacucuguuucuguuaagauguggacugacuaaucuuucccuagaauuaguauucauacaaugaguaaauuauucuccuuaaaacauuacuuuauauuuuacuuuguuuuauguuuauuuuucccugaaguguuuuguggagauggaaacuuuuguuuuaaaagaaguuuugauuuugauuuuuuuggaacacauuucaaaaauuucaaauugucauagcaaaauugaaaauggggcugcacuacuggguagauaaacacaucuccccaguccccugggugacacuugaguggucccucguggugcuggggcgguggagugacagccagauggccgugggcugcugcugccuucugcccagaggcacugaccgaaccccugcuucuaacccaguucagacacucccuguaccucaacccgguucagacacucccuguaccuccuuuuugucauccuuauugcuuucaaucacaguuuucucuuaaaaaauacagauuucuuuccaugaaaacuucaguucugccauauaaaauuauagucuauuuccuugaauuuugugcucuccuuuaucaacuugguuagcacagugugugcuccacaguguuuaaauccauggcuuaauggccuauuucaggcuuguaagaaauucucauaucuuuuagauuuuaauacauuguuuauucugaaucagauaauucagugcucuuuuaaagcuucagagagucacgguucuccuuccauacuaagauuuguuuaaaaaaaaauaaguucggcaugcagccagggaggagaaagucauagaaaagcaagaaagcagcagccccucggugugaagaaaguugagcuuugauucacuaacugggauaugagccaaggaagccgaacagcacagaagggcucuauuucccccucacuugugugccuccugccugggaugcccacagaucauuauuauguaagaauuccccucucgcucaacuacuggagaaaagaaaaaggaaugcuuaguaggugaugcuaugacauuccuguggacucgauaauucaugaaaaaauguacaguuaacauuucuuuauuuguuuagagauuuuuguuuuuuauggaaauaauauugaaugaauauaguuuuauuccugguaccaaacugacauauucauauacuuagugaaaaccuuaguaagguucauggaaaacagggaaauaaaaguuccucuuuuuuucuaauuauuugcaacuuggucugaaaauucuaccaagcauaaaauaacaucugaagucauaagcuuagagauaaaccagcuaugucagaaaaauuuucacaagaauaauuuuugaauaaaauaaggaucacuaaauuucaaccaaugauaggauaaugaacucuggguacaacucaccuagccauaauggggaguucaucguaucccagguccagacuggcuuuccggccaggaggugaauugucuuuuuuccaaggcacaaggcuuuguuucugcuuaaucuacugcuaguaaaugcaaaguuugcaaugcuuuaguacaaugauggugucuagacucauuguucuguucaaguccacuuuuuagguaauaaaaguuuuuugauauguaggugcauaauacuaucuaucuauauuuuauuuauuuauuuauuuauuuauuuuuggagacggucucacucugccacccagccuggagugcaguggcacaaucauagcucacugcagccuugaccucuuggacucaagugauccucccacguagcugggauuauaggugcacgccaccauugccuggcuuauacucauaauuucuaaaggaaaguucagguuucauuuuuuaaauuuuauuuuuaaacuuagguacaguaaauucacucuuuuugguguacaguucugaguuuugacagcuaccacugcaguccugcaaccaccacuacauuucaugauacagaacagcuccgucaccuccccagguucccucgugcugcccaucccccugguccuaaccauggcaacagcugauguguucuuuguguucauaauucugcguuuucuaggaugucauuauaaauggaagcaugcaguguauagucuuucgagucugacugcuuucauuuagcauaacacauuugcaauucaaucauuuuguugugucaauaguuuguucuuuucguggccaauaguauuccaguguuuagauauaccauagcuuguuuauccauucacucauugaaagacauuuggguuuccagcuuuuggcaauuaugaauaaagcugccguaaacauuugcauacagguuuuuguaugaauguaaguuuucauuccucuuggguaaauaagaguaaaaugacugggucauuuggcaaguauauauuuaauguuuaagaaauugcccaacuguuuuucaaagaagcuauaccauuuuggaauccucaccagcaauauaugagaguaucaguaguaguuccacaucccuaccugcacuugauagugucaguuuuuccucauuuuaaccaguccgauagguaugcagugguaucucagcaugguuuugauuugcauuuccugauggcgagugggguugagcaucucuucaugugcuuauuucccaucuguagaucuuuggugcugaagcuucuguucagcucuugugcucauuuuuuaucagucuguuuucuuauuguugaauccugagauuuuuaaaauauauauauguauuuucuagaaacaaguucuuuguuagauaagugauuugcaaauaacuugucgcagcuguggcuuggcuugucauuuucuuuuucuuuuuuuuuuuuuuuuuuuuuuuggagacagggucucacugucgucgcccaggcuggagugcaguggcaccaucucagcucacuacaaccuugaccucccgggcucaagcagucuuccagccucagccuccugaguagcugggacuacaggcucucaucaacacuucuuguuaauuuuuuguauuuuugguagagacaggauuucacccuguugccuaggcuggucucgaaguccugagcucaagcgguccacccacuucggccucccaaaguguugggauuagaggcaugagcuaccacacuagccuuguuacuuucuuaacagugucuuuugcauaacaaaggcuuuuaauuuuaaugaaguucacuauaucaguuuuuucuuucauggacugugcuugaggugucauggcuaagagcaguucacaacauuuucuucuaaagguuuuaggcuuuucguuuagaucuuugaugcauuuugagguuauuuuuguauaaggugugcagugugguagaaguagugcauuuuuuuuucacaucgggauauccagugggucucacaccaucuuuuggaaagacagaucuguuuuccauuuauuagaaacauguuuguaagagaaaaaaaaucaguugauuguauuuguugguuuauuucuggauucuauucugcuccauugauuuauguguccauccuuuucgcuaguccuacacugucuugacuuguguagcuuuaugguaagucuuuaaaucaaguagcgugaauccuccaacuugguuccuuuacaaaauuguuuuggcuauucuuuuucuuuugccuuuccuaguaaauuuaaaugucaguuuguagauauuuauaaucaugcuggaauuuuuauugaaaccgcauugauucuguagaucaauuuucacaucuugauaucucaucuuuuaauccauauauaaaaauauaucguauuugauuuucauuaggguuuuguagucuucaacauacagauucugcauauauuuuguuagauuuauguguaagaauuucaggccaggcgcgguggcucaugccuguaaucucagcacuuugguaggccaagguggguggaucaccugaggucaggaguuugaaaccaaccuggccaacauggcaaaaccccaucucuacuaaaaaaaaaaaaaaaaaauauauauauauauauacacacacacacacaaaaauuagccaggcgugguggcacacaccuguagucccagcuacucaggaggcugagucaggagagucacuugaauccaggaggcggagguugccgugagccaagauugcaccacugcacuccagucugggcgacagaguuagacucugucaaaaaaaaaaaaaagauuuauauguaagaauuucauuggagaguuguauuguaaaugguacuguuuuuuaaauuuccauuuucuaguuauguauugcauauagagaucgcuugauuuuuguauauccaccuuuuaucuguggccuugcuaaacucacucaauaguuccaggagcuuuuuuguggguauggauucuuugguuuuuuugucuuuucuuuuuuuuuuuuguuugagacggagucucgcucugucgcccaggcuggagugcaguggcgcuaucucggcuuacugcaagcuccaccuccuggguucacaccauuuucgugccucagccucccgaguagcugggacuacaggcacccgccaccacgcccugcuaauuuuuuauauuuuuaguagagaugggguuucacuguguuagccaggauggucucgaucuccugaccucaugauucacccgccucggccucccaaagugcugggauuacaggcgugagccaccgugcccggcccucuuuucuuuuuuaauguagacaaucaugucagcuuggaauagagaguuuuauuucaucuuuuccaauccaugggccuucuacuucuguuucugccuuauugcacuugcuaggacuuccuguaugcucuugaguagaaauagugagagcaaucaucuuuggcuuauuccugaucuuagggacaaagcauucagucuuucaccauuaacuaugauguuagcuguagguuuuuuguuagaugugcuuuuaucaaguuaaggaauuucucuucuauuucuagguuguugaaaguuuuuguucaugaauagaugcuggauuuugucccauguauuuuguguacucaucgagugauuguauggcuuuucuucugcuauuaauacagcaaaucacacugaucagcuuuccauugcugaaccagccuuacaugccuggaauaaaccucacucgauggugauagauuauucuuauauauugcuggauuaaauuugcuaauaauaucugguugaggauuugguucacgaugguuauuggucuauaguuuucuuguaauuuguuugguuuuaguaucagggcaaugcuagucucauaggaugaguuuggaacuauucccuccuuguuuauauucuggaagagauuauauagaauugauacuguucuauaaguguuugauagaacucaccacugaaaucaucuggaccuggaguguucuuuguggggaggcuuuaacuaugaauuuaauuuccuucauagcuauaggacuauucaggcugagcuuugguagcuugggucuuuaagggagucgauuuauuucauagaaguuguuagguauaguuuuagaguugcucauaguauuucuuuguaccuuuaaagauguuaggucuacuccuucauuucugauuuugaucauugucaccucucuuuuuuucuuugguuuuauguauuuuuauuuuucucuuuucuauuauauuguuucugcucuuuuaucauuucuaucgcuugguuuggguuugauuuauucuuuuucuaguuucuuaaauauagaaacuuagauuauuguuuugagauauuuccgcuaucacaggcauuaaaugcuaaaaacuuuccucuaagcaugcuuuugcugcauucuauaaagucuaccuuauugaguuuucauguucauucaggucaaaacauuuucuaauuuuucucauaaguucuuauuugauccauggguuauuuagaaauauaccuauaucucaguaucuaugggaauugguuccagaaccucccacagauaccaaaauccauugaugcucaagucccugauauaaaaugguauaguauuugcauauaaccuaugcacauucucccguauauuuuaaaucaucucuagauuaauuauaauaccuaauacaauguaaaugcuauguaaaucauuguuauacuguauuguuuugagaauaauaacaaggaaaaaaguccauacauauucauuacagaaaaaaauuuuuucccucaaauauuugcaaucuaagguugguugaauccaugggugcagagaccguggauacagagaaccaacucuauguuuaauuuccaacuaucuggccauuuccugaauuuuuuucuuuugaccuccaguuuuauuauguucagagaacauacuuugcaugauuuuuaguccucuuacauuuauugagacuuauuuuauggccuagcauauggucugucauagggaauauuccaugugugcuucaaaagaauaugugucuguagcagcuggguggaguguuucauucaugucaguuaggcuggguugauaguguuauucagguuucuauauccuugccaauuuucuuucuaguucuaucaauuauugaguaucggguauugaaauuuaacauuaugauuaguggacuaucucuccuuuuaauucugucacuuuguuuuauguauuuugagucucucuuguuagguagacauacaguuuguaauuuuaauaucuuccugauguagugaccucuuauaucaugaggugucccccauugucucuaguaagauuuccuguguuaaaguguacuugucuaauauuaauauagccacuccauuucuguuaugguuacuguuuguaugguauaucuuuucccauccguuuacuuucaguauaugugugccuuugaaaucaagcuguuucucuuauaggcaagauaguuggaucuuacuuuuuuaucaagucugacaaucucugcuuuugauugggguuuuuaggccauuuguauuuaauauaauuauugacaugguuagauucacauuugccauuuuguuauuuguuuucuguguuugcuucuuuuuccuccuuuacugccuuuucuuuguguuaaauauuuuacgguguauuguuuuaauuccucucauuguuuaagcuaaauuuuugaaguuauuuucauagugguugcccuaagggauauaauaugcaucuuuuuuaacaucacagugcacuuuagauuaauauuaauuccaguaaaauaaagaaauuuuucuccuauauagcuuuauucccuucccucauuuaugccauuauuuuuauauauauuacaucuguauguuaugaauccaacaauacauugugguaauuacugcuuucuacagucuuuugucuuuuaaagacacuaaggaaacaaauuagaaaaaaauauaucuauagaaucuuuuacauuaauccuuauauuuccggugcugcuuauuugucucugcagauucaagucaccaucuuuaguaauuucuuuuuagccugaaggacuuccuuuaauacuucuuauaaugcaggucuguuaucagugaauuaucucauuauuuaucuggguaugucuuuauuuuuagaggauagucguaccgaucuggcuccauugugucagaaagcaagucagcuguuaaugcuguuuaucucacgugcccacucuacuaugcaugaucagucauucagauauuuuuugucucacucucucuucuuccucugggauucucauuacaaguguuuggugugcuugauguauucuaauauuuuacguuuaaguuuuuuuucucuguguucuucauguuaguuaacuucuguugaucuaucuucaaauucacuagguguuuuuuuucuucugcuaccuuaaaucuuauguugagccuuaucugcagugaauuuuuuauuucaauuacuauacuuucaacuccagaauuuccaugugauucuuuuuugguaacuucucucuccuuuuugaaacucuguguguugauucucugucauauuuuucuuuaauuuuuuaggcuuccuuuaguucuuugaaaauccuuauagaaucugcuuuaucugccacauuguuuuuuucugccaaauucaacaucugcggacacucagagauagugucuauugacuguuuguuuuuuucucaguaugguucauaucuugcuauuucuuugcguaucucuuaauuuuuuguugaaaacuggacauuuuugagaauauauuuuagcaacuccagauucugaguuuaccucucugaagguuguuguuucugcuuuuuauuuguuaaguaacuugccuaagauuaaaucucugaagucugucucccuggaaguucaguuauugcuguuuguuuguuuguuuguuuguuuguuuuauauuugucuuccuagaguuugcuccugugucuguggauugguaguaagccuuugauugacugacagagguuguacccaaccaccucaggccaguaaguuggggcuccuguccucugucaauguaacuguaacucgauguaacucauucaaagcucaggucauuuuuaaguugcccuggcuuuuacuuucuaccagacccuuuugugucuccuuuacuuguauguacagccucagaguugaccaggauugugugccuggcuuggacccucucuggucuccaauguguaugcauacagccucagccuggaauaugcaugguucaaccuuggcuaucagggcuguugucccuuccuguucaucugucucugagauugucacugccacugacaccaccauugaacauggcaucucccaucacuccaagcgagccuucuacccucacggagaagcugcagcugcccaucuucacagccuguccacccuagugguaccaccaugucgaacacgugggguggguggcacacaggcagcagaugcgggggagacaggagcagccucccaccaccacagauuuccaccaucgucgccugaaguucaguucuucaagcauaaacacuucucagguggccauucgccuuuuguugauuucuagagcacucauuugguuguuuuuauuacuguugucuagcuuuauaguugcuuuugagggguaggguuagcugaucucuccaggccauagcuggaacuucuaccacuagaaggcuuucaacuaauaguaguuuuuguuuguagguuuauaaacauucuuaguguucacuugauguuuguuaugcuauucuugucaagcugacuuucuacuuuuaaaacagaaaggaccacucauuaaacuguuuuaguagagucacaaguuccagaauagcaacuuccauuauugcauuaguggaaaaauuccuuugguauuucaguuuaaguaauuuaaaauaccuggaggaaaaaagcuauagccuuggguuacucuucauaaugcuaaauuuaaacuuguauagauguaauuuauauugcauuuggacacauuuugauaauauggaaauaccaugucguuuguaagaaugacauuaaauuccacucaucacuccuuucuugcuuauaggacuucauguggccacacagaaacuggccuguuagcuuauaggaaagagacagguuuucauguugagauaagauuuaauuuuuuuuuaguacuuuaaggauacuugaagaaaguagcaccuugagguugucauuauucuugucacaauaugugaauauguuaaauuggaauuauguucuuaaaaacugaagucuguugcaucuuaccugugggccuuugagcauucguuguguugcuuguuuuuuagauuaguuaaaaaucuccaugguuuaccuuuugcuaaauagcuuucuacccaauagccaguagacauagaaaugguuuuucaguuacaguaugguaacagucauucauuuuagacaaaguuguaugucauucuuggugugucgcuugcaggccgcuuugaagaggaauuuaucaaaaugcgcauggagagacuucaggccuggaugaccaggaugugucgccauccaguaaucucagaaagugaaguuuuccagcaguuccuaaauuuccgagaugagaagguaggacauuguguuaauauggcaucagagaauauugagaguugucucauucacaccaaacuuauuucugaaaggaguuaaaauuauguugguuaguuauuucucacuuccuccagugacagugaggggacagaaaccuaaauccccaccauaggaaauuugucaugaugugugaagaacugccugccagaagggcuucccccuacacugggaguggguuggcucaagaugggcaggggcagggugagggauguaauagggucagcaguuuuucccuagauguuuuuaaaaauaggaggauaggccccaaacucugaagguauuaucagcaugaagugaggggaguggagugacugauuuucccgaucacguugcccuuacaauguaacagcaugauggcaggaaagggagaggcagacaugagccgcucuucucagagccaggccauuuucaucacuguaauggugaguccagagucagugcuggccucucucucugccugccccuguggccuguagucugccaguggucaucuguucuucauuaaaaucaaggaaacguuggcugccugacaucucaaaagugucugcuuuggaaauaguuuucucucucaguaagcauuuacuguacuccuuauuguaucauuuuauucucuaaagauguuuccuccacaauuucucucaacaaauacugcaucucucagcacccuaaagaauaaaagcaggaguuggcccagaagccacagcagaugcuaaauacauuaucagccugggaaauaaauuaugaagcuauuuuugucuuuaaugaaauaauagaauaucauauacccucuuggaacuucgagagguuuacuugcuaaacuucuuuguaguaauuuucacuuguugaagugaacacauaguaagucuuaaauauuagggcucuaucgguguauguuuacagguguaugcauacacuuaacauacauauuugggccuuauuuucaguuauugacuauuucuagaauugaccagcucaugugauauguuauaugucaccagauugggaauuagacaacauggagaugcuucaccaugucuuugugaauuuguguauaucacaggucuccucaccaugucuuaugaauuuguauauguuuauggugagauaggguacucagucacacugugugucauguagcuauauaguagugaaacuaaguucuuugaauucaguaaauauuuggguuacuuuguaguuacagaaacuacagggaaccaccuccaaguuuguugccuuccugguucccacaagacuuuaacaagagcuuauuugauagauuuuccaaggauuugauuuagaaagcauuucugaaggucauguuuucugcaugguggaguuaauaaauccuagacaucaguuguguugguuuuuuuaaaugccaccuucaaagagggaucaacgugucauaaaagugguauaagagaaaaaagaaagaacuuggagucagggcccuugaguucuggucuuagugccacuucuagcugccucuguggucuuagugaagguauuuaaucccuuugggccagaauuuccucacuugcuaaaugacacuguagaacuacauagaaacuaugauucugugguaaguagcagcucguguaaauaaaugguagacacagaaacccccaaagaaucugcagagacauuauuagaaauaagugguuaguaagguagcuggauacaagacauugcauauuuaucagcaaaaacagaaauugaaaaucuaaaaaaaaaauaaccugucauuuacaguaacaucaaaaguaucaaauauccaggaauaaauacaagaaaauguacaaaagaucuacauagaaaacuaugaaacauuauugagaaaaauaauagaagaccuaaauaaauuuucuaauacugcgucucauggacuggaaacaauaaagaugucauauguagaaaaucaaaaugccaagcauagccaggaugcucuuggaaaauaaugaaauaggaggaggacuuuauugcguaucagaacucauugugaagcuaaaaaaguuuaaaagcauggcauuggcauaaggcuagacaaaccaaccaguagagcagaguagacacuugaucuaugacaaagauggcacugggcguaguaggcaaaggauagucuuuucaguaauuggugcugggucaguuggauggcaaaaugcagggaaaugaaaugugcucgcuaccucacuacaaucugcaguugauuuuauuaagguuguuauugauauuguuauguuuuuaaaacaugucccaggcuggguguggcggaucacuugaggucaagaguucgagaccagccaggccaauauggcgaaacccugucucuacuaaaaauacaaaaauucgccaggugugguggcacacaccuguaaucccagcuacuugggaggcugaagcaggagaaucguuggaacccggggguaaagguugcagugagccaagaucaugccacugcacuccagccugggcaacagagcaaaacucugucucaaauauauauaaauauauauauguauguauuauauuucaaauuagcuuuaaaguaagaaaaaaaaaaucccagagguaaaauggaggagaauaccuaugaaacaagauuggcaccucccggggagcaguggugccugggcagcuuuucccuuggccacaugugcugaagguggagcugugggucuccuguggagucacagcagacaggcacuuggaaaguuucuuucacucugaguuuugguugaaaggaaagcacccaaaacuauagccaaaggagucauuauacuuccagaaaaaucucaaaaguauugcaagcaacaguaguagcuauuggaucagaccuuaaagguggggguggaaagauuuaaccaguuagcucagugaaaguuaaaguuuucccagaauauggaggcagcaaaguaguucuagacaaaggucauuucuuauuuagagguggugccauucuuggaaaguguguaagccgaaguaaaucccuacugaaauggcaucacaugccaccacaguuccgaaagccuucaucauguaaaugacuuccguaucucuuuuacuaaacuaaugauauuuuuaaaaagauuggcaaaaguguugguaauuaucgaagcugaaccugggggguuuauuauacuuuucuucuuuuguauauguuugaaaguuuucauuguauauggucuucuugaaaaugaauuccauguggcucgcagauuuaaaugugaaaagcaacauaguaaugcuuacagaagauaacguggaacauccuccuauccuagagagcagggaagaauuucugaaauaugacaugaaaaagacuaugcaggaagauguggauaaauuagacuacauuagaacuucuuuuuucagccaugacaagcgaaaaacaagcuacugaguagaagauacuugcaacauauauaagcaaugaagggcuagauuuuagaauauaggaaaacaucaguaagcccaguggaaaaauaggagaugugaucauguacuucauaaaauaagguaucugaaucaacaacagauguguagaaaaguaccuaaucucauuagcaaucaauaaauacacauuaaaaccacaauaagaugccacuacacacgugccagaauggcuaaaacugaccauaccaagugucaucuuggugaggugagaugcugcugggauucauaacguguugggggaaaaugguaagacuaauuuggaaaaguuuggcauuuacugaaguugaacccucucauaugaccuggcauuuccacuccuggauauguacugaauagaaaugcaggcacacagacaccaggagacaucuacauaacagcuucauucauaacuugauaaggguggcuaccaguaguagaauagauaaauaaauuggggauuacucauaaaguagaauauuauacagcaaugaaaugaaugaacuguaguucuacacaagauuuugacuguaguuccuaagcaagauugagcaaaagaagccaggcaccaaagaacgcauuuauagggcucuuugcuagcuugaaaaacuagcaggacaggguagcaugcaugcguaggugguaaaacucuaaacaaagugucugaguccauuugugcugcuguaacaaaauaccugagacuggauaauuuauauacaacagaaauuuauuucucacaguuacggaggcuggaagucgaagaucaaggcaccagcauuugcugucuggugagggcugcauccuccaaaggagagaaaugcugaguccccacaugguggaagguggaagagcaaaaagggacaaacccccuccaucaagcccuuuuaucaggaugcuaaucucauucacaaggggagaagcucucaugaccuaaucacuucuuaaaggccccaccucuuaauauuaucacauuggcuauuaaguuucaaaacaugaauuuuggagggaacacauucaaaccauagcagaaaagcaaagaaaugaaaaccauaagagagagauuaccgguuaccuuuguggggaagggaagagguagcaguguuuggggaaaggacaaugcgggggcuuuuggaaugggagcucuuugcuccuuccuggccuaguuggucguuaggcaaguauucacuuugugacaauucauugcacuggauauuuuugauuuggguacucuguguguguauaucuuaauauuuuuaaaaaaauagcucauaauacugguuucugucuuauauuuuagaaaagcauuuaccuuuuuagaaaacagauaaccuaaauauuugaggcacuaggucagaaugcauagggugggccgagcacaguggcuuaugccuggaaucccagaacuuuuggaggcugaggugggcagauugcuugagcacaggaguucaagaccagccuggcuaacacagugaaaccccaucucuacaaaaaauacaaaaauuagccaggcaugguggcaugcgccuaaagucccagcuacuugggggcugaggugggaagauugcuugaaccuggaagcucaaggauacagugagcugagaucaugccacuguacuccagccuagaaggcaaagugagacucugucucaaaaaaaaaaaaaaaaaaaaaaaaguauaggguguuucuguuugcuguuuuuauauagguagccauuggaaagagaacauggcugaauugguucauucuuuaaagauuuggucccauuaggaccauucuguggaaugacacuguucaugcccugagauuacauucggaguauaaagguauuuaguccauggugcagagggagauagagugggagcugcuuccugaaaauuagaaagauaaaggugauaaaugagcugguccuguuugggaauuuugaagaccaguuugacugugcucuccacuugaaccuuacaacauucucauuuacaggaauggaaaacuggaaagaggaaggccgagagagaugagcuggcgggagucaugauauuuuccaccauggaaccagaggcaccugacuuggacuuaguagaaaugugagagacgcugccagguuuucuuucuucucaauccgcacccuccuccuuuggccaucaggcuucagccaguguagccgcagccgaaacucaaaucagacuagacuuuuaugaaaugagugggauuuguaguccaaugacaagggaaacaucauuuguacauagaaguacugucuuucuaaccgcaacaucaaauuacaaucuuucuuucaccuugaagccagugauuucauaguugacacggugcugaguagcuguuuccaauagugugaugaaaccaagcggcauggagccaccuaaaacccacucaauauucagacagcaaaucucuuugaacauugccuugaggaagcagucucuaaccugcuuuuucuguaugcuuuuuuaaucuguugauugauuuuaaucauguaguuuuuuaaaugcagggucaguugaaacuuuggaguaguuccuuuucucuuacggacuuaaaagaaauuugcgugguuuuuaauuuuaagcuuuuuuuuuuuuuuuuuuuuuuuuuugagacggagucuugcucugucacccaggcuggagugcaguggcacgaucuccgcucacugcaagcuccgccucccagguucacgccauucuccugccucagccucucgaguagcugggacuacauaauuuuaagcuuuguuaucauaaaauuauugcguauguguuaccaaaaguauagacaaguaacacacacacacacacacacacauaacccuucaaccacgcagagagaaaaucaguguuaauauguuaguguuuagucucccaaauccuccucuguacguauguaauuauaggaaagauuguuuaaacaaaaaugaccucacacuagacauuuuguuuuauaaucugcuuuuuucaucuaacaguauauugugaucuuuucagguugguaaauacacuuuugacauccuuagaaagaacugguaucuuuaggaucacuuaggugauuguguauccagguuauugucuccguuucauggaguacuuggaaugaauggccagcuagcauuagcaaccccuguuauucuuuuauagauuugaugguccccccagugauuggaauuuuccuaaauaagauauucaagaaauuauuauuuuauuuacuuuagaauaauuuuaaaauucacaaagaauuguauaggcagaaaggaagcgaaguuaaaauauaaaucagcgcuuuuuaaguaguucuuuaaaugucugcaucaagccuguauuuaaggcuaacuuagugaaaggggaguuguuaucaugcaagaaaacaagugucugugguuauauuuggcccgaguauccccacagcagugcuguuucuccugcuuaugugacugacggccgccuucacccacagagagcagaagugcgaggcuguggggaaguucaccaaggccauggaugacggcgugaaggagcugcugacgguggggcaggagcacuggaagcgcugcacgggccguaaguccacuccucacagugcacugggcucguagggggugaugcaggcucaguuuuaugucccuuaucauagaggggaaccugcugccucgaacagaaguguauuugguggacggcaguaaugucccuccugugauucugcuugaucucacuucaccugaguuaaaccacagaaaacugaccagcaaagccagguuaagaaaucucauagggaacaccacguucacuuaauuaguuccaguaauuuggggcuuuauaaucuuuggaaaauuaaucauuuuugcauguuuucagagugcuuguaguuauucuuagucucaugauuuuauuuuuuaaucuucauccauuugguaagauguuguguauuugacuaaaaccauaguguuuagaaaaaccaauauaguuaguaguagaaaauaugucacagcagaagcacugccgaggggagagugucgcugucagucacggcuuucugaccacucugcugugucccuaagaacuuccugccucccuccuucuccuuuguuuguaggcuuucauucugcugaagguuuuuccuguauuuccuagaacugugcagcucugucaccacacauguggcccaggauagaaaaauagucccguauccagcuguagggcuaaugccacgggcugcugcccuguuacacccacaggcucagaggcugcagagugacuugucaggcccugaaaugcugcgacugcacugcugucccaugcgcagaugccuuuaacucccuuagaguccuaggacuucucuccuuuauaucuggucugcccuuauugcugugucuuaaccucuagagaacagggccuucuaaucuaucacuaagaauuuucuggccuucaccucauaacaccauacaggaauauugguuguauucaguuaaaaaaaauguuuuauauuuugaauuaugaguaacauauaccuacuuuucuaucagccuuugaugcucagcauaggaaagggaucuguucuuguaaugauuuuuuuaaaggugauauuuuuacacuaaaaaaagaaaacaaucagaauuugaaauccaauaauaauuuuaaagagaggaaacuaaauauggagugacuuguagaugaauuaauaagauagcacagcaaagacaaugucaguauuacuauucaauccagaucugaaaauccaaagccuuacaucaggagucaguaaaccaugguccgagcaccauauuuggcuugccacuuauuuuguaaauaaaguuuuauuggaacacacccaugcccauuuauuuguauauugucuuuggcuacauuugugucauaaugguagaguugaguaguuucaacagaaacuuguggcuccauaaagccuaaaacguuuacuaucuggcacuuugcagaggaaguuugccaggcccugccuuaccucaaccauuggccaauaacuaccucugccucuuccucuacuagcaguaauaccaguaccaguggugcuuuaccauccacauauuaucuuauaccaacaaaacaacuuguagcauaccagcuguucgugcuugaggggcagacaucaggaauaacaguuguuucuuucccauggcaaagaaauaugaugcuguauccuaaauauauagaauuagcccugagaaaauaauguauacaaaugcagcaucuagaaaacaaaaccugugucaagacuuuagucauagaggaugacucaggaacaaaaagcaaaguugacguuguucucuaaagcagaggcccccaauccccaggccauggacugguacauggaccauuaccgcacagcaggaggcaagugaagcuucaucucuaucuacaggugcuccccaucacucacauuaccgccugagcuccgccuccugucagaucagcgguggcauuagauucucauagaaauuugcacccuauuaagagccacgcauacaagcuugugagcccuuaugagaaucuaaugccugauaaucugagguggaacaguuucauccccaaaccauccccccgacccacugucuaucuguggaaaaauugucuuccaugaaaccagucccuggugccagaaagguuggggaccguugcucuaaaguauaaaugaaagaauucaguuuuuaaaggcaaugaauuaauuuugacuguaaacucuugcaagaccaucauaacacaucauuuaaaucuguauguucuuugaaagccauuuuuccugaguguaaauuuuacaauugcauuuuuuaaggauaucauaaaaauuugggauuaugauaucuuuuuaaaaauuaaaucccuuaugucuaaugucugaucaacuccauguccuguguaauucacaaggcuaaauguagaaaguagggaauacuggccucaggccgcucuuuugugggguggggaaagggauugacucaggcauaucuccuccuguuucucaaaguaguucuuuaaaauuccuaauguguagaaugaaaacucuagcacacacucugcauggugaaccacaugccaggugccuuuagguagagaggcaaaacugagguaccacagggguacaauuuauuaaaauuaacugagcucguguaauuuggauucauguuuccugauaacugcagcuuauagaccuuaccucaaaugucucuggccuaaauauuuuuuaaagaaacauuaaaaguuuucuuuuucuccuuuaauacugcagugagucuuuaaaugcaaauaaugguuucuuuugaaaggcaaacagaugcuccauuuaaggggacuccauacagaugcaaagaaaguagcuuaaggugcagagacucuugggaaguucuccaaagugauccuggaaucuuagcaccuuaaaaagaaaccuuaggggucauuuauugaaaucaucucuucaugcagaugagaaaacucagaccccucuucccuggucaugcgaagucugacuguuguauuuuucuccauaccuuguugcuuucagucuuuggugguuaugguuugcaaauggucauuuaugcaccuguaacagagugggaaaggcuacguauuuggaaucacaaguccauguccagcauuuauuagccaugugaccuugggcaagucaguuaucugagccuuauuuuccuaauccucagcaugaggauggugucucugcaucugguagaggggcuaucaugaugaucaagcgcggugucgcuagaaguacuuuguaagcuagaaaucaucuaaaggagcuuccauuucacuuacaucucauuuggugaaugagaauguaggagugauugucaguaauaauagcauccaccauuaguugaacagucaauuaaaauaaucgaaagaaaucaauugaaaaaacaaucacuuuugcaacaguauuuugugaaggaauauauagacuauuuugaaucacuucaaaaguuacuguaaucacuuuuaggaaauaguuuaaucccauuucaguuugcucagaagacuaaucguuuauuccuuuuugucuuucagcauuacccaaggaauaucagaagauaggaaaggccuugcagaguuuggccacaguguucaguuccaguggcuaucaaggugcgucuuucuucauucauccagugggccuuuagagccuuauguagaccugucaccugcuuaggauccugcagacgcuaacucccuccucagugaagcacccugguuguggguguguaaauuggcuaggcugccgcacuaaggacuuuugcacccucauccuaggacuuuugagaaaagccaaaggugguuauaauuuguauuuucuugcuagcucguuugccuuuuuuugcucucugguguagcgcuuuuguuucaaugccaucaguuucauuucucugccaagucuuccugugacagaggccagauuuggcugggcacaguggcucacaccuauaauuccaacacuuugggaggcugaggugggcaaaucacuugaguccaggaguuugagaccagccugggcaacauggugagacccccaucucuacaaaaaaauaaaaaauuagccacgugugguggugcauacagguaguugcaacuauuugggaggcugaggugggaggaucacuuaagcccgggaggcagagguugcacugagccaugaucuuaccagugcacuccagccugggugacagagcaagacccugucucaaaaaaaaaaaaaaaaaaaaaaaaaaaagccagauuucaucaaggccauuucaaggaaaaauguuugaccaaguaacaaguguguguugccuguuuucuccuuaacucauaacuguuucagcuuauccuauaaauguguaucuuacccagggaucccuuugugguuuacauuggcagcacuuaugagagcaaguuagcucuuuuucuuuauuaaaagggaaaggaacccaggcaacauaaggagaccccaucucuacaaaaaaauaauaaaauaaaaauuagccaggcauggugucacacaccuguagucucagcuguucuggaggcugaagcagaaggaucgcuugagcccaggaggucgaggcuauagugugccaugaucacaccacugcacuccaauaugggcaacagagugagaccccaucucaagaaaaaaagaagaaaaagcauuugucagcuagguggcaccuauuaaaucuguuaucuccugucacuuauagaagugguagaauugguacagguguugauccugauacucaaggcagacagugcuuuggaugucgguuucugaauauuuuaauaauaaacuaauaagaaguuucucaccaaaauguaagauuuagggcucccacauggcaauaguucucauugcccuggccuuaccaugucuuacaguugacacuuuuagaccagaagcgggcuuugaggucuagacugggaacucaaggccagaacagagaagcaucuuggcccagguaacaagugggugauggaagagcugagagcaagccacgcccauugcuuagggaggaggcagaggucuuggagcccuuuuagcaugguggcucugugaugucucaacagggugagaagauuuguccuagagaugcuggaauuuuggccaucaugauggcccggcuccacaggcauccauggguuccccacugggagcugcuucgugauucuuuaacauuuucuggacugugauuaucaauacauaauuaaauguuccauauugcaaauagcacuuuuucaaguauuaaaaauacucaguguauguuuuauguugaauaucauucuacuuaagauaauauuuuaaggaagcauucaaguuccuguugacuggcuuuucucccauuacaaaggacagugaaggucagcaguguggaguacuguguccaucacauccacuugcucagauguguuggcgucuuagagcagugcuauacuaugcgaucuugcaauaauguaaauggguuugauuccuggaaauauugugauuauaguaaaaauaacuuccagugcuccuuuacaaguucauguacuaacuugaaauaauacagacuauuagcauggccccugcacaaaaccaugaaacauugcauauucuuauggaugagcauauggaaauauaagcaauaaaaauucuuaaaugauuauagggaaggagagagagagauggaagguaaacugauuauaucuuguuuuguacaguugacuuuggaauaauguaaaugcuuuacauaauuauuagaaaacaaauuuaaaucaaaauggaaaaaaaauuucuaaucaaaagcaaaauaaaacaaaugauacaucaaaaugaaggcauagcacacagaggaauuguuucaaaacaccuuaaaauggcauuuuauaugcccccaggagcgggugccucaaggucagaaagacuauaagaauguuaguuguuuucacuaaacauguagucaauaucauguugguauuguuauucuaaaacuucuaaaacuauuuacauauuguaggauaaagcaaauacguaauuauguuacuguuguuagcaauuaagauuuuuaaaauaaaaaguuuuaaaauaaaugaagaaaaccccuaaagucauaaauuugcuuuggaaacagugugaacucauuacaugauuuccuucuuaaaaaaaaauacaguuugccuuucuguuaaagcucuagaaacaguuacccaauccaguagcaagaagcauucccuggcaccaaucguaagguccacgucccaccacagugaaccaggguuccuaucaaaagacuuagauaccaauuggaagagccuaccacuggccaaagaaaagaaaaugugagcauuagugaaaauaauaauuaauguggaaugaagcauaucaaauauuuuuaaauccagaauuauaaagaugcuuuuuaagaaauuaaucucaguuacuuuuggagaauggugguggauuaacucauuauuuugaaaacuauaaagagaaagaauuaagcacuuaaccugcuuuuccuguucaaacucuaccucuggguaaccggaauauugauaaaggaaaguugauccuuauggaaguauuucagcuaauaaagaaggaaugguagaaauagaauagcaccauuuugcaaacucauacuaaaauaaaagauccagacaauggucauucuagguaacgaucauuuucuaacauucuaagaguagaaauaacugaacugguggugugugacucugaucaggccucuaggucuaauagccagugugaagagaacacagggacaggggagugugugacauaucaccagagacacagccagcagcauccagaaugcaggcaccagggcacacgacaaauucaacaccccacgaaaagaaaggugcagggaaaaaaggggccgagggagaagaauccacagaguuaagaaacgcaucaguucugugccguauggaccuuuacauccugauucaagcagccagcucucccugagaggccucauuauagccgaaugacagucucgucauaggugucauaaugguacugccucauguuuuagaguccucaucuauuaggcaagauuuaugaaugagaugcugauguccggugaaagcgggucgggguguagacgaacacaggcuggcgagagcugccaguggggaaggcagauggugggugaugggcauucauucuauucccaauaguuuugaaaauguuugaaaguuucuauaauaaaauuuaccaauaaaaucaauaauaaaauuuuaacaagugaaaagaaaauaugcauaacuuauaaccacugauaaaauugaucauuuucaggugaaacagaucucaaugaugcaauaacagaagcaggaaagacuuaugaagaaauugccagucucguggcagaacagguacuaacauaaucacacaauuccaauuaagauuuguugcuaucuaguccacauauuuaauuuaaaaccugucuuaggacaaacgucccaaauaaguacccucuucuuuucuguuucuguguaucuuuuuuaauuguguuuaaucaugguuucuuagguuaagacaaaguggaugaauacauuugucaucaagaaaucuaaauaggccaggcacaguggcucacaccuguaaucuggcacuuugggaggccaaggcgggugaaucucuugaguccaggaguucgagaccagccugggcaacacagugaacccccaaaaauuagcuggguguagugguguacaccuguagucccagcuacucgggaggcugagguaggaagauugcuugagcccgggaagucaaggcugcagugagccaugaucauaccacugcacuccagccugggugacagagcgagacccuaucucagaagaaaaaaagacaucuaaaugaaugcacuccaguauugaugccucugaucuguucuuagccaucaggggauucuaaagaacaggaaagaaugcuggcucagaucuguauggaccauugcuuagccucucugagcugugguuuccuuaucuguuaaucugcagugguagugccuacccuguaugauucuuaagauuuaauagcucauaaauaaaaagcaccugcuacaguccccaggacaggguagguccuugucauagcuacauagcuuuuauuggagucuuuaguaccccaguuucaggggcuuuuuagauaacagauaauaaguucccuuaagaagaaucuaaguuauuuucuaaucccuuaauuaaaaaaaauuuuuuuucagaugacuuuaaacuauguguauggaugcacacauguguacacacacuaaugugguugugggcuacuuugcugauacuucuaaaaaagcauucauuuuaauaacauagcuauuaaaguuauaauucagaaaaaauggaaaaauuuaaaauuaccacuuaaaaugauuaguuuuaauauuuuuauauucucugcucauauuuagaaguuaaacuacaacaacucauuuguuuguguguaaacauacagcauuagcugaacuuccuucauggugguauuauuuugggccacgucaaaauaacuaauuuuacaaaccaacuuaaaaauuacaugauguuuuguuguuuucuuuacaacauaugauucaaaguauggcagucuugggaguuauuuucuuuuagaaaaagugaucugaaugcuuaacacucaauaauuuaguguagcacaugcaggauuuauagucuuuggguauaauaguucucuuuuccuugauuuucugaauuucucugccaguaacaaucagcuuguaucuuguuauagccaaagaaagaucuccauuuccugauggaauguaaucacgaguauaaagguuuucuuggcugcuucccugacaucauuggcacucacaagguaaccugaucguagacauuuauagaagacaacagcaggugaaggaggcagaugugcgcaguagucaguauugguuuuauauguuuauuauuaaaaaagaaacaaucuauaauucccauuagaaagguuuuguaacugaauuuugacauugguuugggguguccucacauaugaauucugguuuucucucccuuuuuaaaaaucuguacaucaccucaggcaugaguugugaguauuuuauauuuuaugucaaccauaguagucuaucguauauuaugauguacuuggauuuguuaggaaaaucucugcaaagggcuggucugugaucuuaacaguccuggcauguggccauuuuagcauucugcuuuauaacuuaaauaucaugaagggguaccauagguaaauuagguuuguacaacuucagauaacuuaauauaaaacucagaaaaauuagcuugcugucgaaauguaugccagcagcaucagaguuguaggccuggagccuaauuaaugcaugaguauagaguuguuccuuccagacagcgguaaauaacgagcagcgugaugacacuggagugggaaauguuuggcagcuuuucuagccgcuuccaucugagucuuuaaauggauucagcgccucuuaaaaaaucaaaggaaagcccaggacuuagaaucagcacacuuaggcacuagcuuauaaaauauucuguuguauaaaaaaagagagagagugccugugugcacaugcugcccuguaccuagccacaugacuuccaaaaccugcuaaugccugauuuccauuacgugcuacuccucaaauggcagcggcuucugaauauuacagagauggugugcuguuugcuuuucucuuuuguuguagcauaaaacuguucauuuuagcuuagugacauuugucaagaauagcaaccuuuuugcuuccaagggacuugaaggaaguuaaauuuagaugcuuuccucucuucuuauuuuguggagguauuuccuguucaguagcaaaucaguuauagaauauauuagcauuguuauauuuuaaacuaaugacuaaucauuucagcuuuauucauacuguugcauuuuauauuucacagggagcaauagaaaaagugaaagaaagugacaaacuaguugcaacaaguaaaaucacccuacaagacaaacagaacauggugaagagagucagcaucaugucuuacgcguugcaagguaagaugaaaggguccuuaugaggugcugguggaaguuuuuuuuuccccagcaaaguuucccuugauagagagaaauccagaugugagcagcaguuaaguaagugagaccuuuuaagccccucguuugcaggaucccggugcugaugaaaaucuguaauauuuauuuaauuuuucaccuguccaccuuaucuggcuauagaugacagcuugauuaaaacuguacauuuuauuauuucugagagacauuuaagauuccuuuuguaaucugugguaucauaaugcucuauuaaaugccagagcccagcuuuuagcagucuguaaccugcgugccuugggaucauggaaugugaagggguuugggugugucauuuuaggcacaauuuuuuugugucaagaaaaaaaaaagaugaauuucuauagguuugaguguuuuugagcagaugagggcagcaaguggauuuuuccuguuggcggauggguggauggcacuuggaugggcagagaauggagagcguguucuguuaggaacaaaagccacaaaauuguggugcuagauugugucaugggcaugaaagaguaaaacauacuuagagguuauugggaaauaaauuuugauugugaaggaacuugaaagcucuagacuugaugcaggcauuaagaagccauuaaaagggaguaaaaaaaaaucaauccucaagggagaaggauuugcugguuauggaggggagauuggaagaugcagacacuguccaagagcccagccagaagaccaucucacuguuguagucugagcuuugagggccuaaagaugugguacuggggagaagagaaugaagcacauuugcaggcuuuuccaaggaacagcuuucaagacuggggcauucaugggagaaagagaaggaugagggagguguccagagccaggccacuacggcaaaaacgaggaacccugauugaaguuucggguuuugaaggguuugaaauggggaguuugguuuugaacuuguguuugagguuauccaaauugagaaauacaaagcuuuguauaacuucaaguaacugaauguaaaauguagaacaguuugcaugucaugggaaucugugcagccgcuggcuuucucagccuggaggguuugggagaaggcggcauaggaggcauccgagggaggcaaugagguccucugaugacgaagacuccucuagaguugggggcaggggcaggggggacagagaaagaaggaauccauguauucagcaaacaugaagaaaguugucccucagcauccaguccuccugcccugugagagguugaguucugacagcgucgcuggugcucaggggcagcaaggcuucccguacugaagaagggucucccgcugucccacacgcugcccagccuuucaccagaaaccugcugaagcaauugcugugcaggagggagcggggcagggaccccagcugccugcuagguccagugcagacacaccagaggcuuugaacugcagucaucuguaacaaauaugaccaaguauuuucuauuugaucgauucuguuagaguaauaggcugcauuugggugauuuaucuguauuggauuuuauaguuuugaauaugcaagacagugaaagucauucauuuacuggaaaguaauguuugucauuagcuuguuuuguuuuguuuguuuuguuugagacagucucgcucugucacccaggcuggaguacaguggugcaaucccggcucacugcaaccuccaucuccugaguucaagcaauucuccugccucggccucccaaguagcugggauuacaggcaccuguugccaugcccggcuaauuuuuguauucuuaguagagaugggguuuugccaugcuggccaggcuggucuugaacuccugaccucaggugauccacccaccucaccucccagagugcugggauuacaggugugagccacugcgcccagcucaacuuguuuuucuaaccucuuaguaaagugauuuaccaagaacugacaacagcagccaaccagauuaggucagguugaugauuaauuguaacugagcagagaaaccagguguugucauuugaaaacuugagggaaaacugauugauguucugauuuggguuguagcugagaugaaucacuuucacaguaaccggaucuaugauuacaacagugucauccgccuguaccuggagcagcaagugcaauuuuacgaaacggugagugggcguccacgugccuuucgcaugugcuugaggagaggguuccugguaaaccacuuugaccauguaaaguuaaucuguuuguauucuuuaauccuaaguaauaaaccaaaggagccuaaauuuuggacaggauuuuuuuaaucuccuaauuccaucugcccuuugcuuuuuggauaacacuggguuaaaaaagauuuucuucugaagcaggggucuuggaugcuaguugcaaggccccaagaaguuccuuauugugcagcuccuuccccccgucacagccucucugugccucugugcaccaggaacggugcugaaugagaugaggucacccagccgucccugggacuccguuggcagcuggaacaggagccuggcaccacacaggaaaccaaaggcagccuuugcuuuuugugaaugagguuuucacagugcgccauggaaaucgcagagagaaaaccaaaaaagcgagaugugggaugguuuuauucacaaaacaauaacgaaaacuuaaauuuuucuuaccucugcuuaguaauuuuguuguuuaccagagucuauagaaaacaaaaaucuaguagcaugucucccucagacaccugcagguaaggucuguaauguagaauccagccuccgcuggcggccuugcugccuacccagcuccccucuggccaugggaucuaagccauguucauggggaguggugagcaagcccucugcucagccauacugguggcaucugcgagcuggacacugcugaaaacgccugucuccagcagccaguucuuaaaggagaacugugcuugauguaccuaaugcauauuugugaauugugucuuggacaguugguuugggagacuaacuuacgggaggaacucaccuaagcccuguccucccuuacaggacgugggcccuaugcucuuuaaaugcacacuuuucccgucaguuggugccauuguggauuugccuuucauuguauauuagaauauaacagauuacauuugucugugugagaaaauaaugcaagggcaacucucaaaauuuugauaguguugauuuauugauuuucaaguccagguaugguauagugacauuguaauucagaauagaaaaccauguauuucaucacugucuuugcauaaaccuaaguagcugauauaacauuguuagguuuuagaucuaaguuuuauggcaaaguaacccuuaaguuacuaaaauuuguguauguguucauggagcagacauauauugaguguuucuuauauaccaagcccucgugcuggauguuuagcauccagggauggauaagacagcugugccuucaaggagcaagaggcccuggcgcagagaccacugcagcgccucguuagcuucacaggcaggcucgugcugucugcacacucagcagugacagcaggguguggccagggcgacacaaccuucaggggauucuggaagcucauacuccuccaggaaagagggggcucuaggcaaacaugaaggccugagcccccagcucaucugaggaaaagcagguggucuggaagcgccgcuagggcagagguggggagcauguguagacgccucccggcgggaagggaccaccagggccagcucgggccccagcgcugccggugucauucgggguuaaggucuguccagcagcaacgcggggcagggcuggugccaaaaagaccaguuaaagaauuggaauuugugucauguuuaacuuguuggaguugugaauaaagaacacugugaggucguaaugggagugauaucucaacguuguuuuguuuugcuuucuugucagauugcagaaaagcugaggcaggcccucagccgcuuuccagugauguaggacagaacgggccuugaagagaaugccgcgugcuuucuccugacuuggggcaaugcaauucaaaacuuuuuuuccccuauuauucagaaaaaaaaggaaacaaaaccaaaaagaaagaguugcaaaaaacugcauuuauuuuauuagccacccuaaaugcgucaguuauuuagggauggucuuuuguucauuuccgcauccauuauuuaaaccaguggaaauugucucuauuuuuggaaaguacuuaaaaguuaccagaauuuucaauggaaaaugagggguuucuccccacugauauuuuacauagagucauaauuuauaugucuuauaaauuauaagucuuauauaauuuauaagucucccacaaucuuccaguucuuacccagugucagauaauuaauuacuaauuacuuucuuaaaaacaugaacuaugccagaauaaaaaauaucuauguuuguauauuuuuauaacuccuuucaguccucuggggcuccugucauugagggaagucguuacgccuuucacugccacaguuacagcucaagugcuuacacuucaagagggaggacgcugggggccccuggggcugcuagugccaucgugguguguggcaggugggccaucccaugucccuccagggggaccccacagccuggcagaugagcagauaccccuggccacccauguccucagcgacauuucugaugugcugcucuuaugugaggaccagugcuuucucucuuugcacuuccuuccuaaucuugguuaaggcauguuuuaugccaugaagaauacauuagaagaauugagggacuuuguagagaauuuuguggcuuugguccaacgggugaguggcugugcggaggccuguguucgggagggccugggagaaggagggcacccagcaccccggcgucucuggcccuuucuuauucuuuggcuccucauccaccgugaugagaagcgcugcuguggccacggcacacugcuuggcuuggguggcggguucauggccaguuggugucaucagcaaagagaaaaagcacagguuagcuccccauuagauggaaaaguguagggacugagaagggcugcagccucagcaguguacagaguccccggcgcucugagguuggagagaaagaacagaccagcgcccuucccgacuacauccgaaacuucacacaggguguuucugagcaccagcacuuccagcgcuucacuuaacggcauaaagcaaaacaggaccuuggcacaccgucagcucgaacucaacacuggcagccaccgucucaccccugcggaggagcgcucccgucucccacaggugccuuaccgcguucccucccgcugcuuucauuuuucugaccuaauaauuacgggaaauggaaagucugggccagcaucaauaaaaugacaccaaaaauaaguagaugaaaucaaaugaauaugagaacaucuuguucuucaauaucacggguuuuuguuaauguuucauaaguaauucuccccacuugauuuuucuucuauaaaaucccauagaacaauguuuaugcuauagccauuuaauauauguacaaauuguaaagaauauguauaaauguuuuacacgaauguaagagcauguagaagccaacauauaaauaaauuguuuaaaaaaacuguacaguaaauucucaaagcacuuuuucaaaacacuuuuuggacuuugugugugauuuuuguuguuguuguuaaguacuuuuuauuccagcugcugaaaaugguccagguaaugaauucuuccccaaauccuauuucuucugacaugaauucaucauuucaguuccguaggucaguguugcgguccgggaagcguaucauaaccaccugggaguugccaagaagcagacagucucccagugucugacucucggauauuuggauuugacuggugugaggcaaagugaaaaagggaugggggaaauggagauggcacgggcuccucagagcgugguagccgacugugaggaaaagcagagggaaugugaaagaaaauaagagaauccacgggauuugaugccuggaagauucuccuucaaguggcaacauggcauauauauccuucuccggggagucacaugcaccauuugguucuuagauacguugauguuuugauuuuuaaugauuuguaucaaccuguagguaccacagaagagcuguagucauacaaucacauaacuuuuacaaauauagugg

SEQ ID NO: 192660 - RNA, 58777 nt, Homo sapiens
agagcgggccgagggggcggggucacgagccgccagccgccggguggagggucccggccgggagccgcggaaagaguagggcuccccagacaacgggguccgacgagcaguugggcacgggcugaguccgccugccggcagguaggacgugaaggcagggguggugugggggcggacgggggcgucggcgcagcugggcgcgguggggagcggagaauggggagggcagggaccgggcacggccgagcaccgccgucuggcgcgcggaccggaccgaccagcugacgcucggcugggcgugagggccucucucucugguggucgcgagccugacucgucuuucccugucgcugccuuucucuggcugcugucgaggccuuggggagugcaccugccgguccgucuucccgggcucgguagucacggagagaugaggaggaggaggaaagggccucaccagucacuucugagccuugcagaccaccgcuuccugcucccucucuaaccccagagauggaauagauugaaugcugagagagcucuaaacucggcaacggucauuuuaaagugaaagaccccagaagguucuaaaguuacucccuuuccccaagucuguucuguaagucuaaaggaacacugucauuauuuuuacuaguugagauaugagauucuuguuuucuguuccuuagguuaaauuguacuucccgcauuaagcucaugcugccuuuuuuuuuuuuuuuuuugagauggagucucggucugucugccaggcuggagugcaguggcgcgaucugggcucacugcaaccuccgucuccuggguucaagcaauuauccugccucauucucccuaguaacugggauuacaggcgugcgcuaccacgcccggcugauuuucguauuuuuaguagacacgggguuuguccauguuggccaggcuggucuggaauuccugacaucaggugaucccccgccucggccucccagagugcugcgauuacaggugugagccaccgcgcccgaccucaugcugccuuuuuuuuuuuuuuuuuuuuuuuaacaucguguguguucaugugaucgcuaaggaacccagcucuuccauuuaguucccucuuucuaucccucaaaucuuuuccaacuggugauuuccauauuguugcacucucuuuaaaauaaaaaaauugccuccaagucuucuucuucccaaguaucuuuuauuugcuuuuuuucaucuugcauacauucucuuccuugaucucaucaguuccauuuuugugcacuugaugugugucagcuauuauucuagacgcuugggauacaauggugaacagguaacuaauuuuggugggggcagagagacucugaaaucaguuaaggaauaaguaccauuuggugaugugauaaagagugacuagagggguuauuuuggccagggggaugucagaaauggccuuaauuucugcauuuaaaaacuucuguauaccaguaacaauuaacuaggaguuuuaauaauaaaaagacacuauucauaauggcauucaaaacuaaagguaccuagaaauagaugaaccuaaagcuguguaguccuuuagacagaaaauuguaaggcucuguuggaacacaaaagaugacccaaguaaauggugagauauaccguauuaauagauggaaagacucaacaaaaagaugucaguuuuccucaguucuacgaauucaguguaaugccaauuaaaaucaccauauuguuuuauggaauuugccaugcugaacuuaaaauuuauauggaaaggcaagggaccaagaauagugaagucaauuuugaagaagaagaaaaauaaggucucucccuaucagauaccaaagcuuaauauaaaguuguaauuauuaagaugguaugauauugauucagggauagagaauuagauucauggaacagaauagagacacuagaaacauaccuauuuacauacgggaguuuaguauaccacuaagugguauugcaaagcagggggaaagcauagacuauucaauaaaggaugaugaaauauaugguugcugagauaucuggcauuguuaugguauacagacaggauuagauucuuacuuucaaacuauugacaacaguuuccagauaaagaccuaaaugugaauggcacagcugcaagguauuuggaaaggaauauaagagaccauugucucuaggaaagauuucuuuuuuguuugcuuuguuaaaucuuguuacacauaagauuuaucauguuaaccauguugaguuguugaguucagugacauucacauugugcaaccagcacuacuaucuaucuccagaacuuuuuuuuuaaaugucucugagaaggauuucuuaaguuacaaaaagcaccuuugaggugucauuuuauuacuccaaaugagagaugauguuggcuugaacuagacaagaguguagcagugaauacagagaaaaauggauggauuuggggguauguuuugaugguagagaagagcaacucugcgugguuuagauguagaguaaggggaaaacaaggaaucaagggcaacaucuguuuuuuugcuucaguuaagagguagaucauuuaccauuuacaaucaaaaagcauugaccauuugauggauagugauggagaagauuuguggaggaagaguuuggggagaaaaaguaaagaauucucuuuuggacaguugaguaugaaaggccuguuggacauccaaguggaaauguuccaauagcuguuggauagauaggucaggaaagaucguagcuagagguacucugagaucacuggcauauagauauuaagaacugggccgggcacgguggcucacgcuuguaaucccagcacuuugguaggccgaggcggguggaucacgaggucaggagauugagaccauccuggauaacacggugaaaccccgucuguacuaaaaauacaaaaaaauagcugggcgugguggcagccgccuguagucccagcuacuugggaggcugaggcaggagaauggugugaaccugggagacggaguuugcagugagccgagaucgcgccacugcacuccagccugggugacagagugagagacucugucucaaaaaaaaaaccaaaaaacaaaaaacugugguguguuggaaucagcuguguuacacagaaaacaagauaauacuggcuuaaauauguauguaauugcauagguaggcagccaugcuuuuauggaagcagcucuguaaucaucagggacucggauucuucuaucuggcugcucuaccguccuuaauaagaugcuugguguuaagaugacugcuuuaauucaaacugucaguugcucauucuagcaagagggaggagggaaggaggaagaaaggcacauacccuucuuuuuaaggacacuuuucagaaauugcacaugacacauccacucauauuucauuagccaauucuuuguaagugcccauaguuaacuagaaagaaagaaaggugauguagucuuuuuuguugucuguguaccuagcuacaacucacguuuuauuaaucagaaugaaagcaugaaaugauguuucacucuggcuuccuccaccagggcaaugaagcuacugauaugaagaucccagugaccuccauauuguuaaacuuaauggaauuuucaaauauuuguuuuauuuuuaaauuauaaucucuucccuuuuauuuucugugucuuucuuagucucaaaauuucuccguucucuacuuaaaaucaguguuucagauuuuauguaaucaccgucauaauauauauauauauuuuuuugagauggagucucgcucugucgcccaggcuggacugccguggcgcaaucuuugcucacugcaagcugcaccuccuaguuucacgccauucuccugccucagccuccugaguagcugggacuacaggugcccgccaccacacccagcuaauuuuuugaauuuuuaguagagaugggguuucaccggguuauccaggcuggucucgaucuccugaccucgugauccuccugccucggccucccaaagugcugggauuacaggcgugagccaccgugccuggccccauaaucuuaaaggugcuuuuaaauagaaauugacaagcagacucuaaaauuauguggaaguaccaaggaccuagaauaguccgucuugaaaaggaaggacacagcuggaaaauuuauacuacuagcuucaagacuuacuuuaaaaacuacaguaaucugccuggugcgguggcucacaccuguaaucccagcacuuugggaagccgaggcggguggaucacgaggucaagaguucaagaccagccuggccaagauggugaaacccugucucuacccaaaauacaaaaauuagccagguaugguggugggcaucuguaaucccagcuacuugggaggcugaggcaggagaauugcuugaaccugggaggcggagguugcagugagcugagaucaggccacugcacuccauccugccugggcgacagagugagacucugucaaaaagaaaacaaaaaacaacaaaaaaccuacauaaucuaaacagugcaguguuuauauaaggauagauaaauagaucgauggaguggaauagguccauacauauguauuccauuaggguuuuuuguuuguuuguuuugagaugugggucucacuguauugccuaggcugguguugggcuccugagcuccagcaguccuccugccucaggcuucugaguagcugguauuacaggcaugugccgcagauauagucaguugauuuguggucucaagcaaucaucccaccuuggccucccaaaucacugggauuauaggcaugagccaccacacuuggcccuaugguauacuuuuuauuguuauuuuauaguguauucaucuauucccucuacuuauaaaaaaauaaaauuuacuguaaaacaaguuaugcuggcagcaaccucauauaucucguguaaaggaaaguuuagaaguuacaugucagcuuuuugaggcauuauaaaccaucccaaaggcuacgggcuaaaacaaacauuuauuauugcuugcaggcuaaggacugaauauggauuuguagggucaccuaggggcuggcuaguuugauguggcuucacaugccuggcggcuguugcuggcugucaguugguacuuguuggcuucauuaauggggauauuggacauuucucuugugauccagcagacuaaccuaggcaucuuuacauggugcuggucacagguuucucaagagcaaaaagacaggagccucgaugugcacguacuucccaagucucagcuugcaucaugcuucuauuguccuauggccaaaguuacucguaagaucaaucuaaagucaccgugggaggggacuaccaaagaucaugguuauaggaaaaggaauaauuuguggccauuaaaaaaaaucugcauuuaagacaaaaacuauguguaaaaaaagcaggcaaguaugaaagugagccaacuggaaguuuuagaaauaaaaguuuuugaaauacucaguggauggaucgaaugauagucuaaauacaacuaaacagaaggugaugaauuggaagauagauuuggggaaauuauagugcaugucagacagauagaaaaaaauggaagaaguugagauuugaagguuagacuuuaaaaaucuagcauacaucuaauaggaguaucagaagguaaaaguugaaugggggucaaagugguaauuguuaagaauauugcagaauugaagaaaaaugugaguucuaagaucaaaggagcauaccaaaucuugagugggguauauaaaaacaaacccauacccagacauaaaguagagaauuguaagaacaucaaaaagaucuuaaaacugccagauggaauauaauauugauaguaaugauaaguagcauuuauugaacacuuaauuuggaauaggcacuauucuguguguuuuacauauauuaacucaugugauauuuguaacaacccuuuacaguaguucccuuauuaucaccauuuuauagaugaggaaagugagacacagagguuaaauagcccauuaucauaugucuaguguuuucaaauguaccuggauuuuguuuuaaucaggaaugguaagaagacagacacagagacaacugccuugaaagaagagcuuauuauguacaguucccaaggaagagugggcgugccacaccaugcaaggccacauggggaaguaccagggucauucaggaggcauaaggagcaaugugaaagcaugggccagagcuuucuuuuauuguguuuuuuugugggaaggaaugaacguuuuuuuugugggaaggaaugagcgagacaggguagacgagcugaacaaacuuaggauuggauaguucgaauaauuuggcagaccagagagguggucucuagcugccuaguaccuggcucugaggagauuuagaguaagggaagcauuggcuguguguggugguuggggguaugcaccugggauugguugguuugcauaugagaagcaugcucacaggcagguuguuugcuaccucuagcaguuagcuaucccagagaggggcagucacucccuggguccuuaagguccuaagaugucaaagcauucuuaaaaaaaaaaaaaaaauuacuaauacaaguuguuuguggaauuggauuugaaaccaggcagugugguccuacagagcacauucuuaaacuucuuugcuauuauuuugccuacaaagaaacaacaguuagacuuagauuucuccugagcaacaagaaauaucagugaaaauaccauuaauguaccaaaggaaaccuacuguuauucuaaauucuaaacccagaauuccaaacccagcuauuacuauuuuuuuuuuuuuuucugagacagagucuuacucugucucccaggcuaaaguguagugcgugaucauggcucacugaaaccucugucucccaggcucaagcaauuccucugccucagccucccgaguagcugggaauacaggcacaugccaacaggcccagcuaauuuuuuaaauuuuuuuggagagaugaagucucacuggucuugaacuccugggcuggccuagagcuccugggcucaagcagucugcccaccuuggccuccaagugcugggauugcaggcaugagucaccacgccuggcccaaacacaacuauuuuuuaguauaucuaaaauagagcauuuuuagacaugcugagagugagagugcuaacuacauauaugccuucaugaaggaacuaucaaaggauauaccuucaucaagaaugauuugaaccuaggaggaaguuguggaugcaagaaacaaaaguaaggaaggaaacugacaaaauguugguaaauauuuagguugacugcuuuuaaaaaugacuucuuuugggauguuuaaaaauaaaauggaauuaaaauacuagacaagauaggagaggaucguauuuaaagcauucuaauauucucauuugggaggauaauuauauuguuuaaauucauacuauauagcacauuuaaaauguggcuguuuacuaaaggaauagaaauaaauuguauaacuuuaagccaauuaaagaguaauaaaaaaauccugaucuauccaacaugcgauaaauguaaauggauuaaauucaucuauucaaagagagguuuugaaauuauaaaugauaccaaaagauuauaaccaugaugggaaaagguaagauaguuaaauacuuagaaaacuggcaaggaacuuaaagcaauaaauguuaauagggauaaaggaagauaguaugugaugacaaaaggaaaaaaguacuaaguuucuaauaaucauucauuugugugcaccugauggcauaucuuuucacauuaugaccccccaaaaaggguaguauuuguuugccacagauugggguguuuugcacuagagagucagauccaugaaagcaagggcagauuuuucuuuuucauuguuaaauugcuagcaucuagaacaguucuucguuccuagggacucagauaaguauuugcuuaaugaauaaaaaaaaaaaggacaacaaaagggguaaaucgacaagugcgcaaaucaguaugaaacuuuuaaaaaaccccucucguacugguagaucaugcagacaaaauuaggaaggcuguucaauggccguuuggagcugugaaaaauaaauuagcaggacuauagaaacaacaaaauuaacaagccuaguauaauggauauauucugcucgcaacaaagaauaagcuuguaugauauauuuauaaauauugacuggaaucagguaacaaagcaagucuucacaauuuuaaauaaucuaugucacauagcagaauaagauaaucuuugccuguaaucccagcacuucgggaggccgaggcggguggaucacuugaggucaggaguucaagaccagccuggguaauauggugaaacccugucucuacaaaaaauacaaaaaauuaguugagugugguggugggcaccuguagucccagcugcucgguaggcugaggugggaggauugcuugagccugagaggcagagguugcaguggguggugauugcaccauugcacuccagccugggugacagagccauacccuguuucaaaaaaaaaaaaaagauaaucuuaaaaaguuuuauauauuuggaaacuaaaagcuacacucuuaaacagcucacagauuagagaaaaauuacaguggaauuuuagagggauaauuuauagucuuuuuuuuuuuuuuuugaaaccgggucucacucuugcuggagacgacaggcuggaguacaguggcgcaaucucagcucacugcaaccucagcgucccagguucaagcaauucucccaccucagccucccgaguagcugggacuacaggagugcaccaccacaccuggcuaauucuuuuugguagagucaggguuucacuauguuggccaggcuggucuugaacuccugagcucacgugaucugcccaccucagccucccaaugugcugggauuauaauaauuucuaguguuaaaugcauuugugaaagaacaagaaaugcucaucuuaggcauuauugaagaaguuaggaaaaggacaggaugcacccaaagaaagaaagaagaaaauaauaaaaagcagaaauagaaaacaaaacaaaagagagagguaccuucaagguaccuuccuuccuuucccuuauagcaaaaggaaaaagaaaaaaaaaccucacuauccaaagacaaccugauaugggucuagaauacugaguuguguucugggaaugauugcagcauaugaucaucuuuacucaguugaugaauuagguggaugacagcucuccuuugauagaaugccaacaaugaacaaauuucaaaaauuuuaaacaacguggguacuauccugaaagaacuagagaaaagcuaaaugcuucuauggauucuaaguguaccguccacauagagcuucucauuucuguggggacuucagucaucagagauaaauacauauauacauauauuuucaaagacauuaaauuuuuuucaugccuauauugguauucugauuaauagucugucuauucuuguuaccguuuaauucuuguguucugggaaugauuguaucauauuuagaucaucuuuccaauugugaaaacuaugcacaauuggacacagugugaggaagaauaaugaaaauucuaacaaaauauuauucuaauaagucccuuuuaaguuuuuaauggagaauuuuuuuuuuaauuggaaaguuuucuucguagucuugaaaaagcuaacucugugggucauccacugugaugguaacauguucuuguaguuaaaacaaguguuuugauuuagaugcuaaauuaaauuuguuguaauuguucuacuuacacagaaugucccuggcugcuuauugcgucaucuguugcagaagaauaggaaccucuacuuccccaccaaaaaguggcacacacuggagagauaucagugaguacagcuuaaacaacucuuauuuucuuauaggaacagugauagaauuguggccauuucuaagaugggccacaaaaacuuuuugaacccaugauuaaaucucaaauuuguuuaugucuuucuguacuaauaguucaccccaaauuuauaggcccagagccauacauacuccuuuuucuugagaauuauuuucccucuucuacuucuucugucaaauuucauacucaucauccuaaacuuaaauauaacugcauuuucauucagcagauauuuauuaagcucuugcaaaacaacacccauauuagguucugggaauacacuggugagcaaggaagauguugucuuugccuuacgggggcucgggauauggcuccagucuacuccauuuggagccuugccuucguuuaggaagcuuucucugacacccuaggcccgguuggaucuguuacuugucauuucauagggucaguauagaacuuaauuaucugucuuuccccauaugcuguaaacucugugaaggcaguauuuuaucuuguuuaccacuauaaccuaguuauuuaucaugcauggcauguaguaggugaucaaauaguguuuguugaauggaagaauaaaauaacuuaccuuuucugagcauuauuuccuuuauguguaaaaugagaagauuggcguagaacaucuuuuauucauuugacaauaaacaaaauauuuaauugaccaucuacugugugccagguacaauucuaggcccuaagaauacaauauugaauaaaacaaaguccuuuuccucauggaguuucuuuuugaucuuuaagagaaaucuguuuuuagggauagaucauuuucaucuagaaaauucugauacuguguuuuaaauacaaaaagagaagugaggacaaaugucauuuuggcagcaugaguugaagcucugaacaaaggacugucucaauacgugcaauaaauuauagguuaaggcugggugcggugacucaugccuguaaucccagcacuuugggaggcugagguggguggaucacuugaagucaggaguucaagaccagccuggucaacauggugaaacccugucacuacuaaaaauacaaaaauuagcugggugugguggugggcgccuguaauccuagcuccucaggaagcugaggcaggaggaucgcuucaacccaggagguggagauugcagugagcugagauugugucauugcacuccagccugggcaacagaaugaaacucugucuauacauauauauauauauaguuuauauguauuuauuauauauaaauauauuaauauuuauauaaauauauuaauaucuauauaaauauauuaauauuuauauaaauauauuaauaucuauauaaauauauuaauaucuauauaaauauauuaauauuuauuauauauaaaauauauuuauauaauauauuaauauauuauauaaauauauuauacauuuaaacauauauaauauauuuauuauauauaaaauauauuuauauauaaaaauaauauauuuauauauauauaaagauuuuugugggcuagccucaguaccuaaucaugaguaccaucaguuaagguugugcucagugcauguaacagaagcuugaguccaguggcuuaaguuaauaugauuuucauucuucuuacauaauaauaagccaagguggagacaguuuagggcaggaauuacaguuuagcaaucuucuugucuuccuguuccauucucuuuauuguccucauggucacaagaugcuugcugaauccuugggcaucaagaagcagagggccaaaagccauuuugaggcuuugucuuuuuauguggggagggauccaucucuauagacuuccaucuauauccgauuggcuacaacuguguuacacuguuagcccuagcuacagaguugucuaggaauuugaauauuuuugggugguaaucagguuguguauuuguaaggauuaaagggcauguguauuggacaggcaauuaucagugucugccauaggaauuuuuuaauauuaaaaaaguuuuccaagacccaaacaaacauuuauaaauaaacuuguagaauauaaucuguauuuuauuuuauuuauuuauuuuaagauggagucuugcucugucgaccaggcuggagugcaguggcacaaucucggcucacugcaaccucugccuccgugguucaagcgauucuccugccuuagccucccgagcagcugggauuacaggcaugcgccaccaugccuggauaauuuuuuuuuuaauauuuaguagagaugggauuucaccauguuggccaggcuggucucgaacuccugaccucaggugauccacucgccuuggccucccaaaguguuggaacuacaggcgugagccaccgcacccggccuaaucucuauuuuaaauggggcuacguacguauguaccuaaccaucaauuauaacauaauuacuuuagaaaacauucuuuuauguccccacuugacaauauaauccuucaguauaguccuaguagugauagggacaaugcuucccauuucuuucuuuaauggguuguuaacuaaaaggggucagaagggaagugagcugccugcauguugcauuugguggaagcauuguaguccuacuagcaucaguaguggaacagggacuaggagguggagaaaggggagguaugaaaugucaucaauauacauuauauuugcacuuaguacuuguugauuuguguguuugugucuaaggauaggagaccauuuauuaauagcaacugauuauauuaauagaaaaauaauaacuucuuaucugauaauauaugauauagguagagacuuacacuguugccuauuuccuuucacacuuuuaaaaaugaaauucaucacauugacuuuuuuucuuuugaaggaaauauaauaaaguuuacuggaucacuuauuuuaggguaagucgucaacuguggaauauuaauuggcuucauuauacucuauuggaaaucucaauggcagugauugacagguugcaugaggucuugaaaggguauagauuuuggaauuagacugguggauuuaaucacugaucccaccacuuaaauguugucaugaugugguuuccuuacuuucugaggagugcuuucucuuggagccaaauguguacuaggaacucugccugccaggcacugcugcugugaggaaagcacuuugacacacuuaaaucaggcacucacuuagcucugacacacuuaaaucaggcacucacucagcuccggcaggcuuaaauugggcacucacucagcuccggcgcacuuaaaucaggcacucacucagcuccggcacacuuaaaucaggcacucacucagcuccggcacgcuuaaaucgggcacucacucagcucugacacaguuaaaucgggcacucacucagcucugacacacuuagggucacaucugguauuagguucuaaagugggugaaaaagguacaaauugacuauggucaaaaguauuuuggaaaaucccuuaacucaccauaaagcucgcaugaaaggaaauugaggcugacugagaaaaccaacagauggacgucuccuaucugaugcucccucaggagcauguguaaugaaugcagugacccucuuucagcaaauuguuauuuuucauacucuuuuacuuuuuuuuagggggaggaauauauauguaauacuaucguacuguauuuguuaauacuuuuuacuaguacaaauauaaaauuaacucucagaugccgaaaugauaaaagagauauauuuggcauuuuauccaaaugcauacauuucuccaugacauuguaauguaaggcaaaauauauuuagauaauuuuucccuuugacucauucugggcaaagcauaaauguauauggaaccuuuucuguaaugcaguuugucuagcucacaauuauauucaggaauauagugaacauuaauuacaguuuuuuauuauaguaaagaauuuugucuuucauggaaaacaggauaaaaguacugaauacauuuaccccuuuuguuggcuguucagauacaucccgaagagagcagaggauucuuuuuuuuuuuuuuuuuuuuugagacagaguuuuccucugucacccaggcuagagugcaguagcgugaucuccacucagugcagccucugcccccuggguucaggugauccucccaccucagccucccaaauagcuggaucacagguguguaccaccacaccuggcuguuauuauuauuguuauuauuauuauuauuuguauuuguauuuuuaguagagacggggucuugccauguugcccaggcuagucuugaacuccugagcucaggugaucugcccgucuuggccuuccaaagugcugggauuacaggccugagccacugcccuuggccgagggcagaggauucuaaagaggcuucuuuguguuccucuggugcuagcuaguaucuggacuuuguuuuaccugcuugccugaggguagaaaccaaaggucagaagaaggugcuaagcucugaauccagagugcaaucuuugugucaggauuuagggaguguguaagucaaucugauuaggaaaaaagaaaucuucauuuugagauucacaacaaacaacauuuaaaguuaacuucagguguugcucuuaggaaaggaaaagcuuucauaugcugaugaugggaguacacauuggcuaaucuuuuugcaaaaacgguuugucauucucuaguaaaauugaauauguauacuaucagaagguauguaauucuagauaccuguacguguagauagaggaacacguacuguaugcacaguacagauguauaagauaugucacagcauuguuguaacagacucaaacuagaaacguucucaauacccaucuaugggagagugaauaaguaaguuguaguauauccaugcaauggauaauugcauacuauacgaaaaucuaagugcgggaacuacauuuuacaugcaacaacauggauaacucacaaauacaaggcugagcaaaagaauacauguagugugauuccauugauaugaauuucaaaaacaggcaaaacuaagcucuguuguuuaaggaugcauauauaggugguaaaacuguaaagaaaagcacauuguuauaauaaaaaucagaaucauauauagagaugagaacagaucauuauccgggagggacacauuguggguuucugggguucuguuaacauucuguuucuugccuggauaugauuaugcagcuauuuauuauuuguaagccgaaauguguauauacauguauauguauauauacagucaugugucaauaauggcgauacauucugaguaauguguuguuaggugauuucauuguugugcaaucaucacagagugcacuugcacagaccuggguggcagagccuacuccacaccuaggcuguaugggacagccuguugcuccuaggcuccaaaccugugcagccaugugacugugcugaacacgguaggcuauuauaacacaaugggaaguauuuguguaccuaaacguauccaaacaaaaaaagguacaguaaauaaaauuuuaaaaugguacacuuauauagggcacuuaccaugaguggagcuuacaggaccuggaguugcucugggugagugagagugagggccuaggacauuacugcacacuacuauagacuuuaucaacacuguguacuuaggcuacauuacacuuuuuuuuuuuucggagauggagucuugcuccgucgcccuggcuggaguguaguggcaugaucucgucucacuacaaccucugccuccucgguucaagcaauucuccugucucagccuccugaguagcugggauuacaggcgcccgccaccaugccuggcuaaguuuuguauuuuuaguagagccuugguuuugccauguuggccaggccggucuugaauuccugaccucgggugauccgcccgccucggccucccagaguguugagauuacaggugugagccacugugccuggcugaacuuuguguuuucuuuaaaggcagagucucacuguguuuugccuaggcuggccuugaacuccuggaugcaagugauccuccugccucagccuucuaacuagcugguacuacaggcaugcaccacugcacccagcuacacuauauuuauaaaacaauauuuuuuucuucaauaauuaaccuagcuggauguaguggugugggccuguagucucagcuauucgggaggcugaggcaggaggaugacaugaccccagaaguuugaggccagccugggcaacgugguugagacccugucucuaaauauaaauaaaguccuggcuuuaauaauuaaccucagcuuacuguauuuuuuuuuuuuaacuuaugaacuuaaauuuuugaaaaacuuuuugacuuuuguaauuacacuuagcuuaaaacacaaacacguuguauagcuauacaaaaauauuuucuuucuuuaugucuuuauucuauaaacuuuugucuguuaaaaaauauuuucgaggccgggcgcggcagcucacgccuguaaucccagcacuuugggaggccgagguggguggaucacaaggucaggagauugagaccauccuggcuaacauggcgaaaccccaucucuacuaaaaauacaaaaacaaaauuacccgggcgugguggcaggcgccuguagucccagcuacuugggaggcugaggugagagaauggcgugaacccaggagguagagcuugcggugagccgagauugugccacugcacuucaaccugggugacagagugagacuccaccucaaaaaaaaaaaucuuuuugagacgaggucuugcucugucgcccaggcuggagagcagcggcuacucguggguacagucauagcaugccgcaggcuugaacuccugggcucaagggauccuucugcuuuagccucccgaauagcugagacuacgugccuugcuacugugccagcaaaauuuuuuuuuuuaacuuuuuaaauguuuuuguuaaaaaugaaacacaaacccauuagccuaggccuacacagggucaggaucauccauaucacugucuccaccuccgcaucuugucccacugugaggucuucaggggcagugacaugcauggagcugucaucuccugugauaacaacacuuucuucuggaugccuccugauggaccugcccuaggcauuuuacagguagguagaaggaguacacucugaaauagcaauaaaaguauacuauagugaauacauaaaucaguaacauuuauuauuaucaaguauuauguacuauacguaauuguaugagcuagacuuuuauaggacgggcagcacaguagauuuguuuacacagcaucaccacaaacgugaguaauguguuacgauggcuacucagucacuaggagacaggaauuuuuuagcuccauuauaaucuuaugagaccacuaucguauaugaggucuguccuugaacaaaaagucaguaugugauacaugacuguauaaauguuauaugcauauuacuguauacauguuauguuucccaacaaaaaagaaguuuacuaugacaagcuuaauagagaagaguagcucuuguguuacauuuugauugucuauuuaugaugcauuuuuucuuuucucuuuaagagguucuuuauuucuuacauaugaaguucuggcccugaagaaggcugugacauuagauacucaagugguagaacgagaaaaaaugaagucauauauauaugugcacacaguuucuuuagacaaaggagaaaaucaugguaaguuuauuguaaaguaauccucugugaaaaauggaagcuaguuauugcauuuaaaaaugcgucuauuuaaaacacaguauuaguaauacagauugagcuaauucuaagaaucaccaaaccccgugaaaaccaaguuccugaagaauuaauugaggaccaaaguuuaggcuuccguauuuaauccagguuugcaacucuccuaaaauuaagugaagacuaacuggcauuuuuagucugaaccuggaauuccacaucuuaguggggcugucaauacagaggcuggcucucaguuuggcaaguacaaaaaacaugauuuuguaauuuagcucagugauauuucuacuuuaagggauguauucaugcaaaccaaacucaugagauauauucauaaauaugaaugccaacucauuuauuauaauuaucugucaccaaggcuagaaaaccugucuuuacuaguuaggacacuccacuucucaauauuuaggacacauggaagcccucauuagcgaucauaugguugcaugggaacgugaacuuuuagagcagaggaguauauuuuccucaacauauggauagcauggugagucacauacuugacucacagcugccuguucauacacuguuagcuagaaugugccaguuaacaugauguuccucaagugaggcaggcucugcugcucgccugugucugucaccuugcugcccuguugcuauuuguuauuauaucauuuuguguauuucaacaugcuuuuaugguauguuuacaauuucaguuacauagaugauuguuguugcuuauaauauaccuguauauugagacuuaaucucuuuaauaaaguaucuccaaacuucaguuugaggcgagcucaucaugagggacauuuuccuggauauugcaaaaccuauguuguauaugaggauuuucauuagcuuuaguuaguauuuuuguaguuaguguuuuuguuuuuacuuuucccugacuuggagagcaaucuuauuuuggaauugagagcucuguguuuccauaaugguuuuaguugcaucgauagugacaauaaaaagacaacaguguuauuuuguauuuucuuugugaaaaaauauggaguuuauacauaucucuuugaaacguuggagcauaguguuaagaauacauucuugggccgggugugauggcucacgccuguaaucccagcacuuugggaggccgaggagggcggaucaugaggucaggagaucaagaccauccuggcuaacaaggugaaacccugucucuacuaaaaauacaaaaaaauuagccaggcgugguggcgagggccuguagucccagcuacucgggaggcugugaagcaggagaauggggugaacccgggaggcagagcuugcagugagccgagauugugccacugcacuccaaccugggcgacagaguaagauuccaucucaaaagaaaaaaaaaauacauucuugguuuuacuuaauuuuauaaucauuuuagguauugccuggcaggcaagaaaagaacuucacaaagcaguaagaaaaguauuggcaacaucagccaagauacugcggaauccauuugcugguaaauauccacuauaugacuuggaauccuuaucaguaaucugaaagucauuggaaugaucaaccugauacuuuuuuucauuucuuauacuaauauuuuuuauagcuauggaaaauuaaucaggccagguaugguggcucacgcuuguaauccaagcacuuugggaggcugaggugggugggucaccugaggucaggaguuugaaaccagccuggcuaacauggugaaacccugucucuacuaaaaauacaaaaauuagccaggugugguggugggugccuguaaucccagcuacucggaaggcugaggcaggagaaugacuugaacucaggaggcagagguugcaaugagccaagaucaugccacugcacuccagccugggugacagagugagacucugucucaaaaaaaaagcaaaguaauuaacauuauucucuuggacuguauuuaauuuuaagggcuuaaugcuuuugacaauuuucuuccuuccuuagguaauugugaauaaauauggagauaaaauauacccuauucucuugauaaguguuuuauaauuuuaaauuuguuagaaaaucacucccaugccuucauaaugagcauaguauauccaauaucauagauuucacaaucagguuaaucuacaguguggagcuagauacaaaagggcuuaucugaucuccuuaaaaaguuggcaucgugaaaauaaaaggugggaagacuuucuauaauugaaagagacuauuaaaucuugguuuuaaaaaacagcuuuaaauauauuuuuuugaaaaauuggggaagcuugaauauggaauuagacugaauuuuagaugauuugggaagauuuuuguuaguguuuuugggugugauaauagcauugugguuauuuaagagaaugcaggauuguucuuaggagaugcagguugaacugugaaaggcugaaaugucauuuugucuacaucauccuuucaaauaguuugggaaaaauuacaugugaauauagaugaagaaaauacgguaaaauaauaacaguuauugaaucuagaugugauguauggauguuauucuuuuuuuuuuuuuuuuuuuuuuuuuuuuuuuugagacagagccuucucugucacccaggcuggagugcaguggcgcgaucucugcucacugcaagcucugccucccggguucacgccauucuccugccucagccucccgaguagcugggacugcaggcgcccgccaccacacccagcuaauuuuuuuuuuuuuuuuguauuuuuaguagagacaggguuucaccguguuagccaggauggucuggaucuccugaccucgugauccgccugccucggccucccaaagugcugggauuacaggugugagccaccucgcccagccuauguuaacuuauuaauuucuuucauauauuugaucuuuuugaaaaaguuuuggggagaaaaagauuuuaaaaaugaccacauaugaaagacaccagaauauacaaaacaaaagcacacacauugagccugggcaauuucuugagucccugucucuagaaaaaaaaaaaaagauuagcugggccugaugguauaccccugugaucucagcuacucaggaggcugaggugggaggauuguuugagcccaagaggucgaagcugcagugagccacgauugugucacugcacuccagccuggguaacagagcgagacugucucaaaaaacaaaacaaaacugaccccugcccccccauccaaaaaaaagcacacacaguauucauaauaacuguaaaagauaauaugacagaauugagaacaaauaauauuaguuuuuaucaauaccuauauauauggauuuaacucuccaauuguagauuucaguguuuauaaauuaccaucuuaaagugaagauaaaaguauuaucuuaacuuuucacauugucuuggcuuuuucuuuuugcaaagauccuuuuaguacaguugauauagaagaucaugagugugcuguguggcugcuccuacggaagagcaagucagaugacaaaaccacgcgacucgaggcugugcgggaaaugucggagacccaucacuggcaugguaaugagacuaccugaacagguggcaugccuucagcuggcucuugauugcugacauaaaagacaagggaguggccaggugcgguggcucacgccuguaaucccagcacuuugggaggccacgcugguuggaucacaaggucaggaguucaagacccacccuggcuaacauggugaaaccccgucucuacuaaaaauacaaaaaaauuagccaggcaugguggcgggcgucuguagucccagcuacucgagaggcugaagcaggagaauggcgugaacccaggaggcagagcuugcagugagccgagauugcgccacugcacuccagccugggcaacagagcgagacuccaucucaaaaaaaaaaaaaaaaaaaaaaaaaaaagacaagggagugggagugagauucaggaaggaaaauaauucaggcaguguuaguauauauagaaaguauuugaaaaauuuuaagaagcuucagugauacggaaaguagaaagccugcugaacugguagucaaauguguuugguaagaauaagcucaaaaaugagguauauauauuuguguaacuuucuaccagaacaaaguuuuauuugguuacauacuucuuugagagcaacucuugauucugauaguuaccuaauguacuugaguuuucuuuugguuucuauuuaaugaaguacauuuaauugcuugcuacaccauacaauuauguuugcuuuuacuuuuacaaucuacuuggcucuaauacuaauagucgaauguacccaauuuguauuuguguauaucauuuuuaauggacuauuugaaauauguaauuguguuuaaaaaucacaaauuuuacaauaaaaauauuuuuaaaagaacucauaucuucucugguuauaguacauggauaaaacuauaauuuguuaguagagcugucuuguaaaaaugggaaaaguagaaaaaaauaauuuucucagccaggcaugguggcucacaccuguaaucccagcacuuugggaggcugaggaaggcgggucacuugaggccaggaguucaagaccagccuggcuaacauggcaaaacccugucucuacuaaaaaaauagaaaaaauuuagcugggcauggugacgugugcuuguaaucucagcuacuugggaggcugaggcacaagaauugcgaacccacgagguggaguuguuagugagccaagauuguaccacuccacuccagccuggacaacagagcaaaacugucucaaaaaaaaaaaaaaaaaagaaaaauucucaaagaaaaguuaagcucagaaugagaucucugcaaauuaauuuguuaauugguugguggcuauaauuauaauuuauaauguaaguauaagcuuacuuaauguugguggagauuuagaauagaaauauuuuucaaaauuugccuuccagggcuccauuccagacuuauuguaucagagaaaucagaggaagugcccuggcccacagauuuuggaaaaguuccccacuugauccagaaguacucacccagguuauuauuauuauuguuuuuugagacagucuuguucugucacccaggcugaaguauaguggugugaccuuggcucacuacaaccuccgucuccuggguucaagcuauuuuccugccucagccucccgaauagcugggguuacaggugccugccaccacgccuggcuaauuuuuguauuuuuaguagagacaggguuucaccauguuggccaggcuggucuugaacuccugaccucaaaugauccgcccgccucggcuucccaaagugcugguauuacaggccugaaccauggcgacuggccaaccccagguuauaaacugccauuauugaaaauaauguuugcuuucaugguuggaauuuuguuuuugauauauaaagaauggcauguuuaauucaaaguacugcuaucuggaacugcagacuaaauauucauggacacuaugaauaccaaagcaccauaucaucaccacggagcaguaggcuuaaaugccaccucauguguuuugaguaguggucagaacaucuuuugaaugcuggaauuguuuuaaaaagaaguuaaauugguucugacuuaccaguuuccaccuuugagcuuccuuuuuuccaaaaaguuaggcugugacccggucuccauauauauguugaggagaauugugagaucaguccuggaaacguaucuagcuuauagguguuguaaauguaguugcacuugggaaauuuuggauuacaaauuugcagagcaguuuaaaaauuagagugcuuucaaguuguuuguucaguuaaucuuuaugacaucugucagcuaguuuugguauuaacaaaagaaaaugcuuuuucaauagauuaccaguauaggauaauugcucaagccugugauccgaaaacucuuauugguuuggcacgaagcgaagagagugaucuucgcuuuuuucuccuaccaccuccuuugccaucuuuaaaagaaguaaguaaaacaauaauaauaguaauuuagagagugaaaaaugguuuaauauauuaucuucacuugggguacaaaacacuuuaaaaaaguaguuguuggcuacuucucacaagcagauaaacuggaauguaaaacugaaaucauaguuuuuauacaaagauuugguuccucaggaggggcuguuccuucuauauuauuuucugccuuugggaauuuggagucucuauaaaccauugggugacaugccauagcauaucagcauccaugaguuggucccuucugaguuucuguaggucagguuuucucagccucaacacuauugacauuuugggccagauaauccuuugugguaggaagcuguuguguaaauuguaggguguguaguagcaucccuggacucuacucccaagaugcuaguagcacccccuaguuguaacaaccaaaaaugaccccagacguugccagauguuucuggggcaaaacaggcccugguugagaaacacugccauagauuuaaagcauguuucuugaguaucuuuccuagacuagaaaaugaaacucuuaaaacuucuguguuagcagcuuuuugaaaaauagaaaaaugaacauacuagauauuaauuauuagagaaaaugagauaguaacaaguucuggauuuaaaaagcaguagcuuuaauuaguaagggugcaauaauucauuuugagucaagauguugagaaugucaagaugucagaugaacauugagaguuaaaguuuacaauaggucugucaguuugaaguagcagacaugaaaguauagaauucaaaauuaaaugauuguuuauuuaccugggugggugacuguuuucaagacugaaagcaguaauuaaucucugauaucucuuucccuagaucucuauaucauauauauauguguguguguauauauauauauauauauauauauauagagagagagagagagagagagagagagagagagagagagagacaugcacacauaauauauggcuuugauauauauggcaaauauuggcuuugagucuuuggauauuuuuuguuguacucaguuguugaguauuuaugaagaauuuccuuuccuuuuauuucaggauucuuccacugaagaagagcucagacaguugcuggcuuccuuaccucaaacagagcuagaugaguguauccaguauuuuacaucuuuggcucuuagugaaagcagucagagucuagcugcucagaagguuaguucauguauucauucaguaaauauuuuugaguguccacccuuuccaauguauugugucaguggcuggcauucacccaguaacugaguaaacaugcuaacuucugguugugugucaugcccugggcuggaugucagggaugacagggaggcagguaaaugaacagucacagaguguguaagagagauaaaggugauuucaggagcccuucacuaugcuuaagaggucauuuacagcuucacaggagguaacucuuaaauuuuaucuuaaagaaugagggccgggcgcaguggcucaugccuguggucccagcacguugggaggccgagguggguggaucacgaggucaagagauugagaccauccuggccaacguggugaaaccccaucucuacuaaaaauacaaaaauuagcugggcgugguggcacaugcccauagucccagcuacucgggaggcugaggcaggagaaucgcuugaacccgggaggcggagguugcagugagccgagacugugccacugcacuccagccuggugacagagcgagacuccgccucaaaaaaaaaaaaaagaaugaauagggcugagggcaguggcucacaacuguaaucccagugcccagugcuuugugaggcugaggcaggaggauugccugaggccaggaguuugagaccagcuugggcaacacagugcgacccccgucucuuuaaaacauuaaaaaaaaauuagcuggacaugguagcaugugccuguaguuccagcuguuugagaggcugagcugggaggauugcuugagcccaggagacugaggcuucagugagcugugauugugccacugcacuccagccugggcaacagcaugagacccugucucaaaaaaaaaaagaaaagaaaaaguaaaaggcuaucagugaauacugaauucugauauucuugggguguuaugucagcgaguuuuucuuuauaaaaaucucauaucucuaagagaaaucagaacgaauaaccaccauuauuaacugcaauaacuauguaaucucaaugagaggaacguauuuugucaguaaaaaaaaaaaaaucaguguuuuauauucuuugaccaauuaaaugcguuuucucauuuuucccuuuugugagaaauuagggaugcaucaguagaaaugacuugucuaguauacuuuacauaauuuccccuuuugggccaugucuuggaauugcuccagugaauuauaaugguuuuucuuuuugaugcugagaguucugucgucuggccucuauagcccuuucuguaugcugaccuucuuaugcuuuuaaauucuguucccaaaguggcuggaaggugccaugguuuuuugacaagguaucccuggcucuuuuugauucuuccugcccuacaagauuuggccgcuucuccaaggagaucugguucuucuuacaggaaaagguuaagaguccaaaacccaggcacuaggugugcauaguaguucuucaugaagguagagcugguggacccugggggcuccuagacaccuaagugacggagcagaacaauuaccuuuuucuuaaaaggucuuaaauuuauggugauauuuccaauucaacuaguuuucuuuuuaauccacauaccauaaaacccuuuaagacuauacaauucauuggguuuuaauauacucauagaguuguauaaucauuacuccaaucuaauuccagaauauuuucaccaucccccaaagaaacccuguaaccauuagcugucaccacucauuccccucuccagccccugguaaccacugaucuauuuuuccuauggauuggccuguucuggacauuucguaugaauggaaucauccaauauguggccuuuugugucugacuuccuucacuuagcauaauguuuucaaggcucagccacacuguggcauaucagugcuucauuccuuuuuauggccaaguaauaguccauuguauggcuaugccgcauuuuauuuaucuguucaucagugauggacauuugggucauuccuauucuuuggcuguuauguaugaauaauacuucuaugaacauucuauuguuuggcuauuauguaugaauaauacugcuaugaacauuucucauuggaaaaaaaaacuguacuguacaagauaggaaaaaagcaaagcauuuuuccuacuuucucacaccacuuaacacuucugacaccaggaguguggaggguuuuucccuacacacucagcaauucuccaucaaacaucagcucaguguccuucaauuuaguucaguucugacaucucuaccuagagauggugucagagcccauagguuaagggcucugucccacaggacugccccccacuucagauaccagucacaaguuccaggugugaccugugcuucugaucaaccagccauaaacugggagugcccaugacccccaccuuggguuugauuaauuuacugggacgacucauggaauucagaaaaacaccuuacuuaugcuuaccguuuauuauaaaggauaugacagaggagagggauggacagcagauggaagacaugcguagggcaagcuauguaggaaggggcgcugagccuucaugccccuccgggugcaucacccuccagacaucuccacggguuccgguauccagaaacuuucugaacccuguccuucagauuuucaugguuuuaaucaguuggcaugauugauugacucauugaccuuuggugaucaccucaaccuucaggcccucuguccucccuagagguugaguagggcagaaagucccuaccaucuaaucaugcccuuagucuuucuggccaccagcccccuuccugaaacuauuuaggggcccuccguccaccagucaucucauuagcauacaaaagacacucaucacucuggagggaaccagggguagagaccaaauacguauuucuuauuagaucucaauaucaacauuuaugugcaugucuuuguguggauguauguguucaguuuucuugaguauauaccuaggaguggaauuucuggguguuaugguaaguaacuuuuugaguaacuuucaaauguuuuccacagagacuuuaccauuuuacauucccaccagcaauauauguuauuguccaucuuuuauucuagccaucccauugugugugaaguaguaucuucauucuggcuuugauuugcauuuccuaaugcuuaaugauguugggcaucuuuucacgugcuguuggcacuuacauaucuucuuuggagaaauaccuauucaaauccuuggcccaauuuuuuuuuaacuagugauuuuguuuuuguuuuugagaugaggucucacuguguugcccaggcuggaaugcaguagcuauucacaggcaaaaucauaacaugcccuacagccuugaacuccugggcucaagugauccucccaccucagccuccugaauagcugaggcuacaggugugagccaccauggcucccuuugcucauuuuaaaauuggguuacuuguccuuuuugaagcaucuuuucauguugcagcacccaauuuaaaaauggacuuuuuuuguuguuguuguugaauuguaagaguucuugauauauucuagauacaaaucucuuauuagauauguugaauuguaagaguugaaauuuuuuguugaguuguaagaguucuuuauauuguugaauuguaagaauucuuuauauugaugaauuguaagaacucuuuguauauucuggauacaaaucucuuauuagauauguaauuugcagauauuucucccauucuguggguucuuuucacuuucuugauagugaccugugcaccccaaauguuuuaauuuugaugaagucugggcagguaugguggcuuaugucuguaauccuagcacuuugggaggcugaggugggaagaucacuugagcccaggaguuugagaacagccugggcaacauagcaagacuaucucuacaaagaagaaaaacauuaaccaguuguggggugugugccuguggucccagcuucucaggaagcuaaggcaggaggaucacuugaacccaggaauucaaggcugcagugagcagugaucaugccacugcacuccagcuugggcaacagaacaagucccugucucuaaaaaaaauuuaaaaauaaaaaacauuuuugaugaaguccaauuuauacauuuuuuccuuuuguuguuugugcuguuggugucaaaccuaggaaaccacaacccugucaugccaaguaguuucuuaucuaaaucuguauucaucccuucucuauucuuaugccccugcuuuucaucuggaagccagggaaccaccucaauuucagcaggccuugucuaacaucugauaguuucagcuugguugggaccaggcuauuuauagacagggucuuguguacuucucuguguucugccauggugucucccacucccaucacuaaauuaucuccugcacccccaugucggagcuccugagaccuggccugacguuacuauuuaguuaauauuccucuaccuucuguaguguucuguaaccuuaccuuuugccaagugaagagagggaaagugguuuaauaccaccaugcuaccuuuuuuuuuuuuuuuuuuuuuugagacagagucucccucuugucacccaggcuggaguucaguggugugaucucgacucacuaccaccucugccuccugggcucaagcaauucuccugccucagccucccgacuagcugggacuacaggcaugugccaccacacuaggcuaauuuuuuuguauuuuuaguagagaugggguuucaccauguuggucaggcuggucucgaacuccugaccucagguaaucugcucgccuuggccucccaaagugcugggauuacaggcgugagccacugugacuggccccacuaugcugcugcuuggugcagaauucuuggccucagccaguaguuuaaagaguuacauaguuuaaauuggccuugugcauauguguguguguguucauaguuaacauaucauguguuuguguguuuuaacauucaccgccuuggagaggaccugcgucuucugacaacuucuccaccacccuccccuacccauuucaggugccucauuuuaaagaucuuccccuaaccaaaguuuuucugaaaaaguaauucguaugaccuuuuuuuugagaugagggucucacucugucacccagguuggaguacgguggcauggucucagcucacuacaaccuccaccuucugggcucaagugauccucucaccucagccucccaaguagcugggacuacaggcguguaccacuaugccuggcuaauuuuuuuuguauuuuugguagagacgggguuucgccauguugcccaggcuggucucgaacuccuggcucaagagguccacccugccucagccuuccaaagugcuaguauaacaggugagagccaccgugccuggcccguaugaccuuuugauugcauugucuuuaugcuacuccaauucaguguguuuaggagccauagaucacacuggaaaugaugaaacugacacuugaaacauuuccauucugcuugggcagaucacagacacauauauccauccuuuaaguaaauacauuguuuuuaguauuuuuuuuuuaaaugacagagcaagacuccgucucaaaaaacaaacaaacaaacaaaaaacaacgaaugcuuuauguuuaaugaagcaccuuugauuuuuccacuuggaaggcacuaguuucacuuugauuugagucccuguucuuuuuuuuuaaacaagagguagcauauauuuaauuaauuuaauauuuaaauaaauauuuaauuguaauucuaaugucucaucucuuuaggcgaguaagcacugcuuuuuacuuuuuuuuuuuuuugaggcacagccucgcuguguugccaggcuggggugcaguggcuugaucucggcucacugcaagcuccaucucccgcauucaagcgauucuccugccucagccucccaaguagcugggacuacaggcgcgagccaccaugcccagcugauuuuuguauuuuuaguagagacgggguuucaccauguuagccaggauggucucgaucucuugaccucgugauccgccugccuuggccucccaaagugcugggauuacaggcaugagccacugcaccuggcugccuuuuaguuauucuuauucccccuacucugccucaaguuuaucaugccuccuggauuucacauaugccaggaagcugggggugcugacaugguggguggagagaguccaucugguuuguagugaucugucugcccaguuuaugacagaccugccucauagugguccccaagggcccuucagugucagugugcuguuucuauauaaaacugcuuucaagcugggcacaguggcccaugccuguagucccagcuacugaggaggcugaggcaggaggauaccucaguccaggaguucgaggcugcggugcucuaugauaguuucugugaacagccacugcacuccaaccugggcaacauagugaaaccccaucucuaaaaaauaaaacaaaacuccucacguacagaggcgacugucagccccagcauacagccaacacgauaaugcuugguuuuggaacaggguucuuaaccuuugaauaccauggacuccuuuggugauuugguaaagucuaggaacucaguucuaaaugcauaaaauauaauacauaagauuacaaaggaaacaaauuauauugaaauacuguuaucaaaagagaaaauaaauucugauauaauuaauauauguauggaugcauucaauaauaagaaaauauauuuaaaacaugaaaguugaaguuaauuaaaauuuuucucuuuuuauuuuggaauaauuucaaauuuaaauaauugcgaaaauaauacauuucauuaaguuuuaccaauuacuggcugggcgcaguggcucacgccuguaauuccagcacuuugggacaccgaggcaggcggaucaugaggucaggagauugagaccaugcuggcuaacacagugaaaccccaucucuacuaaaaauacaaaaaaauuagccaggcgugguggcaggugccuguagucccagcuaccugggaggcugaggcaggagaauggugugaaccggggaggcagagcuugcagugagccaagauugcaccacugcacuccagccugggugacagagugagacuccgucucaaaaaaaaagauucaccaauuacuaacauuuuaucccauuuguuauaucaucccucccuuuuacuuuccaucucucugcagguauauuuuaacggaccuauucacacacauuuaauauuuuucugccugagccauucauuagguacagaccugaugccccaaggacauucccugaaagaaccacaguacaguuaucgauucagaaaauuuaauauugguauaauauuguugucuaauauuugaauacuccauauuugaauuuucccgguaauucuuuuaugacagcuuuuuuuuugagaugaagucucgcucugucacccaggcuggagugcaguggcgcgaucucggcucauugcaaccuccgccuccccaguucaagcaauucuccugccucagccucuugaguagcugggauuauaggcauauccgccaccaugccugacuaauuuuguauuuuuaguagagacgggaugucaccauguugaucaggcuggucucgaacuccugaccucaggugaucugccugccuuggccucccaaagugcugggauuauaagcaugagccacugcacccagccuaugacagcuuuuuucuuuuuaaaaaaucuauuucaggaucuagucugguauuaagcauugcaugugagucuuguguauuuagucuccuuuuaccugaaaauuuuuucagccuuucucugucuucaugacauugacauuuuugaagaguacaaagcagugguuuguagauuggcccuuaguuuaguuugucucaugcuuccucaugauuaaauuugagugugcauuuauuacaggaauacgauagaggugauuuuguguccuucccaguaugucaugcccagaagcacgugaugccagcucaacacuuauuggcugauguuuccuuuguucacuugguuaaagugaugucugccaguuuucucugcuugaauguuaauauauuuauguauuugaaauuaauacacgauuuuaggaggaggagauacuuugagauuaggagacuguccuguugcucuucaaacuuucagccagugguuuuauuuaauaauaaucuuugaaugaauguugccugaauaacaguuauuguuaggugguugcaaaaugcugaguuuuucccccuaauuuuauuacuccuuacucauuuauuuaguauucuucuguaggaaaagcuuucuucuuccucucauuucuccuuucugcuuuucuaauccauaugggauaacacaugguuauuuuucuucacuagauuauaaucucuuacuauccuuauucauacugauguucaaauugucccagguuuggcugugggagccccuucagguugucucccaugucuuuuguaaaugguuucauucauuauuuuuggaguucuugcuuauuuuuugguauuagaaaauguucaucuuagacuuucccuguucuagcccuagaauaagcugauuuuuuaagcaggcuugguuccuuuuagggcuaaugguauuuaguaaccaaguucugggcuagguaagcucauugcugcugucauugcuuucaggccuucaguggauagagcuggggaaagaggcagcuucauaugguuccauucaauauguaccuuuuauuuuuuaaugacaucagugugaaugcuguugaugcuucacugaauaagaacauugaacuguugaucucaaaccauuguugcuagggaaugcugaaagcaguguagauuugggaucacuaguaugagaaugugcaacuucaccguuuggugauaguuggcauugaaaggaagagugaauauaaccguauuuucagauagcugcaacaugagaugugauaugaaaauaccugugcuuucccuuacugcuagaaucacagguacugcuaguguuacugugguuuauugucuguguucauaacugaauacuaugcagaauaucaguuagagguuaggaaaaaacaaagguaauuuuuuuuuccauccaaguuuacacccuaccugccuugaauucuaucuaccccauaccccuaaggacccuuguuaaaaacucuugcuuuagaaugaacaucauuuuaaagcccaguuaguuugcacaaaucacagagcucuaagguuguaacuuuuuaugaagaaacaccagagaugggccaggugcaguggcuuacgccuguaaucccagcacuuugggaggccgaggcgggcggaucacgaggucaggagaucgagaccauccugucuaacauggugaaacccuaucucuacugagaauacaaaaaauuaacugggcgugguggcacaugccuauagucccagcuacucaggaggcugaggcaggagaauaacuugaacccgggaggcggagcuugcagcgagcugagauugcaccacugcacuccagccugggcgacagagagagacuccaucucaaaaaaaaaaaaaaaaaaaaaaaaauuaacaccagagauuagcucuuuuauauuacuguugccuuuccauuuuucuaccuauuccuuuuuuuuuuuugucuguuugagacagggucucacucuguugcccaggcuggggugcaguggcaugaucauggcuuacugcagccuugaccucccugggcuaggcaauccucccaccucagccucccggguagcugggacagcaggugugcaccaccuugcccagcuaauuuuuuguagagaugggguuucacuguauugaccaggcuggucuugaacgccugggcucaagcaauccacuugucucagccucccaaaguguugggauuacaggcgugagcuaccacgcucggccuguaccuacucuuuauuauuguuuuuaauauugucauucucuagcuuuuccugugcacuuccuuaauccuuauaaaauuauuuuuuguugcacucauagaauuugauguuugguguuucuuaaaucuuuaugaauuuauuuagucuugucauaucuuaguucaguauaaaguagcaguaacuauguacauuuauuuuuacauuaggguuuagaauauaauccauacaaccauacugugaguuuguuccuuuguauucauuccuuuuugcuuguacuucuuacugccacaaaaucugccaauucauagguaacaagcuucgccaaaagugagaaugaaaugggaacugcacucuacaucacacugcggaaauggccaagacaaaugaaaguccuagaucauuuuucuuugccuucucuccucucuguccuuggggaauuuagaguagaacuagaugagauagauaauucaaggguacaaggugggaagagggguuugggggagccaggauguggcgauaaaucuucaacuaaaaauuccuaccccccgacaaagcuuaccaauccacuauuuaccauugucucugccagagaaggacgacuuuucaugacuuagccccaucucaguccucaguuuaaaugaugugacucugagauccaagcauguuuaaauuuagaaaaaaauaauauuauauacgagaagaaggcaugaauaaaaaguauagaguggccaaaaauuauuuuuaguugguuuacugaaccauggaccuuauaaauuaacuaaaaaugcagaaucuuauggauuauauuuccuauggaaaacacugggcuuuauauuaauauauacauuuuuuagccauuaccuuguaguuguccucuuuugccagcaggugggcuguaugcacacaauuaugacccuagcuccaaagugaagcacuuccaaagcaccuacagcaaugcagcaauacaucuucucuccauuccuuccaucucuccuaccccaacacacacacucucucucucuacacgaguaguagcauaggauacauacacacuguucuauaccuuuuucucacuuaaggauuauuguggagauugguauauaucaguguaagaagagacucaaaauuuucagaccggcauggcauuccauuguacaacuguaccauaauugauuuaacuaacccccauugauaaauauuagcugguuuucagucuuuauuauuauacaaacaaugcagcagcuagcaaacuugcauaucuaucacuuucccugugugugagcaucucuguaggaucaauuauuaaagggcaugugcacuugugaucuugaucaccgaugccagguuguccuccauagaagucgugccauugauaccacucgcagcagggugcugugcgugcuuguuucccuagaaccucgucuguucgauggaugacaaauguagcuucuuaguguccuuucagugugcacgccucucauuaugaacagugcugagcguuguuuauauauauuuauaaaauaaauauacaaaaaauauauuuauauuauauuuauguauuuuauauauaaugaauuauauuuagaaauaugccucuaaaauauaaaaauauaaauauaaauauauuauauaauuuacauauauaauauauagauauaaauauauaguauauuaguauauaauaaauguaaauauauacuauacaauauauaaauauauaauauauaauuuauaauauauucuuauauauuuuagaggcauuguauuuauuuuccuaacaacuuuauguuuaugacugugcuuguauuucuauaauaguguugguauuuuuugucacugacuuguaggagauuauugcauauuagugacauuaacccuugaucugugauaagaguugaaauugaaaugcuuuaauuuugaaaacauucaauagaaaauugaaauguuuuuauuuauguuuuaauauguuagaaauaguccccacuacucuucuguuuuguaauuuuuguaacgauuuuuguuuauccuuccauaagaacuugaauugaauuucaacuuaagaagaauugaaagcucugugaucauugucaucguguucuuucuuuuuaacuuguccaauaaugcuuuauaucuuuugaauuauauugauuauuagacuuuaaguaggcuauuagcagaaucuggaaaauaauauacuguagugacuacugggggcugaaagagaugacacuagaacauccugggcuuuucuuacuuguuaaaagaauugugaguuagucuucacacuuucauacaaaaggacacagaggagagacuugacgaggacacagguugcgcucuucuuggaauaauuuguauguuuucuauucugauaacccacaguuugcauaaaguuccuuuuacauuuccaacauauuuugaggcccuacacauuaguauuuucuaacaccaucuauuaguacagagauuucuuuuuuuuugucaaacaaaaauauuagucacuuuuuuucaguaaaaauuuuaauuauuuuaauuucagggugguuuaugguguuuuggaggaaauggacuuccuuaugcugaaaguuuuggagaaguuccuucagcaacaguggaaauguucuguuuagaagcuauaguaaaacauucugagguaauuuacauuuucaaaauguaguuuacuuuuuaugauuuuauugaaauaauuauauagguugauuuuugcaagggcaauaaucauuuacuguaaaaggagaaaagcccuucacuuauuuuuaaauuucugcuuuccuccaauuuuaauuguuagaauaaucaugauuuagcaccaauaaaugagauucuauuuugcuaaguauuucuaaaaauuuauuuaauugccuaaaagaaagcagccuaucaucuaaauguggcauuugccuuugaguuauguugucuucuacugccuuucucagauauuuuuacauauuauuuucagauaauuuccauuaaaacaacugccaaagaugugacaggauaaaagaaaaaacaggcugggcgcgguggcucacgccuguaaucccagcacuuugggaggcugaggcgggugggucaccugaggucaggaguucaagaccagccuggccaacauggugaaacuccgucucuacuaaaaauacaaaaauuagccaggugugguggugcgcaccuguaaucccagcuacuuggaggcugaggcaggagaaucgcuugaaccuggguagcagagguugcagugaacugagauugugccacugcacugcagccugggcgacagagcaagacuccaucucaaaaaaaaaaaaacaaaacaaaaaaaaacaaggaaauauuagaugacuauacucuugaaguguaacuguagcauauaucaaugauuguuaaacucuuugguaccauagaaacuuuucugucaugaugauaguuuaaaaaagaaaaaagcaacaaaccuuguagugcucauagugcagaaacaucacccaggaaauguguuuuaaaaugcacauuuuuccacucacuuguaucaaguuuaacaucauagauuugguguggaguccaggaauuugcauuuguagccagcacccuggugaggugaaugcaggugaucugucccacaucaagacaaacaccauccuugagauucggaacucuccaguucaguuuugggacacauuggacauggcuuaaaagccauguguagaaagucaucuuuaguucucgcccaugaaauuaggaacugaccacaaagcagagggaauaagguguuguaguacagaagggaccugggaaaacuugcucgaguguggugucuccugaguuguuuuucugaagcaauagcugcaucuucaguagaaaggacagugcauggaauauaauaguuaucuuuccagaaaucucugaaauuauugcagaucucacuugauauacaguauauuuaaaaggcauacauuuuaaggcacuuaaaaugugauauaauguaacaaaaaucuagaaagugaaaauugcuguauguacauauggugucauguccuugaguaaaacuagugaugggaagaggcaaagcugugcccagugacauuagaaagacugacuuguuggucaguucucuucccuuaacucaauaugcauguuuucuuuuucuuuuaucuguuuucuccauuaaaacuucaaaucccuuuuuauuuuuaccugaucuuucucuuuuaaaaaaucuuccaacuucuaaguuugaggccagccccauagcugugggcauugugugggauaggguguggggccacagaggucacuggucucgcccugugugaguccuuguuugcugaaugaaaucuguucgcuugcacaggggacuauuuccugagaauagguggcagauuuuucaaggugagaacuguuuuaagguaauuucaagucaaagugucacuauaaauugaaacaauuuuguaauaaugacauugucagguuacauccaaccaagagcuaagcagaaugagaauaaugauuuuaguaguccuggugagagaugccuucuugggauuuuuucuaugauuuugaagcacuucccacuuaaauagggauuugcuuauuuaagcaagcugagacaagagcuuugaggagucucccugcaucccugcccuugagugggagcuaccuagcuguccccaugaccaggcugugucaucucacgucaugaauuuguacaaugucaagggagcuucuguuuauuuauugugccagauauccacacauugugauaaaaucgaagcaaauggaggccugcagcuacuucagaggcuguaccgacuucacaaggacugcccuaaaguacagagaaauauaaugcgugucauuggaaauauggcuuugaaugaacaucuucauucuucuauaguucgcucagguaacagcuuuauauacugaguauuuuuuacuuuguucucccaccucuaccccucaugauauguucauuuuucuuuuuuuuuuuuuuuuuuuuuuuuuuuaaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccaauuucucaaucuuuuccccaccuuucccgccuuucuauuccacaaagccgccauugucauccuggcccguucucaaugagcuguugggcacaccucccagacggggugguggccggacagaggggcuccucacuucccaguaggggcggccgggcagaggcgccccucaccucccggacggggcggcuggccgggcaggggggcugacccccccaccucccucccggacggggcggcuggccgggcagaggggcuccucacuucccaguaggggcggccgggcagaggcgccccucaccucccggacagggcggcuggcugggcgggggggccgagauauguucauuuuucaauagacaaggcucuacuuaggguuaguuauggguccuuagaacauguuauuuugguagaggcaaggaauugcuugagauuguagauaaucugcgccuaagauaaucaguauuguagaugaucauaggagagcagguuugccaugaugaucaucuaauuauuuauguaauuuuuuuuuuuuuuugagagaaucucacuguguugcugaagcuagagugcagugguguggucauagcucacuacagccuuaaacuccuaggcucaauggauccucccaccucagccucccgaguagcugggacuacaggcacgugccauugugcauggcuaauuugaaaaacuuuuuguagagacggggguccuacuuuguugccuagguuggucucgaacuccuggacucaagugaucccccugccuuggccucccauaguguugagauuaccaugccuggccuguaauuuuugaugugauuugguuaaccaagaggcauagucagacuaaaaagagauucauuuuaugauuaaugauuuucccucuugcaaguaauaaaccagcuguggggagauacuuuaagaccaagcaaauauccugcuuucuauccucugacaguuccugcccgaucuagucuuuaccauaaugguuuuaaaaugauuuucuagcuccagcacacccucugcaguuacuuuuuagcauuuggcauucuacuggaagcaagaguccuucucuuucccuccucccucccuccaucuccucccucccuucuauggacagguacaugaauuccuauuuuuaaaaguuuauaauuuauugcuguacuuaauaauuuggugccaaauuguuccagcuuugacuaaugggagccccagcaaacuggcccauguccuuuaugauaugcccacauuauuuuggggaggcauuucuuauuuccugguauaacaagauauuuuagguucauuucucugaagaaaccucuauacuuuuaguggagaaugauucuuagagaccaaggucuaaaugauaggagugcauauugcuccuggggugucuuugcuucuugccucuuucacuagaaagagcuggauaauacauacacacauauauauauagauauacauacauacacaaauauguguaaauguauauguacacauauauguguguugugggauggaagauauacuuucaacacuuacuaauguaauuauugauaucguuugguuauguuggucaucuugcucuuugcuuucuauuugucccucuuuuucuucuuuuuucugacuucuuguauuacuugaguguuuguuuuuaaauucuguuguuucuccucuuuuggcuuuuuauacuguguuuguguguuuaaugguuguauccuuacagucuacuuugaauuaagauuaugccauuucauaugauguaagauccuuacaaccccauaauucaguucacauccccugccauucuuugugguauuguuguaauauguuuuacucuuauuuauagacuucacaauacauuaucauuguuauuauuauuuuuugagacagggucuugcuguguugcccaggcuguccucaaacuccuaggcucaagugaucuuccuaccuuagccucacgaguagcugggaguauauguuugggccacugugccugguuacauuguuguuauuuauaauaguugcuuuaguucauuuugugcugcuguaaccugaggcuguauguuggaggcuggguaauuuauaaauaacagauuuauugugucucaguucuggaggcugggaaguucaagaucaagguucuggccauuggugucuugugagggccucauuguuuuaucgucacauggcagaagacugaagggcaagcuagccugcauguugcaugaagccucuuuuauuuuuuuauuuaaaaauuuuugaauuuaaaauuuuauguacaugauaguuguacauauuuaugaggauguaaauauguagugauauuuugauacaagcauacaauguguagugaucaagucagggcaguugggauagcaaucacuucaaacaugaauuaauucuauuaaugugggaggaacacugauggcccagucaccucuuaaaggcucaccucuucauacugucacauuggcaacacuugaauuuuggaggggacacauugaaaccauaggaacagucgugugacauuuaaagaauauaagaaaucaaaaaucuuuuuuguuugcauauuuauaaucuccagugcucucccuuuuuucuguauauauggauuuacaucugauaauauuucucuucagccuaaagacuuuccuuuaguauuucuuguguauuggguccacuggcaacaaauucucucaccucauuauuugaaaaugucuuuaauuugccuuuauuuuauguccaggaaaagguaucuucccuggauaaaguauucuuuguugaguguguauguguguguguguguguguguguguguguguguguguguguuuuccagcauuucuaaaaugucauuccacucucuucuggaguccauugucugaugagaagucucuuugaauucccacuuuuguucucuuauacguaauaucuuuuuuccucuggcuucuuuuaagaucuuucuguuugauuuuugacucugaaaugccuaggugucauauuuauccugcuugagcuccacugaacugagagaauuaacauaugcauuaccuuauacauaucauuuuuuguggugagaacauuuaaaaucuauucugucagcaauuuucaagaauacaauaccuuguauugauggguugguguuuuugaucaaauguagaaacuuuccugccaguauaucauccaauauuuauucuuuuguccuuuuuuauucuuaucuuuuucuggaacuucuguuauguauauuagaucucuuuuuucuguccugcagguuauugagauucuauucauuauguuuaaauuuuuuccucugugcuuuacuuuggaugguuucuauugaccuaucuacagguucauugaugagguggagacuaagggauucaaagcaggacaaagaccugaucaaaucaguaucuuauuauagaaaaaaaaaugacucuucucugaaaccugggucuaccccaagucuucaguccucuuaucuccuggauagcccacucaccaccuuggccucaauuccaugaccuucucaucuucauugauuuccugcucugcuccugaguugucuaguacucuacuccuaagucauacauugaaccuaaucacugccugaaaccacuucaccuaaaaaucagcccugagcacauccuucuuucauucaagcuuguuuuugcaucuaccccauaaggacugguuuucuucucuauugaaaucuucuauccacagaccccuuuauccucucccaauccaucacucuuuuuauucuuuacuuccucccugaacccagcuuauauuccauggucuguuauuucaguaauauuuuugccaguaccuacaacucccuuucccuuugauccuguuaccagucucuuggucaagaccuugaugaaaccuacugccugcuuacuacucuguggcugaacguggaaucauugcagauugguugucagcaugcuuaugagaucacaaauuaaagaaccuucaauauugcucagcaauuauguuucuccaaucagcuaccuuaacauucuuagcaaugacuauuguaaaccuucuacguguuccuuaaaccuuccacauauuccuuccucucagaggaugacuucuccuccuacuuuacugagacaauugaagcccuaaaaggaauuuucucacuaacaaaaaccaaacccuguucuuuccuuuucuugguaauaggaaaagagacaccucuuuuauaagcccuccagccauguuugggccugucuccuuucacagucucaggaauguauacuuuuuucuggucucauggucagcugcugccucauagcuggacccucugaucacauacauuggaggaagaugugaaaaacauaaucugcauccccuauaacauccuguccucccuguuauagcuaaacuucugaaagaguuaccuacauauaccuucuuuuugcucagccuucauuacuucucaguacuccaauuugaauucugcuaacuugcccuguguuuuuuucucuuuaggcauccugugucuuucccucuuuuuauauauuuuguaucaaucuuaguaucagaucugcagauuuuugccuucagauuuacaaaaguuggagcaaccuaaaugucugccaauaggaaugaauagugguuaaacaauggcguacucaugugacguaauacuauaguucaaaggaaugaaguugauauauauagagagcucuccaagacauacugcugaaguacagacacagaacaguaguaugauuccauuuagguuucaaaaagugcacauagagcuacauuuuucuuuuucuuugagacagcgucucacucuguugcccaggcuggagugcaguggcgcuaucuuggcucccugcaaccuccaccucccggguucaagugauucucaugccucagccuucugagucgcugggauuacaggcgcccaccaccacacccggcuaauuuuguaauuuuaguagagaugggguuucacauguuggccaggcuggucuugaacuccugaccucaagugaucugccugccucagccucccaaaguguugggauuacaggcaugaaacaccacgccuggcccauuguauguguuuaaauuauagauauaugacuauauuuuucaaaaggguguccaccaaacuucuaccuuucauuacucugaggauguaaauggaguugggaaauuaugggaguacuaaagcaagacuuucaucauuagaugcuacuuuuaguuauuucauuauuuuuuacaguuaacauguacagacaugcauugcuuaauaguggagaaacauucugaggaauguaucguuaggcaguuuugucacugugcaaacaucgcaaaguauacuuacacaaaccuggaugguagcaccuauuccacaccuaggcuguaugggacagccuauugcuccuaggcuccaaaccuauacagcagguuacuguacugaacacuguagacaguuguaacacaaugggaaauauuugaguaucuaaacacagcuaaacauagaaaaggcacagcaaaaauacuguacuauaaucuuaugggaucaccauaguauuugugguucauuguugacugaaacauuauuauguguuuugcaugagugcauucagauguuauauaauuuuaaaaugcucaauguuaaagaaguaaguuuuccaaagggcauuugauauuuuucaaagguggaguaucucggacauugugaacauauuuugucaacugaaaaaagccagagauggcuuguaccaugcuuuuucuugugacuucauuaaaaauaaagccguauuuucauauauaccaauaacauacuugucuaucucuauagauauaauuuuuaaauauucuuauuuuauuauuuuaaaaucuuuaacagauuuugaagaggaaucuucugauguuauaaauuugaauauuguuaaguacugagucugaagcuucuuuuagguuauuaaaugcuagcuucccaucaucacagugacucaacacuuuugucguaaagagugggagaagggcauggggacagcugucguguauugagugccugcugggccugggcccacgguuuucacauacauuaguuuauuaaaaccuuccucuaguucaguugcuaaauaacuugacugagguuccagagcaaguaaggagggagcagaaaugugagcccaagucuaacuucaaggcccauauucugcuuuauuuuaaauuaaauaaauuauauaaauaaauacauagauuuuucaccguacuucagaaaauagauauagcgaaaaagcuaaacauacguuuuuuacagagcccucuucuacccuaucucucuccuaaaagguaacgacuuuauaaguuuaguguauagaucuuuguguguuuguguaugugugugcacauguacuuuuauauuuauguauauaaaguuuuaaaaacaaaaacauuaaaaaaaagaaaucauagcauagauaguauuauccaugcauuuucuguuugccucccuuuaaaaaauguuuuuuccuuccugaucuccagauucuacaagaguuuugugucucaaauucauuguuaagaaauaguuucuucauuuguaugaaaggguauuacugauugcuggucaggaugaaauaacuaguauuaacccacugaguuucauaauucuuguuaaaagcaaaacaucaugguauuuuguucacuuuugugaacaccucuauaacugcuaugaacaccucuauaauugguauuaguguuaggcuuucuaaauaaagaaaauggcucuucaaccccucuuuccuucuuugaggucccuuaagggguauguggaugguauugugccacaggucucagaggaucguagggcagaaugggguuggaauagucggacuucuccgccaaggacagacacgcaagguuugccuuucucccaucauauucaguuugaaaccucacucucucuguggucugcgauggauucacaucaguauuuaggauauguguacuuuucaccaggcuggguuuccaucauggcagaagcaaugaaaucuccccacauuauggaguccucacacgcugccagaauccuggcaaaucuagaccgagaaacugugcaagaaaaauaucaggauggcguauaugugcugcauccccaauaucgaacaagguaaggaagcagaagagaguugcuuuguccccuuuggaaaugugaagccuagaggccucaaauuuuuaacuuauuucugcauaauucagauaaguuaaauaacuuauaagucaaauaucuuauuuacuaaaauaauuugucuauaguaaccacaaaagaauuggagguugucaugaaaaguaugugaacuagcuaaauugucaugguuauuuuacaaagggcuucccuucaguuagguggcauucacauuugauaaugcgucacacuuaaacuuuguaauacauaucuccuuugguucaaggcauuuucacuuagaucugaguuaauaacugauuuggauuguagaagucagcugaauaggaaggagauaagacauugucuuauguggcaaccaaauuagccugggccuagaacucaagggacuggagaaaguuuaugcuaguuauaaaaggaugcauuagaaagaauaaguuguaauaaguuugacucaugccccuucuuaagguuauuuguggucauuauaucuaguuguauaauugcuaagacaauaaauauagaagggaccacacugaaaaaauaacauauuucuugguuuucuuagggcacuuuacaaaaaguaccucagaaaauagcaaaaacuuuuaaauuaaaaaguggauuaccugguuaauuacaauuuguaaauaaaauauuaugguuauauaugugcauugcauaauuguauguguacuguaaauagcuugcaacuaacauacuaucuacaguuuuuaaugcgucauaugcaaugagugaauguuacuuugaaaucucauuuuauaaguauuaguuuccuuaacacauuuuugaaaaucucuuuuauauauacugacuuugaaacuguuauuagcacguucuucuuuaauuucuuaaauacuuuuauugauuuguagaauauucucaaauggaagucuuuagaggguaaucuaugacaucugucaguugauugauugcuaagcucauuacaauugauugugguuggucugccugacuagaauagucuccauuuuuagagaacagugaacaugcuucauguaugucuuugccaaagcuccuucuagguuuucccagcaaaccugugcuuauagagcuugcuuuaauucaguuuuaugucacauaagccugcuaaagcaccauccacagagaaugcuguguagauucuuaccaaagcaguaaugcauuuauucugcuucuuuuuaaaacucucuccccuauuagucagcccauuaaagcagauguccuuuuuauucauggccuuaugggagcagcauucaaaacauggcgccagcaggacagugagcaggcuguaauugaaaaaccuauggaggaugaagacagauauacgacgugcuggcccaagguaagggagccacugacucuggcccugguugcuggggcccugguugcuggggcccugauuguggcuugcuuguuuuucucuuuguucugggauuuuuuucccaugcaguucuucuuucccuuagggagauuuguaguauguuuugacaacaacugggcuugucacccuauguuguauaauuuccauuuggggugcaguguaugacucaaaaaauauucuauuaaguaaaaaauaggggcaagagccaguaauaguucacuuuuguuguaauauaauacaaaaauaacauaacaauacuuacauuuauaauaguuaccuaauucuaugaccuuaauaauuacaaaaauagaaagucuuugaagaaguaauuauacuuugcauuucuuuccuucuuuuuuuuuuuuuuuuuugagaugagggucucauuuugucacccagacuggagugcaguggugcgauccuagcgcacugcagucucaaccucccaggcucaaacagucauucccccucagccuccugaguagcugggaccacaggcacaugccaucaugccuggcuaauuaauacuuuacauuucuuugauacuauuucucccaaagaaccuuaauucuggaaugaauucauugaauggaauuuaucuaaagcucauuuaaaagugaugcugcauauacgugugaauaguuuuuagggcauuguuccauuacuacuuauucuccuucacaaaggcuuaucaaguagaagaaugauuugcacuuucugguggcacugaaguacagagaugaugauagaccuaggguauacagagauagaacugugaugauuauuauuagugucucugaauucucagauccaaaaucugucagacuaugccaucuguccugagauuauagcauucuacuaaauucuuucaaaaagccaacuugaucuagacuuuaaaacaggccuugcuuuuggcuauagcagcuuaaaauggaaaauauucucuugaaaccuucauuggccuuaugcuauaaauacugguaccacuucgagaccagagacuugaaaagauagugcuggaauuguuuuuacgguaccuucaaaccuuauuccagugcuaucuuuaauuauagugcaagaggccuuuaguuauaaauuugauuuacuaggcaguaauugcaguggugaagauucauacuuguucucacauauguuuuauuuuacuuagacaugguuagcaaaagacuguccugcucuccgaauuauaucuguggaguaugacaccagccucagcgacuggagagcaaggugcccuauggaaagguaacagaggcgacuuuagaccaggaggacagggaagaauucaggccgcaaguuuagguccucuuggaugggaagugauuuuaauuuuuugaugccacagacaggauuuucuuaugaagaacaaaccuaaucuuuuuugucuuccuucuagaaggaguuugcugucaauaagcaguggaauaguagaaggcuuagguauaucaccaauggugggcuccuaacaugguuuauuuacaacuguucuaauagugaaggaucguggauugucuagcagucuccuuuucuaucagaaguaaaagugauguuuuuuuguucuuguguccacaaucauacuggcuaaaggaagcaaagagaaagaugcugagaaauaucagcugcuauuucccuuguaugucaucugugccaguuguauacaugggaaggagugcuggauuucagaguuacuggacugagaguagccggauccuaccuuugauuugcugugcagucuuagaccagucaguuaacuuuuccgggaagcuuugucuacagauugacagaguuggucuaaaucaguguuaucaaacugcuuucugaaugaaccucccguaggugcccaagaagggugucaaggugagcaggcaagaccccaggucucccuccccauuucacccagaggagcucuggagaaccuuuauuuugaagaaaugugucuacaaauaaacaguuugaaacuaccagacuagauaguuuugaaguuccucuuuaguuuaaaaauuacuuauuucgaauucugauucuauuagcauccuguuuaugcuaguuauaaaagcaugcauuggaaggaauaagugcuaauaaacuugacucauucuaguuuuucuaaauagcacccuaguauuucuaaagaauaaaccaaaauuaugaaagcuuaauauuuuugcagccuaacuaccaguagagagaccacagucuuuggugauacuuucauugucaggccuuggaugaaaaaggacauccauauccuaaguguuggagggcaguugcagggagacccacauuugacccgaaaaaauugccugacacaggugcuccaacaauguucaugcaguaaaugaauggccuguucugggcuuagauauuccuaauuaggccaauguuaauaaguuacaaauagagaauuaacgauuucaggaauugagcagagagaucccaggcgugguggcucaugccuauaauccuagugcuuugggaggccgaggugggaggauuccuuggggccaggaguucaauaagagagaauagggguauuuuauauuaagcagagagaauggggguauuucuuacucuaaauguaguauguagcauugguccuguagacuaaaguucuuaacucuaaaaauuagacagcaaauugaggggaucgauagccuugugucaugccugcuguuuuuguuuuguucagaaaguccauugcauucagaagcaacgaacuucuuaggaagcucagagcugcugguguuggggauaggccagugguuuggauaucacauagcaugggagguaaguguggcuucaacuuugugaaguggccauugugauguuauuuucagccacuguggccaaccuaaaguuauuuuaucuuuccauuuuacuuaauagcggcucccuuacccccccugcuaaauuaaucuguguagcuauggcuaggacuuuuaaaauuacuacucuuguuccaugcuguuccuuucucuagaaaagggcaaccuguuacaaaucaucuaagagggauauggguuugacagcguagugcuuucacauagcgguaaugaauaaacaugagaagcagcccguuucauauacacccaccucgucaacaugccucagcauucuuggguggccccaggggugccccuuuauucuuccugcucccccucaccauugcagucuauggucgcuuuagugcccacagucccagacucugggugccugcucacaccaggcccagagcugcugagguacaggugugaucaagugucuguucuugggguccuagugguugcuuauggaauggccuccccugugugcgacucccccaguccacuuugaaauuuucaccacccaccuugcagaaggccuuucugcagcccguggccuaguuuaucugaugaagcacucaggauugccucugagguggggauuuuugcugagacaaagguggguguagcccuucguguccucaaagaccuacugucaucauccuuuagaucuuuguguuucauuaucgguuccaaagccggggcagggggauggaagaaaaggugccuccagaggaacaguucccaugaaagcuguguucuccaugggggacugugugcuguggaauaguagcacuguccugacaguguggucaucagcggucugccauagcaggcugagagaccagccacaccacgcucauguccugagggagcucccagcugggcauaccucauguuccugcacugggacaguagauccugugagacaaggcucugcccuacaaaugaguuucuagaaucccuguuuguaggcuugcacuauaaggaucaggaguauuauuaaguguuuuaaggccuuauuucuuauacuacuguacagagaauuguuuaaaccauuuuuuuuaaaaagaaagcaucucuuuuuauguauuucuuguuuggccuuuucuuuuuuuacaguaauaaagggaaggaaaauagcuuaugcauuguuuuuuucccuugucuguggcuaggucuucuugucaaaaagaugcuguuggaagccucuacgaagccagaaaugaguacuguuaucaacaauaccagaggaauaauuuuuuauagugucccucaucauggaucacguuuggcugaauacucuguuaauauucgcuaucuucucuuccccucguuggaagucaaagaacucagcaaggguaauacuuuuugucauaaaggaaauugggguuauauuaacaucaguuacacagagaagaagaaaaaguuucuuccuugaauguauuaucucauuuuauaauuuguauauaauuguguuuagacuauucauggaaauuuuggguugggcuugauuuuucuuugauaauuucucauuuuguucuuaagccauuauuuacucaagcauuguaauaauuuuaauauuaucuuaaauacuuaaaauuagaaaaauaaucagauaauguuuugcuuuuaaguauuauuccaaauuaccaauaaauggcuuuuuucccccaugaguggagaaucaucaacuguuaaaauguaaaugaaacuuugagauuguuaguauuaauuuuaaaguacucugguuugauaagcaguuuucucucuggaacaccuguuaaucggaauuuggauucccuggcucgagccuaaauauaccaggugucuuuuugcuccuauuuucucuuuguucuacuuuauggagaaucucuugauuucuucuaaaccuucuguuggacuuuccuuucguggagucagauuguguuuuccguacgugccuucuuuccugugcccuggugguucugcacucauguccucuucuuguuuuguggcuccuuuaucuuuucaaauaauucuaaagauccuaaguagaagguuugugaguucccuucuacuccucaucuagcuguuuuuuuucuguggccagcuuuucuguuugcuuaucugauccaucucuuuuaggucauaggccuaucuggugccucuugguugcucuuucauaugugagggugagggaugggaagggacaggcauucugugauuguagacaggcuuuguuggugggaggcugggcuuugggguggguguuguggugccaucaucacacuggaggaccccuguggucccacacaccagacugcccugggaacugcuuccugcccccaguaaugugauaaacccucuccugcugcugacuguccugucgauucuugguuuuagcuuuuuccuugaaucuuaguggcuucuuggcaggggagaaaauaaacauguguacucaagccaccgucuugaaucagaauucuaauuuccucucuaaauuugaaagauuaaugcauuuuauuaugaauuggguaaacaacuugucacagucuuguucuguauaauuuuacagauucuccugcacuuaaaacacuacaagaugacuuucuggaguuugcuaaagacaaaaacuuccaggugcugaauuuuguggaaacacuaccaaccuacauuggcagcaugauuaagcuccaugugguaccuguggaaucagcagguauucacucuuuugaaacuuguuggcuguuagaugcuuaauuauaccuagcauuuacuuguaaacagcaauuuuuauauccagguucucaguuuuaagagauaguuuaugaaggucuagauuugauuucuuuuauucuuuucagcaauagauuaaaauuucucuguaaacauauaacccggguauuaccucucccugcccuuuauguaacugauuagaugagaaggguuaauuggcuaacucuaaguuaggcaucaacagugaacucuuuugcaguaaagaaagcucuucuaucagcuagaucaaaaggggcauuuauuuaauagacuuagacuuauauuuacaugcagaacccuuaagaaaaucaucuaaaaguguggaagcuuucguaaauagaagauccauggggaauaguaaagcuccagaaauauuccagugggaaaaacuaguguugaacuacaaucucuucaugauccugggguugagggaaauggccagugcuugcucucuagugucauauaauguauuauagauucuuugagggaggagcccagaucuuaauuaacucucuucauagacuccucuguuacucuguacauacuagauacccuguacauuucaccaccugaacugcuuuugccucaccuggccaugucuucagcuugccuguuaucucugggaaccccuuucuuacugccucugaggcuggcuuaggugcuguucuggugguagccagccacauuguggguccuucaggcuagggacagcaugcaucuggagugcuugccagaugguucuuuugucuacauaaugaguuuuguccuaauuucauuauaugcuaucuacauaaaaugaaaaaugucauacuguguaguagaacugaaaaauuuuaccuuaaaguaauaugcuguagguugaggaguuacuauuuaguaguugaagaacuugaagaguuccaaagaacagcugccagauguuuuuaaaaaggacuuuggaagcuugaagcaacagcauaguuuuuuguuuuuguuuuuaagagacagggucucacuuugucauccaggcuggaguucagugguauaaucauagcucauugcagccucgaacuccugggcucaagcguuccucccacuucagccuccugaguagcugggaccacaggcgcacaccaccacaccugucuaaauuuuuaaauuuuuuguauaaauggggucuugcuguguugcccaggcuggucucaaauuccuggccucaagcaguccuccugcguuggccucccaaagugcugggauuacuggugugagccacugugccucgcccaaaagcaaaguuaauaucauggaccagcugcuuggaguggcauagccuugcccuaauucugucaccaagaggcuuuucuuccuucauaaccaccaccugcauuccucaccuagguggccucacuaguaccucuuaucacuuccgugcgaggggacuuuguuagaccgaaauaucucaagcacuaaaucauuuuuacccugaaagugauuauugggauuuagguauagaauggaucccaugugagacauucccauucauuucaccaggagaaaggaaguuuauaauagaaacucugaaguaacuuagcaauaaccugcagguguaagaagguuuugaauauguuagugcucaaucucugcuugcucugaaauaaggaaguaggccagaacacauacgaaaaguucauggaaagcauaaaacuaugguucuacugacugagaaucccuuccugcauguuucaucaaauguaguuuagcugcaaucaaacuucagguuccuuuaucuuuuaagagucccuugucacaaccaaagcaaugucuagaacuacccauucggccucuuucaguauugucaaggggaaagcuuauauuuuuacuuagguuuauugacuuuuuuauuuucuucagauuuaggcauuggagaucuaauuccuguggauguuaaccauuugaacauuuguaagccaaagaaaaaggaugcuuuuuuguaccagcguacuuuacaauucauucgugaagcuuuagccaaagaccuugaaaacuaacaguugugcucuuccaguuuucauaugugaauucagugcaagaaacuugguguucuguuucuucuuuuaagcucuaugcaaucaugcaaacauagugaucauagcgucaacauggucuggaguguguugcagacuacagaacauuguucucccuucaagcgcuguaaagcaccaacccggaaguggcaggcacagaaggaagggcuggauugggccccuuugguguaaagaagucccugugugcugcuuuaugguucgcaguguugggcuuggugacuggagcaaagcugcugugagagaguguccuuucccaucugugacuuuccuggugcauccaggaggggcacggcagguucugagguaacucaacuuaccauaaaaaugccauuaagagaguaccuaaaauggagagaagaaugaacuagaacauucaagacucuuuuacuucuggguauugauuugcuguacauuuuuaaaguuugaguuuuuagcucaguucuaccuuuuaucugacacauuauuacuaguguuaacuuuguuagacuuauugucaugucugggucaguuccuuguaucuauuuucguauuccugagaacaaaucuuuuucuuagaaaaauucuagcuuauaauaauucuuuucagacuguagcugccuaugcuuggaauuuguccuagauaaggauaaaguagcuaauccauuauugaucacaguaugaaguaaaacuauucuaagccauuauaugaauuagcaauucuuaguaucaagauucucagauucucuuuggcuaaauaaaccuuucuucuuccuugcucauuugcaagugguauuaauugaccucuauagcaugugaguaguagauaaucaugucgaugaccuuuuuuucuuuagaguaacagcauuauugagauauaauuuacauaccauaagauucacccuuuuaaauuauacaauucauuuuuguuuuguuuuguuuguuuagagacagggucugacucuguugcccaagcuggagugcaguggcaugaucauagcucauuguaaccucaaacuccugggcucaagagauccuuuugcuucagccucccaagcagcuaggacuacaggcacaugccaccacacuuggguaauuaaaaaauaaauaaauacuuuuuuguagagacagggucucacuguguugcccaggucucaaacucccgaucucaagccacccucccaaaaugcugugauuauaggccagagccauuguucccaggcucaauucauugguuuuuaguauaguucacugaguugugcaacaucauugcuauuuaauuucaggcuauuucaucauccccaaaagaaccccauacccaugagcagucaguucccaccucugcuuucccaagccugcgguaaacacuaaucuguuuucugucucuauggauuugggaauuuuauguaaauggaaucauacaauauguggcccucucugccuucuuccuucuauuagcauguuuucaagguucauucaugauauagcauguaucaguacuacuucauuucuuuuuauggccgaaauuacuccauuguaugauaugccauguuucuuuauccauucaucagcugauggacaucuagguucuguucauuuuugucuaugauaaauaaugcuaccaugaucauuuguguacaaauuuauguguggauagauguuuuugauucucuuggguggaauugcuggucaaaugguaagucuauguuuaaauuuugaagauggugaacuuuuguagaaugagauagucgaagcuaaaacuggaguauggcaucugaagguaaauggcucaucaauaaacucgauaucaacaauuaauuguuucauug

SEQ ID NO: 192661 - RNA, 30998 nt, Homo sapiens
ggcgcacucugccggcaacgccgaggcgcuucugcaucugugggccgagguguguggcgagcguccgagcggcuggggaaaguggggugugggaacacugaggggucccaaagaaaggggagaggaagagaaaagccccagaagccuguccaccgggugcugggggcacagggcggugucccccacucucuccgggcccuuccuggcggggccgcacggcagucccccccucguuuaaucguggguuuccuguggggcuagggcucgcccugcgcccagguguaaguggaaguuaauuaaaugggcguacgcugagugguuuguuuccagccuagguccgcacgggacgugauuuauuuagugaaggggcacaagaucuggagaucuggcuuguacuuuuuuccuuuggccaggaacuacggcuuaaucucuuccuuuggucuccucauauguaaaaugagguggcugaggccgggcgcgguggcucacgccugcaaucccagcacauugggaggccgaggcgggcaaaucacuugaggccaggaguucgagaccagccuggccaacauggugaaaccccgucuccacuaaaaauacaauaaauuggccuggcgcgguggcucacaccuguugucccagcacuuugggaggccgagguagguggaucauuugagaucaggaguucgagaccagccuggccaacauggugaaacccugccucuacuaaaaauacaaaauuuggccuggcgugguggcgggcgccuguaguccccgcugcuugggaggcugaggcaggagaaucgcuugagcccgggaggcagagguugcagugagccgacaucacgacacugcgcuccagccugggcgacagagugagacucugucucgaaguguauauauacauauauauauauuauauauguauuuuauauauaauauauauuuauuuuauauauaauauauaauauguauauuauguauauuauauauaauacguauauuauauauaauacauauauauaauauguauauuauauauuauauauaauauuauauuguauauuauauauuauauauaauauauuguauauuauauauauuauauauuauauauauuauauuguauauuauauauaauauauuguauauuauauaauauauuguauauuauauauaauauacaguauauuauauauaauauacuguauauuauauauaauauauuguauauuauauauaauauauuguauauuacauauauuguauauuacauauaauauauuguauauuacauauauuguauauuacauauaauauauuguauauuauauaauauauaauauauauuauauaauauauuguauauuauauauuauauaauauauuguauauuauauauuauauaauauauuguauauuauauauaauauauuguauauuauauauuauauauuguauauuauauauuauauauaaaaguguguauauauauacacacacacacacacgauacaacacaguacauuagcugggcuuaguagugcaugccuguagucccagcuacucgggaggcugaggugggaggaucgcuugaacccaggaggcaagagguugcagggagcagagaucgcgccacugcacuacagccugggcggcagagccagacccugucucaguaaaauaaaauauaaacuaaaaggaggugguugggcucacuguauaauuuuugaagcaccuuucagaacuaucuucuuugauuccugucucccaggaucuuacccuuugucauucuccugaaugggaaaagaaauccuuugaauaauggacgguuuauaccuggguugggcacacugguguagaguuaggccucuugcuucuauuagggcuaauugaccuuggguagaauuggcuggcgaguaagauguggcauuaauauuccaaguagacucauuuuaauuuuguuaaaaaaucagaaugucuuuuuucuuaauguuaacugucuuucauagacuuaacuguuaaauauugacauuuaauuauuuugccucguuucagaggcagauccccaaaguauaugaaaguuaaugauuuuuaauuuaauguuaccuuacucuuuuuauuagcauucuucaggucaucugaaccuucugagaaaacauggucaacgucuugaaaggagugcuuauagaaugguuaguaguuuugauacugcaugaguuuuaaguuuaaauauugaaucuugacuuguauguaugucuuuucuaaaacccuguuguuuuuaagauauggaugaaaucaagucuuucgcuuuuaacaaguggcacagauuuuguugcaaagcuccuggugccagauuucagucccucuguugaauugauggaacuggcaugaucagaggcagcauauuuguuagaugagucgucuuuagagaaacagugcuugcauucuccucaaacaugaugaauuuuagggccugaaagaguucaggaacuugcuuaagucuuuaccauuacaaacuguggacuuuaaaaaagagaaaaacaacagagccaaauggagguuucuuaaauuccuuuagguacauuccagaggagaaacuaaaaaccauaaaugggcagaguugaguuccucaaagcaauccaguguccaggaaccccgggaacccugcucuguggacacucccauugucugaaaauacuacugucuacuuucggugccucuaauaugagccagugcauggauaaugauacuguuuacugugauggcaaggcuaaggaggagcaagaccaaacccuaggacacugccaacauuuagaacagcacuagccaauagaaaucuaaugcaagccacagauauagucuuacauuuuuucuagccaucuuaaaaguaacguaaaaugaaacaggugaaguuaauaucuuuuguuuaacccugucuaugcaaaacacuaugcuuugaacacauacuaagucuucaaaaaaaucuucaucuucaaagucgaauggauauuuuaauuuuacagcacaucucacagacuaaccguguuucaaggacucuguagugaccugacuagugggcuaccuuaugcauagugcagauuuggaguuuugauacaggagacaccaacaaaggcaacuaagaagaaaauagccagugaggcuggagggaggaaagccaaaggaggaaguguuuuguagggaugagcggcuguguugggcacugauugagaacuggcaugagaugaagacuggaguuuugaugagagccauuugaauggagugguggggagaugccagauugaaguacuguggaaaaggaaagggaggugaggagguggagauggagacuucggagaaguuuuacugugaucaugagcaaucucauagagaacuggauugguagcugacgaaggacauggugaggggcucagguucuugcuauuuuuauuuuaaugugaaagacuagaauguacguugaugagaguaaaccacugcgggggagagguauucacuuggaaaagcaaagggggugggaucuggaccccagaaguucuaaacacacuguucuguugucuuuugaaggcacuagguuugauguacuuauuuuccuauuaauuugacauaacauaaacauuuuccucguuggccuuuaguguuauuuuuaaauacagaggauacacauacacagagugucagcuaucacuuuuuuucccucguuucuuccaauucuaaguuuaaucuucaccccuggguuuguuaaauauucacuucucucuucugaggguuuuguguuuuucuugguguuuuagauucauucaucuagaauuuauugggaggaguggcauagguuuguuaaauauucacuucucucuuguggggauuuuguguuuuucuugguguguuagauucauucaucuagaauuuauucagagaagagacauauuauuagauaaggaucuaaauuagcuucuuuuuuuuuuuuuugacacggagucuugcucuguugccagguuggagugcaguggcgcgaucuuggcuccuggauucaagcgauacugcugccucagcugcccgaguagcugggauuacaggcacacaccaccacacccggcuaauuuuauuuuuguauuuuuaguagaaaugggguuucaccauguuggccaggcuggucucgaucucuugaccucaugauccaccugccccggccucccaaagugcugggauuacaggcaugagccacugcacccagccuagcuucuuuuuuguuuuggguguuuuugucuguucauuuugccaaauaucuaguucuccaccauuauuuccuuucuuaaugaugcuugaugccuccuuaaucacauaauuuuacuccccuugcuauucucuuucaucccuucccacauucaucuuucuuguugccuauucuagaauaaccuugaaauaacuuagucuguuuccaaaauaauccuuuuggcauauugguuggaauugcauuaaaccuacguuuuaauuugaaaaaaaagaugacuggauugcaucuuaaagaacaaaacucuggggagacucugaagucucagugcccgguuugcugucccguaucuaaccucugaauucuaccuggucucucuaaugacuguccaucaccuugcacuucaggguaauccccagacuagcaguaauagcaucaucuggagcuuguuagaaaugcaaaaucucagaccucacccuaaaucuacuaaaucagaauugugcauacaaagaaucuuguuaagaugcauuuaaauuuugagaagcaauaauacuguuaaucagcuucaguuuaauaauguuucccuguggagaaguguuuugcaccaggacuauuaaauuuuauuuugcagguuagguaccauccuugcaaaacuaauuuuucccuuugaagugaauucuaaaguguagucugcacaauuuuucaaaaggguaacucugucuucccaaaaacacaagucuuccaaaaagauuuugggccuaagaaauaacauagauucccaaaggaaaggguauggccagugcuaguggauucccuuucacaguuagaugcagauguuaggaugguaacuggaaaaguccuucaguuucccucauguccauauuugaugccaaggagaagccuguuaauaauaugauuaucaguauaagucuguuuauuacuucauaauauccauggauuguaugaagcauuuagguguauuggaguauggaauuugauaggucuggaguuuacaggcagaccacucaaggaucuucuacagcuguugcaggugaauaccaaaauugaggcucagcccuggaagccaaguugguuuuuggcuucaugcaggaaagaauucaagaaugagccacagaguaaagugaaagcaaguuuauuaaaaaugagggaauaaaaggguggcuaccccauaggcagaguggaguggggagggugggaagcaggcgggccugcuaacuggcuauuuuauggccauuucuugaguauauguuaaacaagggguggauuauucgugaguuuucuggaaaagaggcagggauucuguggaaccaggaguccccaguccagaccauacgggguaacuucuagauauugccauggcauuuguaaacugucguggugcuggugggggugguuuuuagcgugcgcaugcauuaugauuuguguaugauaguggugaagguugcuuuuguugccaucuugguucuggcugguuucuuuacuguauccucgcuuaucgguggggucuucugaccuguuguuuacugucucucuugucuuggaaacuaguccugcugaauuccuaucucacagcugcuuccacugucccaggaaucucuccaaauuccagucccaucauuguauuaauagaaacugauguguaauagcuuauauagugcugauccacauauaucuuagauuggcuucacuuaacugccauauuuaaacuccauuucuaucaguuaaguuuaacugauuuugagucugcagagauuugcuaaagaaguaaaccaaauuaugaugauggccauuuauucucaccuucagagaauugaaaaaucagggcacuuggauauaaucuuaacucccaagggcuuaucaaauacuaaaauugaaggcuauaaaagaaguuuuauguuuauaaauuugcacuuuuaugucaaaacugaaagguuggugaaaauuuccucuuuguugggauccaccaucaauugccaggcucacacuaaguauucucccaaaucuagccaccaagcaauuaccaaagcaagcaacacaugaccacaguaugucuguguccaguuccagaugcuggagcagaccucugguauaacaguugccacaauugguuuggcaagugcuucagcaaagauuuguugccaaggugcaaauuccaaccaguuuacaucacaauagcaaagaaucuggagaaauauguauuauuaaacuacacuuauccuuaugaguuuggcuucuaaagcuauaucguuuaugagaagcgaaguaagaaguauggcaaaaccagucuaaccauuguucuguuuuuuucucagcauguauaaaucuuuucucagccuuugccucuuaguagggccauguucgcugaaguuuuccaggcacccaaaacugugccugagauguguguguguguguguguguguguguguguguguauacacacacacacacauacacauauauagauauggcuuaguaaauauuuguguacugaauaaauuuuguuaacagaauugaguccagguuugugaucucagccaaaaucccaaauuuauuaauguuccuuuagagccucucuauuccuacagugagauucacagugaauaagaugggauucuugauaaauuaaaguuuuaguuugaaacagauguguauacuaggccuccuuuuagcauguuguauaucaaaauagcuuuuaaaugaggaggcuguugucuuccagucauagcuuuuaaaaagcaagcaccccaccaagcugcugauggaaguguaaucccaagaaacaacuguaagcaacuugugauggguguuuugugcuuuuauauccuuuaacacaauaacuccguuucuauaaguuuaucuuuaggaaaucgcugggugcaguggcucacgccuguaaucccaacacuucaggaggcugaggcggguggauggcuugaggucaggaguuugagaccagccuggccaacaugguaaaacccugucucuacuaaaaauacaaaaauuagcugggcauggugguggacgccuguaaucccagcuacuggggaggcugaggcaggagaaucacuugaacccaagaggcagagguugcagugagccaagaucaugccacugcacuccagccugagcaacacagugagaccccauuucaaaaaaaaaaaaaauuuuaggaaaugaucagaacugccaauaaaaauguauguauuuaaugugcuagaaaaagaaauuuguugauuguggcauauuuuaaucaaauaauauagcuguuaaaauauuugcagacauuuuaagugauucagggaaaugacacuguacaaugauguuaagugaaaacaccuggauuccuguacuaacgcuguuuuccaugugacaugugcuauacuaagcacuugcuaauauuaauuuaguuuucacaacagcccuuugagguaagugcugucaucuccauuuauggauguacaaagugagauacuuuguaucaauuaaucaauugcucaguuacauagcuauuguuaaacugggauuuuaaaucccgguauucuggcuccagagcccaggcuacuaaacguuacauauacuaucucuccauuauaaaacuaaguauaauauuguguuugcuuuuguuuuuuuuuugaaacggagucucacugucacccagccuggagugcaguggcacaaucuuggcucacugcagccucugccaccuggguucaaacgauucuccugcuucagccucccaaguaguugggauuacaggugccugccaccaugccuggcuaauuuuugaaguuuuaguagagaugggguuucacuaucuuggccaggcuggucuugaacuccugaccucgugauccacccaccucggccucccaaaaugcugggauuacagaugugagccauugcgcccagccuauguuugcuuuuuaaaaggauauacguaugucuuagaauuauaccauauauauucauagguuaaugguuuuguaauugaaauaguaaauugccgagaccagcucggucugggagacccuaacccagcagcgcuagaggaauuaaagacagacacacagaaauauagagguguggggugagaaaucaggggucucacagccuucagagccgagagccccgaacagagauuuacccacuuauuuguuaacagcaagccagggaugagcauuguuucuauagauuauagauuauagauuaccuaaaaguauuccuuaugggaaacaaagggaugggccaaaauaaagggauggguugggcuaguuaucugcagcaggagcauguccuuaaggcacagaucacucacgcuauuguuugugguuuaagaaagccuuuaagcgguuuuccgcccugggugggccagguguuccuugcccucauuccaguaaacccacagccuuccagcgugggugucauggccaucaugaacaugucacagugcuucagagauuuuguuuauggcuaguuuuggggccaguuuauggccagauuuuggggugccuguucccaacaguaaaucauuugauagggauagaacuaauuguaauuuaaaccucucugccuauauccucucacauggucuuggcauuuuaauugcucauuugaguaccuacuaugagcaagauguuuuagaaauauucuguaguccaucaacuuugcaguguagcuaugguacuaacauugcuguuacagaucacaggcucuuuggcucccuauguaauaaaaauuaacacagagcuauacaguuuucccagaugaggcuuuuauuucaggguuuauccacaaaugcaagggagacaguacaguaguaagaacucugcggcugacccccaaaaaagcugauggggacuuuuugauuaggcaaagcaugggaauugacaucagggauaagguaugcaggcugcgcuggguaaagcacaugaaggguacaguauguggucagcaucugugguugcagugguuaucauacuuuaaguucuggguuaaaugugcagaacguacaguuuuguuacauagguauacaugugccaugguaguuugcugcacccaucuacccgucaccuacacuagguauuucuccuaauguuaucccuccccuagaccccaacaccccacaggcccuggugugugaugaucgccucccuguguccauguguucucauuguucaccucccacuuaugagcgagaacaugcaguguuugguuuucugaucuugugauaguuugcugaaaaugaugguuuccagcuucauccaugucccuacaaaggacaugaacucauccuuuuuuaugacugcauaguauuccgugguguauaugugccacauuuucuuaauccagucuaucauugauggacauuuggguugguuccaagucuuagcuauugugaauagugccacaauaaacauacaugugcaugugucuuuaucauagaaugauuuauaauccucugggaauaugcccaguaaugggauugcugggucaaaugguauuucuaguucuagauccuuaaggaaucgccacgcugucuuccacaaugguugaacucccaccaacauuguaaaagcauuccuggcugggcgcgguggcucacaccuguaaucccuguaaucccagcacuuugggaggccaagacaggcggaucacgaggucaggagaucgagaccauccugucuaacacggugaaaccccgucucuauuaaaauuagccaggcaugguggcuacucaggaggcugaggcaggagaauggcaugaacccaggagguggagcuugcagugagccaagauugugccacugcacuccagccugggagacagagcgagacuccaucucaaaaaaaaaaaaaaaaaaaaagcauuccuauuuuuccacaaccucuccagcaucuguuguuuccugacuuuuuaaugaucgcaauucuaacuggugugagaugguaucucauugugguuuugauuugcauuacucuaaugaccagugaugaugagcauuuuuuuauauaucuguuggcugcauagaugucgucuuuugagaagugucuguucauauccuuugcccauuuucugaugggguuguuugcuuuuuucuuguaaauuuguuuaaguucuuuguagauucuggauauuagcccuuugucagacagguagauugcaaaaaucucccauucuguagguugccuguucacucugaugauaguuucuuuugcugugcagaagcucuuuaguguaauuagaucccacuugucauuauuggcuuuuguugccauugcuuuucuuguuuuagacaugaagucuuugcccaugccuguguccugaaugaagcccagguuuucuucuaggauuuuuaugguccuagguguuauguuuaagucuuugauccaucuugaguugauuuuuguauaagguguaaggaaaggguccgguuucaguuugcugcauauggcuagccaguuuucccgacaccauuuauuaaauagggaaucuuuuccccauugcuugugugugucagguuugucaaagaucagauggugguagaugugugguguuauuucugaggccuccguuuuguuccauuggucuauauaucuguuuuaguaccaguaucaugcuguuuugguuacuguagccuuguaguauaguuugaagucagguagcgugaugccucuaguuuuguucuucuugcacaggauugucuuggcuaugugggcucuuuuuugguuccauaugaaguuuaaaguaguuuuuuccaauucugugaagaaagucggugguagcuugauggggauagcauugaaucuauaaauuacuuugggcaguaaggccauuuucacgauauugauucuuccuauccacgagcauggaauguuuuucccuuuguguccucucuuauuuccuugagcagugguuuguaguucuugaagaggucuuucacaucccauguuaaguuguauuccuagguauuuuauucuguuaguagcaauugugaaugggaguucacucaugauuuggcucucuguuugucuguuauugguguauaggaaugcuugugauuuuugcacauugauuuuguauccugaaacuuugcugaaguugcuuaucagcuuaagauuuuggguugaaauggugggguuuucuaaauauacaaucaugucaucugcaaacagagaugauuugacuuccucucuuccuaucugaauacccuuuauugcuuucucuugccugauugcccuguccagaacuuccaauacuauguggaauaggaguggugagagagggcauccuugucuugugccgguuuucaaagggaaugcuuccaguuuuugcccauacaguaugauauuggcuguggguuugucauaaauagcucuuauuaugagauaauaagagauacauuccaucgauacguaguuuauggagaguuuuuagcaugaaaggcuguugaauuuugucgaaggccuuuucugcuguugaauuuugucgaaggccuuuuccgcaucuuuugagauaaucgugguuuuugucauugguucuguuuaugugauggauuacauuuauugauuugcguauguugaaccagccuugcaucccagggaugaagcugacuugaucgugguggauaagcuuuuugaugugcugcuggauucgguuugcccguauuuuauugaagauuuuugcauagauguucaucagggauauuggccuaaaauucucuuuuuuuguuguguuucugccaggguuugguaucaggacaaugccggccucaaaaugaguuagggaggauucccucuuuuucuguugaucggaauaguuucggaaggaaugguaccagcuccacuuuguaccucugguagaauuuggcugugaauccaucugguccuggacuuuuuuugguugguaggcuauuaauuauugccucaauuucagaaucugcuguuggucuauucagagauucaccuucuuccugguugagacuugggaggguguaugguccaggaauuuguccauuucuucuacauuuucuaguuuauuugcauagagguguuuauaguauucugaugguaguuuauauuucugugggaucggguugauauccccuuuaucauuuuuuauugugucuguuugauuuuucucucuuucuucuuuauuagucuugcuagcggucuaucuauuuuguugaucuuuaaaauaaaccagcuccgggauucauugauuuuuuuuuuuuuugaaggguuuuuuugucucuaucuccuucaguucugcucugaucuuaguuauuucuugucuucugcuagguuuugaauuuguuugcucuugcuucucuaguucuuuuaauuugauauuagggugucgauuuuagaucucuccugcuuucucuugugggcauuuagugcuaugaauuucccucuacacacugcuuuaaauauguaccagagauucugguacguuguaucuuuguucucacugguuucaaagaacaucuuuauuucugcguuaauuuuguuauuuacccaguagucauucaggagcagauuguucaguuuccauguaguugugugguuuugagugaauucuuaauccugaguucuaauuugauugcacuguggucugagagacaguuuguugugauuucuguucuuuuacauuugcugaggaauguuuuacuuccaauuauauggucaauuuuagaauaagugugaugggaugcugagaagaauguauauucuguugauuugggucggggaguucuguagaugucuguuagguccacuugguccagagcugaguucaaguccuggauauccuuguuaauuuucugucucauugaucugucuaauauugauggugggguguuaaagucuccuguuauuauugugugggagucuaacucucuuuguaggucucuaagaacuugcuuuacgaaucugggucccccuguauugggugcauauacguuuagguuaguuagcucuucuuguugaauugaucccuuuaccauuauguaauggccuucuuugucucuuuugaucuuuguugguuuaaagucuguuuuuaaucagagaccaggauugcaaccucugcuuuuuuuuuuugcuuugcuuucgcuugguagaucuuccuccaucccuuuauuuugggccuaugugugucuuugcacauuagaugggucuccugaauacagcacaccaacgggucuugacucuaucccauuuggcagucugugucuuucaauuggggcauuuagcccauuuacauuuaagguuaauauuguuaugugugaauuugauccugucauuaugaggcuagcugguuauuucgcccauuaauugaggcaguuucuuccuagcaucgauggucuuuacaauuuggcauguuuuugcaguggcugguaccgguuguuccuuuccauguuuaguguuuccuucaggagcucuuguaagacaggccugauggugacaaaaucucucagcauuugcuugucuguagaggauuuuauuucuccuucacuuaugaagcuuaguuuggcuggauaugaaauucuggguugaaaauucuuuucuuuaagaauauugaauauuggcccccacucucuucuggcuuguaggguuuaugcggagcgauccgcuguuagucugaugggcuucccuuugugaguaaccugaccuuucucucugacugcccuuaacauuuuuuccuucauuucaaccuuggugaaucugacaauuaugugucuugggguugcucuucuugaggaguaucuuugugguguucucuguauuucccgaauuucaauguuggccugccuugcuagguuggggaaauucuccuggauaauauccugaagaguguuuuccaacuuggcuccauucuccucgucacuuucagauacaccaaucaaacguagauuuggucuuuucacauagucgcauauuucuuggaggcuuuguucauuucuuuucauucuuuuuccucucaucuugucuucuuguuguauuucaugaauuugaucuucaaucaaugauauccuuucuucugcuugaucaaaucggcuauugaagcuuguaugugcuucacgaaguucucguacugugguuuucagcaccaucaggucauuuaagcucuucucuacacugguuauucuaguuaaccauucgucuaaacuuuuuucaagguuuuuagcuuccuugcgauggguagaacauccuccuuuaacucacagaaguuuguuauuaccgaccuucugaagccaacuucugucaucucgucaaacucauucuccauccaguuuucuucccuugcuggugaggaguuguguuccuuuggaagagaagagguguucugguuuuuggaauuuucagccuuucugcucugguuucuccccaucucugugguuuuaucuaucuuuggucuuugauguuggugaccuauggaugggguuuugguguggauguccuuuuuggugauguugaugcuacuccuuucuguuuguuaguuuuccuucuaacagacaggacccucagcugcaggucuguuggaguuugcuggagguccacuccagacccuguuugccuggguaucaccaguggaggcugcagaacaguaaauauugcugccugauccuuccucuggaagcuucaucguagaggggcaccugccuguaugaggugucugucagccccuacugggaggugucucccagucaggcuacaugggggucagggacccauuugaagaggcagucuauccauuaucggagcucaaaugccaugcugggagaaccacugcucucuucagagcugucaggcagggacguuuaagucuggagaagcugugugcugccuuuuguucagauauguccugccuucagagguggaaucuagagaggcaguaggccuugcugagcugcaguggacucugcccaauuugagcuucccugcugcuuuguuuacacugugagcauggaaccgccuacucaagccucagcaauggcggucaccccuccccccaccaagcuccggugucccaagucaaucucagacgcugcgcuagcagcaagcaaggcuccgugggcgugggacccaccgagccaggcacaggaggggaucuccugguccgcuuguugcgaagacagugggaaaagugcagcauuugggcuggaguguauugcuccuccagguauagucacucauagcuucccuuggcuaggaaagggaaauccccugaccccuugcacuuccugggugaggcgacacccugcccugcuucggcucgcccuccaugggcugcacccacuguccaaccagucccaaugagaugaaccagguaccucaguuggaaaugcagaaaucaccugucuucugugucgaucuugcugggagcuguacaccagagcuguuccuauuuggccaucuuggaagugacucaguuguucagcuuuauuuuccaaggugggacacuccacaaccuugguuugauacuuagauuuccuaaguaaaaggcaugguuacacaugagagcacagaagaauggcuauuuucuuuguauaauuaaagccuugggguuagcggguacaucaccagcaagguagugauuuggguuuucugaucagugggacaagaaaaggaaaaaaaaaaggaaaaacaugugaaggaggagccgcaucgaauuccuguucucauuucuaguuagaagccugagaaguugagagguugaguaacuuuauacauuauacauauuuugguuggcagagcuggggucuggggcuaggcuuucuggguccaguacucucuuuagacuuuugugucuuuguaacaguaaaaccccuauuauauguuuucuugggaaaaugguagcuguguuucugguuaacuuaaugucuccuauggugucucuucucuuaagacccuacucauguaccaaauuguuauugagcaccuauaauguucugggcucuaaucuagacacccauaucucagauugaacaaaacccagacucagaaaacacuuuggaaaaugcuuuuaaaggggaaauaaaccuaagacagucuacucccaggauauauggaauuuauggaguaauacuuaaaaauuuuuuaaguaauaucuguuggccaguuauuaucaagaaagauaguuuaccauugacuaagccaagauuguucugauggauugucagugcugacagcuuugaccagacuauuuuacagcucacugcaucauccugguuaccauuauaccauuaucaugcuauaauccuuuucagagucauacuuuauaggagcuauacuaagcuucuuuaggagaagguuucaugauaucugcccuucacacuuccagggcaaaguuguuucuuuucuguacaauagccuugauccugggacuucaaguauguauauaugcucuuggcuuuggguuuuguuuuuuuuucugcuacucucaauauagaaguggaauggcucuguguucagauaggaauauuccaggcucuuuguguuucaugacaaaaugucccuuaaacuuugagugucuuuuuuuuuuuuuuaauaauuaaagagucuuuuuaaaucauuacauguuaucuuuacuucagguacaugcuugaaaauucaaucucaaauugucuuucaaaaguuugaggcaugccagacacgguggcacacgccuguaaucccaacacugggaagccgaggcuggaggaucgcccaagcccaggaguucaagaccagccugagcaauguggugaaaccccauuucuacaaaaaauacaaaaauuagccaggcaugguggcgugcgccuguagacccaguuagucaggaggcugaggugggaggauuaccucaucccuaggagguugaggcugcagugaauugggauugugccacugcacuccagccuaggcaacagagugaggcccugucucaaaaaaaaaaaaaaaaaaaguuugaagcgauugauauuaaagcguuauuucaguguucacuggccagucauuccucuaagcugucucauuugucaguuagcauauuuccccaagugugcggaauaccauuaguguucaagaugauuugaagaacauacauuuugggggaguagaauagaaaaauaggccaggcucaauggcucacaacuguaaucccaacacuuuuggaggccgaggcggguggguugcuugaguccaggaguucgacauaacagaacccuaucucuacaaaaaaauacaaaaaaaaucugggugcagugacaugugccuguagucccagcuacugggaaggcugaggugggagaaucaucugagcccaggaggucaaggcugcagugagccgugaugacgccuacugcccuccagccugggugacggugagacucugucucaaaaaaaauaaagagagcaaaaaaauuuuuuauaugaccaguuuaauuuauuugaggagaagaggaaacugacauaucaaacucuugguuuuaugccagaugaaacguuaguugauuuaaaggcaauuuaaagaaaaauauuaagugauuugcaacagagauguuacaagagauggcuaaaauagcaaggaugguauacaaauggcaaacauuuugaaagcauuggugugaugauucagcacagauaugaguccugaggcgcuucuugguuuuagugguuuagcucugacuucauuaagaugauguaaauuuauuccauuuagaaaauucccaaagucuucauaaccacuuaacucuugcugccuuuaauaccuguuaguaguagccaguuacugagaauaaauuggugucaucugaauguacugagcucaaacuguaacaaguuaaucuaucacaugcagacagcaauguuucaauguccaguuugucuuuuauuacuguuacauuuggauccaaaguuuauuuuaaagggcuaacacaaaacaacuguugguccuguaaaucaaaaaguaucugagacaagucucaaucaauuuugaaguuuauuuugccaagguuaaggacaugcccaugacauauccucagaagguccagacaacuugugcccaagguguucgggcuacagcuugguuuuacacauuuuagggagacaaaauaucaaucaauacauguaagauguacauugguucagucuggaaaggcaggacaacucaaagcaaggggaauggggggcgggcuucccggucauagguagauucaaagauuuucuuauuggcaguugauugaaagaguuauuaucuaaagaccuggaaucaauagaaaggaauguguggguuaagguaaagagcuguggagaccaagguuuuaucacgcagaugaagucuccagguagcaggcuucagaguuguuuuuguuuuguuuuguguuuuguuuuguguuuuguuuuguuuuguucuuauuagacgaagucucccucuugucucccaggcuggagugcaauggugugaucucggcccacuacaccccucaccuccuggguucaagcgauucuccuuccucagccuccugaguagguaguauuacaagcgccugccaccacgcccggcuaauuuuuguauuuuuuuguagagacgggguuucaucauguuggccaggcuggucucgaacuccugaccucaggugauccacccaccucagccucccaaagugcugggauuacagaugugagccaccgcaccuggcccagagcucuuaucagaccuaaaaaggugccagacuccccuggaucagggaaaagaccuggaaaggaauggagagucucuacagagucgauuauucccacaagagacagcuuugcagggccgucucaaaauaugucaaagaaacauauuuugguguaaaauacaauuucuuucagggccugccaucugccaugugaugcuuuacaaaagucaagcuggaauuugguguuuuauuccuacaaaaagucuguuaccugggucuuaagaucucuguuuuuuuguuuguuuguuugaaauggagucucgcucuguugcacaggcuggaguucaguggcgcgaucuuggcucacugcaagcuccgccucccagguucaugccauucuccugccucagccucccgaguagcugggacuacaggugccugccaccacaucuggcuaauuuuuguauuuuuaguagagaugggguuucaccguguuauccaggauggucuugauuuccugaccucgugauccgccugccucggccucccaaagugcugggauuacaggcgugagccaccgcacccggccaagaucucuguuuuaauguuaauacuggucagcuaugccugaauucaaagggagguggguaugaggcaugcccaacccccauucccaucauggccugaacuaguuuuucagguuaacuuuggaaugcccuuagccaaggggaggguccaucagucaguuggcagaugggggguggggugcuuagaacuuuauuuuugguuuacaaucccauuguguaaaguguauacuaagaaaccucuaugauuuuuauagaauauauugaaguacuuguggggccuggagagugaagugggcaccacggucauaugaguccucccuuguuugcaaggaaagcuuaauuguagagcacugaaguccagguuuuugucugacucuccccuccccagccaucauaccugucuacuguugaauuacucuccuuuuauucuccccaccagucccuccccuucuaccuuuauuuguaugugcaaggaagauuugagggaaacaacuaaauuuuuaaagagucugaguagaaaaacaaugguuuucaagaaacugaaacuuugguuucucuguccuauaggccucauuuuccuuucugcaauaucaucgggaagcacccuguuuaaccugcuucaucaaccccacguuccuucuagaauugcucuucaagcuuuuuucuauuuuauguuuccaccugugcucuuugucaauaauuaaucaauuguuuaccucugaaauuucucaguguacagugucuuacuguucuagaaaaucuuuucauuuaaauucuuauucuguauaauacucaaauuagagaauugcugaaaaugugaaguuuaacauuuuuuuguaucugcuuaaaucagugaccauuaugcucuguuuguaaaauaccccauucauccuccugucaccagcuguuguugccauucaguugcaugucagugucaucccggagauccucauucucauuaagccuuauaugccgauuuuuccuuuuuuucagucacccaauaaaccacagacucccaagcuaucucugucucuugcauuuucaugaucuauggcccuguucaccaucuccuacccaccacccucccccaccuacccaccgcaauccuuuccacuuugcccucugggacauagugagauggcagcagcaggaugcccuguagccucagccucuucucugaacuuuccuuuuuccuucccccacccaccuuuuccuuuuuugcugugacaaaaccugacuuuguccugagcucacugcuucucccaccaccuuaucagguggugccuuuuuuccucuacaaaggcacccucuuguaccauugggucaggaaacaggaucaguaccuugcuuauuauugccacuuccagaaauucucccucccucuuccauagaaacccccaguuaucaaucccagaucaucagaguggacuacccaccaacccuccucuuuauaaucaucuacagacaccccaaucuguccugaagguuuucccuugaaaaaacuaucuucaguagcucuucucucaaauccuuagugauguuaguauccguguggguaguccuuuagauacccuguucucccaguucccuggccuccucuuccacugagcuuguccuccaccucaucacagccacucauucacauaguuguagcuagaccuauccuuccuuacccucgugccagcucuucagucucauuucaggcaucugacucugaccaccaccuccucuuuccaguucacucccucucauaccucacuccaucauuucuucaacuucgccagaccuauggucuguugauauucccaucuguucagagucccacaccucuuccuagcuuccagucuaccuuucuggucguuguagcaaaauuucucaguaaagagaagacuugguucucuucacugucucuaauuucuuuccucccauaugaaacccacuccagucaugcuuucccuauuaugacuccaccaaaacugcuauugccaagguccagugacuuucugaauccagggaucaauuuucagcccuugcuauacccuauaagccuuugacagaauugaucacucccacuuccugaguagccuuuguucacaucgcuuucaggacucuuuggguuuucuuucuaccucgguggucacuucuuacucagcuucuucacucaggggccaguaggcaucucaaaauauaacaucaaaaacuaaaccuuuuuuuuuuuuaguagagucagggucucacugugcuguccaggcuagucucuaacuccugaccucaagcaguccuccagccuaggccucucgaagugcugggauuacagcaugagccaccaugcccacccuaaaaccaaacuugaucuuaccugcagaucuuacacauuccucuuuaucucaguaaaaaucuccuccagucuuccauuugcucagaugaaaaaucuuggaguuuucuuguuccucuuucucaaagcucauguccaguauuagcaaauuauguugguuuuaugucaguauauaucuagaauucaaccacuucucaucaccuccacuauuaccaccuacaucaaaaucaucaucucuugccuggaugucaccucauggguccccugcuuccauccuugccucugccacucccagucuuuucucaacccagcagccaauaugauccuuacaguuaaaauuuaagucaguuuguaaguuaaaucaugucacuugguaaaacccaaagucccccaaaucaguucugaggcucauacucaucuagggauagaaguaaaucccguguuagcaucaguuaauaccugugcuuguacuuaaaucuuauuuuucuuguuuucaguaaauuauagugacaucuuuuggauuaaauuguuaccuuuacaauugauauugacauuucucaagacaccaaaagauuauaugagauuuuuuucucaagaauugcaaaaaucuguggugcagcuugacauuuuuauauucauuuuuugcuaaacacauuguguauuagaucuaaagaguguccuuugucaugauucaagguuuuuaugaaagagacauuuugcuguaaaucuguacugcccgagaagaaauuguaucccucuuuucccuuaugacuauccuauucuuuccaaaccaaaaaccacaaguuaauaaaauugaauuuggaccucuuuccuugaaugccuauuacaagccaagcacuguccuugacauuaucuccuuuaauuuccguaaacaauucuguuauguagccucacuuuugagguugggaacagaggcucugggagauuaaguaccuauucuauucaaggucacacaaguaagugaugaagcugggguugaauccagguaugacucuugauauacacccugccugaccaaagugacuguuuaacugguuuuguaaguuaauuugucacugguaaaacauugaacaccuacugguuccuuagauguaaugggcauagacaaggaagaaauucaguguuuaaaucaguuaagaaagcugugauucuaggcccuacuaacuacaaagcuuucaauauucuuuuauuuuuuccacuuagugacaaauuauucuuuaaaaaucuugccauuggccucugccucuucaacuuacacuaauaguucuuuuuuuuuuuuuugagacagagucucgcucugucgcccaggcuggagugcaguggcacgaucuccgcucacugcaagcucugccucccagguucacaccauucuccugccucagccucccaaguagcugggacuacaggcacccgccaccacacccggcuaauuuuuuguauuuuuaguagagacgggguuucaccguguuagccaggauggucucgaucuccugaccuggugauccacccaccucggccucccaaagugcugggaucacaggugugagccaucgcacccggccaacuuacacuaauaguucuaaaaugaagccaugucuauaaauuguuaacacuugaggcagagaggaagugagggauugaguaacagaacuuuaaaaaucauucuaaaaauucuacauguucacauuuaauugcucaagucucugugaugugauuugacaacaagcugucuuacaaucauguguuugucuuuacagugauccugccaugaagcaguuucugcuguacuuggaugaguccaaugcccuggggaagaaguucaucauucaagacauugaugacacucacgucuuuguaauagcagaauugguuaauguccuccaggagcgagugggugaauuaauggaccaaaaugcuuuuucccuuacccagaaaugaaaauacucaauauggaccauuuaggaauuauaagcagcaacugugaaagacuugccacucaauaucuuaggugacugauuagacauagaggguuguuuuaggagcaugccacgggaaagacugagggaucaugaucauuuguucagaaaaaaagccccugaacugauuuuguuaccauagaauuuaaaaaaaaaaaaagcuuuaacaguuggcuguaauuuggcuuuuauuauccuuuauuaaaauacaaaugucaaugcuuuuccugccuuuuuaauaccaugucaguguaacauagguauuuauuuugcucaucccugugaucugugcauuuuugcugcguggaugugauuguuugguuucaguuagaaacgucauagauuugcuguuugaauaugccaagguggggacuuagacauuauguacgucucacaaauccuaccugcauaccagucagcucuauugaggaagacaauguaaaacuaauguaaacuacaguuugcauuucccugaaaacagaauauuguuuuuaagaggguuagaaacaaccagugggaaaggcacaugcugcuuuguuuaguuuuuccuuguucaaacuuuguuggucacauuuucccaucuguauucuuuuuuauuaagaaaacagcuuagggaggcugaggugggaggauugcuugagcccaggaguccgagguugcuacaaaaacaccauugcacucuggccuggacaacagagagacccugccucaaaaaaaaaaaaaaaaaaaaaaaaaauucuacuuguaccuuauucccuaugagaauacuuaucaaacuuaucuaaaaaagaaaaauaggaacagccauaugcaaagucagcccaacaggaaaggacauauuagauuaaaauacauugcggccugggcuuaguggcucacaccuguaaucccagcacuuugggaggcugaggcaggcagaucgcuugaguccaggagucgaaacccugucucuacaaaaaaaaaaauacaaaaaucugccuguugucccagccacuggggaggcugagguaggaggucaaggcugcagugaaccuugaucauugcuacugccacuccagccuaggugacagagugagacccugucuccaaaaaaaaaaguguauauguauguguguauauauagcaagagagaguucugugaucaauugaaggcaaaaacaguaacacugagaggggcuuugcuucccuuccugaagaucaugucauugggguggguuccuguaaagggaauuuuccaagagaaaagagaauuuucaugaccuguagacucuuacaaauccauuuuaccugcuuccuuaugguauguuuauucaaagcaccuguguaccauauuuauucacuuacacagcauuacugaaucuggaaauuuucaguuagguauauuuuacauaauucccacccauauaacucaguccauacaguucacaguuuucauucccucauagcaaugcaaaaaauuuugaugaguuacuacuacuaaaacuaguuaaguaaaagaugauucuuaagaauuuccaggcugggcacgguggcucacgccuguaaucccagcacuuugggaggcugaggcaggcagcucacgaggucaggagaucgagaccauccugcucggugaaaccccaucucuauuaaaaauacaaaaaauuagccgggccugguggcgggugccuguagucccaucuacucaggaggcugaggcaggagaauggcgugaacccgggaggcggagcuugcaguaagcugagauugugccacugcacuccagccugggcgacagagggagacuccaucucaaaaaaaaaaaaaaaaaaaaaugaauuuccagcuauaccaaaauguuacuaauguaucuuauauuucaggcaugucuaaaucaacuuuuaguaugccucaggcauuugucaccaaccuuuuauauuaacaugaaacuuagaaaauuuuugauagaaucccagaguucaaaagguauuaggauuuuugccacugaaguaaaaaagagaaaaaaagauauuuaugagaaaacuauugaacagugacuguguuguacccgagcaaguuagaggaacgccacacuuugagacgaauuuaaaaguccuuuauuuagcuggcagccaagagguggcucacacuuggaauucucucagcuccgaggaaggggcuugauuuuccuuuauacuuugguuuaggaaggggacgggagcucaguugcaacaauucuacagaaguaaaaacaugcaaaaaauuaaaaagacaaaugguuacagagaaacaaacaguuccaggugcaggggcucuaaaucuaucauaagaugucaggugugggggcucugccagacacaaacucaaggcuuuaugguguaucucuugagcgaaauccugggaacuucguacauugcuugcuucaguaccuuaugaguuaauuggacucuuugauauguugagagucagcuuacacaaguuaacuccuugaggaaaggggguggguaaggaguccuugauguccuguaaaugaaggaaccaaauggaguuccuccggcuuucucagcuaagggagagcuuauucacauggaaacaaggcuaggugauuaagggagaaagggacagucugaaaacaagguuaguaaaaacaagguuagguauuagaacugcaaagaguauuaagugaaauaagugaaggaaaauaugagcucuuauuuuuaaaaaguuguguuggggcaaauguuaaauaucuuucuuucucuggacauuauuaagaaagauagagugaugugaaugauaggaagcccaccuguaaccacuuagcugacauguccaacuaugggugaacaggaaauaagcgacauucaccuaggcuguuuauuggaaucugacuagcauuauuugauuuggcauacuuuacauguccagaacaaggcuguuggugcuuggcaccaagaaauuuaugacuuuuuuuuuuuuuuuaaauaaaguccuaaagguagcauuaaaaugacuuaacuggaggcaggaggaucacugaagcccaggaguuugaagcugcaguaagcuaagaaggugccacugcacugcagccuggaugacagagugaaacuuugucucuuaauagaacuauggacugaaguugugauauugaguguuauauuucucaauaaagguuuuuucuuuuaauacuguauuaggucaaauucaaggucuuaauuccuugaauuccaauuuccuugugaaauuucaugugauuaauuuaaaauuccagggauccuaucuaacaucacaguugauggauauaacaauguauuuugagaaaucaguuuuggugaacaguaacagcauuacugauaauaggcaacaaacacuacugcauuuuauuucugauaggcauuauaggugguaauccaaaugauuaaugauuuuauugcucuuuacauuuucuagaacaggugauuugacauaauuguacuuuuuucugagaaguugguaguguacuuacuacucuauuuugcaguuauacaauaaaucuuacuuagcugacaacuaggaguaaaagcucugacaaaaagccucugcuguaacuaaaauacugagaucauucuaucuuaacaaacuuaacagauggggaagggguauauuuuaaagauggagaaaugaugcaguuugcaaauauagucaauaaauauucucaaguguacguagcucaauuucauuugcagcaaagauaacacugaaaugucuauggaugagauuauuggauaaacuuuuuuaaaaacacuguucucaagauaggcaagugauuaagagcacugacugggccgggcgcgguggcucacgucuauaauccuagcacuuugggaggccgaggcgggcaaaucacaaggucaggagaucaaaacaauccuggcuaacaaggugaaaccccgucucuacuaaaaauacaaaaaaauuagcugggcauggugguggacgccuguagucccagcuacucgggaggcugaggcaggagaaugguguaaucccgggagguggagguugcagugagccgagaucgugccacugcacuccagccggggugacagagcgagacucccacccaucucaaaaaaaauaaaaaugaaaagcacugauugaaucuagauuccuugaguccaagugucagaucucugcuuacuagcucugggaucucagauguuucguugauuggauuucuuugugcucauuuguguaaacaggaaugcccgucuuuaaagacuauuaaaaugaaugugaguuaacacacaagaggucuucaaaaaguugauggaaaaugcauauuaugaaaaaaauuaugcauagauuucaaaaaucuuugcagcaaaauaaacucaucauuauaacaugucugaacaggaucuaguuugaggcacuaagaaggauaucaguuuaaauagagccccugucagaacaauaugaauucugcuaaaacugaagcaagaacaaacaucaaauuuauggcaaagcuuagguggaagaauggugcaaucauugaugcuuugcaaaaaguuuaugggaacaacgccccaaggaaaucaguuuacaaauggauaauucauuuuaagaaaggacaagacaauguugaagaugaaaccuacagcagcagaccaugccacuucgugaggaaaaaauuaucucauucaugcccuacuugaagaggaccaaugauuaacagcagaaacgauagccaacacaauaugcuccucaguugguucagcuuuuauaaaucugacugaaaaauuaaaguugagcacacuuuccacucaauggauaccaaaaccauccagcccaggucagcugcagacaaaagcagagcuuucgauggaaaugucaaacaagugagaucaagauccugaagcauuucuucaaagaauuguagcaaaaacagacuuuuaaaaccuugaauucagagacagguauaaagacugcuuggugauuuugaaaggacugagaucauuuugggagagaucaucuucagaaaaugaccagauacaacaagaauuuaacauggcagccaaaccaacccacuaacacacauuuaaauaagauacccaaaugcagaaagaaaagcacagucgucaugcaaaauagucacuacucauucaaaaacucuauaguugucugagucguuaugcucaaaauauccaauaauauuucuuuugcugagcuguaaaauaauuauuuugcaaacauaaaagaaaaaaaaaagaauuguaacagaaacauggcuuuaccaguaugacccucaagacaaaauacaaaacaauggcuaccaagagguggaaguggcccagucacagcaagagcagauugaucaagagcaaaggucaugguaacaguuuuuuggauccucaagucauuuugcuuguugacuuuuuggagggccaaauaaagauaucaucugcuuauuaugagaguguuucgagagaaauccaaagcuuagcagagaaacgccugggaaagcuucaccagagggucuuccaccgugacaguuccccugcgcauuccucucauaaagcaagggcaguuuagcuagaauuucuaucaaaaaucauuagguauccaucucccaguccugauuuggcuccuucugacuucuuuuuguuucccaaucuuaaaaaaaucccugaagggcaccuguuuuucuucagcuaauaaaaaagacaugguuaauuucccaggacccucaguucuuuagggauagacugaauggcugguaucauugcuugaacuuaauggagcuuauguugagaaauaaaagaaauuauauuuuauuuuuaucuuuuaauucuauuuuuccaugaacuuuuugaaguccccucagauauaaagcagaacguuaugaaacugaguuaccuugaaucuagaagaguacaaugauaaaggggaagauagaaacacacacauaugcguuguuuuccccacuuucacaaugccgugcagaaacuaacagaugaaggaggagaaucccuaaaaacagagcauuggguagcuaguccaccagcggucugaugcuuucauugaucucaaaacugucucugaguaacucuaccaggaaaguugucuggaggguuaacauuucugaaaccauuuuuaucuuugccuucauucuugaaugauaauuagucucgaauguuuggaucacaauccauugaaagacuaggcuauuuuuucacuguccucagacauuuacugaguccaguuuggacuuuauuuuauuuuauuuuuuuugaaacaagaucucgcucuguugcucaggcugaagugcaauagcgcaaacucggcucacugcaaccucccagguucaagcaauucucgugccucagccaucccuauaggcaugcgccaccacacuuugcuaaucuuguauuuuugguagagacgggguuugcaccauguuggccaggcuggucucgaacucccaaccucaaguaaucuggccucccaaaguggugggauuacaggcgugagccagcgcgcccggccuggacuuaacuucugaagaacucuuucuguuuagauugcaggagcguucucucggcucaucucuuguuuucucacccagcuguucuucuucuaguuggccaucauucuucaucccucccucccuuuccugcaguuaauuauuucuuugaaauuuuaaaacuucuuaauguugccuggaauacaugagucuuccugaucucuucaaacgggguuuguuuuguuuugcuuuggggagaauucuuuugacguuuuugaauaagcuguuaacaacuuuaauaccugucuuguuuguuuucuucagaaauuuguuaauucuccaugauuagcaccuuuaugugguuaucucauuauuuucauuccuuuuuaauucucuguuuuaggaaugcuugucaaauucgucacuaaaauugauuuacuuucuugaaaaccuguuucugcugcucccaacaugauuuaaucuuggcuacugagcuuuugguuacguugcacucccuuuaaaauuacuccguuuaaguacaguguucacucuuuggguaauguguacaauagaagcccaauccccaccuauacccaauauauccaugggacaagcauguacaugcacccccugagucuaaaauaaaaauuuuaaaaaaacua

SEQ ID NO: 192662 - RNA, 22475 nt, Homo sapiens
gcuacggcccuguaacagggccauggagaagcugcggcgaguccugagcggccaggacgacgaggagcagggccugacugcgcagguagcgaacuugcgcccucguccagucccggggcugcccgcuggccccggccgcacugaggaccggccgagcggguggggugggugcgaggccgggggucugggacuccucugcccggcugguugauuuaggagggcuccgccugcuuccuggguagaauuugagaacuuuccaguuuuccaugcggucuacuuaaacccacuuugaggcccccccccgacucucccaucuggccuucugacuuaggaauccgcuaacgucugcccucgcuuucccaaauaauccaucgcucccacguacuauuugguuuucugagccuggugcggggucuggccucgggcugugcagcguaaguagcuaugcagggcauuuauccugcaagcugcagugagccgagacccuaaagcuuguugcaucuguuugucuuuggagguaaaggugguguuauguguguguuugcugggggguggucuuuuggaaauagggagacuggaggaaaaauaaacaggacauugguaagugaaauaauauugaauuaaaauuuuucuguuaaggcagugagcccugguaagagauuuuuuuuuuuuucuuaauaaaagcccuugugucugcgccuuaccagcgagacuugauaaggguuacuuccuccagcaagaagguuaaaaguagcaguggagcaggaacugcgguguaaguuuuuuuguuauugcaugcgauuauauugcacguuauugugugcugucgcagaaguuggacguuuaaaauugaauuguauuucauaaggaucuucuauuugucucuccugacuuccuugucauuauacuuacucagcacuugguguggguagaguucugggcuacaguuuuggguucagagaguguaagacaaguaucuguucucauugcacucuguaacucuguauauuaccacagccacauguggccaaugaauuuuuuuuuuuuuuuuuuuuagauggagucuugcuuugucgcucaggccuggagugcaguggcgugaucucgacucgcugcaaccucugccucccggguucaagcaauucuccugccucagccuccugaguagcugggauuacaggcaccugccaccaugcccugcuaauuauuuuguguuuuuaguagagauggggguuucaccauguuggucaggcuggucucgaacuccugaccucaagugauccgcccaccuugaccucccaaagugcuuggaugacaggcuugagccacugcgccuggagcaauuaaauuuaaauuaauuaaaauuaaauaaaauuuaacauucaguuccuuagucacagcaaccacauuucacauguucaguaggcacaugugguuaaaggcuacuguauuaaacagcgcagauacagaacauuugcauugcagaaaguucuauuggacagugcuacucuaaacuuuggagaugcaaagguaauaucacuuaucuugagcccacugucuagaggggagaaagauauguggagaaguaaucaaucaaagauuagagugacuggcuguauagacaagugcugugaguucagaggaggugaucguucauuaacaaauauucaaguuccugcauauguuugacauuguucaagaugcagguguuaauaacagugaccagugcaaauaccucuuucacauggaacuuaaauuuuaauuggaggaaacagugaauaaacaaguauauaaugugucagacagccacagaaaaagucagagcagguugaggagguugggguugccauauuacuuagauaaggccucccugccagggagucaugugagcacagcucagaagagcugcugggaugucugagcauccugugaauaaaagccuccaaggcagauacagagucccaagugguguguggucagcauguucagggccaguaaggaggccagaggggcucuagcagcggggcagagaagagggacaauuguagaagaaaaggugaagcaggaagggggauucucaauugugaggguucucauaggccauagaaaggauuuuagcuuuacucugagugugauaggaagccuuuggguuuagagcagagugguggugugaccgacuuggauuuuaaaggaucacucuggcagcucuguggagaacaaacuguagaggcaauguuagaagcccagagacugggcuggagacaaguacaguuguccuggcaagagaugacuguggcucaaaucagugauagaagugguuuaaagagcaaaaaagccuguuuaaaaaacaaaaaaguggucagauucuguaaauggucugaguguacagccagcaggccacacuguugacggauuggaugugugagagugggaggaggcaaggaugccucauggcauucgaccugagcaucuggagagguggaguugccauuaagugacugugggaggagcagguucagggaggaaaaucauuucaguguggacgugaagucugagauccagguagcauccaaguggagaugugaggaaagcaguuggacguaacacuguagaguuugugggaggaaauaggagagagaugagaucgucaagaugagguccaagguuugaccucugguuuucucuagguguguagaaguuuagaggaugagcagaagccggcaaagacagcugagaggcguggcgagagaaggaggaggagaaccaagagagaaggaugccccagaaagugagggaagagagugcuuuaggaaggggaugggacccaguacuguugaugggucucagaaguuaagagcagauuacccguggagguuaucaguugucacuuccacgagagcagucuugguggcuggauggggucagaggccugauugaagucaggggagaauagaaagaagauggagaugguauggccaucucagugauuuuuccuguggagcaaagaagugggugguaguugaaggaugcaguggggucggggaacaugucauuuucccaaggaaaauacuggauguuucugugcauugggaaugguccaggaaaggggaaaauuauggugcaggcaagagggaauuguugcuagggggcuauugaggagugacuuggaaagcagguuucucuagggaggaggaaggggcaggaaguggcagugaggagggcagacaccuagcucacugccuguccaagugguacaggauucacaggggagagcccugguccuggagacuaaauuucaaaccuagccggaaggugagaggaucaucagagaagagggugaggacauagggagguuugcuguugguuuuuggagauggguaggagaugagaugggauuaaaggcgcacagaccugaauggggugagggaugaccugagaguguugcacgucuugugcagcaagacguaaccaggauggcgggcacauuggaauugggucuugacagggaugguucuaggccaguugaggaguugggcgaggcagugaaggucauaggggagcauccugacauccaggcugcaucauccuccuaugcaggcgcuuugagccccggggagaggcacgguagccagaguucugggaccucuccuucgagaugccugggaagaagucaaggagggagagauauugagccagaucuuaagagaguugaucauauuccuccccugaucacauccuucauugacuuccugcagcacuugaguaaaauccagaucccucccuuggccucucagcccugcacugcuugucggcccgccuccccacccucuccccagugcuugccuugcccugcccucuuucuccuccucaguuggagccauuuucuucugccugggagaccuggcaguugcauuucuuuuuucaggaaugccccuuccuggcucuuuucagaguuggauuggucacuuccugaugucuucacuuggucaccucuuuagagaggcucuuccugacccaguuacucugccccuauuuauguccuuaguagaaccugccucauuaguuuauugcccauuuucccccaucugaauguaaguacgcuaggugcugucuuauuccuuucuguguauguagaaccuaccaaguaccuggugucuaauagcuguucauaacuacuuguugaacaaacagaugagugaguuguuuggauuuggguaacuaccaaggagagcugagggcauuggcauaagguaauuguugggaguuagaugacaagaacauaaugccggaacauucuacagaguucucuugugggaguccuacuaaccccugcugacaauuugcgagaugucuuaguccauucagccugcuguaauaaaauaccuuagacuuugugauuuauaaacaacagaaauuuauuucuuacggguuuugaggccggaagucagagaucaaggugcacucauggguucuuggugaggccucccccuuccuggugucacacuguugccucugguuauaucuugacauggcagagagcagagagcuuuagucucuuucucgucuuauuagggcguggaucccauucaugaggacuccauccccaugaccugaucaucuccugaagggccaucuuccaguaccaucaccauggggucgaggauuucagcaaacacucagaccauagcacacagguugagacaagucauuugcuuguugacugaguuauuucauauuuacaaauggcauuaauuuaucauguuucacuucaaagaucaccgcguggaagaugguaauaagagaaaaaugccuaauaaacaauuuaagcucucucugccuuucccacuuagaagauuguaaguauaccuaccuuaucuauuucccucacuguucccaugguaggugugggugaggugguuagggggaguguagagaaacacaaggaggaagcugucuuuccagguagaaggagcuaaggcggcagaggagaccccaagcaggagcagcuggcgaggcgggaggacagucaggagagccggugggacaugggaguugaagagaacauuguaagcaggagggagugccaaaguguccugugcuguugaguuggaaaggauacugaugcuucaaaaauguuccuuggaauuaaggacacggaagugacuugugucugcaggguuucagccaggggagggcugaagcuagaauggucaaggugagcuucccaaccacugugccaggcgugugccagcugggggucccgucuacuccuacagccucagauaaggauuccugggaaauaaggcacugggcuaggaagggaacuacaugaaaaaguguggugggccgaagggccugggaccuugacugcaccuccccaggggcuacacugccugggcugugcuccaagucuggugugcagagggagcuuuccccgggaggccugccugcuagagccuguguaauugccuguggccagccccaaaaucacucacagugcuguggucugaaugucugugucccccccagaauuccuauguugaaacuuaauccccaaugugaugguaugaggaggaggugccuuugggaugugauuaggaauggguuucaugcccuauuaaaaaagaggccccaggccacaugcaguggcucaugccuauaaucccagcacuuuggaagccugaggcaggaggauugcuugggcccaggaguucaagaccagucugggcaacauggcgagaccccgcuucuacaaaaaauuaaaaaauuaguugagcgugauggugugugccuguggucccagcuacaugggaggcugcggugggaggauugcuugagccugggaaguugaggaaaagaaggauccauugcccuuuccaucgugugaggacucagaaggugucaucugugaaccagagaugccucaccagacgccgaaucugcuggcgccuugaucauggacuuccagucucuagaacugagagaaauaagugucuguuguuuauaagcuacccagucuacaguguuuuuuuaagagaauuaaauaguuuauuagcuacauacaauuauggaugauacacaagcuucauucccaucuauaauguuaucugguaccauuauucaguuuagauauauugcaugggaugugccaacaaucauuuuuauaacuaauaauucugugacuuugcuugggugauccccuuugguggugaacuucaggucacaacaguaacugucaguucagcuacaccgagcucacugaagacaguggcuucuccacccgagcagaguguaaauaaguuccaaguagaaccuggcaucacccugaaggaauucugacuucacacucuugggggaguuuaccaagauggcuuccgaggagacuaacuuuacacagcacguuuuuuaaaaggacacauuuauucagucucaugaucagacuauuacauuuagcaaucaacagcaugagugcaaaagaaaaaaauuacauuaaaacccuuuguuggaaugcuugguacuuuccacagaacagaaacgaaaauaaccuguuaauaaaauuagucacaaauacaguccuggaguuuuuugcucauacacgugaguauugucuaaaacauaucuucuuuguagcagcugggcucugccaccacugugcuuggcugacugaguucacaaaucucuuguaaccuguagcuucccuaucgcuucucuggcucuccuuuccggcuaaacuuuguuuccuggcagugauuaaaaucuucugccagugccauggcuacugcugcuacuagaaccaccauagccaccuugguuuugugaacccauuuaugccugguauuccauuauuggaacgcuaagcaugugggaguuauuuauguucuccuguucaaggucaucgccaaggucugauuuuucaaauucaaaaagugcaaccucaggcauaaauggguuaaaaucuucugccagugccauggcuacuguugcuacuggaaccaccguagccaccuugguuuuguaaaguaaaguaaaauuuggcaaaguauuguucuccaccaccauaagggccagagcuucugccuccaaaguuuccucccuuuauggguccaaaauuugaaggcugauuguuguaauugccaaaaucauuggagcuucugccaccuccagaauugauuccaucauuaccaaauccauuacagccaucccugcugccacuguauccaccgccaccgcuguggacagcugccaccaaagccaucaugaccacugaaauuuccuccaugaccgaaguugucauucccaccaaaaccaccuccacaaccaccaccaaaguuuccagaagcacuucgaccucuuuggcuggauaaagcacuagccaucucuugcuuucacaggacuucccuaacuucacaguuuuggccauucacaguaugguauuucugagugacagucuuguccacagcgucgugguugucagaggcacgaaggcauagccccuuuucuuggcacuaccucugucagucaugauuucagucacuucaguuuuuccauacuguucaagaucucuuaggcgauguucuucaaugucuucuuuaaugccgccagcaaauaucuuuuucacaguugggcaccucgucuuugagaaucuucucgagacagcccuuugguuccacaacucuucauccaccuuguguggcuuugcauucauggcgcauccaccuccuucacagcggcauacaggacaaacccaaagccccagagugcuuggugcuuggaucucaugacuacacaguccacgagcguuccccaucgcucagauuggcuucucagguucucaucaguuguuucaaagcucagcccuccagugccgagauuccacagucggcccuccagugaggagcuuccacagcuguuuaggcucuuugggagacucugacuuacacuggagugcaguggugugaucucggcucacugcaaccucugacucccgggcucaggugauccucccaccucggccucccaaguagcuggcacuacaugugugugcccccauaccuggcuaauauuuguauuuuuuguagagauggaggacucgccauguugcccaggcaggucuugaacuggguucaagcaauccgccugccucagcuucccaaagugccaggauuacaggcgugagccacagugccuggccuaugguauuuuugguguagcagccagcacauagauuuuuaaccaggagcuggaucccuuacccagcacuuagaacaggcacauagcagcacucaguauuuauugagccaguuaguggauggauggauggauggaugaauggauguaugaguguacagaggcuggaaggugaagugaaguaagcuuucuguuuaagauggaagggacuucauguuuaaaaguugauggaugcauuuucagagagugagaacauguucacuagaggaaaaagcccaauagcaucaauucccugagcagguaagggguuggcuguaaagcaggguggacagguggaucucagcucugugggaaccaggaaaggacaagagcauggguguucuuaguugguguguuuggugguuuggugguuugguggcagcaggaagguaagggaguucacacugauggcuuuggguuucugugugugaaguaggggaaguugucugcuaagaauggaaguguggggcaggaaguggagguuugaagugguuuagaguaaaauggacguugagauaaagcaagaagccuuagauugccaggcagcaaugugcaggccauggggggcugaugaggacuggcucaggaccccccugcccugugccugacuccacccagcagugcucagcucagcaccuccuggagcaggaggagggaaagcugcacuccggugggauuuuaccagguggaggcagcggaaagggaauuugaauguccuguugaagccgcugaaaaaacggagaagggccggaugaggaguucaggaggccaaggagucagcacgguggggccgaggaaccagccugcugccagaagaaacgggucggagagcggcagccggaauuuuggcgaugguguaauuucgagcaggaagacugcccugggcugggucacugaguggaguggaggggaaaggccaguggagaucaggggaugcugcacagaaaggccaggcugcccacgcacacguggaacccgugccgcaugcugcaaggaucuggauaggccccgcgaucaagaguccugaaugagaaggagaaaguguggaccccagcagcggguguggggagcgggcgguucugccuggaaugggccugagggucugcggaugucuguuucuuuuucucacuugucugcacaacuuugacuuuuuauacccacugcuauuuugaaaaaggagugggaggaauacuggauucagugucaucauuaguggaaagccacaaguguuuccuauguuuagauggcagaagcccaggggcaaggcucagguccuuccagcugugcugucuccuggcgauccguggauuagagcuguuccucagcuucuccgucacuuaaagggguggguuucggcugugcugugggagccacucauucagccuucauguuguugcugcuaggacuacauuuuccucuauuauguuucucaccugcuuuuguaaaaaauuaaugaaugaaguucuaguugcaagcagugcugugcuuacuguggcgggaauaggggagcagccccuccucaagggccuguauucucuuggcuuccucuuccucugguagcagauaaguaaaaugauggauggugguuuugggagaggaagagguggcaauuuuauuucuuuucuaagacuaagagauuaacaaaguugcugguuuuggugggauugcuccugauuggugguaaaagaaagcagcacauaaaugcuuaugauaagcaggcugggugcaguggcucguggcucaugccuguaauccagcacuuugggagaccgaggcgggugaucacuugaggucaggaguuugagaccagccuggccaacauagugaaaccccguuucuacuaaaaauacaaaaaauuagucaggccugguggcguggaccuguagucccagcuaauugggagacugagguaggagaaucacuugaaccugggaggcggagguugcauugagcugagauggcgccugagcaacagagugagacucugucucaaaaaaaugcuugugauaagcagacgucaggguuccuucugucuccuaguuggaagaugcacugccagguuuucuuucauguugaagcauaucacaguuuucccaauuaggagucaggaaaucuguauaguuguuucguauccuagacaauuugcaagacuugagacaaaucauuugcuuguggauugaauauuccauguuuacaaguggaaauaauuuguccugcuguuucguuuuaaagaucaauacacggaagauggcaauaggaggaaaaaauaccuacuauuauacaaauagccgugcuguuuccuugcugagagaaaaacuggcuauugaaaagcagcgauugaacuugugaacaauggggugauuugaacuuggaaaagaaggaaaaauggaugcuuuuuccucucacuaaauccucacagcauuguggacucacacgaaccuuuagaaaucauuauucuuuccauuuuuaauugacaaauaaaaguuauauacauuuauuguguacagcgugauguuuugaccuauguauacuuugugggaugguuaaaugaagcugaugggcgugucuccauuuuuuuuaacagaucauuuacuauguaauucagucuuugcaguuuauucuggccugcguaguuaaaauauacuuaguguauauucuuccugaucaguaagaaugaaauguagauguuuuuauaggcaauuucacucuuuguuuaaaaccaaguguuuaguuuugccauaaacagaugacauugcuggaaacaagaaugugaauuaaaacuuaaaaaacauuuaaaauguguuaaagagugauauauguuucauuacagaauacuuaguuauuuuuaucugcuuuucaugcuacauaaggauucacagauuaaucucuugagguaaggaauguaaccaaauguauuuugaacuguugcauauagaacuuucucuuauuuuucauuauucuugaaaauauaagcauguagucuuauuuuuaaguggaugugguaguauaaauuagaaauuuaaguuuuggaauauaaauccuugcuguauauuucuaguuucuugcacagcugcuguugauagauacuuuuuuagccuuauuuggaaaauauauuuuaauaguauaauuaguaaucugaguguguuuauuucaccacuacugugugcuggguuaucauacuguacaaaguagacuuaguaauuucuacuuuuuuccccacauaauuuggcuagaauuugcaugguauauaggaaugcuguugcucuagaauaaaugaucauuucacaguauguuuuuacagugguggaggaggggcccaaaacuuucauggguuggacugaaagagcuuagaacggguaccgucuggugcgugcugugaucgucucugcuggggcugcucaggcugccuccuguagguggccagcguccucuacccuccauggggugcagucaccccaccccaccccuggccugcagccaaugaccggccgaagggagguggcguguggaaggccagccucugccuccagcaggacuugcacugagugcggaugcacucggaugcacucagacucuggcaucuaggagccugaggaauucguccugcagaggcagagagaacagauaaugaaccuguguacucuuucccagccucugcaguuucaguguuuugccuggccuguugcaucugcccccuguguuuuuuuaaucuuuguauauuuuauaauauaucuuauaugucauuuuauccauaucaguguauaucggcugucccuaacagauaaggacuuuugugaaacauauuaucagacuuugcaaaauuaaugguuauuccucagcaucaucugcuacccagaccauggucauauuacccuuaacaaccguggaaucuuaguauucuugaaugacacugugauaugcaaaauaaaugauucagacuauguguuaaaacuuugcuuuaauuuaguauaaagaaucagauugguagugaauuaagacuauauucuaaauuuucccauuuuuuauuaagguccuggaugccucaucccuuaguuucaacaccagauugaaaugguuugccaucugcuucguauguggcguuuucuuuucuauucuugugaguuaaggcuuuauauuguuuaauaauuuuuauuuuguauuagacuaauaauuccauuuaguaccaaaaacuaauguccuuuacuaaaucccuguuagaccauuuugguggaagguauuuauuaaacuaaaauaaagggguagagaucaaugaaaauacguagaaauuaguauuuuggggaguuuuguggauaguugaaauaauuuaagaaaaauguaucaauguguuaaaagaucuggagagucaguaauuuagauguuuauuaccuuuucauacuugguauuuagcaugaaaauuuaacuuaaauagacugagauuuacugguaagcacaaaguuuuguuauggcucauuuauauaugcuagugcaaauaggaagaagauucaaguuaguguauaacauugaaaauuaacuauuuuuucuguguaaucagacuagacugucuacaagcagauuuguauuuaaacauauuacauaauauugguauuguauuacugcaguagcacguuuauauuuuaaccauuaaaaucauaaaauuauuuuaaaauaacuauaauaucuuaacuuagggaacuggauugcuguggcuuccgggcggcauaaagcuuuuugcaguguuuuauacccucggcaaucuugcugcguuagccagguacguuuggcuucucaaaauaucuuguuugcucuugcuaccaaauuuaccuuucuaauaagcacuuucccaguaggauguuuauguaguucuguacauacugugaauucagccacaggauuuacauucauuaaauaaauauguauugacugcugcuguaugccgucucccauaacagacgguauuagugcuaggaauagccagccuuuguggggcacuuaaugugugucugggacuguucuaaguguuuuguauguauuaugacgagcuugugagguaggcaguauuaucauccccguuuauaacuggagauaauagcacagagcaggggagucagugcugcccauggcgaugaaccuaaaucauggcugaggugggaauccugcaggcagugggaauccggaggugggaucccaccauggcugaggugggaauccggagcccaggcuuggagcugcugcacucuaggcuuuguucuuguggagcuuacauuuuaaugaagaagauguucacaugauaagccagaaaaagaugggauggcauuggugcugugcagagaauuaaaacaggguguggcaguagugacagagggcuacuuuauauugggaguaugagaaucccucuuugagaaucuuugucgcaucuuuggguuguuguuugucuuagcccuuuuuaugcugcaguaacagaauacuguagacugggcgacuuaggaagaauagaaauuuuucucacaguuggaggccugaaguccaagguuaaggcacauccauccugcugauagaugcaucccccaaggggaagaucccuguguccucccagggcagaagaggaaagagcaacccccaggcagccucuccuccaagggccuuugaucccuuucaaagggaggaguucucacagccuaguccggucuucauacuaacacacugaagacacuuacauuuuggagaagacaccuucacaccauagcaugucuauugguauaguuguaaaguuucuuuauaaaguuaaggaaaaaaaaaauuuuagugagagauuuuaauuaaauaaagcaacagggcuucuuuuuuaaaaaaguaguuuauuuuugcauaaccagauaaauuaguagaccuguaccucagucacuuuauuuguuucaaauaguacaugcuuuuuaaugggaccugugaagcaacugaagaaaauguuugaagcaacaagauugcuugcaacaauuguuaugcuuguaaguaaauaauacauuuuuaaaacuuuuauugaaguauucuuugcacuguuauuuuacgaauaauugccuguuauguauguauacuucuuuuuuuauuuuuauuuuuuuuuauuauuauacuuuaaguuucaggguuguauguauacuucuuguguugaauauaauaauuauauccggccgggcacgguggcucacgucuguaaucccagcacuuuggggggccaaggugggcggaucaccugauggcaggaguucaagaccagccugaccaauauaaugaaaccccgucucuacuaaaaauacaaaaauuagcccggugagguggcaugcaccuguaaucccagcuacuugggaggcugagacagaaucacuugaaccugggagguggagguugcagugagccaagaucacaccauugcacuccagacuggccaacaagagugaagcuccaucuaaaaaccaaaaaaaaaauauauccuaugugguuauagaguucagaugguacaguauugucuaagacuacuggcuggguaaagccugcuucugcugcguauauggcaugguguagcugcguauuuaaauggagccuagagcugagugugcuuucauuuuuaagcccugcugaugguuucaugagggauuguuaguuuguacccuuuagagggugggcauagacacccucuaugcugagggugagauuuagcaucauuugucaucugacuuuugucccuucucugugugccaacuugacaaauucuaacaauauggcucccguaacaguaucuuuaaaggugccuuccauuacauuguggguucuguccacaacucucaggucaucacucuuauuaucuugagccuggguggcggguagaugagagcuuacacuuuggcuaguaagguuguuuccauucucauacgugcuggguguucagcugaucaucguuuuguguauugugggcaggagggggacccaaaucucuucugcauccugccucugccuccuaacucaccuggucugugucucuuguggauuucuuuugccuucaagcauuuaugauauuuaaagaauuuaaauguuaccauuauaacuauuaacauuagcuuuccaaacacagcuaaccuauguuaauuuauaaggaaauguuuguuaacucuaaucugccuggcagucuucucccaucuccucacuagaguaaaaacucauuuuuagcuuuauuuauuaugucuuuauucaacuucauaguuucuuaccacuuuuauaaucuccaauuauuuugaauuuccuauaauagcauauguaucaacauauauauaaacauuuaacuucagauuacuaacaaaguauauuucacuguuagaauauaaguaguuuauauuccacuaagauuuuaguuaguuuuauuuaagaaauccuggcacuuaccccucaaacuuuuuaguaacauacuguaccuuacaaaaacacacauguugagagaacgugggaacguuugaacauauaagacgucucccaagguggagcacuuugcgugguuugauuugcugcccacguaagaucacgccuaguaaugguggugaagaggcugugccacauagagccuuccacaugccagcuucuagcucaagcccaucacggaugcacucuaccuuauucauuacaacagcccuuuaaagcagguagguaggaacucuccucauuuuaaagagaagacaacagguuuagacgaguccacugacuucaccaaggacccucagauagcaggcgucagagcugggaucucuuuaggucuuuccaacaccacacugcccaccucuugcauucacuccugugccugcuugcuuucauggggauguggaaugaucaucuuucaguuuacuuaacagauuaaauuauuagaugcuuccaauuugccaaggaauauugcagucauagacuuuaaaguaaaauaauacuuacagaaaauacaaguaaaacuauucagcuguauucuuauuuuuguucuauaguauauucccuauguaaaugaaugcagaauaguuuaugcauuuuuauuaggcuuuugaaaggaucucaaacuuauaaucuacucuuucuuccccuguaguuguguuucauauuuacccugugugcugcucuuuggguaaguuaugucagcccuacuggcuuucaguuaacugugugccccccaccccagcugacgugucaucacaccauuaucuuaaaauagcucaucuguuuuuuuaaaacucucuaaagauuagguguuccuaaaauuugacauguuaccauccagcuaguugcuaaaaaugccauagauucuacugucuacagcauagagguagucagugaacacacaugugcacacaugcucacccacccagcugguggcuaaaugugccauagauucuacugucugcagcauagagguagucaguaaacacacaugugcacacaugcucaccuacccagcugguggcuaaaugugccauagauucugcugucuacagcguagaggucauuaauaaacacacaugugugcccgagcucaccugcuugugggccugguuggcaaaucugacagugcccgguguggugaagggcccuggcucaggggcugugcucuccaccaugcugcugcaggggugcgcugugagucugcaguggugaggcaagugugcugccgaguagcaagguguaaaaccaauagagagggccagaaaacacagauaguaacaacaaagagaggaacugaaaucauucuccuacccuguggagaagguuaacagcuguucauuagccuuuaaagaagucacauuguuacaauuccguuuacuucuugaucuccugauucuacaucauauuuuucuauuguacucaaccuauuucccaaauggguuugaagcaguucuugaacuaucaacaagaaaagucccauuuuaaagaagaaaggguagauauuuuagaaugcuaucagaaauauuccaguuuuuuuuuuauuuugaugauguaaggacaggacuuuaguuauaugagauugauuuacgugucauuucuuaaugauaaaagaauauucuuaacuugcaccucucuauagaaccuugauuuuugguuuuggaauugccuguuuacuuauaaacaguagauugaagauaaauaaguaaaaaagcacugauggacaaggaauucugaaaauauuuuaaaacaaccauggaaacuguuuauauuauuccagaagaucacaauaaaauacaauuuuccuucaaaauaucacucaaggagcaaaugggaaugaguaaaauaaguaaauuucacauggggcauacagaucucagugggauuuuacaugucgauucuagauaaguuaacauugacuuuaaagaccuaaccaccuuuaaaagucuaauguuuucagucuaugcacaauuguuucaguaacguuuauuuaaagucauauauuuugcaguauuuaaauuaauggauauaguuuuagaaaggaaauguauuuuuuggguuuuaaaguuucagaucaacuguaucuuaaauuuaucacacuaaaauuuaauaaagauaaaugaagccaucaucuacauuuuugaaagacaagaauuaaguuugauugagaaagauguuuuuaaaacuuugaaacucauaauugcucuguuuuugcuguuguuaguggcauaagaagggacuggcuguguuauucugcauauugcaguucuugucaaugaccugguaagucuuuccuuacccuagugaaguguuaaaauugccugagacgugacgagcauuuuguuugggaccugugaagcccuagcauuucgucugguguuuuggagccagacaggcccugcagggucagaggaggggaggucugcgaugaguccuguugcacuugacagcguggcucagugguacuguucgggagaaguauggggugcugugcucguagaguuacauagugauauguucugcuuuuuucuaaugugagaaagagaaauaauaagaaaaguaggugaugccaugugaguacauaaaagugagaccaaaucacagggugaguccaagggaagaugaguuuaccugcauucuccacucuauugcuggauaaauacaacguggaauuuauccugauguugacucuguggcccugugauaucuggagaugucuucugaauuggcagugauuaaauacuucuuaaguuacugguugagcaucccaaauccaaaaugcuucaggauccaaaacuuuuuuuuuuuuuuuuugaggcagagucucacucugucacccaggcuggagugcaguggcauuaucuuggcucacugcaaccucugccucccggguucaagugauucucgugccucagccuuccaaguagcugggauuacaaaugugaggcaccaugcccagccccaaauccaaaacuucuugaacgcugacaugaugcucagauuugguugauacucaaccaguaaauguaaugcagauauuccaaaaauccagaaaaauccaguauccaacacauuucuaguuccuaucauuucagaucagaggugcuucaccugcacugccuuucccaguccacuuuugugaagauucagucauguccugguuucugcucagacuguccuccuuguagccuuuuugugucucgcacaguaagaguucaucugcauaaaggccauaaauaucugggugguugauuaaacgugcccugcagcuccugcgcucuucuguguuagugaagaguacuuuuccuuuuccuuuagagcagcucuugcuuccuaauuuuugcuuccugguuuugccauuuuacauuccucuuacucgacauuacccaguuugggaucaccuuucuuucggccuucuuucuacugacagaugaaacaucagugaauguuaaauguaauucucuguauaucucaaauucaccauaaaauguucuuuacuuuuuuucacugauaugugaagaaacuuaaucucuugguuauuuucucuaguauuuugccuuuuauugccuaauuuguaacuaauaauugauuuaucccuaaaggagacuauaauuaucaguugugguacaguuucuauuuuauuauaagaagcucaaacuuuagcaugcaccagaaucaccuagagaguuuguuuaaagugcagguugcuuguuaaagcaagcuugugauuuaggagguuuaagguaggaccuaauaauuuacauuuuuaacaaguucccagaugaugcucucacugcuggucggggucacacuuugagaaccacuguacagucucaugcugcuguauuuauuauaagguuagacauggccuuuuggcauaaaggaaaaccaucauucagaugaagauucaacaugcuugaauauuucuugcagguauagccugucguacaucccauaugcaagguaagcuuguuugaaucuugucuucuuucugguucuuuacuuaucuucacacaaauauaugaauuuaaguaauuuuuacauaaaaauacuauuuaaacccuuuuuuuuugguugauuuuaauuuccuaaaaggaaauaaacauacuuuuuuuuuuuuuuuuuuuuuugagacagagucucacugugucgccaggcuggagugcaguggcaccaucucggcucacuguaaucucugccuccuggguucaagauuccccugccucagccuccuaaguagcugggacuacaggcgcguacugccaugcccggcuaauuuuuuuguguauuuuaguagagacgggauuucaccauguuggccaggauggucucaaucuccugacuuugugauccuaccgccucagccucccaaagugcugggauuacaaccgugagccaccgcgcccggcaguaaacauguuuucaaugagaugaauagcagcuugccaugauaaugucuguauggaaacauuuuggcgacauggagcagcucuguggggaguauccucccgcccugcugccuggcgugcacuagggaauguggaugagauucuggacccuuccauggcuuuaggaguucagaaaauaggacacagagacuccaggaaaacaaauucuacuuaagaaaaggaaguuacggcugggugcgguggcucacaccuguaauccuagcacuuugggaggccaaggugggcagaucacuugaggucaggaguucaagaccagccuggccaacauggcaaaaccucguuucuacuaaaaaauacaaaauuagcuggguguggugugggcgccuguaaucccagcuacuugggaggcugaggugggagaaucacuugaacccaggaggcagagguugcagugagccaagaucgugccacugcacuccagccuuggugacagagccagacuccaucucaauaaaaaaggaaguuacugggaaaaugagggcuuacacauaaaugcuuauuuuuggucagcaaaaacauuuuaauuguaugucaagagguaaccggcauuuuaaaauauuuuuccagagaaauguauuuagccguggaggagaaaacaaaacuaguuccaauuuuaaaucugauagauuuagaaaaagauucuggugaggcacagcuuugccuguuugugaaauucaaagauauguuauauauuuaaaaacagcaaaauugucuuuaauacgaacagugaaggaaauugguagaaauuuuauuuuuauuccauuucaaauguaugauucuuucugauagauacuuacaaggagaaaaagcaaaacaaaguuagcuacaggugagaaagcugcuuaacaggagugugcaaggguaauuuaccaugcauaggaacuuuagagcaaggagaccuccaauacuucuuggugcggaggaaaggaccucuagacgugaugucccauacaagaggcucugaagagauggcaggacuucaagaacaugaccagccucuccagacacaggaucccacacucgagagcaauaagcaauguacagauuuugccuauaagaauuuuauuaguggauauuuuuuauggccuagguaaaagcuuuuuuaaugaaugaaguaucaaguaauaacaguuuuggaagaaaauaugaaaggucacacuucaaucuucuuuuaauucugaggauucaguuauaaacauuacaguuuugaaacucaguucauuaguucuuuuuuuuuuuugagauggagucucauuuugucacccaggcuggaguacaauggcgugaucucugcucacugcaaccuccaccucccaaguucaagaguuucuccuggcucagccuccugaguagcugggauuacaggcacgugcugccgcugccacgcccagcuaauuuuuguguuuuuuaguagagaugggguuucaccauguuggccaggcuggucuugaacuccugaccucaagugauccaccugccuuacaggcgugagccaccuugccuggccuaguucuuuuuaaaaauuaaaucuuugggcugggcuugguggcucaucccuguaaucccagcauuuugggaggcugagacggguggauggcuugagcgcaggaguuugagaccagcuugggcaucauagcaagacccuaucucuauuaaaaaaaaaaaaaaaaaaauuaguguaguggugugcccuauagucccagcuccuugggaggcugaggugggaggaucugcucacgccacugcacuuauccuggaagacagagugagaaccugucucaaaaggaaaaaaaaagaaaaaaguuagaucuuuuguuagguuauuuuugguauuuaaacuuauuucuuugauugagaucaguguauaugccaguaaaaauuucuuaagauaaauaccaugucaaaaaucagcaaaauguuuucaaaucuuagcucuuaaucuuaaaugauacugaacaaaguuuuuauuaaucaaaaaguguguuggagcauccauugaguucuguuaaaaaaggugauuuagcaggaacauuuugcgcaacuuugcuuuugaggaauauuauauucuguuuuuuucccucucuuuuccaccagggaugcaguuauuaaaugcuguucuucucuccuaaguugaaaaucagaaacuuguggaaaagagcacuugaauguugguacucuauguuuggugaaguuugcuuuuccccauaaaacacuccaggaacaacugacgugacaguugaagaccguuuuguacuaagucucauuuuguauacugguaaaaacuacaugcuugauuaaaccauuaaaugcuuguaacuuuaa

SEQ ID NO: 192663 - RNA, 137453 nt, Homo sapiens
cgagcccagucgagccgcgcucaccucgggcucccgcuccgucuccaccuccgccuuugcccuggcggcgcgaccccgucccgggcgcggcccccagcagucgcgcgccguuagccucgcgcccgccgcgcaguccgggcccggcgcgaugggggccgccgccggccggagcccccaccuggggcccgcgcccgcccgccgcccgcagcgcucucugcuccugcugcagcugcugcugcucgucgcugccccgggguccacgcaggcccaggccgccccguuccccgagcugugcagguggguggcccgcccggacgcaggcuccgcucgcggugcccggggugagcggccggcguggggggcggggagcgcucgaggagcuccuggggucuccaagucgccuccguuccgcgccgggguccgccccguucccgagggaaaguugccugcgugguguccgcgagucccgccgggucccgugcgcaggcggggggcgcgggggcacacgcggucguggcgguccuggagccccgcguccggccacuuguggcugucgcugagucggggguggcuuugugcggagcggucgccccggcccuuggggucggcgccugcccucgcgcggccgggcguccgggaaaguuggaggcaggaacuccaguuugcuuuguucccgcugcgcguuugcaucagaguuucgccagcggggcaccggugaggccccucgguguggagaggcucaccggggcguuggagcccgcaggaaugguccuggaguugaguguuugugguuucauuugcugauugauuuccccccgugggcucauuuucucuuuaaagaauauauauauauauauauuuuuagcaggcggugacuuuugucuucuuuagauugggggcagggggugucguccagugugagcuuucaagacuugacccuucacuucucugagcccaacuuccugccugguugcucacaugaugucauugucuccggggcggauuauucuaguggaucuugcucugggaaccaugauuguauaacccaucagucccaucgagggcuguucaccucgcgcaacugcuagcaguccagggccuggggaacuucgaauuucaggaauuuucugaccauccuuuucuggacuguuuaggaugauggaaaauucagcuuuuguuuauuuuuuuaaacuuugguaaaaaggaagcaggaugaaaaguuuugaacagacaacaguuucucccuguuacuguuacuuuuacaaguuacuuuuacaaguuacuuuucagagugaaacaaaguugagccuacuuugggcugaacuuggaguuugugguaggguuuaugggggggguucuuauuuuucccaugcaucagagauaguuuuauuagcaccccuguguucagaacaugcagaaauuagucuaaggagggugaggcugaucucacgauagaaacucuuuggaaaggcccauauuuuuuaugcucccuuuuuuggaaggggaaggguggauggagggagaguuugugacacuaguuuaaagaccaguuagcuacccuaagauacauaguuacuccaguaacuaguaugauacagagaaaugguggcagcuuaaacgaggucaggcugagaacaacauuuagaggaaggcauuuuggaauaauggcuucugugaccaaaaauaagaaauuaacucgccugggcgcgguggcucaugcccggaauccagcacuuuggaaggccgaggugggcgggucacuugaguccaggaguuggaggccagcuucagcaacauggcgaaaccccgucucuacaaaaaauaugaaaauuagagccgggcgcgguggcacacuccuguccucccaguuaagggaggcugaggugguaggauaacguuagccccgcaggucgagguugcagugaguugugaucgagucgaguugcacucuagucugggcgacagagcaaggcccugucucaaaaauaaauaaauaaauacaauaagaaauuaacccagcuggccuagugugguugaagucuuggucuuguuaacaaauugaaguuuguuuucuucacaguuaagauuaagguggcuucaagggcagacugauacuuuggcugauugaugggacccuuacuuuugcauuagguuagucauggcagugucuugaaccuguguucacgaacuucaucuccagguggaacacggccucuuggucuaguaggaauggccuuuguaucuuuacguuuuucuggccacugucacacgugggcauacuuagcaaaugcugaagagguuucugagguugauaugcauugugaauauaauaagaucugcccuuuguagucuuagaauaucuuaaaaguuguguuuaauuuuucugccagauuuucuuaggaugacaaaucugccaaucauuucagagacggauuuucacccaccucuuucccuguuacuucccuguaguugcacaugcagacuucuccagaaccacuugcaaucucuacuuuaaacccaacaugugccaagugaacuuccugucuguuccuguuuuauaauuuuuugaggcagggucucaccgcguugcccaggcagaagugcaguggugcagucauagcucacuacagucgugaacuccugggcucaggcaguccuuccaccucacccuucuguguagcugggauuacaggugugugccaccccacuuggcuuauuauauauuuuuuaaaauuuuuaauagagaugacgucuugcuauguugcccaggcuggccucaagcuccuauccucaaguaaucuuccugcgucagccucccaaaguguugggauuacaggcaugaggcaccaugcuggguuuauguuccuguuuuaaacugauaccucuccuuaaauacuuuuugaaaacuuuucuuggggcgggggagguuaucagucaucuguacuuuuaugagauaaaacuggcuaaaauuuccguaaauguagcauguaguugaggaauaggaauguaaguugauuuuuuuuuuaauuugauacaaaaaauuuuaucgugucaccaaggugugacguguuaagcuccauuuuaauuuuguuccugggcaucaguuugcugaaauguaaauaacucggccaggucuccacugugagcaugaaaagucgaguccuacaaauguccccguuuguuuuugcugcuuggucacauggaggcagucccaaauguacagaaggaucacauuccaaauguuuguaaauugguaauuucauacguggaauguguuuuuccauugauaguauucuuguucauuguauggcccccagaaagucauuauccuugcaaagguuuuggagcacccagacaccauauggcuuuaacagaauccuagccguaaauucucauugucucuaaaagauggaguuggauuuccaggaaaacuaccucuccucccaagcccagcucucuagaaccuagagagaauauuuuucaucugcagucgcuuagacccacaagagggacaugagggccugcuucaggggugccugcgaggcaccuugugggggcaaagcuucaaggugaccuuuggcucugagcacuccugggauggggugcgguuccuggugcaguuaguuauugggaggaacgaaggagacagcaccauuucagcagcagcuuuaacuguguccgugcacguggaggggccugcccucugaguugugcauugaacagcaggcacgacaaaggcucauuucccaaaguguaucuggcuugaagcagcgcuuuaaauaagugcaugguuuuuuuuggagagacucagcaaagcauuuuucaagugucaaguggauuacuugccagguggucccagugcugaguuagaaguuaaugauucuuaugcagguauuucuugggaggugauauugcuaguacaaaguuaguagaaaacuuguuucugaggcuagugugauaggcugugggacuggccuguagaaaagaccuggggcaggaaggaguguugaaggucaguggagggcgggaauaguagagcaagaagagagggcauucaggaggagaggagcagaggccaggccaugcaaaaccaacaacagugucuaaagugaucucagcuugucaguggcuuuacuuauuaccauaugcuuuaaacuuuguaaaaugucauauuauauauguaauaugcaaguuuccacccuuuaguuagguguuaacaagaugcuuaaugggugaggucuuagcagugugcauuaaugauaaaauaaugcuuugggaugguuagauuuaagguaguuaagagcuucaaaauuuguacaggacaaguuuuccccaaauuguuuagguauaaaugcuagaaaguuuuuauuauauugaggacaagagaauaaugaagccagcugggaguugagguugguuuaguuacugucucuaaggagauuuuuuuuucccuguaauuuuuccaaaggaacagugcuuauaugccuaauuugggccacauguuaaaccuggaucacauccauuugugugugugcauuucaacaguaaguguauguggaagccuaagguuguuaauuaugguuacauuagaucucauggauuaauucucagaacagcauccugacagauucccaggaaaugaaugccugcguugggccucacgucuuuugucagcauuucauagagagagggauuuuuaaaagauggggcugagagaaauaauugagauguucccuucccuauuuugaucuugguauauaaacuauuguauuggggaaagaacugagcaggcucuagaacugagccuaguggcagagaguagcuuaucacuuugcaggugcuguucuuuuucuuccuccuuuucuucuuuggauuguccuagccacagagagcucuugcuaauguuguaacuggucaugaaugguguaugaggaggugggcguagcagcuguuugacuucaugggacccaccagacuguaaugccgaauuacaauuuugcauuuccaccagugauguaugagaguuccaguucuauauccuugucaacaccugucaguguuagguuuagccauucaaguggaguuguaaugguaucucagugugguuucagcuuucaucucucugcugacucaugauguugagcaagaaaggaacaucuuuucuuguauuuauuggaauccuggaugauguucaccauuaucaugugcuuacugacuggguauuuuuuguaguguccuuuaaaaaucauauuuugucccuuuuaccccuuaaaaauuguuuuuggguucuucuccuuauugagcuuuaggagcuccucaugucuucuggguacaaguucuuucuuagauaugugugagguaugaguguuuucuuucagucuuugccuugccuuuaaauuuucucagugauauccuuugaagaacagauuuaaaaaaauuugauggacuauaacuuuuuaugguuugugcuuuugguagcuugagaaaucaaccuuaaaacuagugacauuugaccuggguaauuuuuuguuuggagggcuauccugggcauuguaggaugucagccagcauuccuggccucuacucacuagaugcuaagacuauacucuaccacucccccucccccagugguaacaaauaaaaaugucuccaggcauaucaaaggcccuggaggggagggggcaaaaucacauccaauugagaaccacuggccuaccccaaggucucaaagauuuucuccugucucugccucuagaaguuuuuugguuuuaacuuugauuccuuaacucuaggaucaauuuuugugguuuaauuuuuauauaugauguuugaagaaaacucaaaccauauuuuuccuuugcucucauuccaugaacagucaucaacacagaagaccuccguaaucaaauguguggucguuuuuccccaggcaccaagcagugaccccuggccaauucaauuccugacccugucuaccuggagauagugucagaugccacagguuuggggcucaguucccgagaccgcuccccaccccacaccagucacaaguccgggccucuggaacuucugaccaacuggcuucaauuugggguucccagagugccucuuugggucugauuaauuugcuagagugacuuacagaacucaggaaaacacugaugauuagcaguuuaugaggauauuacaagggauacggaugaagagauguuuagggcgagguauuggggaaggggugcggagccucugugaccucccuggcucacuacccuccaggaauugccgugcauucaacuauuuggaagcucccccaacccaguuuuuauggaagcuucaggaggucagcauuucuucucccggguauagggugggacccucacuggggaggaucuuaagacccacaguccaaaagcagggaagaugagaguccuaccuuggggcagguggaaggaggggcagguggagagauuguuuccugaggccugacacacccaacauuauaacaaaagaccaauacuaggacuguggaaguuggcagccagaaaccagaugggaaaaaaaaacccauacauguauuauauauauuuauauauauauauauauaaaguauauguauuguguauauauuauauaagcauauuuauuauauauauauuauaguguauauuauauauguauuauauauaauauauaauauauaguuauauauaauauauacacacgcacauauauaaauaacaccacaaaaaggguaaaaguuuauuuauuuccaugaauauaucuaguucuguuuacuaauacuuuaugaaauaugcuuacagcucuguuuuuaagugagauugggcuacaguuuuuuugcucugcuguucuugauggauuuuguuauuaauaauauguuugcuuuguggaaggagcuaguuagcuuuuaguauuuuuguauguggugaaacaguuuguauauaagauggacauuuucuguuucuuaaaguuugguagaauucaccaguaaaacuaucuggcccuggcaggcucuuagguggaauaucaucggggaggacuuuugauuaugguuuuuucuaguuuuauuuucaguuuuaucuaguuuauuuuucuauucagauuuucuacuuuuucuugggccaauuuugguaaucucuauuuuccuagaaaauugucauuuuaauuguguauucauauuuaauaaguagcaugcuacucucauauuuuugauacucuauagcucuagguaaauuuuuaaaauuccugauguuuacuuguguacuuuuuucuuaauuauauuuacuaaagacuuauuuaccuuuuuaaagucuuuccaaaagaacuaguguuuuguuuuuucaucuuuucaccuuuuauuugcaauuuuauuaauuuauccacucaguaacuucuacaucauuuuucuguuucucguuugacuugaaugcuuagcucuuuuauuuuaaaucauuuugcauaauuaagaaauauauuuaaagcuucauguuucuuucuucggaguaccauaccacucauagauucugauacuuuuuuuuuucuccauauuucaauuuuguguauucccuuuuuggauucaaaaguucuaucuguuucaacuuccuggacccacuaaauuuuuagauuuuuauuuuuuucagguccauggacuuuggggguuuuaaauuuauuuuuuccauugugcggguaaaugugguggaacuuacugacauuucccuuguggccuaacaccuagucaaguugggaggguauuauguguuuggaaaaaaaguucucuguuugggucaaaguuacucauggugcuguucagcuuuucuuugcccuaacucuucuucgguuugucuguugcuuuuauuauuuguaucuggcugccgcuguggacaggcauguagcuggaugucguuugcugcugucgcccagcuuaccaguucucccaugguucagauguucuucugcuucccuguugucuuuuguugcagaaucucagcugauguguagucacagcugccuguucuuucugcguggacgcuguagcuucugucaacccucugaagaucucucuuaaaguucugcucugauugcucuauuaauuauuuuuccuugggcccaguuucuuugguuugaguuugucaccaugauugcauggugcuggugcccuugcagugacaggugacuccugaccgugcacucugcagugggucuccacccgaccuuggcugccuccuugugcagcugcgugggguagggcugggagcaguuguuggaauuuggcuguaaauuguuuucagggagacuaggggaugggcaggaugugccucuguggcuguucuuggcgcuuuagguccuuuccacccucccaaugucacccccaagcgcuguucugccaagacacagcugcuaaaccccuguugauugcugcuggcagcguguggccugagacgggggaucuggauuguugaguuggcuguguccaaucacuucuuuucucuggaccucauuuuccuccucaagaggggugggacuuaguuuucuuucucucuuuccuauuugaaaaccucucauuagggaguuaguuuuggaagucacuuuccugggcuugaauccagacuccuccccucacaggccuugggcaagucacagaaccucugaagucuuccuuuccguguguguccagucaggaugcuaaccauguuuguaggcuaggcgugggaugcuaaccguguuguaggcuaggcgugggaugcuaaccguguuguaggcuaggcgugggaugcuaaccguguuguaggcuaggcgugggaugcuaaccguguuguaggcuaggugugggaauuggaagacauuugaaugccuggcacguccucgguguucauuggugcuguagugguagcaguugcuuuaucuguaaguuacagaugcugccuuacaucagggauuuauuuuuauaaccuguuucucgcccucccagagcucuccauuagugucuugggguuucugccucaaccagagagcauuucuucuucaucuguuucaugauuggcacuccacguaagcuuccucaugagaaagaaagguuuccacuguuuaaaaaaguuucaaagccacuggacuccgugauuuccggguccauuuugcaucccaaauucugcaguucugagguuugcagccuugaggaguccuuccucacucagauucccccaaacaaugaggagcuugauaauucgagguguggaguuuggaugggggccgggggucacccuccugcaugugguggcuuggucccaggcuaggcugggagaaagggggcugucgugguuccagggcaagaagagccguccucccuguuucccugugguaggaucaggaagucucagcuaacuucugcacauggucaaggggguccuguccucacuuaggccucuccaggccucccuggaggguggaggaaugggugcuguuguaggugggaacagaaguguccaggccaguggcuuggaugugaaagugcuucauaaauuccaccuugcugugcaacuuaaaaaaaaaaaguacggucguuuagguuuucgaggugcccaaagcaaugcgucauaagccuauuuuugucuccguguuagccagggcagaggggcacuuuccugugacuccuccaggguggggaaaaucccaggugcucugugaaccuggccguucagccagcugcagaccuuugguaggaguuuucuuuuuccuuuugugugcuuuucgauccccugggggcaaccauuauucaguacaucuggagggcaaguuguccaggaagaggaagcagauccuaggagugucguccuucacugggagagguguaggaagugagggggaugguggaaguacuggcccgagcucuguuuucaggagugugugacagcaaaaacuggccuuugcaguugaguugccugugggcuauggccuagagggaaggccaggagggucuugcuguuagggcugccaccuucuucaugccugcugugugcugggaggagagagcuccuucagagcggacccaccauuggauuuugagugugugcaaaauuaacuuguugcuaucugcaugguuaucuguacuccagaaucaguuauacauuuuaaaacagcuguuuaguacugaaaaaacucccccaacacucccugcgccccacccuggccugcaaauagagugccaagccaccagaauagaagugcuaaaguagugaguuuccuagaaguggcaagccugagacuccagugagucacccucauuguuccccugaggcacccugccuccaccugcucucugcucucgaagcgucaguuauaccagcacuucucucuucucuuuugucucuuuuuacagucaccccuuuagagugacaggcagcgugagcucauggccuugacuuugcuggacaugcggagggagaggagagcugguggcagagucggggguugggcccugaggauggggcuguuuuauuggagaguccgcugucaccaggccuuucuguaaaaggcuggaagugagcgagugaaccaggcacccugguggggggccugcaugucagacccagcgggaagcaugucugacuugguugagaggcagcuaagggcccagugugucugggugggcugagccauugggagaauggagggaggggccagagagcacggaggauuagcuguggccagaucacagaggcugugggacuuugggcucccucuggguaaaagccagagcccuugaggacuucaguagauugguggauugaaaggcacaugggccggugcuguggcucaugccuguaaucccagcacuuugggaggccgaggcggguggaucacgaggucaggagaucgagaccacggugaaacccugucucuacuaaaaauacaaaaaaucuuagaugggcgcgguggcgggcgccuguagucccagcuacucgggaggcuguggcaggagaauggugugaacccgggaggcggagcuugcagugagcugagaucgcaccgcugcacuccagccugggcaacacagugagacuccgucucaaaaaagaaagaaagaaagaaagaaagaaagaaagaaagaaagaaagaaagaaagaaagguacauggaagauucgauugcuuggauugccuuagggaacuaugagaucccuaggugaggguugcaguugagcaugguagcugcuuuuccucuucagguugccuuuaggcugcgauggagauagcaugagcucuggagcaggacaggcuucuuucuaacaugggcuuggccacuuugugaauuugugaucagagacaaggucacggaccucacugggaccucccuaggcuguccauucugagucuguaagaagguggagaggggcagccccagcuggguguuaggcuuugcggagccucugcugucugauguuuggcuccagcaucuucaaagcaggggcuuuucuccucuguccaccugauuggccuuugugaggaaccaccaccuggcgguggccucauuagcaucaugggccagccagcugagcugacagcccgcagguuuucuagaaaggcccaccuucccuuguaguuugcacacuccaggaagggcccugggucugggaggguuuucugggaccuuggugacagggagaguagggggcugaacauuaaggucugaauucugcgcugggggcuggauuguccuuaaaggcgguuggccucagacauccacauggcaaagcagggaguuuagcccaucuacaacucuucuuuauacaugaggagcaaaguaugagaccgcccagguaauugcucugauuggaagaaaaucaucacggagcaggguuuaggguugaaauacuggccugcauccuguacuguugaguugaucugagccaaggauagcagagaggaccagccauuuuugugguagcuuucuguuguggagggcacuugcccaccuccugggaacgccacacccugguguguuugcccuuguucuguuuccccugcugcucuucugcuggaagcucuggacucaccugucucuguuguggauggugcagggcgggcaggccagaguggcauccuuguccugagaggucccaggaggcaguugaguguguaugugugcgugagugcgugugugagugcacgagugugugagugcaagugugugugucugagugucugugagugcaagugugugugucugagugugugugugugaguguguuugucugagugcgugugucucugucuucaucagcuccuaggagaugccuccggacaggggccugcccgucucucccuccaguuccuugccagugucaugugacacuccuuucagagggcaccccccgcccccagccaacucaccuuuuuuuguaaacuuaguuuuuaagcaguccaacucucucucuggauucaaaugaaagcuuuagaucauagucuguuucgauagcucuguguuccugguggugguuuucuccucacaaugaccuuguaggcuagcugaguuuugucgaggaaguugagcugggagagacuggcucacacagcuuguuagucagcgcuggggcaggaaucuggcccaggcccuucauggcaccuuucuuaggguagcgugcccccucucuauuccaggugaccucuguuacgcaguccccauugccugcccugguucccugggcucugacaucaacuuagaugucguguuugacuuagggcuuccagccggaucccucuccauacaccgggcuuccuuccagacccugcauaccucucagggaaaaccaaaggcugacguuuggcauuucccugcuucuauuuauuuguauuugucggcccuguaucuuuguccacagcuuuguggguuuguuagaauaggaagugaaguacuuccuauauaagcucuggccaugcugugucaaacucacgugcuuccccagccuucagcucgggguaggagucuucaugcaaaucagauuguuucucuuuuaguguaggcaacagcaaguuguugacgacagugguuaccuuaggcucuugacauucugcucccaagguccagugugggaacccugccuccuugcuccucuuccuugcuguuuuuucccuuucuccuuaguuaaggagacuggucuggauuucugaaggugacugugcuggauauguaugagcugaaacacugucugauacuguugagggacaguagugagccaggugauuucuugaauacucuguuagaggacuugcgugcaugucgaaaguaggagaaucuuuuuuggauguucagguuggaaacacuucacauucucuuugucuccaacauguuagauuuguugcuugcuguagacucagagaaacauuucucuagcuagugaccauguaucuuguuaugugaauuucacuuaugugucaccaacuggguuucugucuuuuaaggaaaccaaauuacagauucacacgugccuacuuuuauuauuacugaucccauccugccuuuaucuugcuuuauuaauugcaggccaguaguaaaauguuuaauaguuacaugaccauuagcauaaccccaagauucacagggacugaggaaacuaagauauauuuuaaaagaguuuggauauauggcaauaaaugaggaagggacagagugauacuucauggagauguuuuguguugaagggaaggaacccaguuuucuaagauuuauuuucuuuaagagauugagcauaccauauauuuugaucauagaauuuuacauacuuuagaugcuagcuguuuuuaaaaggaaagaacuccaaauuacaucuugcaagcuauugugguuuugcaagcauugagugauggcauauaugaaaacucugagaggugucauauuaagauaccaaugucaguuuaaagauauucuauaucuguaucccuaugacauuguauuuugaauuuuuuauuuuucauuuuuggacagacauuuagaacucacucaguggagauggcucugcaucucuguuuuaagcuuuuugaacucuaggcagcugugucggccuggggcuacauugacuucuucauugcagccccucgauugguuucgucuggaccaggguggguuucgauugcggcccuugcuggaacaguagcaggaaaguagaaacaccuuccugucucuggguuaaccagcugacagucuguuacuugugugcuuccuucuaauugguaaucugccaacaccuuucaggauauuaugaaauuucaagcaaaugagguuaaaauggaaccucuguacuucugaacaggcguggacugacugcaguucuccaggauaguuucagcagaagcagugagauuacagucaggagcaaaacaguaucugagcuuucuuuaugggaaagauuccgacugugugcuugguuuauaugguuaaauuaauugcccuuguuaaauuaaaaaaauaggguauguuucugccacagacuuugcuuuaaaagcagagaucuucuaaagucauuugccuuguauuugacuucugcugcuccccguuuccugcugggccugaugguuugauuguagaauguuucugaguugugucacuguuggacucugcugagcugaguagucucauuaaaggagagugugcaucugaguugaggaagacaauauagauguggaccuuguuuguagaguucacaagcugcuuacauagaaauagcaaggacagugcagccagugggaaggagccggcugagggacuugauauuauuuccauggaaaccaguuggguaugggaagagagguuguggaaggcaaugcucugguguuuggcaauucacacugugcagaagagaaagcagaacuggacugggaguauagaguagcagaaguuuaagcuuggggaagaaguugagcaaggaaaagcauaugaucuguugaucagcaugaugugauguggucugaaucuucagacaguucacagcuuuuucauagaggcuguccucagauggguucaaccauucugagaauucugccuuuacgauauaaguaguauccaugacauuaaaaacgagaagagaagcguuuuggccaaugacggacugcauaaacuacagucugcauaaaugaccuugguccuagaagauuaggaugaagcugaacaauucuuaucaccuagugaugcuguagccauuguaaugucguagcacaaugcauuagucacauguuugugguaauacugcuguaaacgaacccacugcgcuaccagucuuaugaaagcguccagucagguccuaggccuuuagguccacucacucacugacucacccagagccgcuuccaguccugcaggcuccauucauuauaagugcccuaggcaagugugccauuuuaauccuuuauaccauaucuuugcugcaccuuuucuacguuuagauaugugucacauguuacaguugccugggguauucagugcagcgucaugcuguguggguuuguagccugggaacaauaggacauaccauauagccuagguuuguaguaggcgacaccaucuaugugugugcagauacacucgaugauguuugagcagugacagaauugccucaugacacauuucugaugacguaucgccauuaagugagugacuauaaaccaguccccccaucagcaguuacacuuccugagguuucaguuacccauggucacuugcagucugaaaauaugaagauauuuugagagagagaugccacauucacauaccuuuuauuacaguuauaauugugcuauuuuauuauuaguuguuaaucuuuuacaacuaauuuauaaauuaaacuuaaucauggguauguauguaaaggaaaaaccauauccgaaaccguauuccugguuccaggccucuacugggggucuuguaucugugauuacaaggugcugcgaagggauaacuguaauuuuucuauaugacuagcauuuuauugaaucaaguuguguagaugguuggcaauauaauaggaacucagagaucuuuaugccauacagagucuguccuuuuaauggcauuuauugugacaagauuuaaacuaaaguuuuguggaauguuuugccaguuuuuguguuguaacugaaacuaaauguuuucugaaaaguuaaaaccauuucuuuaaauggaaaauaaaugaagccguuuaccuaauugguuaaggacucacccgugggccucacaccgccuagguuaauucuucacuuuauaauuccgugauguugggcaaguuccucauucugagccuugggauauuuggcuucaaagcugaggaacuugggaggguuggauaauggcaucacguucuguggggagauuuggcucacauguuagcugugugggugagagccgugcugucaugcguucuuagccacuggccaguuuccuucucaagccaucaguagagaugcugauccugcaucugccagucauugcuccaggagggaagacauuacugucccagagugacggugucauuggggauaacagacacuucagaaaaugccaccacugagcuguaugaagugccauggcagcuagugcuggagcuguggauucagccggggagcacugucuggaggagcugcugcagcacaugugugucucuccagcugucaggcuggccuuuggagugcauuuggauuuuuugagaaugagagagggaccauuggcuaacuguuuuacgcucugaaaaaugacauagaauagcaaagauuuuacuuauuuuugcugauuuucuagaacauuuucugucccagagugaugguuuugaagaaccagcguucuuggaaagaugguuuugcauccagaagagugauuuuaacuaaaaucaggcugccucccuugaggauggucacugaauuuuguacaacugggacaacggacagggauccuggguuguuuccaguggacaagccgcuucugugggggccuuugcaguucuccccgcuccucuccugugucccgcugguuuccuucaguugagauggaauacagcauagagucagugacuuuuagaagacuugacagaguuucaggaaaaugcucacugggcuuucuuaccuauccugcugcagaacuuuuuuuuuuuuuuuuugagauggagucucacucugucacccagucuggagugcaguggugcgaucucggcucacugcaaccuccaccuccuggauucaagcuauucucgugccucagccucccgaguaguugggacuauaagcgugcgcgaccaugccuggcuaauuuuuguguguguguguguguguguguguguguuuuuuuuuuuuuuuuaaguagauucaggguuucaccauguuggccaggcuggucucgaacuccugaccucaagugauccucccaccuuggccucccaaagugcugugauuacaggcaugugccacugcgcauggccugaaguucuuucuuucagaaaauguauucaacacauucuuuuguguguguuugagugaagacgguguuuccacacagcuugcagauacuuucuuccagaagcuuguuuguugcuaacauuuaacaucuuacuguuacagcuuaguuuucucuuugauugaauauauugaucucuuuuuuuuuuuuucuguuggcuuuuuucuuaagucuuuacuuguguaagcucagauaacuuagucuagaauguaggcuuuuucugggaaucucagcugaaugguuucauuugcuuggcuguuaaaugaaccauacuguuuggaauaguuuccuaauucuggcuguacauguucacuucagguagagaauuuucuaacagacaaacuuucagacaaaaaauuuauuauuccucaaagauaucauuacauuuuauuuagucuguaauaauuuuauugcuucugaaaccauuuucuaguucuauaaugugaucauggugcuuuuaaacuuuaauaucaaguuaauuuuaagaaugauuuuagcuuaggccauucuaggggcuuggccuuuaaucugaaaagaaauuuagaauccuuuaguuucaaacaugugauuucuuaaaacuuguugucaguuauuuauacgauuuucaaguuuauuaugaaauagucuuuaaaaaauauuuacuuuaguggaaacauaucuagugauaguuuaaccagggugcauaccagaguacauaauaguuuuuggaauauucuucauaaauuuucagagagauuauuuaaaccacaugacuguuucugagcuccuguugauacuaggggcuaggcauauucguuuuuucuuuuugagacagagucucgcuguguugcccaggcuggagugcaguggcacaaucucagcucacugcaaccucuaccucccagguucaagcgauacuccugccucagccucccuaguagcugggacuauaggcgugcaccaccacgcccggcuaauuuuuguauuuuuaguagagacggaguuucaccauacuggucaggcugaucuugaucuccugaccucgugaucugcaugccucagccucccaaagugcugggauuacaggcaugaggcaccacgcccugccauuaguuuguuuuaaaggagacauaauguccguugaaacaucagaauguuuuaaguacugacagcuugcaggugucuuuggagugaaguuuagaaaccugcugugaccauucuucauuuuaaagcugugacuaagaacucugagauauuggugccuucgccucaagugcugcugauggguuugaauggcauugagguugccaggccuggaggagggcugccuugugcugagugguuaaaucaccccccugaaaaaagucaguguuucaaguauuuuaauaggcuccuccuuuccuacucccauaaccacuuacauuugauaaaucuugacaaaacaaguaugaaauccaaguagagaaaauaauauaauugaauagagcaacacuuuucuuucuagcaacccugauuuccagauuaucaggacaauaucccucauuuuauucuuuuuuaaaucuugauucugcuccccaagcaaacacacucuuuaccuuauuuagauauccccuuugcaagaaugguggauuucuuuuaagaaaagcauagcaggccgggcgcgguggcucacgccuguaaucccagcacuuugggaagcugaggcaggcggaucacgagaucaggagauuaagaccauccuggcuaacauggugaaacccuaucucuacuaaaaauacaaaacauuagcugggugugguggugggugccuguagugccagcuacgggaggcugaggcaggagaauggcgugaacccgggagguggagcuugcaaugagcggagauugcgccacugcacuccagccugggcgacagagugagacuccgucucaaaaaaaaaaaaaaaaaaaaaaaagaaaagcauagcauuuuagguacguguggaucucuuuagcguugauuccuaccaguuaacucauuuuaaaugacacccucaugcaccaauaucauauacuuaggauugugaaauaguuuaaugaugccacugccgcuacuugaaguuugucucuguuauccuggagaaacuagucauggcuccugaauaagagauuagcauuuuuccugaguaguagccaagucuuuguuuacuuguuuaucuuguauccugcaaccuggaauauacacuccgagagggcagggcgucuuuguuuuguucauugcuguacucuccugugccucccgcaguaaguacuuaagaaauacuugugaaacacaugaauaaagguuaacgaagggcaaaggaaacaagccuuuauugaugauuuuucucugugcccaguaauacuuggguuauuuucucauguccuugagucaucuugacucuaggagacaccucuuaacauguuccugcugaaaaagcugagcugaggagucauaccccgaggguaucacccuaagauugggcaccugaguaccccagccugcucuucaggucuguagcugcuuaguggcuaucagaccuuccaagucuccaugcuuuugaaggccuaugugugcgguuugguuucuuggcagggggguuugauggguucccagaccuaggaguucuuggcgccucgucuuccagugaccccaccagggcugcucuuucuccuccauugcugaaacuaguucaggguuggggaggagggcacgugggggggccuggugguugguuuugugcugagucauugccuuggugcacuguggaaggaagcucugggagguggacggcuccuucugugagggagugcuucugucgucaagggaguacugcauagggugaauaacacaguuauguagauauauaugguggucuuacccccagggccuccacaacuccuggaugggccuagccuaagcaauucugauuuaacuuauugccccuccuuuuagcaauacuguugaguuaaauaacaguuuuugcauugaaaauaaaaaaauuuuauuuuuguagagaugggaucuugguauguugcccaggcuggccugaaacugcuggcuucaagugauccucuggccuucgccucccaaagugcugggauacaggcacgagccacuggccaggucuuuauuuuuugcauuuugcaaggacauuuuaagucacuuucuuccuuuucuguuuuuacuccugcugaggagaugauccccauuuuacaaaauggacaaaacauucuccccagggaagggaagaguagacauuugagaauaauuguuuucacagaaccgggaaaccaccuauuuugucccaaguauacugauugaugcauuagcaauaacucacuaucugcuuugccagagguuugaacaaugaguguuaaugcuugguguagugaauuuugugugauuucgaaucugauagcugacucauugcacagcucugucuugcgaguucagaucugaacuguagcucuaagagguaaaagcagaaguggagcugccuuucaugccauagcuaguuuuuuaauaaaauagaguuaaaaaauccuuuggcuuuucagcauuuuggugugauuggaaaggcuauuacuaucuuauauucagcaugagucuugagcaauuacugauuaauaugauuuggcugugucuccacccaaaucucagcuuguaguucccauaauccccauguguugugggagggaccuggugggaggcaauugaaucaugggggcgguuacccuuaugcuguucucguggucaugagugaguucucacgagaucugaugguuuuauaaggggcuuuuuccccuuuugcuccgcacuucuccuugcugaaaaagaauguguuugcuuccccuucugucacgauuguaaguuucuugaggccucccuagccaugcuuaacuaugagucaauuaaaccucuuuccuuuauaaauuacccagucuugaguaugucuuuauuagcagugugagaacagacuaauacacugaucugaguugauauucuuaaauuaaugguaagauauuucuuuuuuuuuuuucuuuggagacagagucucgcacuguugaccgagcuggagugcaguggcacgaucucggcucacugcaaccuccgucucccagguugaagcaguucuccugccucacccuccuagguagcuguaauuauaggcgugugccaccacgcccagcuaauuuuuguauuuuuaguagagaugggguuucauuauguuggccaggcuggucuugaacgccugaccucgugauccacccaccucggccucccaaagugcugggauuacagacgugagccaccaugcccagccagauacuucuauuuugauaaucuuugaguccugagguagcuucagaauggauugaaccacagacagaugguguuaguaguuucugcccuggcuucuuugcaacuuaacauacuugacuuuuuaguguuuuuggcuaaggaaaguguauuuucuaguuuguggcaguuuuaagcaaauguggcuugaauaaaacuagagagaaguuuaauuuuugauaaaucagugacauugacaaguuguuuuucuuccuuuccaguuauacaugggaagcuguugauaccaaaaauaauguacuuuauaaaaucaacaucuguggaaguguggauauuguccagugcgggccaucaagugcuguuuguaugcacgacuugaagacacgcacuuaucauucaguggguaaguagaacuaccugaaauuacuggauuggcaauaugauuccccaauuuugcaaaaaugacuguguauagcuauacguauauagcgauacaaaaauuuugaauguuuagaaaucauaaguguuuauaauacauaauacacauuuguuaguaguuaaaaaugcuaacgguuugaaugucuaguaugagcuaaaacuagguugguucugucuaguggauacuauacagacagcuguuaugaagaauuauguagauguguauuugauauugaaagcugucuccuagauggcucucccuucucacccacacuuuucuuaaacccuguuuuuacauucucccccagcccacauuuccuuuuagugcucccccgacucccauuccuuuguaccuuccagcuuuggcuguaguucccagacaguguuucugcugucaaagauggucacuggaguuaggcuuacauuaaagguuaaauaaauaguccugaggauuggcagucucagagaaagaggugcagccccuucuuuccuaggguucguuucauuccccaaauguaugccuuuugggucaggaucgcuauccuucugugaagaauaugaauccaaguggauuaauauaucagcaccagguuacauagaguggagucagggcagaugccugaaggaagggaggcagggcagacagaaaagcagaaugcauugcccuuggauuuggcaacauggauguccguggugaccuuucacuaaggcaguuagaauaaugagguuugaccacaauggaugcucgugacauagagaugguauaugacuagggacugucugauaacuagaagaagaugcuaggugggcuuuuggauuugggagagaagcuuacugugguagcucugucauuuucuuuuguguuuuaaacauuuuaauauuuuuauagauuuggcaguucaagugcaguuuguuacauggauauauugcauaguuguaaaucuggguuuuuaauacccgucacccgaauaguguacauuauacccaguagauaauuucuaauuccucaccccccaaccuuucugagucuccagugucuguuauuccacuguccguguccauguguaccuauuauuuaguuucuacuuauaagugagaacaugugguauuugguguucucuuucugaguuauuuuacuuaggauaaugugcuauuguucaauucauguugcugcaaaacaugugauuucauucuuuuuuauggccaacauguggaauuuguccauagaaaagaaugaaaucacacacacacacacacacacacacacacacaaacacacaccacauuuuuuguuauccagucauccauugauggacacuuagguuuauuccauaucuuugcaauuauggauagugcugugauaaacauaugagugcaggugucuuucugaugauuuuuuuccuucaaguauauauucaguagugggauugcuggauggaaugguaguucuauuuuuaguuccuugauagaucucuauacuguuuuccauagaggacauccuaauuuacauucccaccaguguauguaagcauucccguuuuucuacguucuugccaacaucuuuugcuuuuugacuuuuuaauaauugccauuccaguggguauaagauggugucucaugguuuuaauuugccuuucucugaugauuagggauguggaacauuuuuacauaugcuuguuggccauuuguaugucuuuagagaaaugucuguucauguccuuugcccucuuuuuaaagggguucuuuuuuucuuuuugaauuguuugaguuccuuguagauucuggauguuaguccuuugucagaugcacaguuugcaaauauuuucacccauucuguagguuuucuguuuacucugcugugcagaagcuuuuuaguuuaauuaaaucuuacuuggcuauuuuuguuuuguugcauuugcuuuugagguuuuaguuaugaaaucuuugucuaggccaauguccaggagaguguuuccuggguuuuguucuagaauauucauaguuucagaucuuacauuuaagucuccaacuuuuguauauggugagagauaggguucuaguuucauucuucugcauguggcuguccaguuuucccagcaccguuuauugaauagggugucccuucgccaguguuauguuuuugucaacuuugucaaagaucaguugguuuuaaguauguggcccugacucuggguucucuauucuguuccauugaucugugugccuauuuuuauaucaguaccaugcuguuugauuacuauagccuucagguauaauuugaagucagguaacaugaugccuccagcuuuguucuuuuuguuuaggauugcuuuugcuauucaggcuuuggcuacucauaugguuccauaugaauuuuaggauuguuuuucuaauucugugaaaaaugacauugguacuuugauaagaauugcacugaaucugcagauugcuuugggcauuauggucauguuaacaauacuaauucuucuaggccaugauuuuugcaucuguguucauuagggauauuggccuauaguuuuccuuuuuuguuguguccuugccuugcuuugguguuaggguguuacuggcuucauagaacaaguuagggaggauucccuccaacuugauuuuuuuuuuuuuuuuuuuuuuuuucagggaguagucucagugggauugguaccaguucuuuguaccuuugguagaauuuggcucucaaucugucugguccugugcuuuuucuugggagauuuuuaaaguacugauucaaucucacuccuuuuuacuggucuuuucaggauuucuguuucuuccgauucaaucuugggagguuguauguuuccaggaauguauccauuuccucuagguuuucuaguuuuugaguguagagauguuuauaguagccucugaugaucuuuugucuuuccauaguaucaaugucuacuuuuucauuucugauugugcuuauuugaauugugucucuucuuuuuuugguuaauuugaguaguaguccauugauuauguucaucuuuucaaagaaccaacuuuguuuuguugauccuuugcauuuuuuggggggggucucaauuucguuuaguucugcucugauuuuuguuauuucuucuguuagguuucaauuugguuuguucuuuuuuuuuucuagugccaugaggguuacauuaggucauuaauuugugaucuuuauuuuugauguaggcauuuagugcuauaaacuucccucuuaccgcugcuuugcuguaucccagagguuuugguccauugugucucuauuuauauucauuucaaaaaauuuuuacauuucauccuaacuuugucauugacccaaagguuauucaggagcagguuguuuaauguucauguauuuguguaguuuugagaguucuccucuuggaauugauuucuaguuuuauuccgcugugaucuggaaagauaguugauaugauuucaguuuuuaaaaauguacugagacuguucuguggccuaacauauggucuacccuggagacuguuccaugugcuaagaggaauguauguccugugguuguuggguagaaugaucuuuaaaugucuuuuagguccauuuaauccugaguccaauuuaaguucaguguuuuauuguugauuuucuguguugaugaucuuucuagugcuuguagugagguguugaagucucucauuauuauuacauugcugucuaucuccucuuaggucuagugguaaugauuuuaugaaucugagugcuuugguguggggugcauuuguauuuaggaugguuauaucuuguugaauugaucccguuaucauuauuuaauggucuuuuuuuuuucuuuuuuaacuauuauugacuuaaaagucucuuuuaucuaaauguugcuucucccgcucacuuuugguuucuauuugcauggaauaucuuuuccuaccuauuuaccuugagucuuuguuuuuaccaguuaggugguuuucuguaagcaacauaugguuggaucauuuuuuuuuuuaaaucuaguucaccaaucuauaucuuuuauguaaaggauuuaauucauuuauguucagaguuaauauugauaugugagguuuuguuccugucauaguguuaauuguuaacuaguugcuuuuuagugucaauuguauaauuauuuuauaagaugugaguuuuauaccuuuugucugacuggguuaauucaaaccugucuuuaagcuauuagauucucuuuucugcuggucuagucugcuguucaagcuuucaacuguauuuuguaauuccuacaaugaauuuuucauuucuggaauuucugucugguuuucuaaaaaauagcuuucucuaguaaaauuuuaauuuagauccuauauuuuuccgauuucuuuguguugguuuuuugacuuucucuuggaucuuauugcgcuucuuuaaaaucaauauuuugaauuccuuagcugguauuucaaggauuucauuuucuuuaggguccacugcuggagaguuagugugagucuuuggggauguugcagcgcucuuuuuuuuuuuuuuuuuuuuaauacuucuagaguuguuacucuguuucauucucaucuggauaaacuaucucuucuuuauuuuugaauuuacuuuggcaggauuuuuuuuuuucccuugagaaugugaauauaacguauguuguauauaguuguuugacuucaguucuggguacuuucagugacagagacucugaguuucuugguuauaguuggccuuuuugugguagcuuucucaaaugcuagugauaguaaugaugugcuugggugugugagcaggauccucaccgucucccgcggggccuggaaggcagaguucucaggaaguuauuuuguucucccuugcuuugcacuuuggcagcagaauuuauauuggguugugcaggccagcaggugguauuuauggguaaaaaccagcugcaguggaauccgaugggugggucuaugagucucugugcuugaccuuuguuuaaugggggaagcucuguugcuucaggcaguggaguggucuguggaaugcacaguggccugagcuaccugcucagccccugagugggggacaaagcuggacagaacugaacugccaguucuucucuuggauacuccaguggcucaagcaccagcccuaacagggguagcagggguagcuguguagaaggugccaaggugucugcggggagguguggggguugcuccagcuccauggccugggcaggugggagcacaaucugccucccugucacaccccguccuggcgcugggaauauucagaacaugagaauaucgcugucugucucaggcugcaguguagugagugcuacgagagacaccuguccauggcuuaccaccaaugugucuucuguagugagccuccucccucaacccaaagcacacacauuuguagcucuccugcucuuugccgcaggaaugcuguggguccguguagagagggugaggccccaccuuucgugcaaguccuggcucaguggaagucgugcaaguccacugccaguggaaaugcagcuuccccuaacagccacagaauggccacuguccugugugccugugccaaccugugggagcagccaugacugugcccacagcaguggguagagggugggggaggagaaguccuacuacccacauccgugcccaagcacugagaccaccuggcuccugggcuggaagcauacuccucccuugcagggcugaguacagcaccccugucuccacugcauguggcacaggccacaagccaugcuccugggcacaggaaagugcaugcuccuuugucccaaggagugcccccuuggcaugcuguacucuuucuucccuuaggagcagcacucccugaggguagaucucugggaacccugcagcuccccuggguccagccagcccuguguggcugcugcagucucagcaggugccaagaaaggucugcagggccucuggugauacggagacaucagugcugagcuuccccaggcaguccucccacugcugccgccacugccacccagguccaguggagggugagcaaccuggcauaagugguagucugauguaaugcccucaggaaguccccaaauugcugcccgcaccaguguuuggguuugugagggcagaaaagcucucccacaguucggguaccagcagucgaccacagaggugaggggcagcaacagcauucccgccaccccuuucaaaggaauaccaagucccucagggcuccuagccgcucucugccccucucguuuccugcuuuuuauuuuuugcccucguuucaucccagggguucuccaccaggcuccagugcucuccacuugauacuccauucuggcgacgguugcucaccuguaacuuggguucuucugagaaccggccucuggcaacucuguucagcugucuugaaacaaaagaaacccccacuugucauuuugcauggaaauugcuaaacacaguuaaaagagcuuuguagaaagcaguguuuagaguacgaagauaagggagugcgaggucugcugauugaggcccagcuccuguuugauuucccucucucucuacaaagagaccauccagacugaaaaaccuggugagagggauuugaggccugggauugagaucugagaaagcacuagauuguugugaauucuugggucugacauuauccuuggugauauacuuaggaaacuuacaggugagauggccaguuuacucauugugcucuuuugagaacucacagagaaaggccacaaguaauucuguuggccaguguuauguagguguucagaaagaaggaaaaguagcuuucuucuugauuuuauuauaauacuucaauauuuuuggcuaaugaaaguaugucuugaguuuaugguaguauaguaugguaugguauaguguaauaccacauagacugaugccagauggaggcaacuuacuugaaggauaauuugugagcuuggccucacuggacaaaguuugaguuugaccaaguucuguggaccuugaaagccagggaggagaagaguuguuauuuuuuuguagggaguggauccauuacagaucuuuugugaugguaacggggaggugaugugauggaagguguuuuuaggaagcuggccccguggaauaggaaacgaugccuacaggggagauaccaaagauaacuagaugacuaaaaaguaacuuacagguuaagaugaugaugauacuauuauaaaccagcaguuuccaaucucauuuuuucccccagauaugugugacagaucccuuucccagagcuugaaacuuccagagggagucaucauauauacuuucaggacucucaguaacggcucccuuucuucaacuggagagagcaguuuguaugagucaaugagagugacauucacaguagcauagggauaaucccgaaucaaaucuaauuugcauauacaauaaaaauaccuaaauuuuguugcacauucaugugcuaggccuaauguuuaaaaguaaaauaucucauuuaauucauucaacaacccuuuaaaguaggugauuucauuucccucauguuauaaaugaagaaauggaagcgcaaaauggaucuguguucuacagugggcaggucugugcaaaucugcccccgaaguccaaggaaguugagaggcugaagaaggaggcugacacccaguuucucagaaagaaacauuuaauacggacuuaugaauagaagccacaucucaagaagucacgagaugggauggaucccucugccaucacccacuccagacccagggaucauacaccauagggaaggggugguucagaaggaauguguaggacaauugaaguagguuuuuugaccuaaggggaggauucgugauaauuaccugcucuuacacaaggaacaguagauaaacuggaaaucuuggaggccuuccuggaacugggguuaaucggaagucagcagggcuguuuggccuccagaauggcguuacuuuagccuccacaaugagcaccuugcuggagguggugugguuauggauuugaauguggacagccggcuccagagccuguguacucacucagggcugugcuuuugugugagucauggggucacaucagacagauuggagcugaaauggagaccaggaugggagaucugaauguguggcucugagaggacaucugagaacgaacuucuuuugaucuuguuagaaaggaaaaaaugugaaccuucaaaacaaccacaagaacuggagcuccccgcagaucagaggaacagaagagcuagcauagaaauagauccaaauauguaugggaacuuaagauaacuuacaaccaaaaaauuggguguaaguagcuauugucucuuacgaaacaaaguucaaucccuccuuuagaucacauacugaaauuacagcucaguuaagauuugaaaguaaaaagacaauagaacauuggaaaaaaaauuaguaacauauagauauaaucuagaagagccuuccuuaaggaauccuggaagccauacaggagaagaggaacauuucuuauuacauaccuuuuaaugacuaaaagguguucuaaagacaaaagacauacacuagacugggaaaaacauuuccagcauguuugccaauguacuauuaggaugagagcuuuucuuaaaaauugguaagaaagacagacacccaggagaaaaauggcaaagucaaagaacagguaauucacaaaagaagaaauccagaugcucaauacaacuucacuaauaagccagguggauuaguccuuucucacauugcuguaaagaacuaccugauacuugguaauuuaugaaggagagagguuggauucacaguucugaaggcuguguaggaagcauggcuggggaggccucaggaaacuuaaaaucauggcagcaggugaaggggaagcaggcagcuucuucacauggugacaggagaggaguggggcggugcuacacacuuucaaacaagcacaucuagugagaacucuuaucacgagacagcacuuggggauggugcuacaccauuggaaaccagccccgugauccaguuaccucccaccaggccccaccuccaacacucgggaucacaauucaucaugagauuuggguggcgagacagagcuaagccgcaucaccagguauaaaugcaaaucagagcaauuaugagaucucauuuuucuuugagaaguuggcagaaauuuaaaugguugaaucauagagugcuggcaaggagccuggaaaugggcacauuuauuuauacguugcuguaggaagacgguugucucuaaauccuuuugggaagauaauaguuggugugagguuguuuuuuuuuuuuuuuuuuuuuuuuugagacagaaucuugcucuguugcccaggccggagugcaguggcgccaucuuggcucacugcauccuccgcccccuggguuuaagcgauucuccugcuucagccuccugaguagcuuggauuacgggcaccaccauguccggcuaauuuuuuuuuuguauuuuuaguagagaugggguuucaccauguuggccaggcuggucuugaacuccugaccucaagugauccacccgccuuggccccccaaagugcugggauuacaggugugagccaccacgccuggccugguaugaguuuuaaagugcccugaagcagggguccucaacccccgggccacagacugguagcgguuuguagccuguuaggagcugggcugcacagcaggaggugaguggugggugacagagugaagcuucgucuguauuuacagccgcuccccauugcuugcacuacugccugagcucugcauccuguuagauaaguggcagcaguagaugcuuauaggagcgcgaacccuauugugaacugcacaugcaagggaucuagguugugaccccuuaugagaaucuagugccugaugauuugucagugucucccaucacccccagaugggaccaucuaguugcaugaaaacaagcucggggcuuccacugauucugcacugugguguguuguauaauuauuucaauuacauauuacaauguaauaauaauagaaauaaaggguacaauaaauguaauaugcuugaaucaucccgaaaccaucccacccccaguccaaguccauggaaaaacugucuuucaugaaaccagucucuggugccaacaagguugggggcugcugcccuaaaauuuuuuauagugagaaacaaauauuaagaccucaaugcugguuuaaacaauauuacauuauuuuaaauugaggaaucauacauuauccacacauccaaggagcucagaagaaauuaaaaaaaucauacauuaguuuuuccuuaggcaaacaauauuacauaugugaaucuuagcaaauguuagccaucauuuucauagggccugugaacaauauuuggucccauuugcaaccuaauuauuuucacauuuuaaagugguuuauacauuuuauaugcauuugacccuugaacaacgcuagaguuaggggcaccaacccccugcacaguugaaaauccacauuuaacauuucacucccucuaaccuuagcugcuaauagccugcuguugaugggaagcuuuaccagaaacauaaauagucgaucaacacauauuuugcauguuauauguauuaaguacuauauucuuacaauaaaguaagcuaaaggaaagaaaauauuaagaaaaucaggccgggugugguggcucacaccuguaaucacagcacuuugggaggcugaggugggaggaucacuugagcccagaaguuugagaccagcuuggacaacauaguggaaccccaucucugcaaaaaauaaaaaaauuagccaggcaugguggugcaugccuguagucccaacuacuugggaggcugaggcaggaggauugcuugagcccaggagguggaggccucaaugagcuguaaucaggccacuguacuccugccuagguaagagaguagugagagcuugucucaggaaaaaacaaaugauaaggaagagaaaauuauguuuauuauucauugagcggcaguggaucaucauauaaagaucuucguccuuauugucuucauguugcguaggcugaguaggaggaggaagaggagggacuggucuuguuguucugggguuaccgaggugaaagaaaaucuguguauaaguggaccugggaaguucagaccuuugcaguucaacugcauuugauuuccuuuucaaguaccucagaugucuggcuuaacaguuaaaauuucaguguaacaauaauuauaaauuuaugaguauuauuauuuaauaauucuuauauauuuacuaguuaugcuaaaauucuaaaauuucuaauucuaaaauucucuuaaauguucuaauacugugucguaagucugaauuaauugcugaguuauaaacuuuggauuggaguuauauuaaacauugcaguaaaaauaccaaauacauucacauuuuuuucuaacacaucaaauauuaauauuaugauuuuaauuaaucuucugaggauuacagcucuauauccauuucaggaagccuguuaccagcccauuuaacuugagguaauguacucacuaaggaacaguguuaauugagguuaccucuggagccuggaauucuguuuggcuucuuguuggugaccugguaggacacagugaguccgacuguaguugccgucccaggugauucauuuacuuuaaagagccuggccccugacuuccagugauuugauagugucugauucuuguaugcacucacagaaaucuacagcaggcacuggauugaucauuggauuguaucuuucaucucuuugacucauaagaugugaaaaugccuuuuccucuuaagucuuuuauuuucuuaaaaccuagaauucuguuggauauuuaagaugauaccugguugaguuuuggauacaacucauguuuuuaucugauuuauggucucuccugauagucuggcaauaccuguuaacauuuuaaaacguauauucacauaaucuuuugugacucaaacggauagaagaaguaguacuauauguagauauuuguacaaaagguuuuugguagcauuguuuauuguggcaaauaugcuggaacaaucuacuguguggguaugguucaauaauuuauaguguauuuucuucuuauuuacuugguuaaaucaucuaaaauuauauguguacauuauauuaaaacauagccaacaguuaauguuuauuuauaauaacuauuugacuaucagucauauguaggcaccgguuuagguacuggaauugaaucagucacuacaacaggcaagaaucucuuuuuuucauggagcuuacauuuuaguagggugggagacagaugaaaaaagcaauggcuaaguaguauguuaaacugugaugacugcuacagaaaaggaaaggaaggguaaucaggaguacugggggcucgggugugugugugaggauauuaaauaggguaagugucacugagaaugugacacguaaguaaagaccuugaguugagggagugagcugugugucucucugggggaacagccaguucaggggacaagaaggguagccaaggaguguguuggugguagcaagaaaauaaaaaucuuuuaaaaagaguauccauauaaauagagaagcuggagguuaaaaaauuggaugaguauuuuuuuuuuuaauuuggcaaaauagcgugaauaguauauguugaaggaaacgcuaaguggguggugcaggggagagaggaagacuugcuugagcacaucgggaaguaggacaggaaggguucucuguuugccuuguagguucuaauugccauggcaauaauauaauugcuguggccgcugcgguaggcaggagggcugccugugaagucaggaucaccaggcuuuguggcuucaaggaggccaaaucaccaugggcuugcuugggcuuggaggugcgaccuggugggccugcagaaugcgacuugguggccugacugagcagcacgugagggccuggugcagccuggcauggugguacccuugagagcguggccuagagggcuccgaggugcagccuggccaguguggucuggaggggucuggcaagcgcuaucuggagcacucagagguguggccuguuuuuccgggugggucuagugaguguagcuuggagugcugggugguguggccuggcuggcaccgaggucccugcggauucuggagaaccucaaggugcggccccggggguguggccaagugugguguguggagggcccuugugugcagccuggugguuccugugagcaugguuuggagggccuggugaauguguccugguaggccuggugagugugugagcauggccuagagugucaccaaaccaaaguggacccgccugccugugcaccagggaaagccaaacaccaaagcgcaggguuuuugcuggagagaguggacugcacugcgacgagacaggaggaaaggucaaaccugucuccccaagcuggcggcugggucggguuuuauaagcauaagcuuauuaccauaagguaaugagguguguucugauuggaucuugcaauuagaugacaccagggcucuaucugauuggauccuggaucuugccauguggugugcgcuucuuauuucagucccgcuccucaguccagcgcuuagguuccucccguguugcaagcuugguucaucugugcaggcuccggugacaugaugucgaacugggagccauggcagcugaaaaacaacgaacagcuuuguacauaaaagaugauacagcuuggucuaaugugguucuaaggaggcucugccggcgagucuuagggguuccggcgggcagccgcgugaaccuggagcuuggggucugcagugcugggaggccgaggccuggcauguuggggacaggucuugggagcugacugggggccuggcgugguggcggcagcccgcagucccugccuggcccuugucugggaggccgcgguucucugcggccucucgccggugucgcccuuggccacugggcugcgaggaagccggcgaggagugggugugcgccccgcccggcucuaccggcgagggaugcaguggccgccagcguggccgugcggcugggucacucccuucccgcuuccagggccuuuuucugccuccuuuucaggacgugacccgcacauuaugagggacccguaggggcucuugacacagaggggucacccuaugugugaacagguuacgagguugggggcuuggcuucugaacuugccaggaaacaccgcaucccuuuuccugcagcggccgccccccaucccccacccgccccauucucuccccuccccaacugcagccuuccgcgccuccuuggccccucgagccucccuggguccccugcaccuccccaugucccccacgacuccuaggccucucgcgcuuccccaggaccccgcgcauccugggccucuugcgccuccccgguccucagcgccuccucggccgccgugccuccccgcaccuuuugcgccucauggggcucccggugccuucugcccgccgccucgccgcgccccucgccuccucaugccccuccgcgccccauaccuccccaccccugugccucucugccuauccccuguaccacccggcauccuccgugccccaugcgccucaccccucacgccucccuguacccugcaugccccgugugccugcugugccccacgcgccuccccccucgcgccucccuguacccugcaugcccugugcgccugcugcgccccacgcgccuccccccucgcgccuccccccuucgcgccucccuguacccugcauaccccgugagccugcugcgccccaugcgccuuccgcgucuccagcccucaugcgccuccagcugcgcaucucccuaggcggguaccucagcaccgcugagcccacccccgccccugcucagugccucccagacacgcccacugcgggcgggacagugggagcuguccaggcgcggagcuguccaggcgcgggagcuguccaggcgcgggagcuguccacgaggcacugaccuugguuucagagccucugcagggcuucuguguccuuuuggcugagccgacugggcaaaaguuuuagaaaagacccuggguguugcagauggagaaggaugaucguggcugacuuuugcuugcaggcagaagaaccacggggccaucagccuggugcugugggggcgcgcugacucgugguccgccccugccccaagacuucagguguauaugggauuggaucagcuaucaucccgagcucauggcacguacagugagccauguguuaauccauagacuaaccuuuuuccuuuuaaaaaauuaguuguuuuguauaauguagcgagcacuguuuccaacaaaaaucuaggaucuuggcaguaaccacuaucuguuuuacucuuuccucuuucacuuuucgcuaggaguaaucauuagcucccaucuuguauuaauuuuuuuuuuuuuuuacuguaucuaauuuccaaaaaaaaaaaaucuguguguuugcaacuaaguuaucuuccuauguguaacuuuuugggacuuaagugauaacaguaauauuacuaaaaaucaaccguauuguuguuuuucacugugguuuauuccuucugacugcugugauauuuuguguggaucugcugaaguuaauuuauccacucuucuguugaugggccuuuggucauuuccagguuuuugcucuucugaagagcaugagauauucuuucacauuuucugcugugcauguuccauaugugcaugguuuucucuuuuauauagaccugaguggaguaacuaggucauagggcacacgaauguucaauuuuaggacauaauguccugcugacuuacauaguuguugaaccaguuaacauuucacuagcaauacaggagagcucugagccaccucauggcugacacuugguauuuaauuuuugccagagggaugguuguaaaugguauaccauuuuggucuugauuugaaauuccuugaucaccaguaacauugaacaugucuuaacauauuuauugauguacauuuuucuuugauuugcuugaucaugucuuguucauuuuauauuggguuauugugugugaccuagauuagaauuuuuucuuuucauuggauauuaagauccaccauuguguggcuaggaguggguuuuuccuucucucuccuuuccagcauggugugugcuuucucagucagagguaauucaucguccuuuauuuccuggaauuauacagacauucuuuucuuguuuguuugcaugugaauguguauguagagauucuugaugcugguucuuugccaguucuguguuuuuccuaguuuauaacuuacuuccguuuucuuuaagcuguuuuuugaugaguauaaacucuuaaauugaauaggucaaccucauuaaucuuuuugagucuuaagaaaucuuucucuaucuuaagauuucugccaaguuuugaaguuuggauuuugauguuuacaucuuuaauccauuuagacagggguguccaaucuuuuggcuucccuaggccacauuggaagaauaauuaucuuuggccaccuaaaauacacuaauacucaugauacuuaaugaucuaaaaaaaaucacaaaaaagaucucauaauguuuuaagaaaguuuacaaguuuguguugggcugcauucaaagccauucugggcuguauguggcccaugggccacggguuggacaagcuuguguuuagaguugauuuuuguacccaguacuggguagggauccaauuuugucuuuuuccauauggaaaacuauuuuguuuccaguuccguuuuuauuuccaguucuguuuauugaacagccuccucuuuucccugaccuauuacuucugucauaaucaaaguuuaauucacauuugugucucugugcucucucuucuagucgauuggucucuauucuagucuuuugaucaguuuauuccuaugccaacccccaucauguugauuuuuacauagacuuuuuauucuggacuguuacaguaauguccuggacaagcagagauguggucauucuacuugugggccuuucuagagaauguugauuuuguagcauaugugaugggaaguauugaaacauuucaguggcugaguuauauauccugauuuguauuuuugaagaucacacuggugcaagauggaugaggaaguggggcuggcgagggaugagacuaguguggaggcagggggagcaguuagguggccauugcuggagcgcagguagugguuuuagcgggaguagagguggagaaauguggacagauuugagaugggcguauagcuguggaccuuucugauguauagaaugcagcagacaagguaaagauggcacuuaauguaauguaauggggaugccacucugagauggaaaauucugggaaaggacaguuuuauaaauuuauaagcuaucagauacauuauaaugcuacuuuuaauuugcuuuuccuuggaaauagcuguuugguuauguauguuuuauagccuguucacucucuuuucucuccaaauaggugacucuguuuugagaagugcaaccagaucucuccuggaauucaacacaacagugagcugugaccagcaaggcacaaaucacagaguccagagcagcauugccuuccugugugggaaaacccuggugaguccacacaggcacuugauguauuucuuuaaaaaaaaaaaggucugccccuugguguucuggcuguagagguauuccaggaagaaucagugagcaaacuuagaaacacaaauaagaaaaacccuaccaaaugaccaucaucaucaagaaccaauaaguaaacaaauucuaaacuuguuacaacuuuuaaguaaaacauagaccaugucuuuuguaaaacuacaauucaaagugauuacuguguuaaaaaucagugcacuguuuaauguuuaaguuauaggcauacuuuuuuuuucucuaaaaccucuucuucuagcauuucauuuugauagguuuuagggcagcauauuuaguuuuuuaaaaaauauuuuucuuuccucauuuauauuaaauuagagauacccacaucuauuuaggagaagccuuggcccguggguaugggguucucaaguuuuuuggauauuaccugguguuuaaaggggacauaauuguguaaauuauuaugauuguucuuauuaugggcauauuguauguaauuuguugauuuuaaucuuuaguuuuuggaaaggaacuugcaguaaauaauuguuuuagcucuugggagaaggaauugguauacaaauucuaugaauguucuugaaucccaguaagaacccaaucuuuaggaaagucagguugagugaaacucuguggcuacuaaauugcuuuaaaauaucauuuuagaauuugggacugugacuauugcaucuucagguccacagugucuuaucugaagaacuuugaaaauaaaacuaauauuguuaauuuuggauccgcauauaaauugcaucguugugcauauugagacccaaaaaagaaucuguucgcagcagcauuaaaugagauuuauauuacagaauaaaauauauagcuccuguuuuaacuucagcuaauuuccuuuaugaauucuguguucaccauaccagaaauagaacugugaaggauaacucccuagacuugcacgugggagugaagaggccaguuccugcugugcuugugucauccugcgaugcugggguugaccuguuuguaguccacucugguugcgguuaacaggaggggcugccuuggaggguuggcgucugguggguguacuaacuuggucagaugcagaugggcuccucaugggagccuuuucacgggaagcaugaggucacguuuucuggcuuucguuugcuggcauuugcuuaagagaacauuuggaguuugagaggagaaugacugaggauuucuucccaugaacucacucaauguacuugcacagcuggggcgguagaauuccuuuggauuaguuacacaaaaucccaacaugauuuuaugaagcuuuggucucagaauuugcagauuugggaaccucuugaugaccccguuuaacuaaagcgguugcauccccugcccuucuugcugcugcuuucuuuauuuuaguagccuuuacugcauucucauuuuaaagaagaaucuuuacaaugugugguaugguaacauuauaauuacuauuuuuuuuuaauagggaacuccugaauuuguaacugcaacagaaugugugcacuacuuugaguggaggaccacugcagccugcaagaaagacauauuuaaagcaaauaaggagguaacaugggaacuucaaauuacaugcuuaugaaguauacucuggggaacuuuaucuuucaaauacugauucuaaccuuuccgggugaaaaucuuuuuuagcuuccaaauugcauuugagcagagauaccaugugauuuaauuuuuaaaacuuuucugagugguucuuauuuuuaggacagggcauuuaaaauaucacaggaugugauuuuugguccagauuggaaauagaauggcucauccauauagggcaaguuaguucuugguuucuggugcugugcaacucaguaaacuaagugacguguuugggcuugggcuuagaguauucacucuaccugcaggagccaucuguuucugacgcugccugcuucaucuuccuuugcaccuggcuuuccaccuguguuguaccccgcuuuugauaagucuccuuuaccuguuugcauuguuaaaucucucugucccucuccucagccuugggaugacuucuggcugcaaugugaguccaggucagguaucccuuaaauucuuuuccagcucaccucagagacuagauuacuagguuacuguuacuauuacguccaccccuuauuauuugaacccagcauuccuuggucaagacauucuucuugggugcauguauguauauauaucuauauacauacacacugaccuauauguauuaugugcaacaugauauuuugaaauauguauacauugaggaauggcuacauugagcuaauuacauauguguuaccucacauauuucguuuuuuuuuuuuuuuuugugaggacucuuaaaaucuacucucuuagugauacgcaagaauaaauuacauuguuauuaacugugguuguggugguguuuaauggaucucuugggcaggucauucuuguugacuaauggaauguccccuuccccagccuggauucccucauguugcacugcuacuugauucucccugguccuggggaagagcagacuguguuccuucugccgcuucuccaugcccaccaccccagauccuaaagggaauuuccuguucucaccuugauaacaaucuuaauuaauugauuaucucacuuuucucuccuacuuucuguuuuuaagaacuuucaaagguuguaaggauucaggaacuaaugaauggucauaaucaguaauuuuuacuaguggccuaauaccaugcaguuuaauaagacaaaaagaaauguuuauuuaaaaacauuaauucagauuaaauuaugaacaauaaaucacugauauuuucagauauggucaucuaugaagggaaagacagugucauauggaaguggaagugguaaaauacugcccaggaaagccauaaggagcauucaaugaaaaaaaaaaaguuuaaaguggaaagaauuaaggcugauauuuaggagacagugucaaauguaagcuucauuuaaaaacuuaggugaagcuguuagaugacauacuguuagcggugggaaaagcaucucaaagcagacaucuguuugggguuugggggugagggugggagcacaguguguucauucucgcagugcuauaaagaaacaccugagacuggguaauuuauaaagaaaagagguauaauuagcucacaguuccgcagguuguaaaggaagaauggcagcaucugcaucuggagaagccucaggaaacuuacagucauggcagaaggcaacagaguaucgagcaccucacguggccagagccugaggaagagagugggagggggaggugccgcccacuuugaaaugaccagaucucacaagaacucacucacuaucaugauaauagcaagaagggggugauggaaucugcccucaugauccagucaccuccccaggccccgccuccaauguugaggauuacaauuugacacaagauuugaguggggacacacagucauccugggauuacaggcaugagccaccaugcccggcuaauuuauauauauauauauauauuuuuuuuuuuuuuuguuuguuuguuuguuuauuuguuuguuuuguagagacgggguuucucuauguuggccaggcuggccuugaacuccugaccucaggugauccgccugccucggccucccaaagugcugggauuacaggagugagccccugcgccuggccccacacacagucauccucaaguguccaguuggccggaucugaguugcuuccugugggagguggaggcugcggugacaguggugcccucugcucuccuguuagaccccagaccucucagucccacagauacucuccugggcucugauuuuccaaccugaucaugauacccuuuuuguuuuguuuuguuuuuguuuuaucugaguguaccucuuaugucacguugcugaauugacaguugugucuucuaccaccuaggaaaaaauugcuuuccaaaauaaaaugaauagcaacuuguuuucaaugggucagaaaucaccaacuacagcccaugguucaaagccugcccuggccuguuuuuguacaaccccaggacuaagaaugguuuucacauuuuuacaggauuguuacaaaacaaagaggaauaugccacagagaccuaugugaccugcaaaacccaaaauguagauaccacaugguucuuuguaaaaaaaaaaaaaaaaaaaaaaaggugcugaucuguguucuaaauaguuuuuggggugggaauggggagguauagucuguguuuuucucaaaacaaugacauuuaauuucucuuagaagcagauugaagaugcaugagaaacauuuguacuuuguacucucuuaccucuucagguguaauuggcagcuggggcuuuauucauugaguuuucauuuauugagagccuauugugagcuaagcaguaggaauuuuguuaaauuuuggaaugcuuucagggagccuauagacuaauggugugaaggacauauccauauucauuaacucauuuuuuuuugucuuauggauagauuaaauggaaagaacugaaaagcauaaugacugcuaaaaauguagugcugucacuguuagcaaaucuuaauaaagcguaugcccuuuuuucugcuuucaguuugauuugauuacaccuuacaggcuugguaugauaaguuuaaaacauauugaagguuuauguacuuauaaaaaccucaucauucccuaaagaaaaaaaaucucaauuugguuuagugucauuguagucuugcuuucuacaucuuacuaaugucucauuuauuuauucauuuugcucugucacauuuagaaugauuuugaugggcaaaaaucaugguaguuacaaacagcccuuuaaaacuauuguuauacuuuguucaguggauucugguagaggcuuuaagguaauuauuucuuuaaagcauuguguaaauauaccuccuacuguagugcccuugggaacaggcaaaauucagaacuggccugcuagcagucuuaccaggguuauaaaaguaagauuauuauauauaaaacagcauuaacucaaugcgugguguguugcagcuggcaaacaaccucgcuccccaggcugcuaaauucguggucuuaugaaugucuccauugcuguguuugcuguagcaggaagugggaggguguuccccaguagccuugacuguuuaccaaugcacacuccaguucuguggagugcugugugaggcaugucuucucuucccuccuggaguagggagacagccaguaguugcuaccugccccgagcagggugcuugcagaucuugccuauguggaauccucuaagugucuuggugaaaugcagcuguuuucagaaugaagaguucuuucauuuucccuucuugccauaugccaucuugcucccuuuuccaucauaggcuuuuauuuugcugguuagagaauugcaucuugucuugcauccuacccaguccacugacucacuccccucuuggguuaauguuuucauaugaucuugcugugggaugacaagcuuuagauuugcaggauaaugggcacuuguggcuuuuuacuguaacccaauuauagucuguggcaauaauuuucuuuuaguugccuuucugcaugaaucuggugguaggcuuaagcuccaugugcugguacccucugagcacuagagguucuaacuuccuccauuauuaguagaaacacuuaggugucugagaaguauuuuaggcgacaggcaacuuugcuuugaggauauggucaaaaugaguucaagugccuuugaggcugugaguagguguaggucguuugauucacucuauuagcucuccaugaaucucugacagcaggacuggggaaaaagguuaguggguuagagcauuccugcagauuugauagccuauuucuaagagaaauuugaaagcuaaauauuaagcaguuaacuuuuguaaauagaccugucugugaauugcuucagucuaaaagauaaaauuuugggaaacuuauccacagaaaauaauaaaacuaucuacuuugaaaugauuucagagaacaugaaguuuuagaauauucuuuggaagagguaauuaaaaugaugccaguguauuauuuuggaaauaaaacuuacaggaauguuucacauagucaugguucacuuggugaccagggccuuuuuuacucugggggggauuccuuucugggcuugaguucuugcugugaugcggaaguugggugccccuacuucaugaaacuguaccgcaaagaugugggugccccuacuucaugaaacuguaccgcaaagaugugggugcuccuacuucaugaaacuguaccgcaaagaugcgggugccccuacuucaugaaacuguacugcaaagauguggccucagagccaugguuucuguccugggcagggagucuugcagccuggggcaguuucaccaucugagcacagacccugauauaguuuggauuuugucccuccccaaaucucacauugaauuugaaucccuaaugcuggagguggggccugguggaaggugauuaaaucaugggggucccucaugaauggucuagcaccauccccuuggugcuguccucaugacagugagugaauucucaugagaucugguuguuucaaaguuucugguuguuucacucucaccgucuugcuccugcuuuugcugugagauaugcuugcucccacuucaccuucugccgugagugaaagcuuuuugaggccuccccagaagccgagcuaugcuuccuguacaaccugcagaacugugagccaguuaaacuucuuuucuuuauaaauuacccagucucagguauuuauagcagugcaaaaacaaccuaauacagacugcuugggacugggcuggcuuuuuuggccugcugccagcgaugggccacaggugggagacucacugaguuaagggcauuagaacuugguggguccugcuauugccugcuaugcuguggagcucaggcugcaccucuuuuuaccaugugggcucuuugaugugguagaggcgccucugucccuccccagaauguugcccuggaggcccgcugaucaccguuggggccagugcuugucucagcuguuggagagccugaauaugugcuugccugacccagcuccacccagcuuuccuuccucaaucugccuugcuggcagaacacaagacagugaugcuuaggugucccauggccccacccauugucugggacaugggaguagccuccucguuaacaaaagccaagcauaaauccuguugccaccacugcagcugccucuuuccugcaaguaccacuuccuggccaggagaugaacuugcguagcccaucugcugagacaagugcacaauugcacagugcuacggcaggagacaagcuuuccaugaccucaguuaccaucaucccucaccacacccuggcuacucagaaggcccugagccugcucaccagccugguauauuacuacuacaacugauguuugagaaagucaccacacaaagccuaucuauaaccaaggaauucauacagucuuugacgcugaaagcguccagaagcaaagccaaauaaaacuaugcaacauacauuauagucacauucucagggcggggggaacccucuagucaaagcaaaaguaaauucaaaccaaaaagugacaguuucucuagaugagaaggaagcaggguaacaauucuggaaauaugaaaaagcaggguguuauagcacccugaaggaucauauuaaucuuccagaaacagauccuaaccaaagugaaaugcuugaaauacuaguuaaagaauucaaaauauuaauuuuaaagaagcuuaaugagauacaugagaaaguugaaaaccaauacaaagagaucagaauaucaauccaggauauaaaugagaaauuuaccaaagagauguuuuaaaaaaaucaaguagaauuucuagaaaugaaaaauuuauuauaggaauuauaaaauugaguugaaaguuucaaccauagacuagacgaagcagaaggaagaaucucagaacuugaagacaggucuuuuggauuaauccaaucaggcaaaaacaaagauucaaaggaaaugaacgaaguguuugagaaacgugggacuacaugaaacauccaaaccuauaaagcauagauauuacuaagggagaagaacaaacaaaaucuggaaaauguauuugaggacauaauugauguaaacuucuuuaguuuagcaggagaucuagaccuccaaauauaggaagcucaaaaaauucuaaggaaauauguugcaaggaggacuucaccacaacauauagccaugagacuguaugaggucaacaugaaggaaaaaauccuauccacgagaaaaguaucuaaucaccuauaaagaaaaucccaucaaacuaauaggggacuucucaggagaaacuuaagagccagagagauuggguuucucuuuucaaggugcuuaaggaaaaaaaaucugucaacccugaauuuuguauccugccagaauaaguuucauguaugaaggaaaaauaaagucuuucucagacaugcaaaugcugagggaauuugucaguacuagauggaccauacaauuaaugcccaaaggaggucuauacagggaaacaaaaguuugauacuugcuaucauaaaaacacacaaaaguauaaacacucuuauaaaacaauuauucaaacaagaccacaaagcaacuaggaaacaguuagcauuaugacaggaauaaaaccucacauauuaauauuaacuuugaaugugcauggauuaaaugcuccacauaaaagauacagauugggagaauggauuuaaaaaauaaaagacagaauccacccauaugcugcuuacaagaaagccagaacuaauugguaaagacauacacugaagcuaaagggauggaaaaagauauuccaggcaaauggaaaucaaaagcaagcaggaagacccaccuauacuuagauaaaacugacuuuaaaucaacaacaguaaaaaaaaaggaaaaagauggucauuauaugauaaaaagauuauucaacaagauguaacaaucuuaaauauguaugcaugcaacucuagagcacaagauucauaaaacaacugcugguagacuucagaaaagaaauggacagcaaugcaauaauagaauucaaucacugagaaagaaaaucaacaaacacggcacauaaauuggauucaggaccacguagaccuaacagauauuuauagaacauucuccccacagccgcagaacauauauucuucucaucagugcauggaacguuuuucgagauggacuauaugucauaccaaaaaacaagucucaauaaauugaaaaaaaccaaaaugauaccaaguaucuucucagaccacaguggaaugaaacuagaaaucaauucacagagaaacucucauaacuauacaaauaauuggaaauuaaauagccugcuucugaaugaauuuugagucaacaauguaguuaagauggaaauuaaaaaaaaauugaaacaaaugaaaguggauacacagcauaaaaccugcgggauacagcaaaagcagggcuaagugggaaguuuauaguguuaaaugccuacaucaaaaauagagaucacaaauuaacaaccuaauaucacacuucaaggaacuagaaaaaaaagaaaaaaccaaauugaaaccuagcagaacagaaguaacaaauaccagagcagaacuaaaugaaauggagaccaaaaaaugcaguacaaaggauaaaaaaaaugagaaguugguucuuuggaaagauaauauucauagacuguuggucagauuaaccagaagagagaggauucaaucagaaauaagaaaguagacauuacagcugauaccacaaaaaagaucauaagagacuucugugaacaucuguguacucacaacugagaaaauuuagaggaaauguguacauuucuggaaacauucaaguuccugagauucaaccaggaagaaauagaaauuccaaaaagaccaauaacaaguauugggauugaaucaguaauuuaagaaaaacaaaacaaacaaaacaaaacaaaacaaaaaccucccaacaaaaaaagcucaggaccagacagauugacagcugaauucucccagaggcacagggaagaacuagcacaaauccuacugaaacuguuaccaaaaaucagaggagggaauccucccuaacucauuauuugaagccaauauuauccugauaaccaaagccaaacaagcacacaacaaagaaagaaaacuagaggccaauaucuaugauaaacagauucaaaaaucucaacaaaauacuagcaaacugaauguaacagcacuucagaaaaauaauacaucacgaucaaguggguuuuauuccaggguugcaaggaugguucaguguaugcaaaucaauaaaugugauucaccauuuaaacaauuuaaaaaaaagucugaccaucucaggagauacagaaaaagcauuugaugaaauucaacaucccuuaaugaaaagacaacacucaaaaaauauuagaagggacauaccucagaauaauaaaaggcauauacgacagaaccacagccagcaucguacugaacagggaaaaguugaaagcauuuccccuaagaaguggaacaagacaaugaugcccacuuuuucaucucuccuauucaacauaguacuggaaguccuaccuggggcagucaggcaagagaaagaaaacgcauccagaucagaaaagagacagucaacgugucucugugugcugaugauaugaucuuauaccuagaaaacucuaaaguuuccuccaaaagucucuuagauuugauacgugaauucaguaguuucaggauacagagucauuguacaagaaucaauaacauuucuacacaccaguaaugaucaagcugagaaucaaaucaagaagucaaucccauuuauaaucacuaaaaaaaaaaaacccacuagaaauacauuuagccaaggaggugaaaaaucucuacaaggaaaacuguaaaacacugaugaaagaaauuguagauagcagaagugggaaaacaucccauguucaugaauuggaagaaucaauaucauuaaaaugauuauauugcccgaaacaauccacagauucaaugcaauuccuaucaaaaugccaacgucauuuuuuauggaauuagaaaaaguccuaaaauucauguggucccccaaaaaaucuuaauagccaaaccaaucuuaaggaaaaugaacaaagcuagaggcaucacaauacccaccuacagauuuuacuggagggcuauaguaaucaaaacagcuaguacugauagaaaaauagacacacagauuaauggaacagaauagaaaacccagagucaaagcugcauacuuacaaccaacugaucuuugacacaguugacaaaaacauacacuggggaaaggacacccuauuuaguaaaugguucugggaaaacuggacagccauaugcggaagaaugaaacuggaccccuaucucuuaccacauauaaaaauuaacucaggucggauuagcgacuugaauguaaggccugccugaaacuauaaaauucccagaagaaaacccaggaaaagcucucucggaucuucgccuaggcaaagaauucaugacuaagacuucaaaagcaaaugcaacaaaaauaaaaauagagaaaugggacuuuauuaaacuuaaaaacuucugcacagcaaaauacauagucagcagagugaacagacaacauacaaaauggccaaaaguguuuuuaaacucuacauucaacaaaggauugauauucagaaucuacaaagaaugcagacaacucaacaagaaaaaccacaaucccuuuaagaagugagcaaaggacgugaacaaacauuucucuaaagaagacauacaaauggccaagaaucuccuaaacauacuccacaucacuaaucaucagagaaauauacaaauuauuauaaaaccacauggaauacuaugcagccauaaaaaugaugaguucauguccuuuguagggacaugaaugaaacuggaaaccaucauucucagcaaacugucgcaaggauaaaaaaccaaacaucguauguucucacucauaggugggaauugaacaaugagaacacauggacacaggaaggggaacaucacacaccugggacuguugugggguggggggcggggggagggauagcauuaggagauauaccuaaugcuaaaugacgaguuaauggguucagcacaccaacauggcacauguauacauauguaacaaaccugcacguugugcacauguacccuaaaacuuaaaguguaauaauaauaaaauuaaaaaaaaaaguuuaggaaaaaaaaaauaaacugcauauauggaacguaauaaaaaaaaaccccacaaugagauaccaucuuauaccagucaaaaauggcaauuauuaaaaagucaaaaaacaacagauguuggcagaguugcagaaaaaaaagagaacacuuauacaccauuggugggaauguaaauuagaaugaccuuuauggaaaauaguauggaaauuaaucaaagaacuaaaaauagaacuaccauuugacccagcaaucucacuacuggguaucuacacaaaguaaaagaaaucugucugucaaagagauacgugcacucgucuguuuauuguggcacuauucacaguagcaaagauacggaauaaacguuaagugcccaccaacggaugacuagguaaagaacacacacacacacacacacacacacacgucuaucauggaauaccacucagccguaaggcagaaugaaauccuauguuuuggaguaauauugguggaacuugaggccauuaucuugagugaaauaacuuagucagacaccacauauucucacuuauaagugggaacuaaauaauacauacacauggacauagagacuggaauaauaaauauuggagcuucagaaaggugagagggugggagggcagugaggguugagaaaugagaaauuuccuaauggguacaauguacaguauuccagugcugguuacacuaaaagcacagaccucaccacugugcaauauccauguaauacaacugcacucgguccuccuaaaucuaaauaaaacaaacaaagaggcacccccuuaaagcucagggucuugccaacucuaacagugggguuucuugauguuuuuuaaaauaaaaagaccauuaguucauagguaugagagacugucauaaauuaaaaccaaguaaggauggauugaaauacccacaggaggaacucaucuucacaguuuauggaacaaauauagaacaaauauuuacugagcucccacuauguuguaggcaucaucuuuagccugcagugacaaacccuugaccucaaggagccccuauuauaguggggggaaaaugacaaaagucaacagauggcaguaccuaguaucauacaucacagugcugugaacaaaagugaggcugaguaugggagacagagagagguagagagugcuguuuuagguaaaggugucagaagaggccuuacuaagggcgauguuucaucagagaccugaaugaagugagggaaagagccauguguauauuuggguaagcacaucucagguagagaggacuuuugaguuucaggaggguagaauugcaucaagaggugaguguggcugcguugagugaggagagugguagguuagggcggugucaugaaggaguuggaauuuccuucucaguguaaugggaagcugcuuugaacagggagagguguggccugauuuaauucugaagugcuaauccugugcuuguggagacaugggcugagguaguagggcacugaagcuggaauuggggggccaguuaagauacuauugcaggcaagagauuaugguggcuuggacaggguggcgaugguggaggugauaaguagggaguggauccaggguuuagucugaagggagagcuggcaggacuugccgaugguuggauguagacgugagagaacuuggcgguggggcagggggaccuuaagguuuuggcucaagcaacugguugaaugauggugccauuuguugagaugaggaacacugggguaacaguagguuuugggggagaaaucaaaggcucauuuuaaauuuaaauacaugaaauuugagaugguuuuguguauccaagugaugaugauaaacaacagcaauaaauaacacuuaugccaaccugccaggagcuguaccccaagcuucacauacauuaguucacucaggccuuacagcagccccaugaaggaauaacugucauuauuccaguauggcacguggggaagcugaggcauggagguuaacuucauucauggucaugcaaaguguucaugccagagguugaaccccaaguguucugcuucgagucugugcuuauaaacguagcuucugcuauuguuggcuguguaagccugcaguucuguggaaaggucaaggcuagagacaugaauuugggagucuuuggcagacauuuauaaccaugcacgaggucaccaagggauuggguguagacaggaaagagggcugcucaguaagcuguggcacaccucuggauugagagucaguuagagggaaggugagaaguguuuccaggaggcugaaaaagagcuggaaguggggcagaagaaaaccaggagccuguggaugcaagccacaggagaagggguuucaugagguggagaaugaucaguagcauccagugccacaagagaccauguaacgggaaggcuaggacacgagcacuggaugugucagcagagauguugugggugagcugguaagcgggguuuugcuggagugggaggcagcaagcugaugggacuguguucaagagagaauggaaggcaggaagaggagaagacguguagggacaauugaagaaauuuugcucuaaguugcagagacaugagaugauagcuaggggaauguagggaccaggaaggacguuugugaggugguagaucucauggcaugcugacggaaacgauccaguggagagggaaaaccuggugauguaaagugagaggagaugauugcacaacaguccucauguaagagagaagagauaccgaaaagaacgcagaggagccaagacguuuauugaccuuugccugaguucguuauuaggggacaccauagcaugauagucccuaaggaauggagagcaguguugugugacauuggucauaagcuuuucugauugaccaagauguauacugaagacucacuuuuuucuuccucccuuccaggugccaugcuauguguuugaugaagaguugaggaagcaugaucucaauccucugaucaagcuuaguggugccuacuugguggaugacuccgauccggacacuucucuauucaucaauguuuguagagacauagguaugaaucuuuguggggcugagggggugguggugagggauuucuucuauggcuucaauaucuuugccuuucuaccuuuauuucuguuuucacauccauguuucugauuaggcccucuaauaaagcuuuuguccccaaaaauguucuauuugcacaacccaccucuucucccccaguagauuccaugccuccuccccaaccccuguagauuccauccuaacuguugauccauuccauguggguguucucucggccagacaccuuggguuucgggauucuacagaagugagggucggucuuguucucugugugugccugaaucccuuggcucugaguuacgggcugggugaaaaagaaaaagggaugaucaaggacuuggguacuuggucgggaugcauauuuggcccaagcugacuuguuccuuucucuguacuugccaaaacuggugugagaagcuuuagcuuaagcuuuagaaucuuugauaaauuaacuaaagaccguaaauaaauggucuuuaucuaaaaagggccaugaaaaguuuuacuaagccuuugacuagccuucagcugguuuuacuaagccaaguuucuaaaacccagcuugauguuccccucagggcuaugaauuguuaguccuguaggccaggacugucuuucugcagugcuagccaugaguaaauucugcuggugauuaacuaaucuaaaggucauuuuuaguguucuucuuuguuuuuuauuucucaaauaguacauaaugcuuugcccuuagaaaaguuuggagaaaauuuuaaaaaauaaacucaauacauggaaguauugcuggauaguagaugaguauuaauuuaugauuauucuuuaaauuauauauauacauuauguacuaucuuguuuauguauuauuucuaaacaguuaaaaacaguaaauauaccccauucagggcucaccaaaaguaaccaaugauaacuagguuuuuuuguguguguuagaguauuacaucuuucuuuuguucuccaaggauaaccuuuauugauuuuuuggaaaaagacuaauacagucuuugucuuaaaugggucuguaacucaaguuugguuauagaguugaugaguuguagauuauugaauucuggaauaauacgcuauuuugauuuggaaaacauuuagguuucuggucucuuaacauuuuacagaucaucugaauuugcugaguauuuucuuacaaguuuuuucuuuccaauuuauuggcaauuugaguagagcuugaaugacuuugauucacaguaggggugcccuaguuuuuacucagacauucuccauucccaggaaauugcccuaagucucaaaccaagauugaaugugacccucaaaaccucuuggauaguuucggacuugccaucaugugcuuaccuccuugcauccucagggcgcuugcuguguauucugccuuugguauaccaaguggauugucuuacacugaguccccaugagggcaaggagccuauggcacagcagauacuauagguggaacaaagcaguccauuugugaaauuucauaauuccacauaauuucauaauuguuuggaaggcuugagaguuaaagguuugcuuaccucuucacuagcuggugcaaagguagauaacccucuccaucuuugauuaauaaggcagguaaaacuuaagggagguaagauuauucacucacucauucgugggagaaggguuguuugaaucccuucugugugcuaggcacuaaucuaggcacuggauuauagcacugaacucaccacaguuccuguuuuccuggaacuuuaguuagauaggagaaaagauagauaguaaacaaauaaaucccaaaguauacuguguaagguauugagucauggucauagaaaugaaugguaaagagcaaccuagcuguaaucauagcuguugcuauacuggcaaucuguaaagccugcgggauguucuggacauauucuggguauguuuucaucuuuaauccuccaccaaaccugugcaguagcacacuggcaauuggauaguuuuguaguuagaccaacguuaucgacauaguaaguggucgauuuaggauuugaacccagagcuguggguucuuucccuaaucuccuaauuguuccagucaucuguggagugccugcauuuucuagucucuguagcuugaaaggggauagugcuaauguuguuguaccucaagcagaggauggguacauuucuugauuacaaauaacaucauaaccuguuuccugugcaccucuuauauaccagugcagagccaguacuuuacaguccuucauccugagcuuuguuugcagaggguuaauggcuugcccaagguuucagaauaguuacuuagggagacuuuuaggaauucaauaauguauuuaaagggacccugggucuaaggguacgugugauuaucacuccuaacaccuaaucugauuuaauguaauacaugauuuucagacacacuacgagacccagguucacagcugcgggccuguccccccggcacugccgccugccugguaagaggacaccaggcguuugauguuggccagccccgggacggacugaagcuggugcgcaaggacaggucagucaaggccuccgaugcuguuggcguuuuuaaucuccagcaaggaccugacuuucagggagcugcaggaacauccuuuuucagcaaggcuugggauagucccugcagcauugcugcuucacauguacuuguaagauuguuggucauugcugugagucacauagucuagugugcuugucuacuuuuuaaucauuugucucuuacagcaguaaaaauacaucucaugauccaguccauaguacauaccuguauuugccucaugaaauaaugccuaucuuaaggugccaucugauauuuuucauucuguggcacccgugaaauugauuuuguguccauuguguucucaucuugggagggcaagagacaggagggacaguuugcuggugaccuucacugggaugugacagggaccuugguucccaguggggaaugguguuccuuauaauguguugugccguguacauaugcucuuguacugccuuuguaucuugccuuggcagacauacgcauuucucuaguguguugcacaugaccauauccugaacuucgaucaaggauucacauuuucuccccauucagaggccuuugguagacaccuuguugugcuugcucuagucuggagcucguggcaugucugggugguuguagggagcaugugcaauuauaauggcacucuguccaaagaaaaaacuugagcguaaccugaggggaaaaguguuuggaauuuucuaugugugugucuguauuaguuugcucaggcugccauaagaaaauacgauaggcuggguagcuuaaaccacagaaauguauuuccuacacagucuaaaggcugcaugucugaagaaggcgucaccggggcugguuuguucugaggccucucuccuuggcucguuagauggccguuuucuuucugugucuucacguggccuucccucugcgggggucuguguccgaaucuccucuucugauaaggacaccagugauuuuuuggauuaaggcccacucacaugaucuccuuuuuccuuguucaccucuuuaaaggcccugucuccaaauauagucacaugcugagcuauggcuuaggccuucaacauacaaauuuugaggggaaacaguucaguccauaacagagucuuuaagugacacauugguaauucuuaauaugaaugaguuugugugacgauuuaguaacaugugggacacugagcaagugugagcuucucuugugggaaaaggcaggucaucugugaucagcuauucucuagcaggcagccaggggcacugggcccuuuccacacugagugcaguaaacccugguggugggggccauguuggauggugguuugggugguggaagagaaccccaguucaguaacugcuguaacugcugggcaggugcugugggguuaagacaaaacaaaacuuuuggcuggcacuuagaauuuguuguauaaagaggaaaugauugacuagccuugugggcaaaaaugcaccuggccugcuugucugccuuuuuuuuuuuuuaauuuuguuaucucauuuacaaccguuuuuugcuuguuuuagucaaaugguguuucuuccuuuuuuuaaaaaaaauaauuuuuuuguuccuuuucucuuuccuuauucuaggacaugaagcagaucaaacagguuuuguuuuuguuuuugcuuuuguuuuugagaugggucuugcugugucacguaggcuggagugcaguggugugauuuugguucacugcaaccuccgccucccuguucaagugauucuccugccucagccuccucaguagcugggacuagaggcgcacuaccaugcccagcuaauuuuuguaguuuuaguagagauggagguucgcuguguuggccaggguagucuggaacuccugaccucaggugauccaccaccuuggucucccagaaugcugggauuacaggcgugagccaucgcacccagccagguuuucuuaauauaucaaauuuaugugcuggucacuuuagauauuugauuuuuuaacaaaauaacacucacuggaguuuacuuaaaacuuuuuuuuuuuucaaauggaaauaaagucauuuuauaccauaucuacuuuuauauuuuaauauuucuucuguuacccucuccucccccccaagugaaugugcugaaugcucagggcaacauaugaauuuggauguacuuuauacuuuuguaauacucuuuucucaauguggcucucccaggcuuguccugaguuacgugagggaagaggcaggaaagcuagacuuuugugauggucacagcccugcggugacuauuacauuuguuugcccgucggagcggagagagguaagugacucgucuccugaucacuaauguggcgcacaguagccuggguugcccaugcgaacgcguuucugggcuuggggcagggugggccuggaugcaggaagcugggagccaugacagaggcacugguggguucucaggagaagacaagcuuccugggauagcuucugucacaugcagcucacucagggagagcuguuugcauuuugccuuuugcuuuuuuacagcaauccggaggggccuccacauauaaugggaugguguuuuguucuagucucugugagauuauuuuaaguaguucacggacagauuuuuuuuugguaguuggguuguuuuagugaauaguggaaaaacgaaguagaauuucaagccugugauuucuuaugagaagccuuucccucccucucucuucccagucugccccuaaacccccauccaugccuucuccccucuuucucaucacaggccaguuuauugcugugcccucugcuguugaugaaaucuccagcgcagcuguaaacucuucgaguguggcugcugagacuuacuuguccuugagugcccagcgccugcaaguguuuuaaccaggggcaggugcugauggaaaggaggcgucccccagggagggagggguagggcagggcuuuccuuuaguuucuuucugccuucuuaguaauagggugaaguagggaggggcugaauucuuuugccagagaaccacacuccccuucccccaagcaaauguggaauuugcucugacgucaggcuggcagcuggccuggugugugugggauauggagacagugcagggcucagcuuuccacuuucuguccccagacuuccacaucaagugcugucagcugaaugaaggccggagugucugauguuuguucugaaugugaauggggaggaauauuuauucacacuuuucauuuguaccuacagaugugaguugaaaucuuuuaagcccagugagauguucucaggcgguagugguuuuaguguuuucccuuuuuauuuguucuacauuugguaagaaucauuuuacacugugagaaccaagagaauugggaguuuuccuccuuuuucuucgaagggguaugaggcauuucuugguguuagaagaagaggcugauuuguuauuaguggagcaagaaguucccucuguuuuuuuuuuuuuuuuuuaaagacagugucuugcucugucgccccggccggagugcagugccacgaucucacuucacuacaaucuccgccucccuaguucaagcaauccucccacuucaagcaauccucccacuucagccuucugaguagcugggacuacaggcaugugccaccacgccuggcuaauuuuuguauuuuuaguagagacagggcuuugcuauguugcccaggcuggucuugaacucccaggcucaagugaucuguccaccucggccucccacagugcugggauuacaggugugagccaccgcaccggccagguuucuuuucaagcuuaacuguucacugggcagaccuugugugacaugugcuuggacacuguaauacuugggagguuuguuuaagcauuuacauuugcucauugaaugauuuuaggagcugguauuuaguaaacacucaccuugucauauagaucauuuuaaaaaugcuuuauuuaauuuauuuauuggguuuacauacuguaaaguucaguuuuuuuuaaguacaauucagugguuauuaguauuuuuuuuuagaacugugcaaccaucaucacaaucuaauuuugcauuuccaucaccccaaaaagaaaccuccugcccauuagcagucucuucccauucauaccccaagcccuggcaacuguccaccuucuuccugucucuguggauuggccuuuuuuggauguuuuaugucaggagaauccuacacuguguggcuuucugugccugguuucucuuacggagcccuggggucugcaucaccaugugucagacugcacugagccacgugggcagaagcaucgauuaugagucaaacagaagaggguugggccugcagcucugcaacuuacuaauugugugcgaccuguuuguaaaccuggcaccuagugccuggcguguagcaggugcucagugaguauuuacggaaugaauggugcugggaagcagcacggcuaugcccggugcuaagcccaguaagucgugucuccuaagggugauuaaaaagcuggcagugacauuccuggugagcagggaccccaucagcccccuucauggcucacaucaaagacgaaugguggagcuccugcucuguagaagcaacacaauggcagaaucggguuugugucuggguggugcccuggcuucacccaggagcagguguggguacagauaugguggugcccaggaucccaaagggguuguggaccgugucucugguugugcacgcaugugauaauguucacucagugucaggguugcaccacuccaguugagcaccucguggaaagcggugaauggaccaugcacccugcacggccuguuagcgcuugccgauguccuagugauugccacgugccacugaguccaggugcuugcuggccgaagcuugagugucucucugaaggugacuagacuagaaagggaauagaguguaaagaggaaauggagguguuacgagucaaauggaaaaaaaauaacaguuuagaaaaaaauuaaaaguaacuuuacugaguuguuauaagucaaauaaucuuaauguguuagaggcaauuaugauucaaaaaacagaaacagcaaaauguagaaaccuaacaaccugucuuugagcuuuucauaaguguggaaaaucugcauuaagcugcaugaaacauuuuuuauuuugcuucuuucacauuguuccugauagggcaccauucccaaacucacagcuaaauccaacugccgcuaugaaauugaguggauuacugaguaugccugccacagagauuaccuggaaaguaaaacuuguucucugagcggcgagcagcaggaugucuccauagaccucacaccacuugcccagagcggagguaagcaggugcuuucugccuccuggcgcugcuuaggaagaaggggaucgagagagggaacgggacaguaggggccaagucaguccaugcaugcuucuggguuggagagagcuguaguuugggcugguguuucagaaauaggauucagguuugacuaaguaagacuguaaucuucuaauaccuauucauauaaaacaagccucuucuuguuaauuucccuguuuuuagguucauccuauauuucagauggaaaagaauauuuguuuuauuugaaugucuguggagaaacugaaauacaguucuguaauaaaaaacaagcugcaguuugccaagugaaaaagagcgauaccucucaagucaaagcagcaggaagauaccacaaucagacccuccgguacgucaacaaccucugugcgauuuuccuuuuucuuuguauuucuugagauaggguugcacucuggcgcccaggcuagacugcaguggugcaaucucggugcauugcagccuugacuucccugccucaaguaauucucccaccucagccucccgaguagcugggacuacaggcaggcaccaccaugccuagcugguuucuguaguuuuuguagacauggaguuuugccauguugcccacgcugaucuugaaguccuugccucggugauccucccacauuggccucccaaagugcguggauuagaggcgugugccuugggacuggccugcauaauuuucaagugcguuguguguauucuugugaaacauaacucccucuccuuuucuuccucuuuccauuuuccguaagguacgggagaaucaguuacuccagcauuccuuccuaguagacuucggcaaguugccguuugucacuaaacaaucaaauguuuuuccuggcuuuagaguaagaaugcuucuguuagaacuguucacuuuauaaacuugcuguuuguacggaaccuacuguaggaaaaguauuuaaugaguuuacaguugauaggguuuuuuauuuuaaaauucguuuuuaaggaguuuugauuuuucucuggcaguuugagaaucugaagcaccaucaacauaacagaaaauuuuaaacaacuaaaaaaaugcauucagcacauuucuuuugacccuuaacuugguaguugaccuucauaaaagcaggaugaaaaugcaguuuucugaaaauguguuaggggcaguuacgauucaaaaauuaggaacagaaaacugcaaaaaccccagaacuggucuuugagcuuuuuaaaagcauggaauaucugccgagaagcugcauuuuaaacauuuuauuuuugcuucuuucaaauuguucaggaucaguauaguccaaggccccucaggcacggcuguguucauggcggcuguuaagaaggcugucuaauucuugggcguuauuuauuuuguacgaaaucuaaaagugagaacaagagaagucuucaugcucacagcaaaaccuucggcacuuucuuccagccaguuacuacuuugaagcgagaggaugucaaguccauacauuuggaacucauuuccuguagauauuuuucccuagcuggcuagagagcuugcuguuuuagauccguagugauuuguugaugcuacgcaaaaggcuuaauguagacauuuaaaaagauucaaguuuuuuucuugguucucccaaacacauuugucuguguauucacaaaaaucuagauauucggauggagaccucaccuugauauauuuuggaggugaugaaugcagcucaggguuucagcggaugagcgucauaaacuuugagugcaauaaaaccgcagguaagugugcgcuggaguucagccccuccucuuugcauucaugggcaugugcuugugugugugcacaggcguguucuuggaagugaacacugaauggaggagucagaugcccuccuuuggacuggccagcucuagcccccagacuggguuuuuucuguuggaguaacacuuuccccacccccacugccccaguggacacacacacauccuguuuguguuuuccucgguuuucucuguuuguuuugggaaugggcccagcaaugagcuuguugggaaaguuuucaucuugaauuuuggugcacacuaaacuacagcaaggacagauucggcaggggcgggauggcuugucaauuuugauugagugaccucuucuuuuauguaaugaguaucaagauaauccuuuuugcaaaguggugacccuaugguagaguuuggaucuggggauugcagaaugucacugggugcauugaagcugaaggcgugcauuucucugaguaaugagaagcacccuugagucaccaaggcacuggcauaucaaaaagcggugccgcuguccauaucuugacgauuguagacacaguuguagcuguagagagaugaugggauuccgucaucaucagagaccugccccaucuguugacccccaggcugugacuccaggcacccugcagggcaucccaccacugcucagagcaauucuagggcccauucugguuuccagccuaagugcugccccacccagagggucuuucuggcccuugcuuccguguguucuguguguuuuucuacagcagagcuuuggguggcuugguuacaggauggguugcuacaggauucacugugggaugagggagaggcagcuggacaugaugugaaccaugcucucgaagccuccggagaucaggucugcguugggagagacaggcaccccugcccugguagcaccgcaccccugcgaacguccuagcaagcaggcaaagaaccagcccagggucuugccacugggaaggcuuucaagcccaaaaugccccaguaacugcuguuguggcaccugccccugggaugcccuuguucacaggucugccauugcuguccuuguucucuacauggccccuuuuguuacuuucacaauacacacauuuuuuaaguaccuauuugcuuaggcccuaugaggcuggaggguguugugaggauagauggcucucuagguguucacagacuagcagcagagagagauaaggagcaugaugauggagguucagggcagugcugcuagaguagagcgagugcuuaguguugucgcuccgcugcuuuaccaggagggaggcaccgaggucagcuggcuggggucugggcugggugcaggggucaggcaguucagagaggaggaagugcugccugagccacacuacauugaggagcaugccagucccguguugggguggcuuuagggccugggccuccagacauucaaaggcauggaccaggggaacugcgagcagguuagaggcguguauggggaauguggcugaagaugacccuggaacggugagugugcaguauuguaagaaacuuguauguccugcagaggagcuggauuauaucuggaaaucugugaagucccaaggauuuucagcagggguaugacauacaucugacucgugaaugagaaaaucaguguggccucuggauggaccucgcaucuggucugagcacucccugcaccccucagcuucuccaucauucucucaucgcccucaccuccuagccuaccuacgcuacuagccuccuuagccaugucugcacccugaaucacgucucuccuacuugguguccccaguccccagggaugcagccuguaucuuccccaugugcccagccccucugaugccugaccuugguucuggcucccaggucaccccaacuggcucuccuggacuccggcuggcucaggcugcucugcuguggucugaaucucccugcaacuuugugaugaccuccuuuggccuguucuguucagggcuuuuuauuaaugacuuggccgagaucuuugagagugugcugaucucauuuggggaugcugggaagacagaaucauuauccaaaaagaucgaaauggacgagcaggauaugagaagggcauuauaucguuucagacuuacagggaagagguguggacaucgaugagcugccaaccaaacaaaaaacacaggagagaaaaaccaaagaacagaaagaaagaaaaauagaaaaaaaaaagaagacccgcaguagaguggggagaucuugccuuguaguuaugagcauagaugaggccacacccucuggguuugguucccagcugcccuaguuuuuaguuaugaaaucaugggcccagagggagcuaaagcccagaugagcugaggcuugacaaaacgggugaaggccucccauagcuccauuuuuccuuuucauuauaaaaauuuucaaacauggaacauuaaaacagaaauuuacaugccugccacucugacagccauugauguuuugccagauuuuucauguaagccaugcgucauugauggcucauaucaccccacccugaugccaagaacgaacauuccuuuauguaaauucaguaccaucguuguacuuaacaaaauuaacagugacauccugauguuaaaaaacccauguuuuccuaggcuguuuucauuaugauuguaacaaggagccuggacagagagaugucagguguuuugugggaggguuuugagcuggcucucaggcaggaguuggauuaaaaaauacuuacauuuccuuccagcucuguaauucagcacuccaaacucugagagcaaauuguguacuguaaaauuaguucauuauuauuuugcucgaauuuaaacuuagaguuuuuggagaauaucccuugguagacucuguuuauuagauagauguauuuuugaaggugaacgaguguuaauuggcuauguaauagaagugugguuuaaguuggaucucuaggaauuauucaugugaaucuagguucauguacuuuucaggaugcaagcgcaucuuuuggucauaauauuuuuuaccaguuuaaaucuaguuuguuguaaagcgaugcuuuauuauuggugauuuuuuuaaauaaagauguuagauaauuuuuuggaagagcagaauucauuaggauaggcuaauaaacuacucacaauuuaaguggcucagcccauuaaagguuuauuuucuuaguucagugcuagucuuuggggauggggcuggggucgggggugcgggcucugcuccauguggucauuuggagaccuacgcuuuuuccauccuguguuucugccaucugcagaugugacuuccaggggcucugcaggaugggaacaucaauuugcuuuguuuuauuuuuuuuccaggccagaaauaagucacuuggcccagccugaauaucaggggaggcugggaaacggaguuuagcuaugugucuagaggaaaaauuaaacuaguuggguaagagguagcauuguuuuugccacagagaaaugggugcugcugccuccuccuuaggcagagagcuccuugguuccauuugaaaaccuuccuuccccuuuugcuggaauugagagacugaggacacaaaguggugugcuggagaauaaacuagagccuguggugccagacuggcaacuuggggauugugugagugagggagagauugugcagagcuaauccuaacauugcugaugaguggacagaaaccauaggccucaugaauagugauuucugaagucaaagcccaguaugcuuaaauaucaacccaagugguuugggagaggggagcacagcuuacuguucugcuaaaauucuuugaggaauuaaguaagaauacguguaagguacguagcaaugguuauuuacaaaauggacucugccugcagauuauuaguaugucucagauguaaaaccagcucaaaaguacuaggacgauuuguaguaguauuuaauuauuuguaaacuuacacguuuuucuucacguuugcagaauacaaaucuuugucaguagugaaaugugaaucuaguaggauuaaacuguguguaaaccuugugggcgggaugaagagaggcagaggcgcgucacuguugcuguuaguugaccggcaagcucaggggcccagcuaugguagcugccucuggguugucagcugcgcccaggaggugaagguggaaggcauuccuuaaagacaguggcuuaguguacuuauuaaaaaccaaaccaaaccagccaaccaaacaaacaaaaaacacaggagagaaaaccaaagaaaaaaagaaaaauagaaaaaaccccacaguagaguggggcaaucuugccuugugguuaugagcacggaugagggcagacccucagggucugauucccagcugcccuaguuuuuaguuaugaaaccauaagcaaauuauuuagccacccuaaaucugcaaaauggugcuaaaauuguaccuuugccaugggguuuugaggaucaaauacauuaauauagucauguguugcuuaacaauaggaauauguucugagaaaugugucauuaggcgauuuugucauugugugaacaucauagaguguacuuaacacacaccuagaugguauagccugcugcacaccuaagcuauaugguguagccuauuggcuccugggcuacaaguguguauagcaugugaguguacugaauacugcaugcacuuguaacacaacgguaaguauuugaguaucuaaauauaucuaaacauagaaaagguccacuaaaaauacgauacuauaaucuuuugaggcuaccguuuuauaugcagucuguuguugaccaaauguuguuaugcagcacguaacuguauaaagaaaguacuuaaacagagccuguucuucugcagcuugccuuuauguagccgaggugcugagcucagugccuggcugagauugugcucacuacagguuugccgcuguggcugguauuauaauuauagugaugauaauauuaaagauuggauagaaauuacaauugaaauaucauuugcucuugguacagaaucuuacuuccuguuuucuuagaucauuaccuagcuuaugauaccaaaccucaagaaggcagaucacauggugggaggcucagacaaggauuaugaaaccaucaggggugggaaaaggaguguugugcccacggaccccuagccuggaaaggugcagggauaggauuuccagcaaggagcaagucagcaaagccucugaaucucagcguccaugggauggggacguggccugugaagagcugguuuucagacuuaggccugaacuauuccugcugauggaugggaaaucuggguggcucacucuugguggaagaagaggcuugauuugaggaggguguuacagacaggugcacugacggaaccacagaauuucagcacuguuuggaguugugcugcuaacauuguggggcuggcauaggaccuuggcgugcuucacugggagcgacugacuauagauggcuuccacucuuguuuuacuuuagggaugagucccagagaacuugucuuguucacagucgcaucacuaagucagcagugcacagggaacuagagcuccauuucuguccuccuuucugugaguccccagugucacccagagauguucaggagccucugggagcugaccacagcccgggagcagaggaucccacucacugcucuugcguuccuccugccugcccuuuuaaucuuaucuuuggagaugcuguacacagccuucugucaaugucucccaaggugaaaggcaugcuggccugccaucgaggacuuaggguuaagcaucugaagcuuaauagaagccugugucaacucagauccccauggucucuaaaaaaaccuggaccugaauuuuuuaacggagcaguuggcauugguccuguucaguuucuuccuugcuccuuagcuguuccucaauuuuggucacguauggaguuuaaauuucuccucuugaauugugcagguaacgaugggaaaggaacuccuguauucacaggggagguugacugcaccuacuucuucacaugggacacggaauacgccuguguuaaggagaaggaagaccuccucugcggugccaccgacgggaagaagcgcuaugaccuguccgcgcugguccgccaugcagguacugcccuccuugccaugcgggucuuaguccacaugcucauggaacauuuucccaugaguacuuuuggaaaugcgguuacuauuuucuuugucaguggguugcgucacagcccucccccaguuuuuucauguggcugugugaauuauuagaaggagcauuggacugggaggugaaauaacugaauuugagaccagcauuuuugaccuuguguuuucacccuuuuacacacugccucucuuccaucucugaggugggaucugcagccucugcccccugggguucuucuguuuggauccucuaggcagauggaugugcaccuugggcugcuguucaccgcugccucagcgugcagugggcuuguacucgaggcugagcuugcuguugcacggcaggcaccggaugaggugccaaggaggcagcagcgccccccacagcacaaccccuguccuugggggccuggaauuuagcaggaaacagagcagguggaauaauaagaaugggagucucaagcagggauaaucugaugggggggauuucugguuuuacccucuuggcagcucaaauuagguguacagaagccaguugccucuguaagggggagaugacccgaagcagagagaaugacuugccucauguaauuaccacccagaacagucacagaacugcuggcgguauguucucgcucguaagugggaguugaacauugagaacacaugggcacagaggggaacagcacacaccauggccuguuuaggguugggggugaggggagggaacuuagaggauggaucaguaggugcagcaaaccaccauggcacauguauaccuauguaacaaaccugcacguucuccacauguaucuuguuuuuuuuuaaagaaaaauaaaacugccagggugacagcacugcugcuccugucuucugagucccaccugguuugcuaaauaccagguuagaaagaggaaucccucuuguggaguguuugagaaccugccucacugugaaccgccugggcagggagugcuggcagugcuguugugguuaaacacccugugugcugcugggaacggugccauaguuaauucuggcacaugugugcuagugaagacauugguuuucugugaaguggaaagaguucuagcugcagaguuggagaccuggcugaggacugguguugccgcauccaaccacauuugcuugagcgagcugcucuccaggcccggguuucuuacggugaacuggguggugcuguuagauuccuuaaguuaacuuuuuuuuuuuuaaacauuacuguguauaagagacaaccuaggaucuaugagauaaggagagauacauuuuucaaucuacagacuuccugacauagcucugguuucuuggaaucugcaguauuucgugguauuugugcguagauagcccuaaguaaauuaugaagggagagcuaaaaccauuccuuacugcuugaagaagucccuuaagacuuuacagcccaccuggcuccaccccagacuuccaguguuuagggcagguccuuguucacaugcacagucuuguaugguuucuuuuaggcuguugacauuggaaaguacuucuccaaauguacuguaucaccacugaugagucaugggguuuugccuuccaaaccccaguacccaaccugcaaagggagcauuuucaaaugagaacguguauuuuuauaucuuuaccuccuccuugacacacuuuguaaguuacuccuucagcgacuguucgccgugugguuugcuuuuuguggaugcccucgcccuugcuugcugugcuggugacacucagcuggugcccccucacguccugcaggugccuaaucagugucugaucacacugaccagcucaccagucuugugaguucagcggccaccugugguaccuugcuugucuucugugguagcaugcauugcauccugcacucagucugcagauguguaagagguugcugguuucuuuuagcuucacaggccuucacaggggccgagcgggguguauuagcaaugguguuaagcgggguguacuagcaaugauguaccacucuacugcgucccaagacacaggcuggcuucuugauuuggguuuucaguuucuaauuucauacuguggggcuugggagaauuuugccguucaguucucugucccccaguugggccuacucuucugaagaaguauugggauguaguuuguuucugucacauuaaaugagaaaccugagaaucucggugaauuuuugugcuuucagucugcccggguuccagaaacagcgcuggggauugagugacgaagugguuugggaacuuugagcccuugacuuuuggcuuaaucacuauuuauucugugacucagagaaaucagcauugcuuuuggcuaaaauacacuuuuguuuuguuacagaaccagagcagaauugggaagcuguggauggcagucagacggaaacagagaagaagcauuuuuucauuaauauuugucacagagugcugcaggaaggcaaggcacgagggugucccgaggacgcggcagugugugcagugggugaguugugccuggauggaagaucuaggugaugcuuuucuagggcauccaguuuggaaugaguuagaagaucuuucugugguucaucuaagccuccucuuucuauaaucacaugaaggaugguaaaaauuuuucauucauaacucaaaugucaguaauugcuugaugcacucuggaauccugaaguuggcuagagcucccugacaugggcuaaagccauaacugggaacagaaggaaccacguggaaaauacuacaucaucuuuuuaguuuguaaccugaagaauaacauugccaguguuuguguacaagugauuuuauuuuauuuuuuaacaacuuuauugccuagaaucguucaaaaguuauggcuugagugaaguguaaucucagcuguagcccuaguguaagaggggcuugcaugcuucgcuuccuuuugcugucauuguuuuggucccguagcugucaugcagagacuucucaauuauuugauacagguauuuagcacuucauuuuugucauuuaugacucacuuugaaaaugccaggcuaugagaauagugagaaucuguuaaaagcauucaauaaggaauugugagccucguuggauuuuaggaauuaucucgguauucagaauugcuggugugucuuuaaaagcagguucaggcauguccaugucuuuacuaagaaggacuuuggaacagaguuuuaauccuuuauaacaaaaagcaagugaacuaagaaguaagcggccuccugcuuggguugcuaaacagguuucguuaauuucugcuuuggauaugagacacauucucacccuuuggcuguguggcugugcuuucaaaagacuuugugucuugggguagcugaagcccugacaguaggggacaaugucaguuuacaguuggugcugaugcauguugcaagccauuuggucuuucuugcccuggaagggcauugugcauccuucauggcgcuuucuggcugaaccuauggaugacccuggaggaccccaauguggcuguuaaugucuagccaaacguggcacucuagggaaacccauccgcugccuugguggguucagggggcuggagaagggcugcacgugcuggguuugggcugauuucuuucuuucuuucucuuucuuucuuuuuuuuuuaagucacuucuuugucugcgugaugaucauuuuuaaccacaucuucuguuuucucccccuuucucuuccagauaaaaauggaaguaaaaaucugggaaaauuuauuuccucucccaugaaagagaaaggaaacauucaacucucuuauucagauggugaugauuguggucauggcaagaaaauuaaaacuaauaucacacuuguaugcaagccagguaaaaauuuuaaaaaagaugaaaucuuuucuggcuucugccagagguccugcauucuucauaucucuguuccucaucagucacugcaaagcugaucagacagauuggcaugguguucagcauuuugaguuccagacucuggcgaugggagauaggucauuuggaauuuuucccucauccccuccucaaaaccaaaucagaaauggagaaaccagauggugucagaagggaguugugggucucagcgcuguauccucuuccucgggacugauacucggccagucaugugguuacuuaacuuccuucaaaggggaaaaaaaucauaaaugguuuaaaacauugcccgugaucucaccacuuaaacacaauguuaauuuucauuaccuuuauuuauagauguauguuguuuuuaccaagucaaaauuuuuaugguaacaaaucuuaauguuucucaaaguguaguauuuuguaaauacuuuucuauguuucacaguuccauuaauaauuuuuaggaacuuccuuguugacauggugugguuuuacuauuuuugaacauuuuccuuauuguuggauuaauagcgcguuuccaguguugcuaauugugcuauuauguauccucucucuaccucccauugaaauauuuccuuuggauaaguucccagcugugggauaaagucagaagcuagggucauuuuguuuguuuguuuuauaugguaaaauauacaacauaacguaaaauguaccauccuaacugcuuuuaaguguguagcuuggugacauuguuguguaauaccaccaccauccaucuccagaacuuuuugauccucccagacugaaacucaguucccauuaaacacgagcucuccauucccucucuucuacuuuuugucucuacggauuugacuguucuagauaccucauauagguggaaugcuacaguauuuguagggcuguuuuuugacccuucuaugcauuauaccucauuucccacugucccuuccaagucuacuucuagcagagaagaaugagguaagauauuuuaggaaugaacggauuagugauccccaucucuuuuccccauugacaggugaucuggaaagugcaccaguguugagaacuucuggggaaggcgguugcuuuuaugaguuugaguggcacacagcugcggccugugugcugucuaagacagaaggggagaacugcacggucuuugacucccaggcaggucuguguccaagcaggaccucugcuuuaaugugacuuggaaccacuuaagguuuuuuccuuaacauucugugugagguuuucaaggugacccgccuuagaauuuuauucaugcuguuugaacaaaauucugaacauccgauguuugaggcuuauuugagauacugaaaauacuaucuuaaauucauuauugaggugguuuugcugaaugcaaaaccuucggaacacaagggaauaaauuauguuugaaaaggcuuucgugugaauucuaggcaagaaaccucucugagggagaccuuacaagaaggccauaauaucaugcucguccuacuuugaacaugcuguuguuuauuagcccagcaguuaugggcuuugaauagcgcuuuaggcuaacccaguagaagggaaugguggaguuggauccaucuccaaggaaaauguuaguaaucgcgguucugguggccucaaggggcagcgucucuucugccuccuccacuucuuccugccguugggaaccuccugggaagaaccucucccuuucaaacuguggggugagaccacucuguuaacugucggacugaccuuccauacuuuuauuguuuuuauucuuucuuaggguuuucuuuugacuuaucaccucucacaaagaaaaauggugccuauaaaguugagacaaagaaguaugacuuuuauauaaauguguguggcccggugucugugagccccugucagccagacucaggagccugccagguggcaaaaaggcaaguagcuucucaguucuguuucauucuuaggcauuauaugcuaagaaauauuauuuucaggaauagguguguucucacuuaaugucauugcuuuaugacaagcauuuaaauacugaugagaccuggucugaaaacugaaggauguuaggaguuuaauuucccagagaaaggagcaggcccauccuugggaaagaaggguggauugagguuaugccucacuauugcgcauuuugugcuucucagugccuagauaucucugugcguauuucugcauucugcguaacugcaguucaaaugaagugaguugucuaaaccagcggugccaagaggagauuugggucccaguguuccugcugccguuggagaccuuguguggguuccuguggucugcagcccgggccugguucuggugacuccucacgucgcucacgggcccucccuucaguguggcagccuuggagugcuucugccccucaggucuuugcugagagaaacguguguuuauuucagugaugagaagacuuggaacuugggucugaguaaugcgaagcuuucauauuaugaugggaugauccaacugaacuacagaggcggcacacccuauaacaaugaaagacacacaccgagagcuacgcucaucaccuuucucugugaucgagacgcgggagugggcuucccugaauaucagguaggaauguuuguuccucaucgcgcucccugaggauacucaugccuguggugggccuuucauuuaagcagagcuuguaucagucuggguuuccagccaaaucaucaccgucauuagauuugccagggugccugggcaguauuaguauuuuaagcuguuuauuuaguggguugugcaccuuaauaacagcccacaagccugucaguuuuggguacaaaacauacaaaagcauaaaaaaaaauccugaauuaacccccacuuagcagaggcuaaauuuucauccugauuuguuacuggacagucuucuuuuuaauaaaaugaagggagaugggcagacuaagcuuuucuucacaguuucucauugggaacauugcucucguccuuuuuugaauccugguuuuaugucacgugucuuucucuuuuugccaucccuccgcgcaucugccguggauuaggaagaggauaacuccaccuacaacuuccggugguacaccagcuaugccugcccggaggagccccuggaaugcguagugaccgaccccuccacgcuggagcaguacgaccucuccaggugaggcagagucagcugcucuguuuuuggccugguacagaugcugagguugcaaguguugcuggugagcgugugacugagcugaugauggggagugaugcuggcuguggggcugcaggaccaagguggggcauuuucagcagagugaauucuaauaacugucuggucgccuuugggauagcaaccagucuuggccacagcagagccucggccuuuagcuucaucauuuaaaacaaugacugucagugcagaggcacgggggacaguuaagguccacugcauacugaguucagcgaagguggaguguaauccuggugcgucaugcgcccagacaagccaacuccugguagugugauugguggagcauguuuuauuugguagcuuuacuuccccaacuacauagaaauaaaugagacugaaauguguaagcucuuuaaaagcauauacauuuugcuuugaaauuuuagucuggcaaaaucugaagguggccuuggaggaaacugguaugccauggacaacucaggggaacaugucacguggaggaaauacuacauuaacgugugucggccucugaauccagugccgggcugcaaccgauaugcaucggcuugccagaugaaguaugaaaaagaucaggugaaucuguuuucacugcuugucuccuuugcccuccuaauuccaugacuuagugggaggaggugguuauucugggacauccagaucaaaggcagcacagcugcucgagagaaacccucugaguaggaguggggccuccaugugaacucaucugccuccuguaggagcagaagugugucacacaggaaucauuguucacauggagaaugcuguguugcagacuuuugaucacacaaagggcagaggaagcaccgaaugguuaugucuagccugaauucaaaagugucuuuaggugcuuucagcagacaccugugaaaaagagaguuuugcuuccaaaagcucuuguuucuggauugauuagggggaaaaaccgauuugggagaguugcuguggaugaaccagauucaagcacacgcucucauucgcugcaguucgucccuggguugaaugcagucaccgccagaacauuuacccgucuccuguggucguuguacguggugaaucuuaaaagagaugucucuggacaucuguauuggcuucuguaaaaauagcauguugggaauguacuuuucuugguguaugcuaauggcagcuuggagguuuuugaaaggaagguggcaagugugcucuggugguuaggaaucgaguuccugguuguguuuaccucugcacauguguguucuuuacuggagcaaugaguucaguguauagucaguccucuuuauucacagauucugcaucugugaacuugccuacuugagaacacguguaacuccaaaaucaccacgcggaacacuuucucagucauuguuggaacgaguguaguggcccaaugugcauaguacccgacaagccuguuccugguugaaguugaacagggggacacucuggccucuuguuucugccucacccugagaugagcaggggauggagagggcgaggcagugcagugcaaaagcuccagcccuggggccaguuggacggggucugaauuccaacucuggcaucucaacucagagaugcuccagagcuggaacuuccgcgcugcacugccugguaaggucucccuaagagaaguuucuugccuagaauucacacuaaagccuuuucaaacaugacuuacucccuuguguucggaaaguuuagcggggcagccuuaggugagccacuuaacacuccuuaaccucguuuuuccuucuguaaaauaaagagaguagaaucugucagcaugaguugucuugggauuucagauuuauaaucuguguguaauagguuuguuugccugaugugcggccagucaguacgcugagacauuggggauuacagccgagaaagaguuuaauuguagggcaggcgaaugaggagaugagaagaaaccucaaauucaccucccuaaggaauuuggguugagggacuuaagggauuuggagcgggccaagguguggggauuguuuauugguagaagagugcagggugaagucaucggauggggagaugaagaaacugcauuugguucccuguagggaggucuucauagugguuagugucagccguuccaccggaauucaggaucugaagaacaucuuacacgauuauugaacgaaagccuuaugauuccaaugccagugauucuuucuguagcaauaauggggaugugacuaguaucuagugcuaugugacuuucaguuacaggccagcaugcagccugauuggugcucaauugcaugccuggaacgcagcaugcaguuguuguuaacucuuugaggaugguuuccuauuccauauguaauaaggggauuuccccaggagcagugguucuguauucaauaauucauuguuugcugcagcuuuauagaauguaaccaccaccaauaacgaaucgacuguaucuucagggggaaaagccuaacaagacugguuuucuugcagggcuccuucacugaagugguuuccaucaguaacuugggaauggcaaagaccggcccggugguugaggacagcggcagccuccuucuggaauacgugaaugggucggccugcaccaccagcgauggcagacagaccacauauaccacgaggauccaucucgucugcuccaggggcaggcugguaaggcacugcugcuggcuggugaccuucacugcugcauuuuuugacugagcguugccuuaugugucucuuaacagcagcagucuugggguggguggcggagcuaggccagucuuaguucugcuuaaggucagugugcgguauauauguucacaggcagggagugauuugugguaccuucauggcugcgauuucugaaguguaagccucaucuuuugcugcggaguuugaggcucuggugacauacacuguuuccuggauuuuuuuucugagucguacagacauuaucuugccucuuaguucuugugaguugaggaucguggcaguggaacggggcuuagagauaguuugguccuguaggggccaagggaaagcuucccuuucacccuuugaaguuucccugaaaaucagcugucaacaggagaaaagacauuaaaauuuugacgugcauagcaccggggaauaaauagcaggagaaagaugacccaguagccuaaugcaacacagaagguuauguacccuauuucacaggggagagggagauaggggauguagacaguucuuuugacggggcagcaaaugauuauuugggagaaagaauggacagaaauuaacuugcaaaugauucucuuuggagccugaaugaggaaggcauuaucuugugcacaagucuguccaggugugauugcuguccucagucuucuuuugugggauagauaaugagauuuccgaguuucuuuuggaaagaagccuucuuggucagguaaggaaauuccagagaaagucucucccugugcuugaggguggagguaacaaggcacgguucaaaggaugaccuugauucucaggcagcuucucagcaugucaaagcacugauccuugggguauugcuuucugagccccagcaguccaaaccacaaagaccacagauaggaaucugaggcuugguauagcucaggccugugggugaacgaugagggcuguauguguaauacaaaacaggaauaagaaauuaaggcugagggcugggcacagugguucagaucuaacccagcacuguggaaggccaacaugggaagaucacucacuugaggacaggaauuggugaccagccuaggcaacauagugagaccccaucuacaaaaaauuuaaaaaaaaauuuagccaagugugguggcucaugccuguagucccaguuacucuggaggcugaggcaggaggauuccuugagcccaggagguugaggauucagugagccaugauugcacugcagccugggagacaaagcgagccccugucucaaaaaaaaaaaauugggaggcagagguaggaggauuguuugagcccaggagucucagacuagccugggcaacuuagugagaccccaucucuacaaaaaauuagccaaguguggugaugugcaccuguaguccuggcuacuugggaggcugaggugggaggaucacuugagcccaggaggcagagauugcagugagcugaggaugugcuacuauacugcagccccuuggcaacagagcaagauccuguuucaaaauaguaaucauauaaacaacuucagcaaagucucaggauacaaaaucaaggugcaaaaaucacaagcauuccuauacaccauuaacagacaaagagagccaaaucaugagugaacucccauucacaauugcuacagagagaauaaaauaccuaggaauccaacuuacaagggaugugaagaaccucuucaaggagaacuacaaaccacugcucaaggaaauaaaagaggacacaaacaaauggaagaauauuccaugcucauggauaggaagaaucagugucaugaaaauggccauacugcccaaaguaauuuguagauucaauaccauccccaucaagcuaccaaugguuuucuucacagaauuggaaaaaacuacuuuaaaguucauauggaaccaaaaaagagcccacauugccaagacaauccuaagcaaaaagaacaaagcuggaggcaucaugcuaccugacuucaaacuaugcuacaaggcuacaauaaccaaaacagcaugguacuggugcaaaacagauauauagaccaauggaaccgaacagaguccucagaaauaacaccacacaucuacaaccaucugaucuuugacaaaccugacaaaaacaagaaauggggaaaggauucccuauuuaauaaauggugcugggaaaacuggcuagccauauguagaaagcugaaacuggaucccuuccuuacaccugagacaaaauuaauucaagauggauuaaagacuuaaauguuagaccuaaaaccauaaaaacccuagaagaaaaccuaagcaauaccauucaggacauaagcaugggcaaggacuucaugacuaaaacaccaaaagcaauggcaacaaaagccagaauagacaaaugggaucuaauuaaacuaaagaccuucugcacggcaaaagaagcauggaugaagcuggaaaccgucauucucagcaaacuaucauaaggacagaaaaccaaacacugcauguucucacuuauaggugggaauugaacaaggagaucacuuggacacacgguggggaacaucacacaccagggccuguugggggcugggggggagggauagcauuaggagaaauaccuaaauuaaaugaugaguugaugggugcagcaaaccaacauggcacauguauaccuauguaucaaaccugcauguugugcacauguacccuagaacuuaacauauaauaaaaaaagguauuaaaaauaauaauaauaaaaugaauuaaggcuaggagguagaggaggugagugggauugauguuggcccugaguuccuuagccaggggacaacagcagacuguguggaguuugcucugcucuucucuccauggaaaugcuuuggggccauuuuauacagucccaauugcuucuguuuuuuaauugggguaaaauauauauaacauuaaacugaccauucugacugucuuuggguuacauauauuauacacaucucugguguccuguauuuaucaccaguauccauguccaggacuuuuacagggucuugcugugucacccaggcuagcguguaguggguguaaucauugcucacugaaucacugcagccucgacuuccugggcucaagugacccugucaccucagccuccugaguagcuggaacuacagguggaguuaccuguaguuaucaaaaugguuuuuaaauuuuuugaagagauggggggucugucuauguggcccaagcuggucuuagaacuccuagguucaagcaguccuccugccucagcuuccuaaagugcugggauuauagguaugagccaccauacacagccuagaaguuuuuugauggucucaaaucuaauuuggaaaggagagcuuuauuucucauaaagauuugcagccugcaggguggccauuucugacaggcugggaaguguagccucaggccagaagccagaaacaagcgcugggagggaggaagacuaagacacgaauggaugcugaacagguuagucaaguauacauauucagcagguuacaggagcagcuaugcauauucacgaagggauggcacacacaugcgugguaggcaacauguaugcagcauguguccccauguucauuuuggguugaagacauaacauuuaaauauauuacaguugggcccuguaugucgaaaggugaagcagaggacaugaaggcccucugugugcagccuccuuagaaggccaggaccaccugggaguuguggucucuuaucagcagggaaugcuggucgauuguuguguugucagaaccacaaaaagggauggacguugucaggugguagguugauaccagcagcagagucuuucaaaagggucggcuucuguuuagcacuuagggaagaaagccuagugguuaacgaggaaagggguguaaugggguaugucucaccucccaccccgucauggacaggaaugcaauuuuuaaguuucucuggaguccccuuggcuaagagugggguguguucagucaguuauggggcuuaggauuuuauuuucauuucuuauuaccuguaguuuuagguuuauaccagggucauguguuuuugagaaauuaucaaaugguuaggagaguggagagacuggaagccauguucauuaucaacuaaauuauuaacaaucccuuguuaaggguguguggcagcuuccucaagccccacugaaaugagccagcaggaugcguucuuucccugcaguggcccaguggacgcugcgucacucaccugccuggucugcuuugucauuggcuaacacucuuuuuccugagagacacuuccuuuagaguugaagaucucggugaucagggaaugaaugacgggcaggcugagcuuggcccaugcucucugcgggagguguucuacccagguuguacacacucuccuuggguucaccugagcuugggccgcccacuucuucucucagucucaggaaggauccagguuugguguuccacggggagaugccuagguugcccaguucagccugcuggucuguuuuugggcacaucugugcauucccugccuguggacugcccccuccuucucugguuucuuguugccauugagacacuggguaguuccagaaaguucuuggacccuugguuuuccagcuuuucugugauaccauauuuaguuuacaggguagcuucacauuguugucgugucucucagcacucauauagggccugcagcacaggaaauacacucacugaaggaagaaagggccgcucucccagggguuugcagucacagaacuuucacaggcuaaagcucagucccuuucacaagcacauugugaaguggaaggagcagguguguuuuuauucuacugcuaguguugcugaggccuggagugggugggggcuuucaaggguagagagcccuugacggccaaggguguggacucaguguuaguggcuguuguuccugaacccgugacccugggcaggugucuuaacuuccuugugccucaguuuucucauuuguaggcuguguuugugggucacugugaggcgcaguugagaaauacuaacaaaacucauagugcaguccuggugugugauaaacacucccugaucggcagcuaccauugccuguguggugguggugcucucacaaagcuaauggcucuuugggggagcuuuuuauggaaacauacacaccgaagggcacacagaugauaacgugacacagcugggugaguguccauaaacuacacaucaagaaagaacaugcuucccccuaggagcccuccugugcccucuuccugccacugcugagcauccuccugaccucugacagcgcaggccauuguugcccaauccugagcugaugucagugaauccuacguaccguugccuuuguguauggcuucuugcauucaacuuuuuguguaggguacuuuucagaaccuugagcucagaccuagguuuggaucugaauucuaccauuuacugcuggcacgauuucuauauuucugaauauccaagcguaggagauuauuuugucuucauagggagaaugagaacauuaaauucuaauuagguaaugcacauuaagugccuagcuuauuggcugacucauaauaaacaucuagcagauuuuggcuauuuuuaugucucaggcgaguauucuuuugguucuaucaaguuccauguuacuguauugacuuuuacccuggauuugcccauucagaacagccaccccaucuuuucucucaacugggaguguguggucaguuuccuguggaacacagaggcugccugucccauucagacaacgacggauacagaccagguacgugugcuuucaccuggcccucgugcugagcugccugcuggacauccucaacucaccccaguguuccagcucugaaccgaccccugccccuucuuucugaaucaguuacuauguugcauugacaaugggugucugcaggucacccagaguuccucuccacuccgcagcucccagcuccugggauaagaaccaggucccucagucuuacucucugcucacuguaguuuccuuccuuuuguuuccauuccuuugugccuuccauguggcagugguauccuggugggcucuggggcuucugcaccaccggcagaugucugacuagucgauacgucacuccacaccuaaaccaucucagugccuguccccuagaggguagagcccguauguuuuaaugugacccuauccauagagcacagccugcagguguuaaugugauccugucuauaggguaaggccugugugucucucaccugugcauaggccagagcccacagguguuaaugugauccugucuauagggugaggcuugugugucucaccguggcccuguguguagggcaaagcccacagguguuaauaugauccuuucuauagggugaggccugugugucucaccguggcccugugcauagugcagagcccacagguguuaaugugccacuugagucucucagugccuacuggcuccucccgccuucugcccggguccaugcccuccacuuguugagugcacccugcagggcauaguaguaagcugcucagugacguucucucugaccuccccaagguagugaguuguuuucacagcaccguguauauuucuuuauggugggaccuguuugccuucccacuuccuguucuaagcuacacugcagacucuggcagcagagaccaaggcuuuuccaaaccaacggccccagcacaggguccuggcuuuguaacugcucagugagggcaggaugccaggcacccuguucauggacaauguuucuggggcuguggccaccgucuccuucccugcauucaguggacagagggaggcccagggcaaaguuaaauauggagaggagaggauaucauuugacagucaccuggucauacuucccaugauuaccuuaagggaauaauugagacagaaaacagaacaugagauuucuuaagauguuuauuuucuuuaagaaacuaauuuaugagucuuauauuuccucuccaacuuuagggaguagcaauagucuucuuagggaaaugcaguagccuuaacagcuuccaggugaguguaauuucugagucugggcucacacuugguauacuucagggugguguauuugaagaggcuacauguagggcuacauuuuugauagggauuuugaaaguaaauggagaaacaguuuugucaggugcauacuugcagguuucuggaggugcuguauguauguuauguuccuguggaauugguuugaaugcgccccuuuuuccccauuuuguuuccuguaggcuugcucuauaagggaucccaacaguggauuuguguuuaaucuuaauccgcuaaacaguucgcaaggauauaacgucucuggcauugggaagauuuuuaugguaagagcgauaugaugcauuuccaguuugcuuugaaacagggggagagugcauuauugaagucaccugcacguggugauaugagagaauugcccaggccacugugguggcagcucuuacucagaaggagaugggaaaauccagauuuaagggaaagaugaaguaaaaccauuuaccaccauucuggcacaguucagacgugaagacuguuauucuucaaauaauaaguuguucucuuuaaggaaacacuuucuaaagguagugcugaagccuguacucauuguccauuggucucuccuuacuguaucuucacaccagagagcauaauugacuucauuuuuacaacuauaauauaauaauuuuuaauggaauaacaaauuuaagaaauguaggguaccacuuuauauuuacuuguaauuaacaugauuucaaugauacauacuuucucauaauugaaaauauuauaacauuaugacuucugugucuucccucucuuauauaugguacauuauuacaugcaguagaucuuacacauuuauagauacggggauguaugaauuuaaaugauguauagauacuaaaccuuaaaggcaguuuauagauacugcccuuuggacuuauguacuaacuguacuaacaugccagaaaguggaaaguuggcaaguuaacuaacaaauaagaaauguuuaaccuagugggauuuggaguugcuaggguucuugucuguggugagauacgaggcauaaauuuguuuguauggcucuuaccgucugaccugcaguuuaaugucugcggcacaaugccugucugugggaccauccugggaaaaccugcuucuggcugugaggcagaaacccaaacugaagagcucaagaauuggaagccagcaaggccagucggaauugagaaaagccuccagcuguccacagagggcuucaucacucugaccuacaaagggccucucucugccaaaggugagcucagagccauguuguuuuguagcuaaaaagggcccugguggcucuguggcuggccaugcaccuuccugaguguaggaugugcacaucccccgccaccaugggcugugcuguccaccuugcugcaggagccaucacgguggucuuccugcguuugaccucgcagaauacaggggucccguuauccguggcuucacuuuugugguaucacaugguccgaaaauaauaagguauuuugugagaaagaaugagagaaaccacauucacguaacugucauuacagauauuguuacaguuguucuguuuuauuguugaucucuugcugugccuagcuuacaaauugagcuucauccucuguauguguguauaggaaacagcauaguauauauaggguucucaauuucaggcauucacugugggucucggaacauauccccccgcagauaaggggggcugcuguagccuguauucaacacagcagucagagugauguuucugaaacaucacaucauaucacuucccagcucagagcccucggaggcucugcacuguaccuagaguagaagccaguguccacaguacggccaugggacgcccgugggggcucucugagaugaucacccccugcugcucuucccgcuuggcccgcuggccucccuguuucugauauaaacaaagugcacugucucccacccuccccucuugaaucuuuguacuugcuccucgcucugcaaccagcacagcugcaggcagggguuuucgucugcuucauucauuccgauacaugguaggaacuuaguauuuguucaauaagccaacgaauuagaguuacauugucuucuaaugcuuggauugguaaacucgugggauuuaaauauuuucuggaagaguaggaaugccaggauguuaggcuuaugguagaaaccugucauaacauaggccgcuguugcaguguguaaagcugucaucacauaggccaccauugcagugaguguguaaaccugucauaacacaggccaccguugcagugaguguguaaaccugucaucacauaggccaccauuggagcgaguguguaaaccugucauaacacaggccaccguugcagugaguguguaaaccugucaucacauaggccaccauuggagcgaguguguaaaccugucauaacacaggccaccguugcaguguguaaaccuguuguaacacaggccacuguugcagugaguguguaaaccugucauaggccacuguuguagcgagugugaccacuuuguucaugucgagucccucgauacacacuuggugcccuggugucauugcucccacgaacggcugugaagcuuguugccaguggcagccuuguccuguugcugcacugugcuugugggcugcgccaugaauacuguucugucucuuaaaaucugggccuucuugcuuuacagguaccgcugaugcuuuuaucguccgcuuuguuugcaaugaugauguuuacucagggccccucaaauuccugcaucaagauaucgacucugggcaagggauccgaaacacuuacuuugaguuugaaaccgcguuggccuguguuccuucuccaguggacugccaagucaccgguaaggccgugcggccuaagaacugagaggccggucaagagucagugugugugugaguggauaugaagguguguuucuguguguauguauauuugugugugugugguguguaugcuugguuaugcaggcagcgugacauuucuguuauauauucucuuugaaugaugccuagaguuguaauguuuuucuugaagagaaucugacuauauaguuaaugguuuuaagcuaucuuuugggaucagauacaucuuaagaacagagaagaaaaugcagaggaaacacauuucacauguacugucagagcuucuuauuugagggugaaaaaaaaagaaaaagauguuaaacucccuaagcugugcccuggaagcugacaguguauacaggagaccuugaccucugggauugacccugccugcucugcaacagugguacuuccuugucaagggcaguggggguuuggcuuuuuucuuuaaagagucuuuagggacucacuauguugcccaggcuggccuugaacuccugguccuaagugauccuccugccucagccuccaaaguagcugacuacaggcgcaugccaccaggcccggcugugaagggcaguuuugagggacagaguggguguguuuuguaggcaaagccucucagccucccguggauuuccuuauccucacaguuaggaaugccagguucacgccuccucagggcuuauuuagggugaaaggcaguucuugagugcucacaaggaggcagaguucuccagcgugguuuuuuguuguguuucagaccuggcuggaaaugaguacgaccugacuggccuaagcacagucaggaaaccuuggacggcuguugacaccucugucgaugggagaaagaggacuuucuauuugagcguuugcaauccucucccuuacauuccuggaugccagggugaguucuccuuggucucuugauuggcgucuguucauuuuauuagagcauuugacucaaggucaucgccuuccucaugcccaaaccacuuauucuguucuuccaggcagcgcaguggggucuugcuuagugucagaaggcaauagcuggaaucuggguguggugcagaugaguccccaagccgcggcgaauggaucuuugagcaucauguaugucaacggugacaagugugggaaccagcgcuucuccaccaggaucacguuugagugugcucagauaucgguguguguucagaccagcaaugagauguuguccccgggugacuccauuucccauuucccuugaaccucugaaucuucuaucuuguuuaaaacuugccuguguuuucguggaguuucagccauugcuaggguuugacgagaaugcacucauuucuucaggucuuaaauguuuaauaaauguuacguaguuugcacauggaggucaaagauuggguacuaacuguggcuaucauuuauuuaauuuuuuuuuuuuuuuuuuuuuuugagauggagucuuacucugucacccaggcuggagugcaguggugcaaucuuggcucacugcaaccuccgccccccagguucaagugauucuccugccucagccucccgaguagcugggauuacaggcaccugccaccacgcccagcuaacuuuuguauuuuuaguagagacgggguuucaccaucuuggccaggcugaucuugaacuccugaacuugugauccacccgucucggccucccaaagugcugagauuacaggugugagccaccgugcccggccccauuugauuaauuuuuaaaauaaacaggaaacaaaucaggcugcugauuuauauuacagggcucaccagcauuucagcuucaggaugguugugaguacguguuuaucuggagaacuguggaagccugucccguugucagaguggaagguaggacugggccugucccuacaagucauuuuaaauguauagaguagcagacguucugaacgaugccuuagauaugagaccgugugauaacagccauagcuggggucaugagacacacgcuagggggaggauaauuucuuuuccuugagcuuuuuuuuuuacugaagcauauugcuaauuucacgagugacauuuuccuugugugccuggauugaugggauuuuggcgucugaugcuugaagacacuaaugugggguuugguuuuguguuguuugaugaagcaagucuuuauucggggaccuagacuuuccuagaaagcuguuugccaggcgauuuguauuauauauaaacaaaaucauguggaaauggcuuuuaaugcccauuuauagcugguauuuaccuaaccaaaaauuguaaaaguuuuuuuuuuuuuuuuugagaccgaguuuugcucuguugccaggcuggaguguaauggcgccaucucggcucacugcaaccucugccucuuggguucaagugauucuccugccucagccuccugaguagcugggacuacagggugccugccaccaugcccagcuaauuuuuguauuuuuaguagagacgggguuucaccauguuggccaggauggucuagaucucuugaccuaguaauccacccgccucagccucccaaagugcugggauuacaggcgugagccacugcgcccggccauuuguaaagcuuuuugcuugaaaaugugaaugcgugugugguugcaguugcccuucacuucuuccauguucuugaaggggacaacugugaggugaaagacccaaggcauggcaacuuguaugaccugaagccccugggccucaacgacaccaucgugagcgcuggcgaauacacuuauuacuuccgggucugugggaagcuuuccucagacgucugccccacaagugacaaguccaagguggucuccucaugucaggaaaagcgggaaccgcagggauuucacaaaguggcagguaccauuguuugucguuuuccuuuuguugcaaaggaauggaauuaaaauauuaaaauauuuugcugaagaugaauuuucccuugagucagaaacaugaguguucuacuguaaaaaaaaaaaaaagcauauuaaugauauuucggauuuugcuugauuuucuuaaacagaguacauacugaaggauguugguagagcaugucuauuuuauucuuaguuagccaugccaguuacugacucuaaggucauauuucucuucuuuauuacaacguugggacacagugagcuagccaguguuggauguucugggguaguacuugauagcauugagucacagggaaugcauuuaguacgagguuuggcuguagaaauuacagggcacgcuguuggucauucaugcuguuucagcaguugggcaagauuuaaauacauuuaggaacuuguaaaaaugaagucaaaguagcugguggugaguacguggacagcccucaggcacaguggagaaagugacauucccuuaggugaugaggcuaaggaaugccucaugucaucauacacgggucagucugugacguugcagcagccuuggacaaggggaagccugauuuuauucccaaaguguaaugugacaggagugcaugguauggugcugggaggccagggauacuuugucucacacucuucaggguguguggugucacaugucuuaggcuaaguuugacagccuagggacccgaaccaaaccuuguuuaauguucuccuucuuuacaggucuccugacucagaagcuaacuuaugaaaauggcuuguuaaaaaugaacuucacggggggggacacuugccauaagguuuaucagcgcuccacagccaucuucuucuacugugaccgcggcacccagcgggugagcauguaccgacggcccucagcggggucuucuccccacccucaggcugcugggaucauauuagaaagaaucuguccucagaucucaucaaaucuccugguuaacugaguuuaaaauaaccauuuacagaaaauauguugaaacuuucaucaguuaguauugauuuucaugaacguaaccauucuuuacuauuuucauucuuaaaacucaaaguauaaacuaaaguuuugcauucucacuuuuauauaugugccucuuaacuuuuuuagccaguauuucuaaaggagacuucagauuguuccuacuuguuugaguggcgaacgcaguaugccugcccaccuuucgaucugacugaauguucauucaaguaaguccauggauguguugucucuuuuggacagacuaacuugguaugauuuugcuuuaauaauuaguggucuugggugcaggggauuagauuagucaguuaauuuaccuaggacucgguuugcucauauuaaaaugaggagucgggcuagguuaacucucagcuccgucaccaccuggagcugcuguggugacugcauggggaagggauuggagcugaagcagagaguggaccccuggcacucuugcgugauccacaugucagugagcagagugggccaggagcgguguggugaccccugcgaugaagggaggucuucguugcaugugaucguccacagagcugcucucaacagcuuugccagaucgcccucuggacaccuggggucccauccuuagagauuuugguuuugugggucugcgguucuguuuuuuggagggaugcccuguguucugccgugugaaacacccaguaugagccacuugaucacuguugacuuuccugggggaaagugcaggugauucuguuuccuuccggccuuuguccuguugugucaucgguuauuuauguaggugaaaucaucauuuaaguuuuaggaacguauguaaaugcaagcauuuaguaauuuauguucagugacuuuaaaucauaauuuuaguaaccuuaccuuuuccaguuaacauuuuguaaauauuuucaugugaaacaaauuuguuucucauuucuacuggaugggaaauguccucaguagauauccccaguucacuuagcaguucucuuucugccaugugaggcugccuucaguuuucugauauuuauauacaaggaauaaaauuuugauuuucuuugcacauaaagcauuuuuccuagagauauguguauguguguguguguguguguguguguguguguguauauauauauauauauauauauauauauauguauuuuuuuugagauggaaucucgcucugucacccaggcugaagugcaguggcgugaucuugucucacugcaaccuccuccucccugguucaagcaauucuccugucucagcaucccuaguagcugggauuacagacaccaccaugccuggcuaauuuuugugguguuuuuuuuuuuuuuuuuaaugagacagagucuugcacugucgcccaggcuggagugcaguggcgugaucucgacucacugcaaccuccgccucccggguucaagugacucuccugccucagccucccgaguagcugggauuacaggcgcccgccaccacaccuggcgaauuuuuuuguauuuuuaguagagaugggguuccacuauguuggccaggcuggucucgaacucuugaccucgugauucgcccgccuuggccucccaaagugcugggauuacaagugugagccacugagccagccuauuuuuuguauuuuuaguagagacaggguuucaccauguuggccaggcuggucuugaacugcugacugcaggucauccuccgucugccuuggccucccaaagugcugggauuauaggugugagccacugcgcccggccuuccuaaagauauuuuuaugcuaaguuuuuaaaaguagaauuaaaucagaggagaauuuuauaaucucauaauaaaaguuaauauaugucuauuguaauugagaguccaaaaauauuaauagaugaaauuacccacccucaccucucccuccccaaccccuagcuucacuccacuuuuuacuguuucuucuugugguucuuuuuggaaccuucuauaacucuaaaccucuguuugucagcuucuaauggugucuguugacucucuuuuaaaagaugaaagcuguccucaccugugcuguucuccucuccucuuuccucugccuuggcuuuguuaguucuauuucuguuucuucuguugacuacuuuuagagcauuuggugauauucacuaagcucuguucuugucccaucaccuucaggcagcuuucccuuccugccaccugccccugguuugggcacuccuccucucgugcgugcaguacugcagcugccacuccgaggucuccuugccaugucccuugucacacguuugguuagucccacacaguaauuagaaugauccucuugagauauaagucccaccaugucgcucuugcugaaaccuucaaugcagugagcgcccaucucauugggaccuacaggcugaaguucuuccucugauggacaugacccccguguugucucuaauaaccucacuuucacucuguuccagccacacgggguuucugucuuucucgggucaugucgggcuuaugugccucgggcccuuugcucaugcuguucucugccugggaugcgcuuuacugggugccaggauggucagugauuccauuucucucagagucuauucacagguccccuucucggucacgccuucucuggcuccacugucuaaaauuucaacagcugccucugccccccgaacuucauaucccccuuaucugccuuuuuuccuucagcucuuacuuccaucaaauacaguauguauuuuuaaaagucuuaucuuguucacggucauuuucuuccacagguaauuuugguaaacuuuguaagauugaugauguuuaauacuguuuuguuuaauacaguacccccaguuuagcacacagcuuuugaaugaaugaccaguuuuuauuccccucugaagcgcuaagagcugccgcugagguggcaucuguagcugcucccguuccugcuccgugguggcagagugugugucucacucacuguuaauauugcuccuggcaugggguugguucccaguuacugucuguauuugggauuuguguaguuagugaaccuuuagccugugcagaaaggucagcaagcccauuuuaauuucagaauuucaguaacugcuggcggccuugguuuuaaacaacagguggcgugcggcugccccgggcauggccccugcugugugugcuccuagcaucuuggcugcuuaccuuugucaccagcaaguuccacuucucaguggccugagcacagacggcacgcacuuugcagacuugaguuuuucuguuaaaauuuaaauuuuuuuuuaagugagccuaauaguuuccugaacuauuauguucagggaaguuauguuguugcugauucugauggggggugugugugugugugugugugugugugugugugugugugugugacagagacagagagaagucgagucuaaaguucugucaggcuuagacuaugccugaauacuugaacguuucuagacagagugcccaauguuuaaagagaauacgaccaagccuaacuaacugcggguuuucuucuuuucagagauggggcuggcaacuccuucgaccucucgucccugucaagguacagugacaacugggaagccaucacugggacgggggacccggagcacuaccucaucaaugucugcaagucucuggccccgcaggcuggcacuggugagagagggccuccucguggggugguguuugcagugaguguaucacaggccagcacuggugagagggggccuccucgugggguggugguuguagugaguguaucacaggcuggcacuggugagagagggccuccucguggggugguguuugcugugaguguaucacaggccagcacuggugagagagguccuccucgugggguggugguuguagugaguguaucgaaggcuggcacuggugagagaggaccuccucaugggguggugguugcaaugaauguauugaaagcuggcacuggugagagagggccuccucgugggaugguguuugcagugaguguauugaaggcuggcacuggugagagagggccucuucauggggugguggcuugucaugaguuuaucagggaagaucaaguaggauggggauucuuuggaggcgcuuuacucucugcagcauggacgugguucggccgagaaacagcaggacgaagaaugauuuaaggguguuaacaguugaucccuaguauggcccaggguaaaucagugcugaggacugcugggaacaugauaacccuuucugaacaugaggagaugaagauauaauagauagaaauaauagccauggugaggaauccuucuuagcagguagaagauggggggugugacguggaggucuuggugugugccugcguauguugagaguuguauggucgguccuuuugugaugcagggacagcucacucaaaccugcggugguuggcugagacuggaugucagcuguacaugggaaaccaagggcaccuccagggaucuugguaccacucauggccccucggaacccugaagaugaaacucaucccauguucguggaguuucauacagccccaccugcaucuuggguggcucaccucaaaggcggugugguuauuuuuagcugcagaaggugguuccauccucugugugguuugaggcugugguuccacuuccccuugcugcguugugcugugcagacuucgacaguggcuguaccccuguggcaugggacuaguucuucacccagggcacauggcacaggcauuuuagggacugggaaacaggcagaauucuugguagcuucuugaauaaagaaggugcauggacguaggccauuuaaaauguuccucugucuuaauuugggaauauaaccuucauccuauaugggguucagaaagaauuucgacugcuacagccuagcuauuccucuacacucacgcccgccugccccaguccaucugugacaaaacagcauguaagugagugagaacuaacgugaugucauugucaucugacuuaugugaaagaaauagcagguauuuugaagugacucuuagaaagcguaugaaguucugcagcgugugugacauuuauugccugaugaaguucuguucuagccuggggagucacuaaaggcaacucuuucuugugucuggugcugcagagccgugcccuccagaagcagccgcgugucugcuggguggcuccaagcccgugaaccucggcaggguaagggacggaccucaguggagagauggcauaauuguccugaaauacguugauggcgacuuauguccagaugggauucggaaaaagucaaccaccauccgauucaccugcagcgagagccaagugguaagggacuguuccugcaccuucugcuguugcagcuuugggaauugagcccaugugcagggcggugagccgcacguccucaucugccuugggaugcgaguucuagagccugggaugaugcgcccuuaccagagguugggggaacagcgucgccgcggccugcaaucuggggaacccucgugcugucuggcuccuuagaagcuugccuggcaguucccgacucagaauugguucucuucagaguuugacucagaccccuaaaggcuguggaggagauuguuguuugacuacaugcccuuuugucuucacggcggcagcuugggaagcacgagaagguuggcugggcccgggucacagguagcgcugccacuucccagccacauaacuugguuaauuacucagguagucugcccugcucagccguucauaacaugaggcauacuuguccugcccauugcaggguuucgagagaagagguaggaagugccaggugucauuucugacacacgggagaugcacagucagugagcaugagugccugugaucaguucuucccuuacuuguuuggcaugcacguaagcaggugucgacugcauacagguuuuucugugugugagauuguggugagccccagugcuagcgugcaugacaagcucgguggcugaguugggcauuaacucgggcaagaccagcucgcugggugucaggguggcucgccccaugcucuccagcggugggcagcagugguaggggagcuugggauggggggcuccaggagcuucaggccugcccucuugccuggagcggcagggaaguuuccucuugggaagauugugcagaggcuuaguccagacucaugagcugcuggggccucugagcauucuccucugugaccugagaggcucauggccgaggacaaaagggcugccccacauguggggggcaaaggugagaggguguguggggccccugugcccagggcccagaaggcugggagggaagggugaaggggugugugggguuccccauguccagagcccaggaggcugggagggaaggaugaggguggugugugggggccucugugccccagacccaggaggcugggagggaaaggugaaggguguguggaggcccugugccccagacccaggaggcugggagggaagggugggggugugucgaggccccugugcccagggcccaggaggcugggagggaagggugggggugugucgaggccccugugcccagggccugggaggcuggacugcagcguggcuuaucagggugcccagcaggaaucaugggguuuaccugggaaggaaggugcugcugaacucaucaugcuaacucugcaguggacaugaagcguuuugagaugagcagaguaagccuuggcuggugccagugggaggaugcguggaaugggcuaguucucuugguauaucuuuuuguuuugacugugauaauggauuuuaccucauuugguuuuuagaauuuuaucaaugauuuacacauuugugucucccuguagcccuuccagcauccuuugcacgccuguccccaaccccuguccuguuccucagccugagggagcuuccugguccccuaaguguguugcugccuguggguguuucacuuaccugcaggggaagcccaugguggcagcucaggacacauucugacccuuugcuuuuccuaaucugcgccucaucccacaggcacauggagacagaaaugucacaugcuguggaguuuuucagagaagcuuccacuuguaaguugaaaucaugauagacauggaguuuuugcgugaucccuucaggaccugucugugcuuuguuguagaacuccaggcccauguucaucagcgccguggaggacugugaguacaccuuugccuggcccacagccacagccugucccaugaagagcaacgagcaugaugacugccaggucaccaacccaagcacaggugagagguggugccagucguuaaccccagcgcaggugagagacggugcccccaccaaacccagcucaucaggggagagacccaaagagaagcuaugggcagcaggcgcccugggcagaggugucaugguguguggguguguuuggccuuucucuggaugggcugcuguguguucuccuggcucuccuucaguggaggagagaaugcucccacagagaauccaucccuccugucacucuccuggugugagaggugcuccugacugggguuacugacagugucaguccagcagcucuaggcucuccagggcagguuagagcuagccccuggcugccuuucagcaucaguguaguggauugccaggagucucucaccugcccuugugcugggcacccagaaaggcacaggcacaguccauuggcagcaagaggugugcugggcaggcucuccccaugcccaccagacucuuaguggcugcugugguauggcccagcagagggugcugugagccacgaucuuuucagcuaaggaugggacaucucauggaucaagggacugacagucucaugauacagccuggcuguugguggaggauuuaggacaggggucguggugagaagucagaagucccgaugcugacauaaucugugugugagcucgccgaugaugagccucccaagucucagcucccuggagucacuguguccccaucuucuuccacccuacaggacaccuguuugaucugagcuccuuaaguggcagggcgggauucacagcugcuuacagcgagaagggguugguuuacaugagcaucuguggggagaaugaaaacugcccuccuggcgugggugagugcuguggucucucguguguugucugacucucccguccucugggguuguccucagucucuuugcaugcuaauggcaaaaaggaugagcagagccaggaagcugagacgcuuuugucuccugcagcagucaccccaugugggggacacauggucaugugauggaaugaacauucaauguaaaacaaugguuaaagccggauuggacacuugaaguuauaaguguuggcuaugaaauugaugguccugacuugcgaaaguucucaucagaaaauuggccaucgagucugugauuguguuuucuccgccuuucccuuguggugcaggggccugcuuuggacagaccaggauuagcgugggcaaggccaacaagaggcugagauacguggaccagguccugcagcugguguacaaggauggguccccuugucccuccaaauccggccugagcuauaagagugugaucaguuucgugugcaggccugaggccaggccaaccaauaggcccaugcucaucucccuggacaagcagacaugcacucucuucuucuccuggcacacgccgcuggccugcgagcaagcggugaguuuucagaugggcacgggagaagugcauguccagugccuggcugcacccgggccccuucgucagguucacuugcccacuaguagaugcccagcugaacuguccacuccugaucaccccaauaauaaaguugacuggaagugcccagugcuauguaaugaagcauuuugacaccuuucuacuuuuuuuguuguuguuauucagcuuuuaaauucuuauggaugaccuaguggugauuaggaaaauuuuuuuguagacucaaagcagucuuuccuacuuaacagaccgaauguuccgugaggaauggaagcucuauuguugacuugucuccccuuauucaucgcacuggugguuaugaggcuuaugaugagagugaggaugaugccuccgauaccaacccugauuucuacaucaauauuugucagccacuaaaucccaugcacggagugcccuguccugccggagccgcugugugcaaaguuccuauugaugguccccccauaguaaguaugacaaauccaaggguggagauaauuuuugcaagacuuuuagugauaaccuuugcguuguuucuugccuucaguggggaguugcucaagcauaaaaaaaauggagaaaguaagugggacuguguauguucuggguccgcuacuggaagauuaaagguuugcacauugaacuguucgcugaugaugguagccagccagucuuugagcaugggagguaacacgaauauguguguagggacucuacuugucaugagccucaggguugacccaaaucaagaaguuuuuaggugaagugacaggaaagcacauugcccuagccugguuucuuugugugaaaugccuugucuucuguaguuaaaacgcuugcgaaaugcaaacaguuucuuuggcaaggaguuauaauuaagggcaagaguacguuugcuaauagcuaaauauuuugccuuaaaagcuuugguuuuaugcauuaaaaaauuauuuuguagagaugggaguauugcuaugucacccagccaggcuggccucaggcuccuggccuuaagugauccuccugaaguucugggauuacaggcaugagccacagugccuggcuuacuagcauguuuuaauagaaauuuggaucuuuaaaaauugucuccaugaguuauauucauauuuugucaaauccuugguauguuuuaauauuugaauguaucucacaagucgucuguauuucugucuguaucaucuauuaugcuuuaaagauggauccucuuguaacauaucuagauguccuuuagaaagauggccauuauauguggcagugauauggggagaugucaggaguguguaaggagaucggccacagccugaauuagcacagcuccagcucugugugagauggaggccuggacaagcugagucuccccaggaagcucuuugguagcguccuuucugacagcgcagaccggggauccucgaucgggaaucauugccuggccacccauugucaaauguuaaaagauguagaaaguuauuuaacuggagaagguguggugccacguggucugaacgugccccacaguggugaaugaagagcacuguagcugagaacaaaaucauggggaagcugcuuauacacacacucacacccacaugcacacacacgugcaugcacacacacauucaucacauacacaguuccuggccauucaccuuuauuuacuuuuuaaaaauaaaaaaagaguuuuuuguuuuuuuucucauaauacucagacuggucuuuuauuuauuuguuuauucacucaaaaauaucucuugggcagccgcugugugccaggugcugugcuaagcaaugaaaaugaacagugaacaccuccuguccccucucccaaggacauagccagugguuacugcugggccacgucagugggcagucccggggcagcacugggcagugaggguggcaggucagcauggagguuccggccuuccccugucagguggugggaggaccguguagcauccuuagagguuuuucagguuccgggcuucccucaucagcugaugggaggacucuguagucuccuugaugugacuggagagauuccuauugcuuaggaucuuugaaaauugaagauaccuagaaauagaaccaaccuuagaacuaacguuaggaucaaaacgauaaccacugacauacggagguuacacagcaucugucaagccuuccaacuggaguugguauaaacccaguuucuuuagaugcugcucauucucagaaccuaugaggucugguuuuugcaauucuguaucaauucuuaauuccacuaaccuugggaaugguuaauuuccugaaauacuguuugcccucgcucuuuguuuaggauaucggccggguagcaggaccaccaauacucaauccaauagcaaaugagauuuacuugaauuuugaaagcaguacuccuugcuuagcggacaagcauuucaacuacaccucgcucaucgcguuucacuguaagagaggugugagcaugguaagugugggccugugacgaucuagaugcucaacugcggguuagugagccaaggcuagacaaccagaaagugcgugucagguccaaggauacucuuauucaaaaugucugccuuggguaagaugguacgcuaguagugugucugaauaauuuaaaccacugauugagggcugagugagcucccccgcaguuaacagcauauagaaacuugcuguaauuuaaaaacauagaacacaaguauagaaaugacauucagcuuugacugcugaugcauaaaagugucauaacuuuuguuuuuacuuuaacaauuacugauuuuauucuaacugggaagucagaaagacauuugggcagcuauagucacucaggacauagcccagaaguuaacaaguaacaaaagaccccuggaaucagaauagcuacaacaaaguggcaccuuuuacuuauaaugagguauugacuuccauuuuaugugcauuaaaaaaagaauaccagcuuccauuauaaugaguucgguauugguuauagucuuugaggacguuuucuuuugaucccugcucugugagauaaauugguagauuauggccccuauuccacagggacucagaguagcucugcaggggcagagccaggucccagcuacugcacaggggaacagcucuuugcuccagggacacagcaccacagccugucgucugugcuucugaaaucucugaagcucugaaaacuuggggcuccuuugacaugaauggacugaggcuauuuaugguguggauuugucccaccuaauguggauauugauacaucuagcugcagaaauauuaauauguuugaucacaggaucugggggugugagaauugccucuuaaaauccuaauaaagauguuggauuccaaggcucaucugaccccuaggaguucaggugauggauuaggaucuguugggugucuuguaauucugauaaagacauccuucugauguuugggccuggagcagguuuguaaagggacuguuagacaugggugugcugacagugacagaaagugaccuggcagccgccugaccagugagagagacaguauuugagaaggaggaggaaacaguccugcuguuuggggcuacuccacaggggcccagagcaccucaaagcccuuggauguguucaugaaucuuagaguguagugacaguccuaguuaguaaggaaaggcagagcuguauucaguccacccauugcaucuguuuauaagcguauuggcauauuuuuauaggggugucugggugugccucuguagaugcacacagcauggggcaacguggauuuugccuugcggggggcuucugcauuaaguucuucguucuuuaaaggacagucuucacuucuaagacccaccucaucaugagugaugcuuuguuaucuacaccaccagcuaaagaguguggaacuaugccuugcuuugacucugcugccaacgugacaaaucgaauuagcuaaugugauuuuaguuaauucucagcagcugcacauugagggugauuaguguuuacuugauuuuagaaaugaagcaucuuaugcugaauguguguucuagcguuccagaaagauuuuuagaagauuuuucuuccccagcaguuuucauuuucaauggaaguacuuuuaccacugaaucauagggaaaaagaugcuuaacauuaauuacaaauggaauuccugagagcugccucaucuuuuuuuguugcuguugaaugagggagggaauaaauaaagugauucuacaauacuuggccuauggaauaucuggccauguggcaucuugccccuugaauaaaugucucccgugucuagagacaguagauuggagcacuugugaggcagggucucaguuucacagaccucucucaugacauauaagcccucccccuuucuuccuuugaacccguagcacagaacauugaggcuuucucucuaaguagaagacaagaccuggauucagccagggagcucacaggauguguagggggcaagggcagggugaugucugugccuugaagauggcauugggucuuucagcugcuguugucuagcaucccuucccucugagaggccgcuguggguuaugcacagccccuguagggacguggugugucacugcuaucuaucccuaugccaugggguuuuuaagacccgugcucuuccuggcaacagggaacgccuaagcuguuaaggaccagcgagugcgacuuuguguucgaaugggagacuccugucgucuguccugaugaagugaggauggauggcuguacccugacagaugagcagcuccucuacagcuucaacuuguccagccuuuccacgagcaccuuuaagguaaugcguucacccugggcguugcuggugcagguguaccaggugccaggugcugugaggcugcugggaguguuuuggauaaugugguaccugugagcugagaggguguauguggccacugggcagcaucuuggugcucucguagggcaugccaggucucaggaagguucuuggauugcguggccaacucagcgcagcugacacuugcguuguaccucauggcucugcacuuaacgcuuuuugaugauaaguaaccucaugaggcggguagugggacccuuuguaucagacagagggcagguggggcagcccggagacaugaauguaagguauccauggggacagggccagcuccuggguggcugaaaucuacagggauuuaauuccuccaaccugguugaagaugaucaaggcaguuguuugcugauuguggcagcuuugggaagagggagguaggaggugcccuggaauugagaggcacuugggcaugugccuccaugccaugccagagcccuggcgugugcugauucuuugggcugcuggucuuacugauguggugucguggucacuggugccugggggccccugacucccuaagccuagauaucuagauguuaccaugccagugccuggacugggguacggaaccccagcaccugcuguggcacggcggcuggugagugaugagccuggaguuuugggcccaggugucaacacccuggcuccugugauggagcccucugccuggguacagguccucccgacaggugugcaguaggugugagccuucugggcgcugggugggccaggagagucagguccaugcuucagcgugcagcgucggcucugcucauucacucacuuggcccgcacaaugucuuauuacacaggugagggagguggggugaccccacugcugggucccuucucacugggcucugacuggagacgacagccagagcaguggcuggcuggcagggguggccgaggcccccagcagggagcaggaggagcaagcaagcugggccuagggguugggggaggccccccagggaaagccuagggccaaggcgauugcguggcucugaugcacacagaggagucuuugcucuuccucaugaaccugccuccagcaucagcugcaauagugguucucucuucacuuugagaccugggugcugccacucugcugacggccacgcaugguuuuuguccaggugacucgcgacucgcgcaccuacagcguuggggugugcaccuuugcagucgggccagaacaaggaggcuguaaggacggaggagucugucugcucucaggcaccaagggggcauccuuuggacggcugcaaucaaugaaacuggauuacaggcaccaggaugaagcggucguuuuaaguuacgugaauggugaucguugcccuccagguaaauauuugcaaugagguaaauaaacuucaagcucauaguaaacuagaaauuagacauagcagcagaaagaagcugcggaguggagcuccacgguccuaugagugcuguaaccuugggcgugaaugugagcuguuccucuguacacccccggugugaaugcuggugugugaaucacgcuguguucucucaguugccuggugaguuuuggcaggugaaugccgguugucacguaggugcuuuaggaugggcagcuuccuuagggacugcugcugcauucugaggugauugugccuggcgaggcacagcugccacacugauaauguucuucuucuuuccagaaaccgaugacggcguccccugugucuuccccuucauauucaaugggaagagcuacgaggagugcaucauagagagcagggcgaagcugugguguagcacaacugcggacuacgacagagaccacgaguggggcuucugcagacacugugaguaggacggcuccgcguccccacauggccuggggccuugauacugucaaggcucgauucacacugagaccuuuguggaugccccagucaguggcaggaauucucuugcauaaaauauuuucuuacucgggcuguuucccacagagaaacguuugaauugcucugugggauugcuggguaaccguaucuacagaccgugguagagcugccgugagaugcugugcuggguggcuggcuaggcccacucacuagcuggagggccuuguguccacauaccagguuuuagcccuggugguucagauuaugccucaggaaaaugaaugucugcuaugggucuucaggauucugaagcuagugaggauuccgguaaaccaggcgacucauuuauugacuuuccgccauguggcagcccagguggggauggagguuucuuggugagccacacucagugccuugccccugcggugcucaggaaguuucaugagaggagccaacugcugugacuugugucuacggaccgugagaugagggaaaugcaugaaaaauuacuaauuuuuggccaggcgcgguggcucacgccuguaaucccagcacuuugggaggcugaggcggguggaucacgaggucaggagauugagaccauccuggcuagcauggugaaaccccgucucuacuaaaaauacaaaaaaaaaaaaaaauuagcugggcgugguggcgggcgccuguagucccagcuacuggggaggcugaggcaggaggaugguguguacccgggaggcggagcuugcagugagccgagaucaugccacuucacuccagccugggugacagagugagacucggucucaaaaaaaaaaaaaagaaaaauuacuaauuuucauaaauguccaguaucgggggaaccagcccccgauuuuucaacguagguucuuuucuauuucccuaaguguuggccggucugagaaauaaggggaaagaguacaaaagagagaaauuuuaaagcugguguccgggggagacauuacauguuggcagguucugugaugcccccgagccgcaaaaccagcaaguuuuuauuagcaauuuucaaaggggagggaguguacgaauagggugugggucauggagaucacaugcuucaaggaugacaagaggucacaaggcagaaggucagggcaggaucacaaggucagcgcgaaacuagaaucacuaaauaacuuccaugucccacugugcacacauugugaggguucaagagcagagaaccgguuuaacuagaauucgccaggcuggaauuuccaaauccuagcaagccugggggcgcugcaggaggccagggcguguuucaucccuuaucugcaacugcauaaggcagacaccccuagaguggccauuuaagaggcgccccugccuuccucccgggaaugcauucuuuucccagggcuguuaauuauuaaaauuccuuacuggggaaagaauucagcgauauuucucuuacccguuuucgguaauaagagaaauauggcucuguccucaccggcccacagucagccagacuuuaagguuaucucacuuguuccuugaaaaucacuguuauccuguucuuaaggugcccagauuucauauuguucaaacacacaugcuuuacgaacaauuugugcaguuaaugcaaucaucacaggguccugaggcgacauacauccucagcuuacgaagaugaugggauuaagagauuaaaguaaagacaggcauaggaaauuauaauauugauuggggaagugauaaauguccaugaaaucuucacaauguauauucuucugucacggcuucagcaggucccuccguucauggucccugacuucccgcaauaguccagggaccaaaaugggauguauuaaggaaccaaacguguuaaauuuacgaaggauugcuauagcuuuguuuugaggcuuauuuugacaaaacguuauucccuauuuucugaaucacacuccuguuuucaaguacuuguagguauuacauuauuaucuuaaauuuuuuuuuuuuuugagauggaguuuugcucuuguugcccaggcuagagugcaguggugcagucuuggcucacugcaagcuccaccuucugguuucaagugauacuccugccucagccucccaaguagcugggauuacaggggcccgccaccucacccagcuaauuuuuuuguauuuuugguagagaugggauuucaccauguuggucaggcuggucuccaacugcugaccucaugauccgcccaccucggccucccagagugcugggauuacaggcgugagccaccgcgcccagcuaucuuauuuuuuuucgugaucauuaguagauuggucaaauauugaauacccgugugaggaaucaccuagggcugugggguuauuaagaaguacgaugaaaggcugugugccaaggagcugggucuauuuggagucaggauacacaugagugaaucaacaugagauguggccagggcagcacgugguguguugccagauggcggauggagucugcaggugcuccugaggcagcauggggaaggcgugcaggaacgugcccuggugcaggccuuggucugacauucucccgccucugcuccccugaagggguggccugccccuccacacuuguggguauuucuagucgggugggaugagagacugagaaaagaaauaagacacagagacaaaguauagagaaacaacagugggcccaggggaccggcacucagcacaccaaggaccugcaccggcaucggccucugaguucccucaguuuuuauugauuauuauuuucauuauuuuagcaaaaaaggaauguaguaggagagcagggugaugauaaggagaaggucaacaaaaaacaugugagcaaaagaaucuauaucauaauuaaguuuaagggaugguacuaugccuggacaugcacauaggccaaauuuauguuucuccccacccaaacaucucagcggaguaaagaauaacaaggcagcauuacugcaaacgugucucgccucccgccacagggcagcuuuucuccuaucucagaguugaacaaauguacaaucggguuuuauaccgagacauucaguucccaggggcaagcaggagaaaguggccuuccuccaucucaccugcaagaggcuuuccucuuuuacuaauccaccucagcacagacccuuuacgggugucaggcugggggacagucaggucuuucucaucccacgaggccauauuucagacuaucacauggggagaaaccuuggacaauaccgagcuuuccagggcagaggucccugcggccuuccgcagugcauugugccccugguuuauugagacuagagaauggcaaugacuuuuaccgaguauacugcuuauaaacauuuuguuaacaaggcacguccuucacagcccuagaucccuuaaaccuuaauuuuauacaacacauauuuuugugagcuccaaguugggucaaaguggcuggggcagaguggcuggggcaaagcuacaaauuaacaacaucucagcaaagcaauuguuuaaaguacagggcuuuuucaaaauggagucucuuaugucuucccuuucugcauagacacagugacagucugaucucucucucuuuucccuacacuccccagcaaacagcuaccggacauccagcaucauauuuaagugugaugaagaugaggacauugggaggccacaagucuucagugaagugcgugggugugaugugacauuugaguggaaaacaaaaguugucugcccuccaaagaaguuggagugcaaauucguccagaaacacaaaaccuacgaccugcggcugcucuccucucucaccggguccuggucccucguccacaacggagucucgugagugccuucccaguccacccgcggcgccacacccucagcaugugaacuucagacugcuugacgaugguuggcucuuuuggguucucaagaugggaauacuaugcccaugugaggcugauggugguugaguugugacuguuccuggaagcagcccgcagugucaauccuggcacagagggugguucugaggucagagugggggcaggagcuuuggugacuggaaacggagccucuggagcuggaagaaccugggcggacugaguuaggcuggguuugauuugcguuuguguguagcucagguugugggaggcguguggguuuucucgggucuuuggcaggagcuccuuaggcuuugcuggcuggggucagcccaugguccugaccacucugcguggggagcgcccgcuuggccaggugcuccugcaagacaucaccgaggagcaggggcauggacucacaggguuuaagugguucuaagugaggugggaaacuugccgagauucuagccacugccucucccagccccggagcccuucuuucuacuguaccacgcuguguccaggguggccgcagguguggacauuccacuccgcgugugucugguuggugagcucccuucuucagugaagacuucuuuugcccuuuuuuuuuuuaauuggaaaagcuauuuuagugcuacauucagugauggaauggagcccuuaguuaucagaaccuuucucugaaaguaaagugaagagcccuccugugucagggcagagacgucacuugcaugccuuuuaccugccccuuugugucguuuucuagguacuauauaaaucugugccagaaaauauauaaagggccccugggcugcucugaaagggccagcauuugcagaaggaccacaacuggugacguccagguccugggacucguucacacgcagaagcugggugucauagguaaggccuguggguccugguccuugguucaaggagcagcaucugaaccgggaaggugaggguguucucaggauggcaaggagagugagcaugugcuuugguggaaaccuccagauaugauugccugucacugucucacaggcauuuuggcucuccuggcacauuaaaauaagugcugcuuuguauuauaugagacugcagguccuagucuguguguuuagagggguugggcuaucucggggaagugcgucuauccaggaggaagucucagaauguucagaguuccucugaaguucacguucuagcuguagaucaagugccuaaauuggcauaaacacacguguuuguuuaggaaagccaaacaguugcaugaggacuugguacagguaguucagagguacaucuuuguaaaaugucuuaacaauuuuucacgggaaauugaucuuguacuugguugcugagugaaaguuguuuucuuucauuauuuaaaggaggaaaauagagguuucuuaguaagagcaauuaggauuuguuggagggaccaguaaaggaaaauauucaccuuugccucuuaggcuggagugggguuucccgaguuguccugauucagccacagggcuacuucagauuagcuugagauguugagauggagaaagagaauuccgagaaaacuacugccacccuugauaaaaaucacacacagacucugcagguugguagguggagggagagcugccauacaggaaguggcgcccagaccgccagccugagacccgcccucccugggagguucuuacugcuuuagaggucaguuauugcugccacucccacacugccccagaagggggaaggagggaaggucguggaggguugcuuuuuccccuguaaucuugcaguauauauggauauucgacuagucuuuccccaacuucagccaacugaaaugacuaaaacacuuaaggcuuccuaaaaguuugaggcaggaggagcaaaagagaguagugaacacagggggugacauggaacuagaucaucugacuucuuagcggugaccugcaggccaccuccauuuggagagcaccauuuugcaaguccagccucgccuggcgggaagagcucaugcuuucuccugggacuggcauuuggcauccugagcaccugcugaccggaacgagaaauaaucuggugucugacaccaaaugagcucuuaaucuuuggcgccaacaagacagcaucuaaggacaaccacggugcccccauuguccgcuuagggaauggaccccuguuggggugggagguagacuuuuuguuuucagaaccaacaugucucaagcagcugugcuuaauauauguuuaauccccauccacuccauggggcagcguugucauccguuucacaggcugggccccugagccgaggagguugagccuccugcccaaucaguaagggcugucuacacuauuaaaguuuuuucuuguuugaucccauaugccagaaguuuuaaaaauuuuccguaaaacaguggaauucuuuuuuccaaaauuuuacacagaagcccaauauuuaaaacaaauucagcuggagcagcuuugaguuuggggcaggccugagagccuagagucccaccucccaccucaccauccagcagcccucaguaccucagccuguguccuguggaaaacacucgggaagugagcacugugcccauguugccuccaccgcaugccccugccuggaaggaucuguguguguguggucaggguggaaggcaccugcuuccccuggacacccugcgccaugcccuggagacaucaucuguccaugcagccaggcugggcccagaccguucccagaacagcccccugcgcagccacaagcagccucuuggugguggcuugagaguuggaaccuggcggccaugcugccccagugauaccugcagcuuaaagcauguacucacuuuucucucagacccugcggguucgagggcucagguuuuucuuuuaaugggucacuuuuaaaagcagacagugcucgacugaaagcuagaagacccuagaaaaccacaguugguuucuguuucuggcuuuucacuuuuuccauucugugcucuguuauuacugggaggcucacaugaggguaccugucaggaaagcaccuaauaugauagagagaguuuacacaauuggagcgauaaugaaggcugccauuacccggggucccacuguucacaugaguuuguugggcacuuucuauacaugcccgaaaccugcccacuuuggacagugcccuguucugcagguaaggcccucaaggcucagaagcucagcaacccagggccacaaaguacgggaguaggaggguuuggguuugaccccaggucuuaggcugugacaauugugcagugggccaggugaccaccccugagugugggaaugcaagaacaggucgauaaaccuuuagggagcccaaaauuuauuuucuucuggccuuuaaaccagauuuuuacuccuaacauugaagcuuuguuuguuuguuuuuuguuuuuguuuuugagauggaguuuugcucuuguugcccaggcuggagugcaauggcgccaucucgaucuuggcucacugcaacuucugccucccggguucaagcaauucuccugccucagccuccugaguagcugggauuacaggcaccugccaccgugcccgaauaauuuuuguauuuuuaguagagacgggguuucaccauguuggucaggcuggucucuaacuccugaccucaagugaucugcccucuuugguuucccaaaguguuggaauugacaggugugagccacugcgccugccugaggcuuuuuauaaugcacuagaaauaaugucaguucaaucauuuguguguuucaggugacaaaguuguugucacguacuccaaagguuauccgugugguggaaauaagaccgcauccuccgugauagaauugaccuguacaaagacggugggcagaccugcauucaagaggucaggagacugggggcucagagcgggacugugcagugagcauacuggagggaauuccuccuugggguuuucaugggcagguuuuggcugagucuuaggagcucagggccagagccgcugauugugcuguauugggcggggcugcuccaggcagggaagaccuccagauacagugcugagacacuguuacaagaccagugcaacuucucugggcuagcuugucucuugaacuagguuuagcacuggcugagcaguacuuaacugaccucuaccuuugaaugucauaguagaaacaaaggggcguggauuugucccacccgagguguucaagcagccuggcugggacccucgagcagcugggaccugcaucuggaccugggaugugcuuggauuauauucaaguuuucccggccacauugcaucuggugccagggagagcuuggccaacagagggugcaugugagcugcuguuugugaacagaacugauuccuuccagacgcugaguuuggaaaaggggugacucagaaauugccaaaggauuuaugaauguaugagucugagaagcuuaaacaaaaaucuaaaaaucuaggagcaaauuuuccagguuuugaauguugcacgguuuacaaauuuuaaaaaauuuauauugaaugcuugccugcuuugucacauuacugaugugugcaccacagucaucuucccuguccauuguggugaugaaaagaagugaguaaaauaaccacccucgcuccgagcugccgucaguguugagucgggaaauucugccuaggccugcgcagcccggggagugggggccucgggacccaacugaagucucgcagcaccuugacugaaagccagugagcugcuucaagggcuccgcaguguucauuguuuugcagucuucccuuaugucuggcuggggaagugacuguagccugugcuucccuccuccuagguuugauaucgacagcugcacuuacuacuucagcugggacucccgggcugccugcgccgugaagccucaggaggugcagauggugaaugggaccaucaccaacccuauaaauggcaagagcuucagccucggagauauuuauuuuaaguaaguaaaacguuuuccuucugagcugugaaauguguucaaaauuaaaccagcaaugccgcucuuucccuaucggggagcacugcaggauaaauaggucuguguuuuaguuacuguugcuggagucaucgucaucuuuugcuuaaacugaggaaaagcguuacucaaucauuaaguuuuaacaccaaagauggugaauucucaugaguguaaaaauaaaucccccguccuucucccucucuucaugauaaucucagggguugaagccgaagccuucugacauguuugagcaggaaucuucugggcuuaccaguguuuagaaaauaaguuucucagcaguguuacuggggcugcucuugggggugguggccgaggugcacagacagggcgagggccguguggugcuggauacggcaccugaggaagguggauuagcacucagaggccagaacugguuggggagaaagccucuugagagggaaacugguguccucagaauugcuguggggucacagacgugcugcccuagcguguccgugcuuccuuucccuaggaaaggaagcauccuggggcccugcagugauucugaggacugaggguuuaugucaugaaugccuucuugaaggacuuccaugucacugugaucuuuucugucucuucaggcuguucagagccucuggggacaugaggaccaauggggacaacuaccuguaugagauccaacuuuccuccaucacaagcuccagaaacccggcgugcucuggagccaacauaugccaggugaagcccaacgaucagcacuucagucggaaaguuggaaccucugacaagaccaaguacuaccuucaagguaauccguggcuucccacaaaguuccacauuuaacuuccuccaaggaaggggauuaaaauuuucaacuaacucccuucaguugaaaucucggaccacuuuuaaaacaaaaaccuuggucuaauucuuuacuuuguuaugaauuucuugacaguggauugagcgauacgugucagaacuaagcauuucacuguaggcaaauugugucuuaguuaucaaguaaauguacaaaaaaacuaaaaccuggucugauccagugguucugagguuggguggaggcugagcugugcacagucagaauugccuuugauuugguuuuaaccaugacacuuccuuauuuuggaaugccaaauaauauuagagaaggguaagagauuuuauauuuguaagaaggaugaaaggaaacuggccuaaauguuaggauguagguuaaaaucaaccaggacgcacauagggcagaguccagggugugaaggaagguuuuaaacuggcacuaauaaggguguugcccuuuguucccucacauaaucgugaaaggcugcuuuuguuuugaacagcuagucuuaacuauauaccuuucauaauuugauuuuugaaccguguguggauguaauaacucuuuaaaaaaaaaugaaguguguuuaaagaaaaccccagccugcucugaugucaaagagcugccgaucauguccucugggaggggagaguagugauagcugagaaggagcaggugcucugugcccuggugcugagcacauugccgagaaggagcaggugcuccgugcccuggugcugagcucaucgccgagaaggagcaggugcuccgugcccuggugcugagcgcaucgccgagaaggagcgggugcucugugcccuggugcugagcgcaucgcugagaaggagcgggugcucugugcccuggugcugagcgcaucgcugagaaggagcgggugcucugugcccuggugcggcugagaaggagcgggugcuccgugcccuggugcugagcacaucgccgagaaggagcaggugcuccgugcccuggugcugagcacaucgccgagaaggagcaggugcuccgugcccuggugcugagcgcaucgccgagaaggagcaggugcuccgugcccuggugcugagcgcaucgccgagaaggagcaggugcuccgugcccuggugcugagcgcaucgccgagaaggagcaggugcuccgugcccuggugcugagcgcaucgccgagaaggagcaggugcucugugcccuggugcugagcgcaucgccgagaaggagcaggugcuccgugcccuggugcugagugcaucuccacgacggcagcaccugauggagggaagcugggucagcaucgcugcuccuggucacagauuguagacagcgcccuggugcaucugcucauagcaccuguggccccugaauagaacugggaaagugaauguucugcuuucugggugaguugaugaugggaaaguugaucagccucauucacuugcauaacuccacagcacggagcuagcacucuguguuucucuguucucugccuuccucacacuucggugaauccuucagucauucagaaucagauguugcaugucacagguugugccuucucuugcuguccucuuucccagugcucgguaaaucuugauuaaaggaaggaaggaaggauuguuucagaagccuucaggggcccuaucaugcagagaaggaaagucuaggcucucucugacacagcuugaagaugucugagaggcucccauguaccaggguagccuugcaagcugcugcuccuacacaugccucagccaucagguuauucacuaguucccaaagucacccuguaaccugguggguuuacauaugcugcucuuggugcuggaaugccuuggcccaccuuccucauccuuccaaaccuacuucuagugccccuccugggaaggcccaccuucucauagcagggugacaccgcuggugugucugcaggauuccaaaccuaccuccagugccccuccugggaaggcccaccuucucauagcagggugacaccgcuggugugucugcaggauuccaaaccuaccuccagugccccuccugggaaggcccaccuucucauagcagggugacaccgcuggugugucugcaggauuccaaaccuaccuccagugccccuccugggaaggcccaccuucucauagcaggugauacugcuggugugucugcaggagucuucacgcuccaucgcgcagcacuggccacuugucugguuacacauaagaccuccacguucacaagugguaugucuagcagaccuuugaggauccccagcuuucagagugcuugugcaugcgcauuuagucauucuugguaaauaaaaucccuuucagaccuuuucacuuucuucauucaccagccccaggaaguagcuuuaguuuuaagacaucuuuucaucuuucaugaagaaaugaaguuucuaucucuuccugaggcuugccauuccuucgggagggcagagcugucucucaucaggacguggagcugcugggcgguuugcuuccccacaucagcccuguggaacaguccauucagcagccccugcuucagcuacucccaagcgagaauguggggcccucccggagcggagccgcaccgccugucucugggccccaucuguguguggacauguccgucuccuacccugcacucucgccucugcauuccuggcacccagcagcaccagccacaaagauuuucagccagugacaaagguugggagcagcagaguucaugcaaggaguccacacaaggguuccucacuucugacagcaacagcacacugaagggguucccaagccaacuucagauuuacccuuucaccauaacucacagagcucccuggaagcaguuacacuuauaguuaugauuuacugcagcaaaaagauacagguuaaaaucaaccaagaugcacacagggcagaguccaggagggaauugaaugcagaguucccaccagcucucccguggaaucagauguguuguguucccagcacccacguguggcagugcacauggaguaucaucagccggaggugcuuccccaagccuugguguccagaguuuuucccggggcucugacaugggcaggauugguccauugaucacucagguacugcauggccagccccugcuccguauccugucauuagccaaggagcaaggccagcccucuuuuugggcaagguuaaauucuugccuucccucuuguugccguugcuucuguuccuggaggagcuccuggcacagugauggggucucaggccuccaccuuacugcacgaugaagaguuugaggagaucaagaaggagacuggcuuuucccacagucaaaucacacgucuguacagccgguucagcaaccuggacaaaggagagaacaggacgauuuccaggggauuccagaacuugccaucaacccagugggggacuggaucaucaaugccuuccuuccagagggagaggaccagguaaacuuccguggauuccugcaaacucuggcucauuuccaaaccauugaggauaaugaaaagagcaaaguugugaauggaccugaaccacucaacagccgaagcaacaaacugcaguuugcuuuucgacuauaugauuuggauaaagauaacaagaucucucgugaugagcuguuaagggugcugugcaugaugguccaaauaaauaucucagauaagcagcugggcaguaucgcagacaggaccauucaggaggcugaucagcauggggacagugccauaucuuuaucacagacuuugcuaagguuuuggagaagguggauguagaacagaaaaugagcaucugauuucuucacuaaaggacagacagcaaacuauuccuugcagucuaguauuuaaguacuggaacuugacaguccuccuguccaccagcccuaccuccaccccaucauuccccuucucccaaaguacuacugcuguugcauaacaaccccaaauauguucugucaacacaaaccugcuuuuggucuauaaacagggcguuacagaaugguacacccagucuauuucuucucaguauccauucgccaguucuucauuuauaaauaucgucuuccucuguucugcugcugaaugccacacauccauccagucugagaaaguaagauagggaauccugccgaggaacaagccagcaaagcucuuucacuggauguagacugcaccugcugccuucccucuggcgagucugccagcaugcuucuccauccuuuuuauauguccuuugcuucccacuucuguguacauucaacauacuguucacguagucaugcagucuuucugcuuuuugugaagccucagaaucuccucuguucuacuuggcaccccaagcuaugccugguauuguauuucugacuuggcucgauaguucgguggucuggcaguuuuuaucuaccuucauuauuaaaaggcccucuggagcugggcgugguggcucacgccuguaaucccagcacugugggaggcugaggugggcagaucacgaggucaggagaucgagaccauccuggcuaacacggugaaaccccgucuuuacuaaaaauacaaaaaauuagccgggcgugguggcgggugccuguagucccagcuacucgggaggcugaggcaggagaauggcgugaaccugggaggcagagcuugcagugagccaagaucgugccacuacacuccagccugggcgacagagcgagacuccaucucaaaaaaaaaaaaaaaaaaaggcccucugggauguugccucuccaggagcuuuuugguaaccaacacuucucucgggaguaugagaucauccucugcacucuucucugucaucaaagggcugcuggguggagauauucuugaaagguggccuuggugagagguguggagucaagucuuuuagguugcuugcccacgucacucuaccucuggccucugauucucaacuuuguaccuauggggcgucucuuguuagugcaguguugacuauucaaaaaguagcaauaugccugcagauuugcuuagucuugggacacgguuaccaccagaacggcugcucagacaauaugcuuggggacuuucucauggcuuuuugaacaaggaggcugcgcacccugugaagccuccugcauucacaccucugcugcaugguuuaugccucaguguuaugugcacuggaaugcuuuucacuauacguuuccaaguuagaaagauuaguguuauggaagugccuaauguauccuaguccaaaauauuuaaagauuguucucugugucuugaaguuuugcacaaaauucuuuaugaauuuuacacuuggcaaauguuaaugcuagaagccauaguccgcuucuuauacaaguccaaagcguugacuguuguaucauuagcucccugguuacacugguuucccagcuccuuguguagaccacugcuaaucccuuagaaacaagaggucuggcacuaguagcacaaccuaagguggcauuccaagucuuuaagcaagucacagcaacuuuucugccaaagucagcuuaguuuagacuucagugaaucaggcuguugccauccuaauguaugucucugugagucuguucauucacauaucugccguuggcugacuuucuugacucgcugcuugcuugcuuguuuccuugcuuuggaaagcuauugaagauguguacauaauucuuuaggaaggggauugcuaaaaaauacacugcaaagcgauggaaaacaguggagaacaggggaguagccaggcuggauggcucaaauauaaaugaaugaggaauucuuuaugaagugucaguuggacuuugugauugagugauguaauacaggaauuauauagaaagggaagaauaucugauacugaucuguuagauacuucagaggcuccuugauuugcauauuuaaaguuccuaaaauuguagcuuuucccuucuuuuggcuguacagcagacuguuuuaauccacgguugugccuuauuguuccauuaaaauugugucuucaguccaucaauaaauacucgugguuaaaacaaaacaaaaauucuuuacugcaugcugacuaagggcagggcucuauccaugugcaucgaguggccucguaagcugugaacagagugccugugggacgugggaugaagucucuucugccugauuuuaagucuuugcaaacuuuuuagaccguaaggagcuaagcucagucugcucgugaaaaaugauggugacaugccaugugugcccuucccguuugacagacggcgaucucgaugucguguuugccucuuccucuaagugcggaaaggauaagaccaagucuguuucuuccaccaucuucuuccacugugacccucugguggaggacgggauccccgaguucagucacgagacugccgacugccaguaccucuucucuugguacaccucagccguguguccucuggggugaguaugacauccggaagcuuagcacuuguaccccacaucuucccuuaagaauaaguguauguguguuuuuuccccaauguuuucuugugaaauauucagaacaugcaccaaaaaauagagaaaaugauagaagcggaccccacauagucagugccccgcuccguugcuugucagcauccugccacugauuuuugguccauggcugcgucaccucccaccacccccagcagcagugccauuguuuccuuuguguguaccaugccccgaauaggguccagucagggcaccccagcucugucccucuacccuguucccauugcugccucccucuccuuagcuccugggaggcaaguacugguggugccuccucuguguaauccuggaacaucuuuugugucguaauacaaaugauuguuugguaaaguuucacuuugauuugagugcaguauuuuuacuuugauuugagugcaguauuuuuacguuuguuugaaugaaugaaaagcuuacucuccagauuuugagaaucagcaugagaacagagggagcaguuucugcucugaaggaagguggcaccuccauugguugucuugugucccacagccguuuuauacuuugccacgaauaacauguugucaguugcuuuccucuuggauuuauuuucuucuuauguuacccccacccaucauuguauuuauauuuauuuuuauuuuuuauuuuuuugggauggacucuugcucugucacucaggcuggagugcaguggugcggucuuggcucguugcaaccucugccuccugguucagacgauucuccugccucagccucccaaguagcugggauugcaggcaugugucauuaugcccugcuaauuuuuguauuuuugguagagaugggguuucaccauguugaccaggcuggucuugaacuccucaccucagauaaucugccugccuuggccucccaaagugcuggcauuacaagcgugagcugccaugcccggccuggcccaccauuuuacauaagcuuuucauucucuguccugagacuuuaagauugggggaacaugaauucuugccauguaauuguuuccuucauguccugaaaaagggaccguagagucagcagacgacaguggugggggucaugggggaaugaagaucacacauuuuacaucuuaaaucagcacucccccugcccacccuuaacaguggacaugagcucagcaaaaaccagcuuuguccugugcuguucaggccuguguacuuagggauccucagcugcacagucagggaaagaggcuuuugguugaaauuucacuugugguauuuucagcuuuugaauguuuaugguguuccggugacgucauuacaaaaugaaaggauugaaacuggaaguucuuccugaaagaagcaaaaugugaauuuuuauaaaagauaaaacccagaagugaacuuucccugcauucucugucauggagaggcuacagcugccaugagaugaauccugccuccugacauggcagcuggucuucuguguggguuugagggaccaggccaggcuaggaucccguccauguugaauguuuagaguucgacuucugugaguaggaaaagcacuguuuauagggcuuugguguuugacucuaaaaccagagaggaagauucuccaggaaaccucgguuucaugauguucagaacaucaggauugggagcuguuuaaaucccuuaacacacugacaagguaauaaggacuuuaaaaaaaagaaacagaaguugaaaccaagagcaaaaacucagaugguggauuuugagggaugcagguaccacccgggggugacguggaauagugccugagauuuuuuuuuccccaaauguuaucaguguuguacauuguagaaucauguaaauauggccagacgcgguggcucacgcuuguaaucccaacauuuugggaggcuaaggugggcggaucacuugaggucaggaguucuagaccagccugggcaacauggugaaaccccgucucuacuaaaaauacaaaaauuagccaggugugguggugcacaccuguaaucgcagcuacucagaaggcugaggcaggagaauugcuugaaccuggaagguggagguugcagugagccgagauggcgucacuguacugcagccugggugacagagcgagacuagaucucaggaaaaaaaaucauguaacuauaacaaacagguagcaauguucgcccuaauagauuaccauuuuuaguucuuuuagcuauuucuucuggaauuuaccucaguauuuuaaauuaacauccuauaucucaucuguugacuuccugcaauaguagaugaagauagagcugucuuacaccuuccuccuacuuuacaaaaaugguucuuucacaauauuugauuaaagucaaaaaauuuacacaaagcuaaaagacaggcaucuacagauggaaggggcaggcuaugugcccagcacaguuauugaugacaagacccacccacuuaugaaauaccaggagagcagauacaaagaaaagacuguaaaagcuuuaggggaggcuaauuuguuguauuagaaaauaauucaagaaagguuaaaauacuuuaaauccucacuuuauaucaucgauagguucuuggaaacugcaacuuuaugugaaaugauguauaaugaaaccaguuuuuuuuccucagcuuuauguuauguuauguuauguuauguuauguuauguuauguuauguuauuuuuuugagacagagucucgcucucgcccaggcuggagugcaguggcgcgaucucggcucacugcaagcucugccucccagguucacgccauucuccugccucagccucccaaguaacugggacuacaggggcccgcuaccaugcccggcuaauuuuuuuguauuuuuaguagagacgggguuucaccguguuagccagguugaucucgaucuccugaucuugugauccgccugccucagccucccaaagugcugggauuacaggcgugagccaccgugcccggccucaucaacuuuauaaugagacaguuuugaaggaaaugaugucauucgaggaccucccauagucgcuucacggaagguugcaguuugaaggaaacugucagcgacccuaugaggacacacuguacuggacaacaguggugucuaagcugagagggguggcagaguucccagcuuuuaaaauuucuuacagugauagcaucauaugaaaguaaaaccauuuucuugaaagaaaugaaggaaggaagaaaagguagaguuccuaauuguuuggaagacauacuguuagacuuccugucuuaguaugcaugccaguauuuuaagaauaaccacuaaaauaauauaaauauaguauguaacuuccaaaacagcggagaagaaaaggagaaguaaaaauacuuaaauccccaaagaagacaagcaaggagaaaaauaaaacaaaaaucagauaaguagaaauuucagcccaguaugguagaaauaaaucuaaauauaucuauaaucauaaguauagcuugacuaaacuugucagcuaaaaaacaaguugucaaacuggauuucaaaaacaacucuguuuacagggaacaugccuaaaacaaggauacagaaaagaccaaagucaaaggagaagaaaagauauaccagaaaauaaucugaaagaaagcugcaguaguuauguuaauauaagauaaaauaggauauuaaagaaaaauauuagggauaaagaauaaagagggucauuauaauuuuaaaagggcuaauuuccuaggaagauacaagaauccuaaacuuccaucuaccuaauaaaaaagccuugauauguaaagcagaaauugacaaaaccacacacaagaaacaagccuagugauugcuggguugaguagacaaagaguaaagcuuuuuuuggaagauugagacagcacagugaaaagcaagauuuaauagacaugcgcagaacacuguucccugcguugggagaacacuguuugcccaagcuuacaucaaacacuuagaaaacuuuagcaaaaauuaaccacaaagcaggcaagucagcaauuucccuuuuuuuuuuuuuuuuuuuuuuuuuuuuuuuuuuuuuuuuuuuuuuuuuuuuuuuuuuuuuuuuuuuuuuuuuuuuuuuuuuuggagacagagacuugcucuuuugcccaggcuggagugcaguggugcgaucuuggcucacugcaaccucugcuucccagauucaagugauucucaugccucagccuccugaguagcugggauuaugggcgugugccacuaccuccuggcuaauuuuuguauuuuuaguagagaugggguuucaccauguuggccaggcuggucucaaacuccugaccucaggugauccaccugccucagccuccuagagugcugggauuacaggcaugagccacugugcucggccuaagucagcagauuucugacugaugcaauuaacuacauacaugaugcaauuaaguuaggaaccaagaacaaacaacugaaaaauagaaauacguuugaagacuaaaacucacuucugaauaaucuaugguccaaagaagaaaucaaagguagaaaguaaaauacgcuuagaacugagugaugaugugucucuuggaugcauuucgagugguccugaguggcuggagcugcuucugggugaguggguuucuggcuuggagggagaggucugcauagcucucagaccugucuguggagugugguggugcuucuuucugagcagaggucaacccuugcaggcccaccuagaacuggacgccaggcugucccugugguuucuugucuugcugauguuuuagauuguuuggcuuaagcugaacuuugagagcggcagcccuugcggcugggccgcggguuggccuguugcccucaaccucaguucuuugagcagccggcaucuucagcagcacaagaugcgccccgcugggguugccucuuaucaccagcagcacaggaggaauuucuguuuaugugauccuguuccuguguguguggccccaagugacagagggccagagagauuagaagugucaagucguuacacucuugagugucaucuugcucccuaagcgcaaagggaagucuccgugguuguuucucauuuucuauuauugucccaacucugcuugaguguucgaugucauggaaacgcacugcuuuuucccacaagugugcaugugggucuugggugggaauggugaacuccgcuggugaggcagcuggugugcucaagagccuucuccugggauggagcaggcuuggagagaggagacccgucgggggcugugcugggcucugcugcucccugggccccacccuggucuguggccgccccugggccccguccuggccuguuucuaaggcccccugggccccuuucguguggagauggugucucauggugggcugcgcucacugcuuccagaagaaauucugagaggaaagagcucugacccuggagagaaguguggugcuucgggacagccucugccccagccuaguccugccguggauugggccaccuagagggggccgcgucccuccugccugucuccucuguguuugggugaaugauaguucauggagcuggaagcagugccuucuugucugcuuucugacaacccugccacaaacucaucaucaggaacuuuuugcagcccucuuccauguggagugggacuuguggccuuguuuucugggcaggaguaagaaucacaugguguugggaaagucagagcugcucuugccuuggggacucaggucucagguuguggcuguggcagcaggaccacccugugacacggcuccuuuucugugacguccuugcagggugggcuuugacagcgagaaucccggggacgacgggcagaugcacaaggggcugucagaacggagccaggcagucggcgcggugcucagccugcugcugguggcgcucaccugcugccugcuggcccuguugcucuacaagaaggagaggagguaagcggguggcagggcgagguggggcggguggaugcaugccucccauagcuaaucuuggggucaguuuugugggguuuuauuuauuuguuuuuaagcccuacagcagcgaaggcucgagguucuuaguccaaaacucucuggaagcaguccccagcguugugguuuuuaaaugccugcauuucugucugaccaaggccgaggcccucgcacaucacccgugccugcggcuucuaggaccgugguccuuuguguccaaagaugaguagaacauuaaacggcaccuuucaugggugccuuuucccacugagcagcugaccccucugcccuccucacaucauaaaugcaggaguuuauuaagcgccugcuauguaccagguaugaugccauccuuuugcgccacuuugcugggugaaaggacucuccaugugacggucaagcagauuuucacgucaggcgucaguguuaguggcucugaccugggggcaggagcuggccagcucaggcguucccugcugccacugucauuugccagcugagccacaggccaaugagagagguggucagaaaguaccaaccauggagguugcagugagccaagaucucaccacugcacucuagccugggcaacacagugagacucuguccaaaaaaaaaaaaaaaguaccgauuguggcccucuacacccaaaaugcagaauggggcagaagaaggucugggccgggaagggcaugugaugucugucucugcgagccaccauugggcaggcuuaguggcgacggacuggugugguccuguuagucaugugaaaaaguccuugcccuaauguuaaguugcucuagagggcccucugcuguuggauuccaaagcccaucuucuuuccacucaaucacaacaaauacauuaggguauauauaaccugucacggcuacucauuugucauucagaaugugggagaaaugcagccaccaccagcccccugguggugcagauggggguggggcuggcggggguggggcuccugcccaugcccucucuacacuggaguaauuauugucuccuuuuuuuuuauagggaaacagugauaaguaagcugaccacuugcuguaggagaaguuccaacguguccuacaaauacucaaagguaauuuucuguggcgagucucuugaaggccugccuccccggcccccugugcugcgcuguccaugucguucucaucaggggugccaaggaaagcagucacaggcugacuggaauccagaaaggaaagcaacacccguugccucagccacuuacgccagcacauuuuuuuguuauuuuuuucccucaaguuucucucgugguuacaacugauuuccuugaaguauuuaauaauuagguuguuuccacuguuuuuggcuguucuuuaaaaaaaaaacaaaacacacacacacacaguagugaagauaguugugcauguagcauuuggaugauuucuuucagguaaauuugcagaaaagaggcauuaucuggaucaaaggacauaauguuuguggucucgauggguaaugaugaauugcucucuaaaacuaggcuuuugacuggagucccuccuuugacauuccuccccugccaugcagugggcaccuuucagucuaugaguagcccggaagagccccuucucccccagcugcgcugggggaucacuggucugcuuuucgguccaggccaucccgaacgccuucugcuuggucccacccuuggcugugagacuccugccaaaugaccccacugccacccucccaaacccuccugccuuggugcagucucauuaggaacaggaagguguugccagcccucgucuuccuuucccugggaacuggagaugcagugacugugaggacagugggccaguucuuccccagcucgugccagcagagagcaucccugaugugguggaugguggagcagaauggggucucuuagggggcucacguggucucugcuguugaucccuggcaggugaauaaggaagaagagacagaugagaaugaaacagaguggcugauggaagagauccagcugccuccuccacggcagggaaaggaagggcaggagaacggccauauuaccaccaagucagugaaagcccucagcucccugcauggggaugaccaggacagugaggaugagguucugaccaucccagaggugaaaguucacucgggcaggggagcuggggcagagagcucccacccagugagaaacgcacagagcaaugcccuucaggagcgugaggacgauaggguggggcuggucaggggugagaaggcgaggaaagggaaguccagcucugcacagcagaagacagugagcuccaccaagcugguguccuuccaugacgacagcgacgaggaccucuuacacaucugacuccgcagugccugcaggggagcacggagccgcgggacagccaagcaccuccaaccaaauaagacuuccacucgaugaugcuucuauaauuuugccuuuaacagaaacuuucaaaagggaagaguuuuugugaugggggagagggugaaggaggucaggccccacuccuuccugauuguuuacagucauuggaauaaggcauggcucagaucggccacagggcgguaccuugugcccaggguuuugccccaaguccucauuuaaaagcauaaggccggacgcaucucaaaacagagggcugcauucgaagaaacccuugcugcuuuagucccgauaggguauuugaccccgauauauuuuagcauuuuaauucucucccccuauuuauugacuuugacaauuacucagguuugagaaaaaggaaaaaaaaacagccaccguuucuuccugccagcaggggugugauguaccaguuuguccaucuugagauggugaggcugucaguguauggggcagcuuccggcgggauguugaacuggucauuaauguguccccugaguuggagcucauucugucucuuuucucuuuugcuuucuguuucuuaagggcacacacacgugcgugcgagcacacacacacauacgugcacaggguccccgagugccuagguuuuggagaguuugccuguucuaugccuuuagucaggaauggcugcaccuuuuugcaugauaucuucaagccugggcguacagagcacauuugucaguauuuuugccggcuggugaauucaaacaaccugcccaaagauugauuuguguguuugugugugugugugugugugugugugugugugugaguggaguugaggugucagagaaaaugaauuuuuuccagauuugggguauaggucucaucucuucagguucucaugauaccaccuuuacugugcuuauuuuuuuaagaaaaaaguguugaucaaccauucgaccuauaagaagccuuaauuugcacagugugugacuuacagaaacugcaugaaaaaucaugggccagagccucggcccuagcauugcacuuggccucaugcuggagggaggcugggcggguacagcgcggaggaggagggaggccaggcgggcauggcguggaggaggagggaggccgggcggucacagcauggaggaggagggaggcgcugcugguguucuuauucuggcggcagcgccuuuccugccauguuuagugaaugacuuuucucgcauuguagaauuguauauagacucugguguucuauugcugagaagcaaaccgcccugcagcaucccucagccuguaccgguuuggcuggcuuguuugauuucaacaugaguguauuuuuuaaaauugauuuuucucuucauuuuuuuuucaaucaacuuuacuguaauauaaaguauucaacaauuucaauaaaagauaaauuauuaa

SEQ ID NO: 192664 - RNA, 11206 nt, Homo sapiens
ugaauuuucacaaagguguaaauuuauuccuaagcaguuaaaaugaaaauuugaguuugaaaggguagcaugcugauacauuaagaggaaaaagacaaguuuaagauuuuaaacuguguccacagaagaauaaacaaucuaaaucuuuucucccccguuaggucaauauugaaggaggggcuauagccuugggccacccucuuggagcaucuggcugucgaauucuugugacccuguuacacacacuggagagaaugggcagaagucgugguguugcagcccugugcauugggggugggaugggaauagcaauguguguucagagagaaugaauugcuuaaacuuugaacaaccucaauuucuuuuuaaacuaauaaaguacuagguugcaauaugugaaaucagaggaccaaaguacagauggaaaccauuuccuacaucacaaaaacccaaguuuacagcuuguacuuuacuuuaauguguaauacucaacucaagguacaagacaauugcauuuaacauuguuauaaauaaaaggaacaucagaucaaucauuaagggcuccagagugaacagcaucuucauaacuuccauguuuaucaucuuuacuuucuggauguaauuuaauaagaucaucaauucgaagaauggugauugcagcuucuguugcaaauuucaaacucuuaacuuuaacuaugguugguucaaacaccccugcuuguuuguugucucgagguuuaccauugcucaaaucaagaccaauccugcaauuaagaaagaauuauuuaacggccgcuuacaauuucauuagguggccuauuaacuccagcauuucauucaaguauuaagguugauuuuuaaaucagacuagagaucuuguagguagucuuucuaccaaaagaagcagggagagauuagcaaucacaguuaacgaagacacaccagugcuaauaauuagucauuaucccuugaauuacagugacugaacaacaaaugcuugcugugaaguuuuucauguuaaguauuugacaagucuguuacuuauguuugcugacauguaauugacuacuauccuuuuuaaugcaaccuguucugcagagguuaacaaagagcgggaaaccaugcuuaccauuuuagauuuuuacguucuggguuaaccugggccucauuaugaaaagcucuuaauuuugcaaccagaucuguggaguccugggcagcauuaacugcuaguguauugggaauaacaagaagugaucuugcaaacucugcaaucgcaagcuguucccgagaccccuaggaaaagaagaaaauuaggugacuucacaaaagggaaaaaaaaaauugaaguccacagcuacugcucucaggccucuaagacaagaaaugacuguucuuaccaugcugguugcauaguuuucaagguauauggaaagggcugcuucuacagcacccccaccgggaaccacagauuuugacuccaaaacucucuucacuacacaaagugcaucauguaaagagcgcuccaucucaucacacaugaaaucauuugccccacguaagauaaucgaugcagacguacgagccuuaguacuguucaaaacaaaaguacaauucuuguaauagcauuuuuaaaaauuuuuuuuugccaagaccaucaauuucucaaaaaaaauggcauuuuaauaaaauaagucuacauaaaguucccuuaaguccugccuacacaggauauuuagauauacuauacagaaacaaugucuagucccugcagaagagaugaaaaugguuacuucaucucaauuuacaguggcccaauguuauuuuaucccaugcguauaacugcucguaucacugugagacuacaagcagcaaauaaaugggaagaaaaccuacuuuuacuuaacaaaaucgguauaacuuuacaauuuuagaaaguggcucuuacuuuuugauuaagaucagcucaucaucacaaauucucuccuguaccacuucuucugccugucccaacauugcagcuucaaaaguuucuucaccuuccaaauuggccaggguugacagaauaguugcuaauaagagaguuacaaaggaucugugaauauugcucuuucaugauuuuaauauccuuggacucaguagcauuugugguaaaagugcuauauuacaaguuuagaauuuaguuaggcagcacacgguaacuccuuuuauccuaagauggaacugucauuuuagaaaugaacaaauucaguucacaaauuuccaacaaaauuucuccaguuacaugaaaaauggcucuauaaauguguugguagcacaaagcauuaagagaauauaaauguuuuugagcuguuuucugucaauauuccaauguaaaaagaccuuugauaggaucagggauaauaaaaguauuuuaugugacagccagcacaagacauaccuccagaagcuuuggcaaugcguuuaaggucccuuuuuaaaacucuucuaacugccauagcaccagccuccacaaaauacuucagacacauaucaucaauuccaccagugguuagaauaacauuggcaccaguugccaggaucuucugaauucucuccuuggugauaucugauucucugcaaaguauuuuuguaaccugaguuaccuucugugauuuuuaaaaauaauuuaacuuccauuaaguauuuaucacaagauaaucauagaucaaauuguauuauccuuuguuaucucugaccagaauuuaaauuaguccaauucauggaaaauuugaaggaauuaaaaauuaccacuuagcucuccccaacccaaauuugaauuacuaauugagaacuaugguuaaacagggaacacagguccugccuucaaggaucuaguggggagagggauuaccaaucacacuccagggcaagugucacuaaagugguaugcagagauuacaagcacauaaaagacauaaauuuagccuaggagguggacaaugaagaugaguccaggccaagugcaguggcucacgccuguaaucccagcacuuugggaggcugaggcgggcagaucaccugaggucaggaguucgagaccaaccuggccaacacggugaaaccgccucuacuaaaaauacaaaaaauuaguugggccugguggugggcgccuguaaucccagauacucaggagacugaggcaggaguaucacuuaaacccggaaggcggaggucgcagugagccgagaccgugccacugcacuccagccugggcaacaagagcaaaacuccgucucaaaaacaaacaaacaaacaaaaacaggaguccagaguugaaagcacaaaagaaggcagaaccagaaaagugaaaaaccuugcagguuacaccaaacaaucuagauacuaagcuuaauaucucuaagcaagacuaguauaucaucuguguuuucaaaaggauucccugauuaucaauguggaaacugcacugaauggcugaagacaagaagauaauaacaugagauauaagcugaaagacaaccuaaacagaaaagucaaauuuuauggcuugggugacuccuggaguaaaauaaauaacaagaguuuugggggcaggaugggaaaugagaguuuaguugaggacaagauuaaguuugaagucucugcuguuacucaggugaagcucccaggaggcagucacuuacaucauggaaaccauaaacuaugggagauccagauuugaagagucaauaugagugaagccaugugaauagaucauucgaagaauuuuuaaaguaaaaugaauuacagaucaaccucaaaagcagcuugucuacuaaacaaguacugugugcuacacacuguuauauaaacucaugguaaaaacuguaauaagccccaggaagaaaaaauacaggaaguuacaacagaauauaauuuagauugaagaagaaagaaaagcuucucuaagagacuagcuuggguguguuucuacaacagucuaggcaagaaaaugaaaaguagguaaauuuaauuuggagguagaaaucaagcggucuuggugacagauuaggagaaaaaguguugguaaaaaggaggaguuaaggacauuuccuaguuuucugccugugugaaggacuccccaucacuaaaauggucaaaagcagauuugcgguauuaucacaaguucaguuuuagacauguucacuuugagaugcuugaaaagcauucuacuagauagagguauguguguuuggagcuuagagaaacagcugaaagagucucuggcauagagagauaauacaugaagucaugggaacaaaggggcuauccuggagaguauuaugacaugguccagacaaagcagcaucacaaagccuuccauccccgaaagcauuucaagaaggacauaaucaaaggguugcuaaaggucaaguaagaggaaggcugaaaaugucuuccgaauuucacgcuagagaccuuaacaugcagucccucaaauggagaacagggcugaaaagggaugagaagaaaagcaccagagaaguuuuguguaguaaaccacucaugacaucugccuguaaagauguacgauagggaguaccuauagcacaaggauguaugaagaagcuugaaggacaaaagagccacaggaagaauccaggaaagagcauaauuaguugaagaugcaaguaugaaacaagaaucaaagaaaaggcucuagagcagaaggaaacagacucuagaacacuuacuguagagggacuggcuuugauggaagaaaggacacuuuguuguaugaggaaggaaggaaaaaagaacacccgugcagacugauuuaaaagaugacagcacauuucuuacucuuggcaaagcuuucuuguaggucuaacuacuguuuaaacuauuuuuuuuuuuuuuuuuuuugagacagggucucgcugucacccagguuggagugcagugguacaaucacagcucacugcagccucaaccuccugggcuucagauucuugccaccucagccucucaaaguguugcgauuacaggcaugagccacugugcccagccuaaacaauuuauuguuuuaagugacugucaggcagucaaaucuauagcaauggucacacuaccuccaccauuagcucuucuggcaugccaaccacuaauaucaccugcaccuccaguaucuagcaaacaguagguuacagucaauacuauacugcugaguucuguacugcuuugaggaaauuagauuccugucuuuuacaucuuuaauauuaauagacucauacaaucaaaauuccacaaaaaggccgauuuucauauagguuguauaaccccaaaucccucuaaaaacaccaccaggcuaauuuuucuggaaguaaaauaguuugacuuggcuaaaaauguuaaaguccuccaagacacucacacuuaaaaggccaaaaauaaucucucaacauaccucugucuaauuugguccaguuuuucagggucuguaaugaccaccuguacaccaagcuucauuuuuguuuuuugcaggcugaagucaaggcaagcaauuuuugcauuuacgauucucuugggcaugccuacaauugaacauaagauuaaguuaauacgucuauccuuaaaagcauaauaaagaguaccuauaaucgauuguauguaaacacacaaauuuagacuaauucauugcauuuuaucuuagaaaaauuuuauggcauuaaaugcacguaauuucuuuuaauucacauuccuucuaccauguuguaugugcuuuaaauuacaaaaagauguacugcacauaauccacaaaaaaacauuuuuuauuuuuuuuuuuuuuugagacggagucucacucuguagcccaggcuggagugcaguggugugaucuuggcucacugcaaucuccgccucccagguuccagugauucuccuuccucagccucccaaguagcugggacuacaggcaggugccaccaugcccagcuaauuuuuguauuuuuuaguagagaugagguuucaccauauuggacaggcugcucucaaacuccugcccucgugauccaccugacucagccucccaaagugcugggauuacaggcaugagccaccgcgcccagccaaaagaaaagcuaguuuuaaucuguagcaaucucauucuauaaaccaaaucccaaaccuuacccugggaucccaccacacaguugagugcauagccacugaugagcauacucuccauuugacuucucccaugggcuuucaaaauauuaacagaguugacuggauagcguggcuggccucuuaugucuguguauuuaauagcaaguacagcaucuacuaccauguuagcaaagaaaucaccauuucuacgccaaaaguuaaggacaguaacagguuuggaauggacaaaggguacacacgugaaaaaucaaggguaauuucaagggacuuccuuuuaguaaucuaaucuauuaaagcagcaagcauuacuugucaccaaaauguuacaacauuaucacuaucugcaauucauaucacuuuuagacaugcuuuuuauuaccuuuucacccuaaaaaagcagggaaggcaacagguaauuucaauacagcauuacuccucucuauugauaucaauuugcauaaaauugguuauucaaaauuuuauugcacaaaauugauacugcugcuacuacgcacgcgugcgcgcaacacaugcgcacacacgcacccacucccgagacagggucuugcuauguugcccacauuggacuggcacuccuggguucaauuaauacuccuaccucagccuccuuaguagcugggacuacaggcacauaccaccaugcccaucucaaagucuuaugcuuuaaaaagucuaaauuuuaucugacaaccacaaggauacauuccaaugauuuuggaagacauggaugucuuagcagcauuaaucaggcaaucucuucccaguucaucuguguuaacaauuagguuuucauugauauaacgcacugcuucccuguuuaaaagugugggggagaaaaacgcuuauaaagucacuacucaaacucuuugcauucaucaugcuuaacacagagccaaaaugucguaaguaauaauauccguucagccauuucauauaggaggaggacaugaaaaaacccucccucuucagaucauggcaaguuuaaucuaucccauaagcauagccacuaaaaucuauuauuaggagaaaaugugguagucaaaugagaaaaaagauacugguccaaguuuuuaacuucaaauauuacuacuuaaaugcuaaaacauuuaaauugaagguuuucaaauuaaaauuuaguuauuaaucaaaacguuaagacaacacaguuuacaacuauuacaucaaaaaaaauuucucugaaugcaaacaaucuuacuugcaagcaagucgauagccacuaauaacugaugugggaugaauuuucuguuugacuaauucaucugcauuuuuuaggaguucugcugcaauaauaaccuguugagaaaacauucacuggucugagugugccggauauucaacaugugcaauacauauggaaugacacuaaaauggccauauauuauuaaccaaaaugguagugaugaaaugaauuaacugguuauuagaaaccugggcgugaagggagaagaacgcuacaaaacacuccaaguccuccacguuacucauaaauucuuggaaacugccacuuuaagcaaaacaauggacagcaauuucucaaauacaguuguuuauuguaacgcugauggggggaggaaaacuuguuuuuuuauacaucaucuuuccucuuaaagucaguuuccaugaagccacuguggauguucagugaggucuuauuguauuauaaaugcaaauggccaaaacuggguaggagccagaaaaauguucuaagaaacuaguucagcaauaagaaacuaguucaucaauacaaccguaaaagacaacacaucuauuaccuuuagaaaaaaugcucaacagaagcuaaaccgagugugacuauucauaugaccuauauuaagcuauuauuuuauuuaaaaaagauaguucuucaaguugauaaaacacuaagaaauauuuuuaaagcaaaaagacugucagcuucuuauggaaggaaaacuacauuuguuaaaucacauuaucguaaguuagacaaagaucauauucauauuuuaggaguagauuccauucuuucauggcuaaaguuuaaucuagaaauacauuuuccccacaaacuaucuaguuucuccagaauuaacaucuuucucaccaaacaauaguguuucuacuauaccagcaugcuggaugaucuaugaagaguuuauacuguguaucacauuuacugacucgguaagaucacacugucauaucaugauguauuuauuaauuucucacacucccauuuugaauuccugagauuaccugucaggauuuaaaaaauagaacaggcugagugcagcucaugcguguaaucccagcacuacagaggccgagaagggaggaucacuugaggccaggaguucaagaccagccugggcaacauagcgagacccugucucuuaaaaaaaaaaaaaagagguuuuuaauuaguugcuugugguggcacaugccugcaaucccaagcacucugggaggcuaaggcaggaggauugcuugaacccaggaguuccaggcugcagugagauaugacagcacugcagcacuucagacugugcuacagauggucucuuaaaaauaauaauauaaaaacauuguuucucccccagauugguaacauuuuauccuccaaauaaucagaaaaguugagagcuuuccaagucucaaggggugaugggggaggaaacaagacuuuugagagaccauaaaaaaaucugugugaugucugaauacugccauaaaaggaaaaauaagcccucaaaacuugugaauaccaacauuuaaaacaauggggcuaugucaaaugaacucaaauucuuuccuacuuaaacuguacaaacuagcuguaacuaucaacuuacaaauuuuguuucugaaucuguaccuaagaagcuuauuuccccucuuaaauguguaacuucuuuuguuuuuucuucuugcucaaucuucugggcauucagaauauguaacuuauuucugacacagcacaaaugacccacuuauggcuucaacuuucugaaagucggucguuuuuagaaaaaugaucauucuuuagccagucuaccuaccacugaaguaguuccaucuccaacuucuuugucuugcagaucagccagcucacaaagaacuuuagcugcaggauguucuaccuccaguaacuucaggaugguugcaccaucguuaguaaugguuacauccuaagaaauucgcaggaaaaaauaugaaccacuuauagaaaucaacacagccccauuauaauacacguucaccuuuaauaucaccuuccaguacguggauucugauaaagucaaagaaagaacauagcaaaacacugaagauaguuuuacuuuaaggaaacuaacacaacaguuauguguacuuacaccaauaucauccaccaacauuuuauccaagccaacuggaccaagagaacuuuuuacaauauuggcaaucgaagcugcagccauaacuguagacaaucaauuaaaaauaaaaaagaaaugaggauaagccacaacucugaaagacaguaauuucagccuaaagguaaaugacauccaacagcccccguauuucccaaaucuacaaaucuguguuaauuauuuaaaaaccaccuacuaagaguguaaauggggccagacacuguggcucacagguguaaucccaacacugcgaggccgaggcaggaggaucgcuugaugccaggaguuugagaccccuuugggcaacauagcgaaacccauuucuacaaaaaauaaaaacaaagccggaugcggcggcgcggaccugugcuuggagaaugcagugagcuaugauggcacucucgucugggcgacaggugggacccugucccuaaacaaagcgagccuauuuggcacagcuuugaugcgggguggaaucugauggcggggaaaaaaaaaaaaaguaauaaccaccaauuucaugcucugccacuucguacagcuauaccagccuuuuccuucagauucugcaaguuuuuugcucauuaaaacucucuuuaucugugaggagagaaaucgguagucaacggggaagguggugacuuucagauuuguuuacgaaaaaaauuaggaaucuaucaagaaacaguaagcucuguagguauccaaaggccugacagcaaacgcucugcuaaguuagcgcugccgucuccuggggucaaugcacucgaguggcguuuccugggcuaacucuacuguaagaagcugucaacccggauacggcuggacgccggacgcccgaccucgacugcagcugcgggcggacagggcaccgggcucauccgagggcgcgcggauggaccuacucuuuuucugguaaaugguccuaaaauaaaaccuggcguuuaacauggacacucagggggucgcccugaaacaaaagggggugcgaggcguggcccgcacgugcgagcccgggaggcccgcuuucccgcggagggcgcguuuccaacgccgccccggacaccacauccacgcguugccggucucaaaacccugccgcgcgcggcggggcuccuccucgcugugggaaaaguggggccacagcgcccugccccagagaacggcgggugggcuggguccggcugcggggccccgaggcccuuucugcggagguaaaggagagaaacgagggcagccgggguccggucgcggugggacucggcccuccccggccgcaaacccgacccaggcccggcccgcccuuaccguuuugggagcggaucguuuccccagugcugcggucaccgaacacggacaaaggccccuccaucuugacggcagcgauacacgucgaauucugcuuacaccgcgggcaaccaguaucgcggccccucggccgaccggcgaccacagcaguggcugcgacggcguggagcguacccgagcgaugucccaggagcuacuggguaacacaccaccccacccgcuucccggcugccccggcccggccgcggggcacggcgggaaggaaaaagaggcagggacaacagggagagaaacaggac

SEQ ID NO: 192665 - RNA, 17099 nt, Homo sapiens
uuaaugauugaucugauguuccuuuuauuuauaacaauguuaaaugcaauugucuuguaccuugaguugaguauuacacauuaaaguaaaguacaagcuguaaacuuggguuuuugugauguaggaaaugguuuccaucuguacuuugguccucugauuucacauauugcaaccuaguacuuuauuaguuuaaaaagaaauugagguuguucaaaguuuaagcaauucauucucucugaacacacauugcuauucccaucccacccccaaugcacagggcugcaacaccacgacuucugcccauucucuccaguguguguaacagggucacaagaauucgacagccagaugcuccaagaggguggcccaaggcuauagccccuccuucaauauugaccuaacgggggagaaaagauuuagauuguuuauucuucuguggacacaguuuaaaaucuuaaacuugucuuuuuccucuuaauguaucagcaugcuacccuuucaaacucaaauuuucauuuuaacugcuuaggaauaaauuuacaccuuugugaaaauucaucccugccuaucuuaccucguuccuuuuaugccaaguaagccaaugucuuuuuuuuuuuuuuuuuuuuuuuuuaaaccuugggaaguaaugaacucaguccuaguaacuaguauuucuuuaacuauuacccacauggccaacaccuagaagauacuaucuuaaaauuggauugugaaauucacugguaagcucucaggguuacuugugcaucuuuaccuucucuggguuuaauccaaguucuuuaacuauugcagcagagacagcugcaaaggcuucauugauuucaaauaugucaacaucuuccagugaccaaccugcuuuuguaaccuagaggaaagauucauagaaaagaggucuaaacuuggguggaaaggcuaaaguuaaaccauucuuugucaacauaaauauaugcugcaugauacugguaacugcuacuuugguuuguucuuagguuaauacagugacauucucacacauuuuugccuuagugacauccauuccauccaaaagguuaagggugugaucuaaaagaucccuuagaaauucuaaauugucuuaaaauuuugaaccaguagcaucuguuauguguaccuaaggcuaauguaacagaaucaguuccccuagaaagcaugugauccaaaugcucucaguggcuggggguaguggcucacaccugaaaucucaacacuuggggagccuaaggcaagaggaucaauugaacucaggaguucaaaaccagccugggcgacauagaccuugucucuacgaaaugaagaaggcuuggugcaccuguaguucgagguaaugggaggcuaaggcaggaggaauauuugagccuaggaguuuugaggcugcagugagcuaugauggugccacugcacuccagccuggacaacagagcaagaccuuaucucaaaaauagaaauaaaugcucuugguuacucuucugguagggaaagacuagagcuaacuacaugaauaagcucacuuaaggcuaacaggaagacaaauuucauaaaagggaauaggguuauacucacagcuugcuuuauggcuggaauugguccuauucccauaauggaaggcuccacacccacuugggaccaggaaacuauccgugcuaaagguguaagcccacguuuaucagcuucugacuucuucauaagaacgacagcugcagcaccaucauuuauuccuguaaaauaugagugacuuaauuucuaccaugcuuauuaaccucaguuacauaucuguggcuucuuuaccaccugaagacaugaguuaaaugauuuuaccuguuggcuaaggcauuuacuauaauucaacagacuuuacauagaaauuauguuuggcaauauauugaccacaaaacuuuccaacuagagaaagugguaggauuacaguagucggggcugggcgugguggcucacgccuguaaucccagcacuuugggagguggaggagggugaaucaccugaggucaggaguuugagaccagccugaccaauagggugaaagccaucucuacuuaaaauagaaaaaucagccggugugguggugugcgccuguagucccagccacucaggaggcugagacaggagaauugcuugaaccugggaggcggagauugcagugagccaagauugcaccacugcacuccagccugggcgacagagugaggcuccgucucaaaaagaaaaaaaaaggauuacagcaguuggggaggggagaucucugacaggaaauggaagaauaagccugggcuucacaaggagguauugggaguuucugguacuggaaaaauacaaagguagauaaacugaaguucccuaauuuacuucuucauuuguaugucuaguugggaugucaagaaaccaaauuaauucuuucaguauagguuaagucaaugaucaaauacagagaaaugacauguuuccuuaaacuguuuuaagaauaauuuuguacauaaauauugaguugggugugguggcucaugccuguagucccccagcuacuugggagguuaaggcagggggcucacuugagcccaggaguuugaggcugcaagugagcaaugaucauauugcugcacacgaaccuggcuggcagagugagucccugucccaaaaaauaguacuuuuguauauaaauaaagagaaaaauauucacucgguagacauuauagaacauaguauucccccagauguccuucagaaaaucuaaccugaagcauuggcuggggugacuguucccguuccaucaguaagaaaguaaggcuuuagcuuggacauggcuucuauguugcucccauggcgaggaaacucaucuguuuuaacuucaauaagaccuaagcaaaggaaaaccaauuacucaagauuaguccagagacagaaguaagugugcugggaaugguggguucucugccauuaaacaugaggauucauauuuagcagaaaaguuuuaauaugugaccacuuugaugacaacaggaggaaaguacacacaagaauuauuguacaugaaaacaauuuaugaguauguccuuaugagacaccuguguuuuccaaauccauaggccuuccugaggaaaguagcuaccagggaccuguuugugccaaauucugcuauaguuugggucauaguacuuggcugguuacgagugaguggaucaggcagucucaaagccaaucgugcacugcuggcaggacauaagagauaucaguuaucaauaagggagcuugacgggagcauucuguauuagaaaauagcgagugaccccaaaagauccacccuuuagaaaugugaaauggagaucacacagaaacagcgagaaguaauggguguccacuucugaggagguugagccuauacaggaaacaggucagcuggugccuccuaacaaccaugagccagugcuccagcuucucaugaaaccugcugugugugcacaguggucauggacgcucuggaaccaagagugcuugagugcugacauaggucccauguuaccguguccuguaaacccagcauacccccuccccacauucauguauccaggacauauauuugcaaccugaaaaacauaacuaagauauaauuucuaaagauuccuauguauuacucuuuuagauguuacucuuaccuauaaauagguugauguuuaaaccacuaugauauacucaccuuuucuaguugacaccaaaacugguacaaucucuuugucaaaauggccagcuuucugugcauucucuguccuguucugggacagaacugcaaccuuguccugaucuucucuacucacuugccauuuuuuggcuacauuuucagcugggaaaggagaaaaacagcaaaaaacuaacauuuucaugaacuggcauuugauagcucaagucguccacauuugaccaagcacugacugaccacauaugcuagcaggcucaugguggccugugcaaugcucugugugggguggcccugccugccacuggcaguugguuuggaaauguugcagugacucucaggagucauacuucucuccuucccuuucuauauaauuguaaacuuacagaaauuuccuucacccagagucaccauuuauauuuucccuccauuugcuuuaauauuuucuuucugaaccaucugagagaaaguuggagauacaaugccuucuuacucuuaaauuuuaauuucaguguauacuuccccaaaacaaggccacuuucuuacauaagcacaguuauaaaacucaagaaauugggccaaguguggcggcucacaccuguaaucccagcauuuugggaggccgaggugggaggaucacuugagcccaggaguuugagaccagccugggcacagcgagacccugucuccauuaaaaauaaauuuagccgggcauggugugugugccauguagcuaguaguccuagcugcuugggaggcugaggcagaaggaucacuugagccuaggaguucaaggcugcagugagccaugauugugccucugcacuccagccugggugacccugucucacaaaacaaaacaaaaaucaggaaauuuaacaugaaucaaacacuauuaucuaauccuugguccacauucaaauuucaccuauauuucaguaauguccuucuagcuccuuuauuugagccaauaaagaagcaugcauuguacaacuaucaaucucucuaguuugcuuuugucuguaacaguucuucagacuaugcuucuuaagcuugauauuuuugaagaacaugggcgaguucuuuuguuaagggucaucaauuuugauuugucugauguuuccucagaauuagauuaagauucugccaaaaggcagguauaccacugaaugauaguaugauuuuucucagugagucuuauuaggacacaaaugacaaucaguuuaucccaggugauguuaucuuugaucacuugguuaaaaugguuugguauucaccagguuucuagcuuuuaaagguaccauuuuuucauuuauaaguaaucaauaauuuaucagagguucuuuuuggauuauccaaauaucuucuuccccaucauauuuucacccacuaguuuuagcauucauucaugacuuucuaacuccaacauuccuucuauugguaagauauuaauuggcauuuuaccacaaagaaaaccuuuuccuuuucucccauuuauucaguuauuuauaucaggauggacucauacauuuucauuuuauugaauaaguuauaacucauuacucucauuacuuacuuugaugcugaaauuuuucaauacuugggcaguuauaacccauuacuaucauuacuuauuugcacgcugaaauuguucaaaauuuaggcaguuacaacccauuacuaucauaacuuauuugcacgcugaaauuguucaaaauuugggcaguuacaacccauuacuaucauuacugacucugaugcucaaauuguucaaaauuccacuacaggaaaguggaagccccguaggcugccuccugugugcuuucaacaugucccugagcauguccuuaauuuuuuagcauuuuuucccuagccuuggaaagggccauuucuccaaacaaccuuaguuccuuuuaguggauaaauguauuuagaagaucugggugucaggacugcuuguuguuacugguuugucauuguuucuaggucuguucaguagaaacuuccauauguauuauuuauaauuuuacauauacacacacacucaugguaacaccuugaguucauacugcauuuugaguucuccaaaaugcaaccuaacaccacaagcuacauucuucucccuuuccguauuuguaacucucuucuacaaaugugagaauuggccagguuuggugggucacaccuguaaucccagcacuuugggaggcugaggugggaggaucccuugagcucaggaguuugaggccagccugggcaacauggugaaaccccauuucuacaaaaaauacaaaaaauuagccaggcaugguggugaguaccuguggucccagcuacucaggaggcugagguggggguugcagugagccaagauugagccacugcacuccaaucugggugccagagugagacccgucuccacacacacacacaaaaaaguuauugcuuugcuuucuaugucuugucuuuacuuaucaagcuguuuuucuuucuuuuuuuuuuuuuuuguuggaugaugucucacuauguugaccaggcuggagugcagcagcuacuaacaggcaaaaucaaccauaguauacuauacaaccucaaacugcuggccucaagugauccucccaccacagccucccuaguagcugggacuauaggcaccugccacugcacccuguaaaagcuauucucuuauauauacuucuagaagcuuuacauuuuuugcuuuuauuuuuaaauccacgauuuaucucaaauuagcuuuuauauagggugugagguagggaucuagguucaucuuucccaugugaguaaucuguuauuccagcaccauuuguugaaaagacuuuaauuucuccauuucauuccauugaugccuuuguugaaaacaagcauaagucugggucuauuucugaacucuguucucuuucucuguccuuaugccaaaaccacauugucuuguuuacaacagcuuuauagguaauguuaaaaucagagcauguaagugcuauuuucugacuucaaaauuguuuuggcuauucugagugcuuugcauuuuauacaguauuuauuuacacuauuuauuuauuuauuuagagauggaguuucauucuuguugcccaggcuggagugcaauggugcaauaucucagcuuacugcaaccuccgccucuuagguucaagcaagucuccucccuuggccuccagaguagcugggacuacaggcaccugcugcaacaccuggcuaauuuuuuguaguuuuaguagagaugggguuucaccguguuagccaggauggucucaaucuccugaccucaugauccgcccgccucggccucccaaagugcuaggauuacaggcgugagccaccgcgcccggcuggaagcuauucuuuuguuguuguuguuguuguugugucacuauguuaaccagacuggaaugcaguagauacucacaggugcaaucauaguagacuaugauagcauugcccaggcuagacucaaacucuuggacucaagcaaucucuugccucagcucuugaguaggugggacuacaggcacauaccaccaugccuggcuccuuuaguauuucuuguaguguaggugugcaggcaauucauuuuccuucaucuaaaaauggcucuucacuuucacucuuguuuuuuuuuuuuuugagacagagucucacucuguugcccagacuggagugcaguggcaugaucuuuuuuuaacuuuuugcuacaauuugcuaagguguaauuuuucccuugucuaucuuggucuuugaacuucuuuucacaccaaauguggaaauuuucuucaguuuuuuucugccccauucucucucuuccuuauguaugagauuccuauuccaugcaugcuaguccuauuuauuuuguccugcagaccaccaaggcucuguucauuuauauuuuauuuuuuugagacggaguuucauucuuguugcucaggcuggagugcaauggcgugaucucagcucaacgcaaccuccgccucccagguucaagcgauucuccugccucagccucccgaguagcugggauuacaggcaugcgccaccagccuggcuaauuuuguauuuuuaguagagauggaguuucuccauguuggucaugugggucucaaacucccgaccucaggugaucugccugcauugaccucccaaagugcugggauuacaggcaugagccaccacaccuggccuauuuuuuaauuuaauuuaauuuaauuuaauuuuuugagacagaguuuuguuuguuacccaggcuggagcgcaauggugugaucucagcuugcugcaaccuccaccuccuggguucaagcuauucuucugccucagccucccaaguaguugggauuacaggcaugggccaccacauccagcucauuuuuguauuuuuaguagagacaggguuuccccauguuggccaggcuggucuugaacuccugaccucagaugaucuacccggcuuggccucccaaagugcugggauuacaagcgugagcuaccgugccuggccuguucauuuauucuucauuauuuuucucuguguucuucaggucguguauaugaucuaucuucaaacuuccugacccuuuuucuucugucuccaagaugcuguuaaggccauucagaauuuuuuuuucuuuuuuuuuagagaugaggucuaacuauguugcucagccuagucucaaacccccagccucaagugauccucccaccucagccucccaaggugcugggauuacaggugcgagccaccaugcccggccccaucccagugaauucuuaauuucagauuguguacuuugcaaguucuagaauuucuauuugguucuuguuuauauuuuuuccuuuuacuccugagauguccacaucuauuccucuaugaagauuauauuuuccuuuguaucuuuaaacauauguaaaauagagccuuuaagauccucaucugauaauucuaguauugcagggucuguugacuguugugguuuuuuuccacccugguuguaagcuauauuuuccuaauucuuuguguaucuagaaaguucucauugcaugcugaacauuauaguugcuacauaacuggacauagagauuuuauuaucuuuagagaauauauugaguuuuguuuccacaagcagucaaaauacuggcaaaucaccuugauccuuuugaggcuuguuuuuaagcuuauuaguuugggucuagaguagcuuuuacucuauggcuuuggcccuaccccuaaacuguggucuuucugagaugucaauggaguguccaaggaguucaguaagguuuccacucgcuuguccagaacuuuuaucuccuaguaaucuauaaaaucuccaguucaccucuccuuugcagcucuuuucuacuaggccuuguaagcuguuaucuacaagcuuaguauuugaucaaagacuuaaggggaaccuuuugcagauuucuggagcucuuuuuuucuucucccccuuauucugccccacaaacuccagccaucucagaagccccaaauucucugcuucuucagaucacugagaccacuguuuccagcuuaggcucugccucuccauaacacaguuugggaagugcccuggguagagacagugacagugggguuuucccuucucucaaggaucucagucuuacaugaguauuagucaaaaccugacauacauaaaacaguggcuuuauauauuuucacaaguuuuaugcuuguuuauaguaggaaaucuaaucuuugucaauuacuccaucaugaccugagccuuuuuucuuuucuuuuuuucuaaagaagagcaauuuauuuucuuacaguucuggaggcuggaagaguaccauucaauccacaguacaccuuggaaagggcucgggaucugaauuuuuaaugaccaccucuaguuaugguugaggcaguuggucacacagugucuuccauugucugccuguguuuuuauagccuucucuguuguggcuguaagucgagaaguggucaagaugccuugagcuucucauugcuucccauaucccuaagcccuuccuuccuuccuagcauucaugcacacaguucccucuuggaaucuuguacuuuuccccauuaccuuuuucacauauuuauguguuacauaaaaccagagccauugcugcaugcauuugagcaaggugcuuaacuucucaggguuugauucuuuaacucuaaaaugucuauucuguuucuuaaguuuuacauguauacuaaagacaagagugcuuuugauuucccaguugcuuugccauuaaacuuagaccacaggacccuucagcaugaaugaccaauaacccaauuguguaguacaaaaaguacagcuagguaccaaaaaaacaacugguuuaucucugucacuaccucugccacagaagcacuauuugugggcccuguuucuucauuugguaaaaugagggguugauccagaagaacucugagguacuucccacuucuaacauucucugauaaucaagaguucacaaagaagagaauacuuacuucacuucaguuaaucaaagaagagauauaaaaauccuuaagacagucucuggccauaaggacgaaagcaccuaagaagcagauuaguauauggucuuuuuaaccuuuuuaaagcuaauacaguuucagccaugucugccuuaccuguaauacccauaugacaguugugaaaugcaucuguaagaccaucacagaguauacugucagucaguggcaucucaccuaucuuuacuccuguucucaaguaagccaagugaggagccuagaagucagaaauaaaaauggauuuaggcuuaguugcaauuagucuucuccccagaauacaacucaaaacuaucuaguauuuccuaagucuucaucuaggccccuuugcagcccuucuccccaguucuagguccucagccaggccaaggucuaaagaccccuggaauuagcagacuucaucuuuccuauuguugggaacgauuacucuccuaccuacccauuuucaauucucccucaaaccuacccauucuguguccuguuuccuuaagaauuccauuuauucuuuccaucgaggcaauuaauuaucuguuaaaugaagaaauccucuaagggcuuaaguaaagcuaacaauguguuaccuauuucaauggaugacauaaugucuacagugagaauaaucaggcuaacuaaaugauggggagggauuucugaguagcggccagucuuaacucucaccaacucaacagcagguauauuagaauggaaagagucauugauuggacuuagagucggaagaguuguauuugaaugcuggcucugguccucaguuuccuuaccuguaaacugggaaugguaucaucuacccuauauggggcuguugugaacacauguacaaaagcaccugguaaaguacuacacagaugucaguaucaucccaucaaaaucacuccgauuauuuuuguuaccuuuagccugccuccuccugaaccucagcaauggcugggcugaaucagcuucuaucuagggaaucugcaccucagccccugagcugcaucaguaggaagcaggggguauaguuuuucuuucaaccacuaugccaguuugagguauggaacuuggugaaacaaaucaugccuggcaaaccuacuggagaagggcaccacuuggugguccucuuuuacauguucuauacccugaaaaggucaaaaagucugguccccaggaucuccuugucaugugcaggaagguaaguggcaacaucuguuuuuugccuuuuacucacaaugggaaagaaauuuaaaaccaaggacaucaagcaacuaauaugaauuuaauucagaaaauauuacaugcuucauuaauaguuuagaaaaaguauauucgguuccaaucacacugguugauaaacuucuuaucaacccggauuucccacccaaacugaagaauacuucacauucaaguagggaucaagguugucauuucuguuuauuuguucacuguuugguuccagcucugcuaugcaucuguuuacucuguucuggcauagacaugaguuucucagugugaggucagugaaagccaccucaucagagaggccuuaccuugcucauauuuuccaugccuccugcaaccacaaugcuggagucuccuaucccuauugacuggacugcaaggcacacagcuuuuaggccugacccacagaucaucuggcagcuccaugcuggaacagaguagggaauuccugcacccacacuggcuugucuaacaggauucugcccacagccuagaaagaggaacacagaggacucuuagcaaucaaggagaaagacaaaaugucacagugaaaguguguggaaaauugccaguuggguuaccugccacuucugaaagccuacaggucaaguaagugcccacuggaggcaaaaaggccuguauacacucuccaccugucacagucuagcccuugaauauauacugccuugugcugcucuguagguauuucauagauauaagcuuucuccuccauaaauaagucauuaauacauuaagaaagaagugucauccucaucuuuugauauggcuuaaauaguugggcgcgguggcucaugccuguaaucccagcacuuugggaggccaaggagggcagaucaccugaggucgggaguuugagaccagccugaccaacauggagaaacucugucuguacuaaaaauacaaaauuagcuaggcgugguggcgcaugaguguaauccuaguuacuagggaggcugaggcaggagaauugcuugaaccugggaagcggagguugcggugagcugagaucacaccauuacacuccagccugggcaacaagggcgaaacuccgucucaaaaaaaaaaaagugcgggggggugcuuaaauaagcauuaucaaaccuaugucuaauaaacacaggauauaaccuaggcauuaucaguguuucuaacuagggccauuugcucccaagaucauggcuuaagacacuugagaagaaaaaggguuacuuaaaaaggaaaaccuuugauaauaagcaguucuguucuugcuuaguauucauuacacuaugcuuaaaugguuauauaacaaaauauauacaaacucagaauucacaaauaccuuuuuuucucauucugaguacugaaacacaaauaucuuuucauaauucaacuaugggacuuccuuuaguugggaagaaauacauaauuuacuuaaaguagcacagaagagaauggaguuaaaaguuucaaauauucucaaucgccauugucuguuaucagagucaaugguaaauguuuauaaagugguuacucuauucccaguuucagauauacucaaaccuaccacccuuccuuggagaguuuguggggaagaacuagcaaauaagucgcugauaaaaacuuagagauuauauucaucacaauguuaucaaucugggauuaggcuggaaacuaaaaacggguaagguuacuugagacugaaaacauaugcaggaucauauacauauuaaaaagacaggcccagugcggugccucaggcugugagcaguggcucacaccuguaaucccagcacuuugggaggccgggggaggggggcgcauuacuugaggucaggaguuugagaccagccuggacaauauggugaaacccccccucucuacuaaaaauacaaaaauuagcugggcaugguggugcacgccuguaaucccagcuacucaggagguugaggcaggagaauugcuugaaccugagacagagguugcagugagccgagauuguacggcugcacuccaccagccugggcgacagagugagacuccaucucaaaaaaaagaaaaagaagaaaugagguacagggcugggcaugguggcucaugccuguaaucccagcacuuugggaggccgaggcggguggauaacuugaggucagaaguucgagaccagccuggccaacauguugaaaccccaucucuacuaaaaauacaaaaauuagcugggcacaguggcaggcaccuguaaucccagucacuugggaggcugaggcagaagaaucacuggaacccgggaggcagagguugcagugagccaagauugcgucacugcacuccagccugggcaacagagugggacuccaucucaaaaaaagaaaaagaaagaaaugaggugcuaacacaauuaauaaugcuagcauuuagcauacuacgagcuucaugagaaugagaauuucuaucugauaugaacauugcuuaucuccagcugcuaaaauagugccuggcacaaaguaggugcucaauaaacauuuguuacaugauuguagaagguaucuggcucaaggaauaggacagaucuaaguucaagugcuagcuccacuucaaacugugacccugguaagucauuuaaccucuuaaacucucauuuauucauuuguaaaaugaagauaauaggauauaacagacuugugaggaagauuaaaugagguaaugaaaggaaagcauuuagcacagugcuuuaaaagccuuaaacuuaguagacaugcaccgguagucccagcuagcucagaaguucaagggcauggugcaccaugauugugccugugaacagccauugcacucacgcccaggcaacagacagacuccacuucuacaaaaaaauuuaaaaaauuagccaggugugguggccugcuccuguaaucccagcuacuccagaggcugaggugggaggauaccguggagcccaggaguuugagguuauagugggcuacgauugauuacaccacugcauuccagccuggacaacagagugagacccugucucuuuaaauaauaauaauaauaauuaauuaauuaauuacgaguguucaaacccaaagaaucagaagaugggggcacucucaggacucagcuauauuccucuggggagugauaugccccauuugcaaggggcaugauguggcaccuauuuuccaagcucagaacugagcccuaagagggcagggaacuuaccuguauuguuggaaccauacucccagcacuaagcacaguauggggcacauaggaggaacugaauacauuuuuguugaaugagugacacuuugagguaguaaggaggagcaggcauacuuuccuaugcgucaggcuggcccugcugcugcuucuucuucuucuuuuuaaaaggagucucacucuguugcccaggcugaauggagugcaguggcacaaucucagcucacugcaagcuccgccucccggguucacgccauucuccugucucagccucccaaguagcugggaauacaggcgcccgccaccacacccggcuaauuuuuuguauuuuuaguagaaacgggguuucaccgugucagccaggauggucuugaucuccugaccucaugauccgcccaccucggccucccagagugcugggauuacaggcgugagccaccgggcccggccggcccugcuucguaagaaugaaaaggcagugggccgccuguagucccagcuacucgggaggcugaggcaggagaauggcgugaaaccgggagacggagcuugcagugagccgagaucacgccacugcacuccagccugggccacagagagagacuccgucucaaaaaaaaaaaaaaaaaaaaaaaaaaaaggaaaagaaaaggcaguguaggugguguaggucaguggucuaaguucauucacaaaaagcauauuaaugaagcuaagucuuuuuguuuguuuagagaaggggucucacucugucacccaugacggagugcagugacacaaucacugcagucucaaacuccugggcucaagugauccucccaccucagccucuccaguagcugggaggcacaggccaucauaccuggcuauuuuauuuuuuguagagacggggucuugcuuuguugcccaggcuagucucaaacuucuggacucaagugauccuuccuccuccgccucccaaagugcugggauuacaggcgggagccacccugccuggccaagaagcugagucucaagcuggauagaagcuacugacagggcuggaagaagggggccaacaggaggaaucauaacagagggaacucugagcaaaagcaaggaggcaagaacuugagugagugagagagugugugagugugugagaguguguguguguguguguguuuaugggcuguuucuaauaagccugacuucuccuggaaucacugagacuuaccugcugccaagacauguccaaagaugaccucagacacaucuuccggagccacaguggcccucuucaagacuucuuugaugacaguggagcccagguccuggacaggaacagcagcuaaggcaccauugaaggaaccuacaauagaaaggcggagagcguggacaucacaagccugcggguaauacgggaaccaccuacgagcaggggagccucaugacccuguuuggcaaggccacgcgaggaggcagugcccucuccucccacacguuccuacaccugcuggucugagcaaaggucaaggugggugccacaacucgcagcagccgagggcuggacaggcgaccuccagaacggccuagggacgccgcuguagcccuucuauuuccccaaauccgaaggacuggaugcgaccccaugcuucccaaacaaaaggaaccggcgggucaagggcguugaaaaccaugcggcacgaaggagacgaagucacgacuucuagccauugugugacagcccgaccccagcccaaagccgggcucagaccaccuagcaguuccgccccugccgcaggcauuaccgauggcgccucccggagccggccaaucaggggccccggaggagaacaccucccuacgccaaccaaugggagaggcaggccacgcgauggcucuaccccgggagccaauccaagcacgagggacggagugcgcacaucgggagaggagaggguggggcuguagcaccaggucagggaacgcgggagccgcaggguuccagggaucccgcggcuccucgcggcuuggccugaccggcuuccuccacauacgccccucuccuacacaaguccggcccucggcgcuccugccgaagcagcaggcgccucggacucugcgcggcucccgccggccacucaccuaugaugguccgcgccgccgagacgaugaccacaggaucugagccugcauucaucuugcuucuccugccgccgucugcccugcgcugccugcaagcuaggcaaagcuccuccucgcagcccacaggccugccgcgggcgggaccugagguagccccgccccucgcccuccaccuccccgcgcacc

SEQ ID NO: 192666 - RNA, 11599 nt, Homo sapiens
aacuucugcuuuccugaaauuuaccacugccuuuaaauacucuagcuuguaggucaucauggagauugggucucaagcaugagcugcccaauucuccuugcuuggcgcccugcaaauaaacauccuccuuucuccuacugcaaaaaccaccuuuuugcaguuuugcuguugaaguuugccuuuacugugcaggugagcaaaccccaguucaguucaccugcuacauuuaaacaguauacagcucuauuugcaaaaacuauacaggaacauuugaccuaacaaaaaccacugggugacaucuaccagaaguaucacugcagaggauuacucgacaaaaagugcaauuuucuauagaaagccgaguguuucccuugggaaaguguuaauauuuuauuuuuaaguaacuggggcaaaagacuagauuuucuauaacugcaauagaauaggacuagaaaggcaucccuacaaguccccaaaguauauggauggaauauuuuugaugguuuuauaaaugacaauuguaauuuagcucucugaagaaaauguccaaucagauucaaucacacaaagcauuuacuauuuucaaucacuugcccaauaacaaaauguuuaguaagaaauuauucagaacauuaaguuguuuaugaaauaagugacuaagcaacaucaagaaaugcuacaauagagcagcuuacuguauucugcaguacucuauaccacuacaaaaacagucauaaagagcuuaacauacucagcauaacgaucgugguuuacuuuuugcaagccauguaucuuucaguuacauucucccaguugauuacauuccaaauagcuuuuagauaaucaggccugacauuuuuauacugaagguaguaagcgugcucccacacaucaauccccagcaguggaauaaggccuguuagaaagaaggggaaaacaaaccaaccaucaguuucagucuaaaacauugcaucuucucaauuucaacuuuuauuauucuacucacacaaaauuacccuuuguaacaaucucauucacuuguuuuuuuauauaaguaggaaaucuagauaagaaugaauauuccuauaaaauauuuuuaauucacuguuuacaaagaaaaugugacaaauacuaacaauaaaauagacuugggaaaauuaacaacaguacuuuaauagcuauucuuaaaaauaccaacaaauuaauucaagagccaauucccagccuuccucaugguggucuuaggagcagcaggaaggguggguuacaucugugggagcaggcaaaagcccacugagaaccuccuccaaagggucugggcacucacagggguuuacgaggaaccagcucugcuccccaaggcuaauuuuaaucuuugggaauacagagcaguuggaggacacaguguuuucagaaauuaagugagguaaaugaagaauuuaguucuaucuguaaaacauccauuuaaaaaaacuuuuggucugggcgcaguggcucaggccuguaaucccagcacuuugggaggccgaggcaggcagaucucuugaggucaggcguucgagaccagccuggccaacauggugaaaccccgccucuacuaaaaauacaaaaaauuagccuggcgagguggcaggcgccuguaaucccagcuacucaggaagcugacgcaggagaauugcuugaaccugggaggcggaaguuguagugagccaagauugcgccacugcacuccagccugggcaacagagugagacuccaucacgcacacacaaaaacacucaaaauaaauuauagcucucucuacaaaaacaauucuuaaccaguaugucuugaucaguugugagggaggucacuaguaauuuauuauuaauaauuucaaguagcaaaauuuauuaaugauuuuuauaaacaaaaggccaugacauucccucauuuuccuucuaaugugcuuuccacagggagaggaaggaguguagcugggacucacuuacaaauaucagccuuucuggucaugcagcucuacaaauaaccugacucuacagaucggugcuuacaaauuuuuuguggcuuuuacaaauuguuaugccaugucacugucccaaaagagcuguucagauucugccaaaaucugggucuauccugugaagugagccacagaucaagaguauuccaaugucagggguagaagaaggggcagagaaugacuguuguugaugugaagguaucacuuuaaguucaaagucccaacccucugccagacaacucauggcucuauuucccauacucuucagugacauuuuuuaaauccaauuaggcucaacagcaaaguauuuggugagcccagccuggcacuuccaagccgaauauuuucauauacucuaccaaagagccccagaaaggcagaaggucuggaaaccugagaucuagucccaguuuaaccucaaaugcucagcagaggagguaacaguacaagcucugaaaucagucucugcuuguauuucuuuuccucacucuuguucuauagcuaauuuuuuuuuuauuuuaguacauauaauuaucuaagcugauauuaauucucuguagaaugaagcaggguuaauaaguaaaacauuuggcugggcaugguggcucaugccuguaaucccagcacuucaggaggccgaggcaggcagauaccugaggucaggaguucaagaccagccuggccaacauggugaaacccugucuguacuaaaaacacaaaaauuagcugggcauggugguaugugccuguaaucccagcuauuugggaggcugaggcaggagaaucacuugaacccaggaggcggagguugcagugaaccgagaucgcaccacugcacuccagccugggcaacagugagaucugucucaaaaaaaauaaauaaaaauaaaacauguuuguuaauguaccuauaaaauuacguguacuuaauuuuaugaaauaucaggacuucuaaaacauuuuuacuuacacaagacucuggguguuaucuguuaagauuugcaaauuauuacauguucuuaaaacacuguuaguuuuccuuauuucuaguugaaugcuuuacaguagagcaucucucccaaaugaaaucacaauuuuuaaaucuaaccuguuguuccuugcaguggauccugauuuggacaagcagcaauuuguaaguguccccguuccuuauugaaaccaagccaaccccaaccugagccuuggacaccaacagaugcagccgucagcuucuccuuaaacuugucaaaggaaccaaagucacguuugauggcuuccagcaacuccccuauuaaaaaaaaaauccaaaaccacccacaaaugaacagauuucaauaauuacaguaaaauguuauauuacauguauuaaaauauuuuugucauagggcccaagaaauuagacaacaucagaaugcgacaccuggaucuaaguuucacaauuuuaauucacguuuuuguuuuuuauaacuucaacuuuuuuuuuuuuuuuuuuuuuuuuucauuuuuuaccuuuugagacggaguuucacucuuguugcccaggcuggagugcaaugccaugaucucgggucacugcaaccucugccucccagguucaagcaauucuccugccuuagccucccgagcagcugcgauuacaggcacgugccaucacgcccggcuaauuuuguguuuuuaguagagacaggguuucuccauguuggucaggcuggucucaaacucccaaccucaggugauccacccgccuuggccucccaaagugcugggaauacaggcgugagccaccgugcccgguucaaauuuuauuuuaaauucagaggguacacgcacagguuuguuacacggguaucauaugaugcugaggucuggggugcaauugaugccaucacccagguagcgagcuuaguauacaacaguuuucaccccccguccccuucuuucucccucccugcucuguccucagugucuguugcugccauuuuuauauccauaaguacuccauguuuagcuuccacuugcaagugagacaugugguauuugguuuucuguuccuggguuaauucgcuuaggauaauggccuccagcugcguaguucacauuuuuuaaugaaucguguuagagggauuuccccacucacuguacuaucuuuguuaggaaagaaauacuacuuucuguuagcuuuuucuuuucccugaauagaaaauuuuccuuugacuucuacccuccuucuucuacgccuccauuugggaauaaagucauuguucuucuccaaggcagcccagcucuuccugucuugaugggcaguuuucucuacgacugaacuaaggguauacuuuaagagcuguaauccuuuuauucuguaguaauacagaauauaauucuagauuagucacaucaacuaaaucaacugggucaaaaucucacuucucuuauucuacggguuuaaaaguaaucaucuuuauaagcacaaaugauggaaugugguacagauuaaacaaaaauggcagcauaccaaaaccacugguugcauaugaauauaucugauauucugguaacugacaaaacuucaaaaguauuaaccgauagucuagaagacugaacucagaaaaaaaauaaguuggccaggcacgguggcucacaccuguaaucuuaguacuuugggaggccgagacagguggaucaccugaggucaggaguucaaaaccagccugaccaacauggagaaacuccucucuacuaaaaauacaaaaaaauuagccgggcaugguggcaggcaccuauaaucccagcuacucgggaggcugaggcagagaaucacuugaacccgggaugggcagaggcugcagugagccaagaucaagccacuucacuguagccugggcgaaagagcuaaacuccaucuccaaaauaauaauaaauaaaaacaaaaauaaagaaaaaguugcccaguuucccaagcuuacucuccucauucaucauuaccuuaaaaugaaauugcuuauuucaagugcauaagauaggcugccuuccauaacacugauuaaaaaugaacaauaaaaccacagaaacuuagggugcauauccggagcccagaaacaagagacaagaacuacauuuacgccucaugcccucccugggugaagaagauaauuaaagucaucugggccuccacaagcuacacaggaagucaaggaaacagugauagcgaacaagaccaucuagcccuguacucuccucauucccugaacacuuuuuaaaaauacccagaaaaccuaauuuccuggaacaacugacuuuuuaucaguuaggaaagagugaaaaauagcaaaugacacuauaauuuaauucucaaaacaacaccauuguuaucccuguaucacauagaugaaaaaagguacagacgguuaacuaucuaauccaggcccuagaaacuaguagacagaaaguucaucuuuucuagacuggcgcgguggcucacauccauaccacagcacuuugggaggccaagguggguggaucacuugaggccaggaguucgagaccagccccgccaacauggugaaacccugucucuaccaaaaauauaaaaauuagccgggagugaugccacaugccuguaaucccagcuacuuggguggcugagacacaagaauugcaugaaccugaaaggcggagguugcaaugagccgacauugcaccacugcgcuccagccugggcgacuguaagacuccgucucaaaaaaaaaaaguucauaaaaugaagucucucagucuuucccuaauaugaaguaccauccagaaaccagaagguggaguugaugugauauucuauguuggcgugaacauaaaaucuuaugacauaaccccaugaaagcauucuccauuccuacuuguguccuuuugaaaguuacaacuuuuaucauacucguuguuaugaaaaauaugccacuaugauaccucugguaagaauaagguaacuuaggccaggcacgguggcucaugccuguaaucccagcacuuugggaggccaaggugggcagaucaugaggucaggaguucaagaccagccuggccaacauggugaaugaaaccucaucucuacuaaaaaugcaaaaauuagccaggcgugguggcgggcgccuguaaucccagcuacuugggaggcugaggcaggagaaucacuugaacccaggaagcggagguugcagugagccaagacugcgccacuguacuccagccugggcaacaagagcaaaacucuugucucaaaaaaacaacaacaaaaaaaacaaaaaacaaguauaagguaacuucaguaaaucaacaaucgauuccuacugugcacaaaauguagauaagggugcaccaauauauaccaaccuuuggguucuccaccaccguuagggcugagguuuguccagaaaaugcuaugauugauaugaccaccaccauugaacuucagugcaggcugaagagcuaucugggcuguaacaucuccugaaaaguuaaaaugcaaacacauuuuuuuguaacuccuacuuuuucaaccacuguauacauuauauuuuuuucuuuguaagcuauuagauaaugggaccagcuuaucuauaacauccguuuguccuaaaauucagcacccccccgccccaaaauuauuugucccagacaugcugaacaacugaugaaggaccuagcagagguggaaaagcuagaaaauucacuccuggcugcuaggcucagggaucucuuagauagaagagauuuuaggaaaugaaacaccaaagaggacaaucaaaauaauagaaugcuaaaauguauggcucaacauacagacuguacagaaaaccuucaacucucacuuucaagacagacgacgauucauugggaaauaucuccaagucacauuaacaagaaacucaacauacucaaaauugaacuccugauguucuaccccaaacuuacuccuccuauuguccuccacgucucaguaaaugccagcucugucccucaggacauccuugggaaccugaugucauuuuugacuccucucccuucaccccacauccaauccaccagcauauccauuagcaaagccagcucuaccuuuaaaauacauccaaucuauauaaaagcacacagagaaaaauaaaagaaaaaaauaaaacacaagcagaaccuaaucccuucucccuaacucuacugccaccucauugggacagaggaccaguauuucucacugcacuggugccacuauccccucaguuuuggggggugggggugggccuugcccccuccaaaggcuccccuucucacuggagcgaacccuagguguuuacacucagcuacucuuacuaccaagaggcgcugcacuugaccccgucauugagcacgugcucacgcagcugcagccucacuggccuuuuugcacucacaugaccaacuuggauguuccccucaaggcuagcugagcacugcugccucugcugaacacucuuccccaagacagucucaugcugcguuccuguuccuccuucaagucuccacugaaacaucaaccccaucagugaagccuucucuagccaccauacaugaauuagcaacucccugccaccccucccagacccuuuacuccuucucaauaggcccuguaacuccuggcauacugcauggguaccuugccaaauaaguaggcaaaauaaaauagucuuuucuaugccuucaagaagcuacagacuaaaugaacuauuaauauuagaaaaaaauggaaauccucuuguuuaauaaauauuuugugcauauuauccacaagauaccaagagaagcaaaguaaaggacacagagacccacugagagcuuugcucucaaggagcuuacauuuuggaaaaaguucucaacugcuguucugaaaguguacguuaagaacauaugucugggccgggugcgguggcucacgccuguaaucucagcacuuugggaagccgaggcgggcagcucucuucaggucaggauuucaagaccggccuggccaacauggugaaacccugucuucacuaaaaauacagaaauuagccagguaugguggcgcgugccuauaaucccagcuacucaggagcaugaggcaggagaauggcuugaacccaggaggcagagguugcagugaaccaagaacacgccacugcacuccagccugggcgacagggcaauacuccgucacagaaaaaaaaaaagaaagagaaagaaaaaaacauacauacaaggccaggugagguggcucacgccuguaaucccagcacuuugggaggcugagaugggcggaucacuugaggucaggaguuccagaccagccuggacgacauggaaaaacccugucucuacuaaaaaacccacaaaaaguagccaggcgugguggcguacgccuguaaucccagcuacucaggaggcugaggcaggagaauugcuugaacccaggagacggagguuguagugagccgagaucacaucacugcacuccaaccugcgggacagacugagauuccgucaaaaaaaaaaaaaaaaaaaaaaguaugucugacuaggcacgguggcucacaccuguaaucccagcacucuggaaggccgaggugcguggauaggggagcccaggaauucaagagcagccugggcaacauagugugaccccgucuguuuuuuuuagacagaauuaaaaaaaaaauuuuuaaaaggaacauacguagacaaugcugcuuucugaaacaagcuccaguuguuuagcgauucagaaaggagagaaccaacugauaucugaauacacagcuaaucucaaaggguuuuuuaaagacaccaacuuuuuuuuuccuuuguuagguuuacaaacaguuuuuuauagaucuguguuucccuuauuaaauuuucuugagagucacucuaaaaauagauguaacuuuucuauuguuuuuuaauaaaucaauaguaacugaauuuuuaaaaugggaaagauacaugcuuaaugagagauaauuuaauaaucuuaacaucuuacaguuugcuuacucauuuuaaaauuaauaaaaauugagggcuuaauaucugcuuuuaagaacacuuuucugaaauucaacauuuuauuugguuucaguuuaguuuuugccucaaauaauaauaaaagucaaaugcuuuuuguugaaaaauauucauauuagucaguuaaaugugaugagauuaugacauuguuuuaucuuuuuuccccaaguuuucaaacaugaaaaucuuuuuaauaauuuuuaaaauauguuuaaguaaaagaaagcucugcagguacucaaucacuuauaaacaauauaguacaauacaauaaaaagcuuuuuuccaguggguuguauuacauaaguaaggcucugauuccacaaguaaaggacugaaauuaaguuguuuuuaaaauacugaagagaaagguuccuggugucagauguugccuuacaggaaguacuuucacaacugggguauuccccagucucuccccauuacauguuucccaaauuuguuauuuccuaaaucacggggccuuuucccguaauucaagguucgucugucucaaguaaaucuuccagaaugugguaacuuccuccucuuuuaaucauuuacuucaaacacaaucaggcugaaauacugcauuuuuccacuagaugccuccagucaacaagaugugacugucuaaaaauuacucaacaaauuucauaaccccgaaauucaaaacauuuaaggaaaaguaaacauuuuuuacuacguagcuuaccaagcaauacagagagucuaaaaaacaugacuaucgauuaucuuccuugugcaaaccacuaacgaauaaauuaaaaagacaauacuauuuuguaaaaaacguuaaaacauaacauucccauacacacccccaaaaggcacagacucaaaaaguccacauaccccugguuuuaucaaccgagcucuugagaaaaaaaaaaaaaguuaacaacauauauuuuaauugcauuacaaauaugaguaaauaguaaauaaaaacaagccuguuucaguuucccacuaaagggcuauuuuccuugugaacuuugaccccuaagggaaaucaagaaaaguaucaagucuaaagauccugaacuguuccacaguuagguuacugcuuuuuugguaacgcacaccacaacggugugccuccuccucucccaccugaagucaagugggcucagugaaguuucaccugcaggguagcuggggaugcagggagucuccaaguccuaggcuggagucccgaccccguuugcucucaggaagaugacaaggaccaugguuccuagcacggaguaguguccuccugucucccaccuucagugugaccuggcaguaagacaccacucccacuucuaucaggaggugacccugacacucagagacaccugcggacccgaugaugucuggccaccaguggacaggcgcucucagcccuccugcaaacggcuggcacaccuaccugagagaccaaacauuuccccaaagcacauuauacaacaagaacaauuucaauuugcaaaaaaaacgagugacacaguagagcuuucuuuucaggcccuacaauucaccagugcuggcaauauguguaacggaauguggcucacaacaguaaggcaagcuccuucgcaggaccccaaguucccugagaugacagaaguguguucaaacccaucgaggcacuccuucuacaaugagguagaccauguguuuaaaagagagacuaucgugccuggaaaacucggaaccgguacaaauacgaagcgaguucuccuccacggagaggcccguccguauggggccuggcucccuggggucgccucugccggggacugccucccgccgcucagccuggaaccuacccuuggccaacgccuccugguacuucuccucggugacguucagguuguucacguaggccgcguggugcuugcuguggugcagcugcaugaucugcgcguugaugugagguuccagggcgccguagucguagggcaggucggggaggcugugcuucugccuggagcccagauaccccaaaaccggagccagcugccugcuggugcugaagacgagaaagcacagcccggucagucagcgccgcgggaccgucuacgcaggcugggcugccgaggaacggcagcgcgcggcgucccccgaguccccgcguccccucccugcggauccccgcuccagccgccgcgccgggcacucccgggagaaccgccugcaggugccccggucccgccaggcccggugcggccacugucgccauugccgcggaggcccugcccgccgcgagccccuucgcccuuggggccgugaccggguccccuuucuucucacccgcacacugcccggcucaacaugcugcuagugcuggugcuaccgcugaugccgccgaucugcugaagccgcugccgaagccaccacagccacgagugccgcuccugcgccgcccgcgggccuuaagaaagcgcggggagcagggccgcgaccccagcugcgccgcaagggcaccgc

SEQ ID NO: 192667 - RNA, 18214 nt, Homo sapiens
ugaguacuucagguuucucuuuuaauaaacaaaaccauccaagguacaguuccaaaguacaaaaucaaccaggucugaacugauuggugauaagagcacacagaucaguccuuccuuaaggaaacaguuuccucccugaugcccucuuuggucacuaugcagauccggagugcguccccaguguacacaucucucucagccgcagaaaugaagacaucuuucaccagccgcauggcucuguccaaggacagcggaacaugcuccacauucugcauguucuuaaaaccaaccuggugggacaugaaacuugggugagaugucaugugacagugagcacaaaggaaagguucaaguuucuuccaauacccucauguguacgaggauuugugaugaaaauacuacacaaaauuaaaauguccuucagacugaauaaagacccuuccagaccuggaugaauuacacacaucagaaaucugacaacgauucccuggcaaagcucccacucuugagaagcacaugacccggagagguggacguaugcaagcaaagugaucagagaauugcuauaacuaagaagaaaauaagagccaggagagccccaacagauguccacuaagucuccuagaagaagacaggcuucagcagaaaggacuuuuaaguaggugagcgcugaaggcuacacugaagagcacagaacauuccagacugaagaugugggacggaguuaggaaaagcacaucuuuucugagaaaagcagaguuagggucuggguguaguggggugacaggagaugaggucaauaagcaauaagcagaggaguagcuauauaugacauccuucagaaaacugagcaggaggaauuagggaaguaaacuuguaggcagaaaggauguuaggaaauaaauccaauaaucuaauaauguaggucugaauuuagccagcaguaaucacaaagagggacgaauuagaaauacaggcggccuuugaauaacaccguuuucaaccacucaggcccacugacacauaaauuuucaguaaacacacugagaaguuuuuggagacucgcaacacuuugaaaaacucagaugagccaaguagccuaaaaauaccuuaaaaauuaagagaaagguaugccacaaauguauaaacuauauguagauacuagcuauuuuaucauuuacuaccauaaaauacacauaaacugauuauaaaaaguuaaagugaucucucaauguucuccuuuguuuuucauuguguuuagugcgauuauuauaaaccuuaaauaacaaguggcccaaacaaagcacuauuagugaugcuggaacugcuccccaagaagcagggaaaguuaugacaucacaagaaaaagcugaauugcuugauauguacuguagauugaggucugcagcugugguuguccaccacuccagacagaugauucuccuuguaaacagaugauguaaacuuacaguaucaacaaauacaguauuguaaauguauuuucucuuccuauaauuuucuuaauaacauucucuuuccuguaguuuauuuaucauaagaauacagcacauaauacauauguaaaauacgugauaauccacaguuuacauuauuggcaaggcuuccagucaacaguaggcuuauuuguaaguuuucuuggagucgaaaguuauauguggauuuuccagugcucggggaacuggcgccccaauccccguguuguucaaggcucaacuguaugcuugggaguucaaguacaguauuggguaacacagaaaggggggguaagagggaaaaaggcauuuuuaugaucuucagguaaagacagcaagagaauuagccacuacagacauaaaagaguuggaagccaugagaauacaggaaaacaaucaaaaccaugggaguagguaaggacccacaagagaguaggcagaacacagagagagaccaugagguuucuguaggacacgucugccaaacucaaacaguaauuuauaagaaagucuuuauaucuuggcucuccuaagcuaaugaagaggagaacuuggaggaaggcacuucaacugaacaccaugacaaguuggacauaguaucauuaccuggacacaguaucauuaccugguugucaagcaggggcuguagcauggcacuugcugagccuccagccuugaaggagucucucugguaagacccuacuggaucaaagcuguauacagcccccuuuccuuaaagaagaaaacaguauucauaaggaugguauccaaucacaaucccaaaucaucgcaaaaauaaaucaggucaaaacgugacacaaaacggacuaucaccuuggcuaaaacuucagggaacaguuggaacacagccacuguugcacuggugacagcugcagcacacacacuguugcacaugugacagccagaacccagucaccauugcacaggugccacccagcagacagccccaauccccguguugguguguuguucaaggguaaacuguaggcuugggaguuaaaauacaauauugaguaacacagaaaggguggguaagagggagaaaggcauuuuuaugaucuucagguaaagaugacaagagaauuaaccacugcagauguaaaacaguuggaagccaugagaauacacaaaaauaauccaagccaugguaguagguaaggacccguaagagaguagggagaacacagagagagauggugagguuucuguaggacacaucagccaaacucaaacagucauuuguaagaaagucuuuauuucuuggcucuccuaagcuaacgaagaggagaacuugaaggaaagcacgacuuauguauauagacagguccaagggacacauccgcaagacacaguaaaacgaagagaauucuguaaccuguaaaauacgauacugcuuuuguuuaaaagaauaagaaaacuauuuguacaagcacaaaaaagucuggaaagauaaguaacuguggcuggucaucuuugagcucugaauuagaggcaagaaaagaagggaauuaauucaugugcuucuaucuuauuugaguuuguuacaaagaacacaggugauucuacaaucguuaaaaaggccuguuaaaaacaaccguguucuggguaugagaaaucacgagucauuuacaagguaugauuuuuuaaaaacauaacugauuuagaaaacacauuauauaccagaacucaguacccugggagaugugauauagggacaaucuccuuacuaaccauguacaacugccacuguuagcuuuguauguuuucuacuauagaacugcguaaacuuggccaggcgcgguggcucacgccuguaaucccagcacucugggaggcugaggugggccgaucacgaggucaggaguucgagaucagccuggccaacacagugaaaccccaucucuacuaaaaauacaaaaauuagcugagcaugguggcacgugccucuauucccaacuacuugggaggcugaggcaggagaaucgcuugaacccaggaggcggagguuguggugagccgagaucaugccacugcacuccagccugggcaacagagcgagacuuggucucaaaaaaagaaaaaggauuguguaaacugaauucucugguggagaaggcaccaucugaggucaccuaagaaacugggaaguauuuuugcuggaagcaagcuugggacaagacaugagaucacagcaggcaauccacuaaccucaauauacaaaaaaagaaagagauguaagguguaaaggcagaaaaaugauuguaucucucaugaggaugacaggccacaaguaaacugaggcccaaaagcuuuacccaaggauggaaccaaucucagaaaaccacacacaacaaauuuaaaaaaauaaaccaaagaaagggugggcuauguccaagaacacagcuuuaaagacccccuagaagaagcaagagagacacuaguaaaaucaguauaaaacagcaaaaaucaauaaauaaaaacaaaaauaaauguagaauggcaugaaucuugauuacaaagugcuuuuccucaucaaaguaaaauccaaaaagcacaaucauuucaauguaaaaaauaaaaucagacaagucuuaaaagaaauacagcuaagcuuuggaugggagaaguuuuucuaacaaggcaagaaacugaaugucauaaagaaaugauugacagauuagacuguaugaaacacagcaauuucuguguagcaaaaggcaccacccaaaagagacaaauaacacucuugggaguaucuauaauaucacagacauuugacacagucgaauguaguucuugaaaaucaguaagaagaaaacuaaccugcaaauaaggaaaugggcaacaguuaauauaugaaucagucuccaaagaggaaauuuauaaagucaauaaacauaugaaaacaugcccaagaauauauauaaaugaaaauaauaaacuguucaauaggcaaaaagauguuucaaaauguguuaauucuaauacugggaagguuauauaaaaucggguacucaggguacuggcguauccuucagaaagaguauacucaacaaaauacaaaaaaaaauuuaucugacccaauacuucaacuacucgaaguuuauucuagcaagacaagcauaauuggggaaguacacaaaaauguauguacaaggauguucaucauaguguuuauauuaagaaaacaggaagccaaaaugcccuuuagaggacugguuagguaaaugaugcuauguauuacagcagcaaaaacagaagacaaaaaaauuuuuuguuaauuaaauacaaaaaucauuaugcauauagcuuagaucuccuugauaauacauaauguauaguuacagaaaaacagauaccaaaguccuacuuacauaaaacugcaugaguguauguauaaacauguacugauuguuuucacuacagaaaaacuaaagccacuuuuaauuugggagaaaaauuuuuaaaaggcaugagagcagcuaagagauuaaagacagagagguuagugcagacagcgguugacaccaagggaaagagcuguggaccuugcuguccugaagguuucaauauggagcacugcucuccaggucccugcauccaccaacacagaagacaguaaaggaagucuccugagacauuagcagaggcucuggacuuaggggaccaggcucuagaguggcaaaggguaggagcaaaacacaugaaauggaaaguugauguaaacaaaacacagaccuucagcccccuuccuccucugaggccuaaaaagcugccaaccgggcuucucuuccuguagucccaccucaccucaggaaaaaagauuaaagaaauucuucaucugaagaaaaugcugcuuacuuaagcacccaguuaacggcugucaguugacaagccaugucaacaaggacuuucauaaucaaauuuugguacaagacucuucaaugugaauggacagcaaaaaaaaaaaaaaaaaaaaaaaaaucagagauuugaaggaagccucuaacauagaagacagaggccaaaaaugaacacauaacaugaaaaaaaaaacauucugaugaaauacagaaaacugcaaagaaaguaaacaggauuuuuuuuaaaaagacaaaaaauaaguacaagcucuuggaaauuaaugacaccagaaauaaaagcaaucaguaaaggaugaaaagcuaaaauuaaggaaaucuucauaaaguagaacaaaaaagacagacauggauaacauggggagucaaaaauaaaguaccgggucauaauccaggugguuguggagaaggugcagagggguaggggaggaggagaggaaagaagguggagaaagaggauaaaacaaauaagaaacucuaggcaaggaacaucacuauacaauuucagaacaccaggguaaagaaaagauccuaaaagcaaagucucaaaaaggucccguuuuguuuuuuucagaaaucuuuuaggagguaagccucuaaaauaaggaaauaaaucaagaaagaggagaacacaggaugugggggaaucucaggauggcagugguccauccuggagcaaggggaaaagggauccaccuaguaugugaggucugacaaccagaugaauuguacucagagaauguacaaggaacugacaaaaaguuuaaagaaaucugagccaauuagagauaguuaacuuaagaaaaaaauaaaaacgaguuacacaagaaagaaaauauuaaugcaugcuacuuggcgcaacaaagaucaauaucuaucuggucauaauaaaaacauuaaaggucuauguuaccaaaaguguaauguguuaaaggaggaugcuaaugaggaagaggacacaaaagagcuaagaaccaucaucuaccagaacaaaacaccaaaagauaucucaaaagagugcaguacaaauacagaguuuuggaaaauggagguaaguaccaggaaauacagguaaaagagcugaaaacugucuuagggcaauggaaaaaaaagauagaggacugcuuuauuauucacacaaauuccucuauaaaauaaaaauuaguuuaaagaacacuuaaaagccaaccagacagacaagcuuagaaagacaguucuagagacaccugagguugucaccaaaacuagcaacacuguuacauggaaaucaaagaacagggcucugaagugaaacaaaagccaaaccugaaucuuaggucugcugcuuaguagguaucagcuuucccagauuagacucucuaacucucggaaaaacucaaaggaugcugucuggccugcugaaauucaauggcagcucagcuauuuuuaauguugcuaaaaucugaaucuauuaaucugacauuaaagccaggcauaauguaagucaaaaaagacaccagaagcauccagcuugcuaaguuaggcaaauuaauuuguagcuagacucuaauuacccauguuaaagguaauucauuucuauuuuuacuauuucuacacuuuacuuuuucucuugguuuucaaguaagguugaaagccuuaaaaagaaauugugucaaccuaauuugucuacgccuaaaccauggcagguaaaaugaucagaauguuccccaaggcuguguaugggggcggauguuaagagucagagauagcgcacgcaaagaaaacgcucauggaacagaaagcgauaggagucaacaaccgagaggcagggcgcugaaaugaagcuugacccuuuccucuuagaauuuucccucacaggauuuaggguccccaguccccuugcuuucuuucuguguccaacugagauguucugugauguggccagccgcauguauuccccuggaggcucugacccaagccaaggccugccuugaacauucccaggcgcugacaauguuguuuaggcuauugcuugaaacacugagaaauuaccccuguugcuaaacacacagaaacuaucccuggcccugaaccaaauuccuucaacacucaaaucaacucccucaccuuggacacaucuuuuccugcugucugcugagaggacugcugcagcacuaaaugcuuuugacugauuacccugagauuuaguguucuggaaccccaacuagguucggggcagucccuuacaggaauuccucugccccuacuuuuagggcaacuucagccacagguucagccagaaggaacacagaagaugggcuuacuccaaugauauccucaucuagacacuucuguaacuucuuaucucaauggacuacucuaaaugacacagauggacuacuuauccaucugugucaauggacuacucuaagugacaaagaucuguccugggacacuguacuuguauuugauuuuuagaugcaaccaaaagccaauccaaaugagaacauuuggauugcaaaugagaacaaauggauuggaacauuuggauggaaaacauuggugcccauguggcguaaugcagcucuggaacaaaaaugggauggaauauuaaguaacaagacuuaauauucucagggaauccuggucugacucugacaaaaucagagagguguuucaaaaaguucugaaaacacuggaguagaugcuuauuauuaauuaccccaaaugacuucuagaaccguuaaagaacuuuuuugaaguguauuuguuaauaaaaaaauuuucaauacucagaaucacauuuaggucaagcuuucuagguccgauuucuuucuauaagauaaaaaugccuaauuauuuacuacuaacucaugcaaguuccugagaaaauagcaaaauaacuggcugcucaacauucacuauuagagcuucaaugugccuuuggaggucauacauuagcuucaguuucuucaucacuuucauuaucagaaaugaaaugagaauugugucagaugguauuuaugguucuuuucaacucuagauggauacacacaucuagggaauaauaacuccucccccccaccauuuuccagaaagaaggaauucuaccuucuucaucaaguccaccgaugauguuguaaacauaguauggaaagaagcgccuugaauacaggauuguagacagcauugcagcaauugcccccguagucauggccuuauuauuggaaugcuuauacaucugcaauuauugauaaaagucacaggcauguagaggcagaggccauuauagacuagaacaaucaacaguauaaagugaauaaauaaaugcauaccacaguggaaggggaaagcaugccuauuuccuucaugaucaaccaacacaguauuacuaacauaaaauuuuaagggaaggaaugccaaguuugcccucagcucucugguuuagacucuauuuuccauaccacccuuaucucagguacugcuaauccaagagcuaauguguaugaaagggcacaugaaguggccuaaggaagauggguuuaaauccaucucucucccucacucugcauauagaccaggggucaacaaacuaccccuguaguuuggcucaggggccaaauccagccuacucccuauugcuaugaauauuguccguggcugcuuuuucacuacagaagcagaucaaaugaggcccauaaagcuguaaauauuuacuaucugguccuuuacagaaaaauuacggcaaucccugaucaaaccuagauguaagucccucucuuuguggagcagaucucugugagaacagaagacacagggcagcacccuuacucugcaugauuuuaauacacagcaguggucgugauccuuaaaacaucuacaguagagaacacaagcauccaaaacagggucuuagcaugacaauacagugacugcaaauccuagcuuuacuauaccuuugcgagcccuacauuacccacugguagagaaacuucacaaaaauuauaaacauaaaaugaauucaagaucaccaauuuuuguuaaccacauagcaaacaucucuaaugagaaacuuaauggccaggcauaguggcucacaccuguaaucccaacugaggcgggagaauguuugagcccaggagaugaaggcuacagugagcuacaauggcgccacuguacuccagccugugcaacaaagugagacgcugucucuaaauaaauagacagauagauaucuaacuagcaccguaaaauuaaauaaugacagucaaaacacugaaaaaugauuagaaaugaacuacaaguaacagguaaguuuuuuauagaggaaugccuuuccaagauaaaaacuauaaaaaauuauucauaggccgggcacaguggcucacugcuggccuguaaucccagcacuuugggaggccgagauggguggaucaccugaagucagggguucgagaccagccuggccaacauggugaaaccccgucucuacuaaaauacaaaaauuagacagggguggugacaggugccuguaaucucagcuacucgggaggcuguggcaggauaaucacuugaacccaggaggcagagguugcagugagccaagaucaugccauugcacuccagccugggcaacaagagugaaacucugucucaaaaaaaaaaaaaaaaauuucauuccauuucauuucgaaaccaagcaccaacauuuauuuacuucaccaccuaauaaaguaugagagaaaaacuucaggaagggguguguauuauguagaauucaccauuccuuguuuuauuaacaauaucauguuuacuuuugucuucuaacucccauuuauaaaauaagcauuaggaauuaucauauaaauaugccaauaaauguaagucacuauggcuuucaauguaaguuucuaaaaaagcauuaacaauugauaaauacugagugaaauccuuucuacacauucaaaaagcaugugucaguuaaauaaauauacuauauacuccaguaaccacucauaaguguaaauaaucucaaguguuauucaugaauaggcaaaacagaaugugaucaccccugacuucuggcagcuggcuaucaacugaagcuggucaggugacagacguuaauggugcauguugugccucccauccaagcucccagcuuauucauucuuucguauuucuacucaugcauccugccaacuaagagcacagcacuguaaagaggaaaagcuugucaacugauggugaugcaaaccaagcuccugugucaaaucuuuccugggcucucuccugccacagaaauugauuugcuuuguuuuugagggaagaguaucuucagaagaagaacuccucccaggcuccuucuaaaaggguagagaacccuucauaugauacaagacuuuaacaaauggaaugugcugcuguuucacauuaugcuacuuuaaugacccugcauuaaugauaucauuucauuucuagcauacauuuguaauucaucuacuaaccuagugacucucuagcuaucugaccaacagucaugcuguaggcuuaaaagaauuuaaugaauuacuauuaauuuaaaauaguguagaaauguacaaaagcaucuaccuuuagucuugcuucaauaaucuuugucagcguaagacagucuccaugaaaaccgcugcauccaaugacuguuuugucuguucuguaaaaagcacauuucagaaaacugagcugguuagauaguagagcaaaacauaucuucggcaauuuuaaauuuaaaauucugauucccacuauucccuaaaugguaaugggacaaacagucacccuucuggggaggaggggucuguauuccaucuuaccccuuauuccagaugaauuacagguggaucaaagacuuuaaaaaugcgacuaugaauggacuaaauaaaucaugggugaauuuuuuuuacuaucuugggcugaggaagauacguagguagguuaauugacugauuuuugagacggaguuucgcucuugucacccaggcuggaaugcaguggcgcaaucuuggcucacugcaacuuccgccuccuggguucaagcaauuccccugccucagccucccaaguaucugggauuacaggcacccgccaccacacccagcugauuuuuguauuuuuaguacagaugggguuucaccauguuggccaggcuggucucaaacuccugaccucagguaauccaccugccuuggccuccaaagugcugggauuacaggugugaaccacugcacccagccucgugaagguagauuuaaacaacacaauccaagggccacacagaaaaauuucauaaauuugacuacauaaaauucuacagggaaauuuaagaauagcuuuuuaaaacccuaagaaaauauauuaguagcaucuacccccaaagucuaauuuuaauucuauaaaaauucuuacaaauaaggaaagcaauaacauaaaggaaagauggguaacuucuaugaacagacaagucacagaaaaaagagacauuaagucaccauaaacauaagagccucuauguuacucagaaauccaaaucucaaaaagagacuauuucaaccaauuauacuggcuaaaaaugccuaacuaacuaaaugcuggugagguuguggaaacaguauaaacugauuaaccuguuagaugggcaauuuggugguauuuauuaaaaauuuaaauacacaccacucucaccaauucuauugcuagaaauccaucuuguuaauauacuuauccaaguaugcaaagggaugcucuagacucaccagugaguacucauuuaaauagcaccccaaaacaaaacaaaaccuaaauguccaucuguauggagaggauuaaaauuugguauagacauacaaauucaaccguguauuucaaaaauuaauuccuagaucuugauaugaaucuauaaagaaaccuaaacaauauuuugcagaggccacacaauuccucuuggaaacuuacgaaugacucgcacaaaccauaccuguccuacuaggagagcagcugacaccucuagggucaucacuaacaucaccugaucuaugccuaccaucaaccucacugcacuaaggugaagacguccaauccccuauaaggcuuuacugccuuuacugacaagauugguugacaauaccaacagggaaagacagaaaucuuagaacuucaagaugcuuuucccaaauauccaggugcaucaaaggaaugggaguuuucaugcaaagaauacagucugaaacagguuuggaagaggcaagcuuaguucuaggucagacccacaggacgugggaugagggauauauacaggcauucguuaaugcugcauuguucuuauucucuaucucuauaucugacguguuucacaaaaaaaaaaaaaaaaagugcucacuucaccagcaaacguaacuaaagcaauauuuaaaagaugaguaaaagcuaguacaaggaugguauccauaaaguuguuuuaaaaucuuauuucuaauauuuacuacuuucaaguuguacaagugucguccuugaggagaaaaaaagguaacacaagagcaccauaaacagaaagcagaaaggggguaucaaaagaugcaaguggagagaaacagaacugggaagacgaaaacaaacuucauugcuuuuuaagaugugggccaucccuaggagcaggaaagacaacguaucuuuucuucuguaccuacuuccuacaauacaaggaggguccauccaaaggaccuaaaccucguaagucccauuccuauuacaauucaaguuuaauuaacccaggaauucaugaccauuuauaagcauuuccaaaacugguaaauacagaccacugccaaucugcaguauguauucaguauuuaugcaggcuuuuuguuuuuuuaaguuuuggcuuuauuuucauguuuuaggaaaaacauagcuagccuauuaaaacugagcuguggacauaauugcuuaggauauuucuaaaacgaauguuucagguaaaaaaaaaaaguguggggaggcagauuuaaaaaaaauaucauuuaauggauuaauggugcugugguuugaauauucccuucaaaacucauguugaaauuuaauugccauugugaugguacugggaguugggaccagguguuuagguccuagggcucagcuuucaugaauggacauuaucacagcaguggguucgcuugcucuucuuucuuucucuggccuuccaccauguuaagacacagcaggaaauuuuucaugguaaaaugcuggggugaacacauuuagguuaccgaaagcacuuuugguacccugaauacagcaaauauuauuaagacugcacauuaaauuauuaggaaacauuaacuuagaaaaugguuuucuaauaaaaaugcucccaacagcaacuuaaaaacucaugaaacaaaucauuuagaaguagaaacucucacaacaucaaaucauuacaaaggcauugugaaaugucuuuagaaauauuuacuuacaauuuguaacauuuggggcuaucccgcguaugaauugaaaacccuucacucaaucgaguaucagaagcaacaauugcaaaaucuucuccagcaauugccaguauaguacugaggaaaaaagaaaaaaauuaauucuccagggugguaauccuaucccuacaaauagaagaaugcuccauaguacauaaugggauaaaauacucuagaugucaacaaaaacaugauucaaaugggaagaggaaagaugagcgggaagagaaugaacgccuggcuacgaguugucugggaaaaaaaaauuauuaauaagccuaaaucagggcaaagucuccuuggcaggaguuaacagaaaagccaaugaauuaucaucaccaacacauuaaauacuuacucgcgcaagguacuacuaauacagaacaacuaaauaccacaucugugcccuugaggaucagguauagacagugguacuacaacgcaagcucuaugaguuuagagaagaugagauuuuuuuuucuugcuucauuucuuuauauccaaguccuuauauaacgccuauauaaugcuuauuucuuuauacccaaucccuuauauaaugacaaauagauggacaaacaguaaauuuuucccucuguggcuguacaauuugacagcuuaucaaagagacuuacaguagaauuccaaaagcagaccgccuggguucuaauucuggcuuucccguuucgcagauaugagacuguggguaaguuacuucucaaagcgucaauuucaucauauauacaacagagaucacugcaguugcuaccucauuaggguguucaaaggaucaaauauguaagcccuuauagcagucccugacauguaacugguccucuaguaaguguuagcuauaagugcuauggcacuggaguaugacuaagcaccugggcucuggaauuacaugagacagagacccacucuugcuacuuacuagguaugugaucuuggacaaauccuccaaaugcaaguugaugauaacaguaccugugucacaagguguguauauauauuuggguguguauauuuuaauguacaaggcuugacugauaacuauaaccacugcuucaaugcaauaguggaaauuaaaggcauggugccucacagacguaagcacucaggaaacuuaagccacuauuuuuacugaggagggauuugugcuaaagcucucaagaagaaaaggauggcauuccagguaauauaaacagcaagcaauggcaaacagguaauuauucaaauaguacauacauucaagcaacucauucaggcagcccuuuuugcauaagcacauguagugacguuaagguuuaugugauggacaggguuccuacuguagaaaaucccaaaugccaagcuaaagauuuuggaauuuuagcaagaaaucaugaagguauucugagcaagaaugaucuguaguuguaacuacucaagaggcugaggugggaggacugcuugagcccagguguucaaggcugcagugagcuaugaucgugccugggcauuagagugagaccuggucuuuaaaaaaggaaugcaagagagagaaaaguuccauuuacaaagugggguuuuaggaagacugcucugacaauaacauaguaugugaaaugggacagaaacacuguucuaauacuacuaaugcaauaguaagguagcagggugaacaguaaauccaaaaucaucacaaacacacaaaauagacaaauuuuuauaucuacgcaaauguuuuaggaacugggaaaaccaauuaugacauccaagauuuagaacuuagaugaacagaaugauggcauaauuauaaguauuuuaaaggagaggaggccgggcacgguggcucacaccuguaaucccaacacuuugggaggcugagggggggggggggggucaauugccugagaucaggaguucgagaccagccuggccaacauggugaaacccaucucuacuaaaaauacaaaaauuagccaggcgugguggcaggcaccuguaaucccagcuacucgggaggcugaggcagaaaugcgugaacccaggaguuggagguugcagugagcugagaucgcaccgcugcacuccggccugggugacagagugagacucugucucaaaaaauaagaagaaaggagaagaggagaugaaggggaauaauuagcuugcuuuuuguuuugcuagcugucuugaguugcccugagagcagaaaaaccaguuaaaaauguuuuacugaagaagccgaaucgagggacucaugagaggcagaacuggaaaaccagauuugggaguaauccucccagcaaugagacaugaaagagugcugagcgauaaacaaggcggcuaaugacuuaacuacauuuaaagacagaguaggaaaagagaaugaggccucauuuugcggaagcgaaggcugccugagagccagcugcaguaaacacuaaagaaaaagaacaaugacugagaaaaaguaaucagaaagaucuaaguaauuuuuagggcaguaauggcuuaaacuggauuacaagggauuaaaaagugaguaacgaguagggcauacugaacacugaaaauucuuauuuauagagaauagccuuacgaaacggguccaauaacccucccuacaauauacaacuuaauuagucaucacaggaaguguuaagguguauaauggaaaagcauccauaaacucaguggugaaauagcuaugaauuaaguccuggcucaacuucacaccagcucucugacccugacaguuuaacgucuaauauaacccuaggaugcuaauaucaucuaacauucacuuuucaugaggauuaaauaagaugacagcuugcaauuuacaaaaugcaucucucuugauucucaccaaaaacuaugaagcuacuaaggaagauaaggaaauuuagguucaagaaguucagaaguacccaaaguguccuuuaguggcagaaccaaggcuaaaaucagacuuucguuaucuuucuaacacacucccaaaaugugcauuuauauuucaaauuuaugaggaaccaauuaacauuuuugcuuuguuuuuaaaauuuauuuuuguagagauggggucuugcuaugcugcgcaggcuggucuucaacuccuggccucaagcgaugauccuccugccuuggcuucccaaaguccugggauuacaggugcgagccacacugcccagccaauauuuucuguuuuaagaaccaucgguucguucaaauugcguguguauauuuuaauguacaaggcuugauugguaacuauaaccacuguuucaauuuacagcucuucccugucaagagucuuaaacagagcaucuuucuauaacccuaaaucucuggcgugccaccacggaaaauuauacuacucaagauaaagcugguaauuaaaauaaaaaccaaaacuugaacauaacauacaagaacacacauacuaaaagguccaucuucugaguauuuuguuuuccugaacuuaagcuaaacguuaaaaaaaaaaagcacuuaucuaugaaacuaaguuugcucagccaaucccaccuucuauuugaaauaaaacaaaaugauuaaacugcuacaauuagaaauaacagaaaucaggcggcuacaauuagacaucucggcuaccaacccagcuaugcaucuaacaacacagaccaaacaacccuaacuuuuaaguuucagacgcuaacccucuacccucgccggcuggcauaagaaacguguacaugagguccaguuuuaauggucuuccacagagcagaggcuauguuucaauuucuacuuuacugucuuacagcagcaaggagcacggaguggcgguccacauaaaaacucaaaugacaugacuguaaugggaaacccuaaaaaccaaggcuguaucgcaaucaccaaguaaacuugagcaaagcgagccugaagagggaaacacagggcaugagaggacggcagggagaccggccuugugcggacccccucagcucaggguucugaggccugcaggagcccggggcagcgccaucacggcggugacuccuaaauaggcuucagcagaugggggaagggcgaaagugaaagccgcagcucucugggguuuuuacccuccguugaaaacguagggcgaaaaucgcagcugcaaagggcccgcggcucugugcgguuccauccccaagucucugccaggagccgaauacauggcuguagaggacaacaucgcacggcugcgccugcggauccgacacuugcugucucacggcgagauggcugccuugaccggacguuacgccacuuccggcuucuc

SEQ ID NO: 192668 - RNA, 16556 nt, Homo sapiens
gcgugcgcgagccaucuggcgcuguaaagcgcuuagaggcuggaauaacgaccugccuuacgcuuugcggcugucgucggagaggcaucuggguucggacuggggccgccauggggaaagugaauguggccaaguugcguuacaugagccgagaugacuucagggucuugaccgcgguaagaaacccgccguuccuguucucccuuccccuuaacacugugugaccucuuccuguuccugcaaguuuucugggaucugagcaggcacacucugggacccgggacguggcagaagcugggaauggagaagagagcauucagaaagucggauuuuuaaaaagguuuuguuugggagcuuaccuucccccagauagagcaaaggucccgucuucuaauaauuguuuucuuuucugcugcuauucgcuuugcgcugaagagaaacgcuugcaucucuguggccuggaaacuucucugauccugagcuuccgaccagcugugaaagguuuaagcccccccccccccccgagauuugauaauauugacuucccuacuaacagacucagucgcauagcagucuuucugauucauucagucaacacauauuugucgguuuuuuaguagcaacauuaggagguucacuuguucaaacagacaaguggagagagagacacagaucaucaaguaaacgaaaaauaggauaauggauaaaugcuaugaaaaugauaaaggauaauggcauagaaaguauauguaucugguggagaggaggggcacaaguuauuggccuuugguagacaaucaauaaauauucacuaaaugaaagaaugaaugggggaauaauaggagcugugugagaaagagacagcccagugaaguccuuggaaagaguuggaggcagaggaaacagcaguaguaagugcaaaggccuugagacagaaaagucuuugaagagaggaaaggccaauguaauguggcuggagcaaagugagaugcacacuaaugguuggagauguagcggaaaaggugagaaauuauguacuacagagccuuggagguuugguaaagaauguggggguaaccacuaaauguuuuuaaucaggggaguaacaaaaucugauuuuauggccucagucuuauggcacagaaauuaauauauagaucaagacauuuguacauuuauuuaggagccguuaucuuuugguaaggagugaaccccaugauaaggacuaccuauauuguguaauuauguaauaggauaugcgaugugagucacacugguucuugcauuauguuaaggcuucaaguuuuggauuuuuaaaauuaaucuuaaauagcgcuuaaguauuaaacuaucaaaugcaaaaucagugugaaauuuggaagacaauguuuacuuugccucucauguagauucuucuaaucagcuggacuuucucuaugaaaaccuacuaucacuucggaaagauaccuuccuuuccugcuuucucagcacacucauuccuuagugucucugacagaaguaggggucaaaaguaagaguguuagaggacgggggaggcagagacaaagcauggaaaauaaguuaaauuuaaaaguuaagguuuuggugagacaucaaaaugaugccagauuuaucuuccaaaacauuggcgcugcaauauuuaaauuauuuguaaaguucaccaagaaaugacuuagucauuaaauaugacauuccggucucaguugaaucucaccaguguugguacccuuucuugggccucucuucccuuuuacuucuuuggcuccuccuauaucaauaaucauuguuugacuagcugcccuuagcuuucaauaugaacuugccccagaauucugcucccaaacauuccuuuucuuccauuaucuccugcucagugauagcauccacuucacaucuucaacucucacuucuauaaaauaauugacaauuuuuccuucuaauuauaacuucauuccuaaauauaggccccuuuccuauuuaauuuucucucuuucuuuuuuuuuuuuuuuugagacggagucuuauucuguugccaggcuggagugcaguggcacaaucucagcucacugcaaccuucaccuucuggguucaagcgauucuccugccucagccucccaaguagcugggacuauaggcgcacaccaccacgcccagcuaauuuuuguauuuuuaguagagaugggguuucaccauguuggccagaauggucucgaucucuugaccucgugauccacccaccuuggccucccaaagugcugggauuacaggugugagccacugcaccuggccuccaguuuuccuuuaaacauuuuuauuugacucucagugcucaaaccaaauucaauuuuuuucuacccccuuucucuuuucccaagcucuauaaaaaaaaaaaauaauaaaaucuuaaaacuugcuuuuccucaucacuuccaauuguggcuuuccguucccuuuacccuuccacaucuaauugccaagcucucccauaauacuuccuaaagauuuuuauuccuuccuuccaguaccacuaccacuuacccuguucugguggcucuuuccucugagcuggacuucugucuuaguucuccggaguacccccucagauuuugccaucucuaagccaauuugcauauuccugguacauuaauguccuuaaaauaacccuguucgugugucucccacgccuaaacaucuucaagagcuuccugcucucaucaggauaaaauauaaaaguauuuggucuacauuuuaaugccuucucuauccuagaaguaucuuccagccgcguuugcaugaauucuauaugcuaucccaucugagcugcuacuguacucagcuauucucuguggucaguacuuucuugcauaugugccauuuucaaaucuuuuucuuucacuaauauccccuugucuguuuucucuguaugcccacaucuuuuaaaagucagucucuaguuuugcaucuuccuuggaacugaucccucagcuagaaguauucuuauucugcccugagcuaccuuuuuaagcacuuaucacuucuuaacuucuaauaaacuuagauguauaccauuuuuuaaaauuuccaucaugagauaaaaauuucucagagguaaaaagcacauauauauauauauauauacauauauauauauauacauauacacaugcagaagagcauguaggauagagauauauauauaugugcuuuuuaccucugaggaauaaauuuaaaaauauauauauaauauauauauuauauauauauuauauauauauaauauauauauauuuuauauauauauauuauauauauauauaaaauacuuuuaaguucugggguacaugugcagaacgugcagguuuguuacauagguauacacaugcuauagugguuugcuguacccaucaacccaucccaucuacauuagguauuucuccuaaugcuaucccuccccuagccccccaccccccgacaggccccagugugugauguuccccuuucuguguccacguauucuuacuguucaacucccacuuaugagugagaaaaugugguguuugguuuucugcucuuguguuaguuuucugagaaugaugguuuccagcuucacccaugucccugcaaaaggcaugaacucauccuuuuuuauggcugcauaguauuccaugguguauaugugccacauuuucuuuauccagucuaucauucauauauauauauauauccucuacgaugccuacauguaguacuuucucauuaaauaccugcuuaauaaauaucuggcauaucuguaguuuuuaaagacaaauguuuaggugucaucaaguauuuuagcauugaccaaaugucaucaguaugucuagcacucacaguuccuacucuugaaauggaaagccaauacaaauaucaaugauuagauuucaaauugcaauuaaaaauauuuucaagagacggaagugauuaugucucagaauuaguuggagaacugcauagucaggaaagcuucaaggagaaguuaauuucgcaggguuuugauagacaaggcuuuguguugauuaugauuauauaaugauuccuuuaauuucagguugaaaugggcaugaagaaccaugaaauuguucccggcaguuugauugcuucuauagccagccuuaaacaugguggcuguaauaaaguuuuaagagaauuagugaaacauaaacucauagcuugggagcguaccaaaaguaaguauuuugaggcaccauuugugauuuuucagguaauugguuuccaccagagcaaguguuccaaaagucaagaaguagaaguugccagacuaguaaagcauuagacgaagaacugacagaacacacuucggccauauccuauuagucaaaauaaucacagggcacacccagaucaaaggaggugaaaaaagaauaguaguaagaacauguagguacugcagaagagcauguagguacugcagaagagcacguagaguacugcagaagagcauguagaguacugcagaagagcauguagaguacugcagaagagcacguagguacugcagaagagcacguagguacugcagaagagcagguagaguacugcagaagagcagguagaguacugcagaagagcauguagaguacagaagagcacguagguacugcagaagagcacauagaguacugcagaagagcauguagaguacagaagagcacguagguacugcagaagagcacguagguacugcauaagagcagguagaguacugcagaagagcagguagagcacugcagaagagcauguagguacugcagaagagcauguagguacugcagaagagcaaguagguacugcagaaaagcauguagguacuguagaagagcaugaagagcauguagguacugcagaagagcauguagguacuguagaagagcaugaagagcauguagguacugcagaagagcauauaggauaaagcuauuguggcuaccaucuuuggaaaauacaaucaguagucauacccuagaucauuacuucugaaaccaucuguggugaaggauuaguuuuuuccaaccuaucacagauccuuacuuuuauaaaauacaaaaaaauaauuacuagaaaaaugaaauggauaacagauauacaaaaacagacauaaauucuaggucaaauugauauacaaauugaacuuaaauuccuccuuuuaucuugucacaaacacuuacagaccugucuguaggucacauuuugauuaucaguacacuggagaagaaaugcaaauuauaggaagaaauuggaagcuugugagccugggcaguuuaucuuuuuccaaugaagacuuuauuguuaaaucuuucuuaugacuugaacuuacgugacuugguuguacaauguaacugaaauauggucuuuaugcuuugauuuuugucuagcuguccagggcuaucgguugacaaaugcaggauaugauuaccuagcuuugaaaacacuuucuucuaggcaaguaguugagucuguuggaaaccagauggguguuggcaaagaaucagguaagugcuaauaguacugugcaaaguauuuucuuugcuuuaguuuauguuuucccuucagaaaccuuuccucuuuuaauuuucccuuuuuucuaacuaaacaguaaguuggaaaguugauuggaagcaguacaaaucagaagguguccuuaauuaguagguuauuauuuucucugaacgucuaucacugaaaauucauuuauaccaggaauuaauuuucuucuaauaacucccaagauauaucauuauuuaugugcaaauauaccagaauccaaaauucaaaacacuucugguccgaagguuuuggauaaggagggauacucaaucuuuauuaggaaaaaugacauuuuugauacaaauaaaauuagagaaaguuagaauuguuuuaacugauuggaauaaacguguaauaaugguuguuuuugaaauuuugucucuagauauuuacauuguugcaaaugaagaaggacaacaauuugcauuaaagcuucacagacuaggaagaaccucguuucgaaauuugaaaaacaaacgcgauuaucauaaacauaggcacaaugugucauggcuauauuuaucucgucucucugccaugaaggaauuugccuauaugaagguauuuauuuuauuuuguagucaugcauuuuuuagccaaauaauacaugugucucaaaggccuuaaugacaagugugauucuguuguccccacaucucucuaaccuuagacucaauuccuacagacagacucaaucuuaaauaacucuguugauuauuugggcucuuuuaagugauuuccuucuacguuaagguauuuuaaauuguuacuaaugcauaagggcaacacauucuguaaugcugacaagaugaaagagccaaaaguaauuaaugaugcuguuaccucacaaauauguauguguggauguauauauaucuauucaauauauguaacuauacauaugucuguuucuaauugaaaacaccagguaauuaucaucuguagaaaccuuagugucucagauaaguuggcuaguuuuuuguuucacauaaaggaacaaacauuuauagauuuauauguauauuaaaaaugguaaaaauuggcugggugcagugguucaugccuauaauaccagcacuuugggaagccgaggugggcggauuacuugagguaaggagcccagccugaccaacaaggugaaaccccaucccuacuaaaaauacaagaauuagccggggauggugguggccaccuguaaucccagcuacuugggagacugaagcaggaaaaucacuugaacccaggaagcagagguugcagugagugaagauugugccacugcacucaagccugggcaacagagcaagacucugucucaaaaaacaaaaaugguaaaaaucuuuaguuuuuaagagguaaggaugaagagaaguggguuaaaggauacaaacauacaauuagaaggaauacauucaauguuugauagcagaguagggugacuauaguaaacaaaauguauuguacucaggagaugaacacacuaaauacccugacuugaugacuucucauauauacuuaacaaaauguuacauguaccucauacauuuauacaaauagaaaaaaaugcuuaaccuggcagaugaaaugucaaaaucucaaagacgguuuucucaggguuaggccuauucauugcacuucaggugugcugaccccugcaguuuccccaaauauuggaacuugacugcauauuuuguggcacuggcggacuacauuuauacuguccccugacauuaaaaaaaaaaauccuuuauuuuuaacuuugccuucaaaauuaaguucagcauagauuguuaaauauaauaauauccaaauuaaauauauccaacaauaacuaaguuaaacaaaagauaauauuguguuuuuauaauccugccaguaggauuugucauaguuuaucuucauuuuucaaaacaaugugaauuaaagauugcuacagugugugaacaccuguuucuugaggauucagcuuguucuuugaguggguuauauacuuaaauuuucacuaaucaugggagauuucuuaaggcagcauaaauuaguaauacugauaccauacaugucaauguacuucuuauacuaauaguuuguaucuuguaauauucagucaguaaaugagcagcuugguagggaucauuuacacauuuucccaaaaggguaguagguguuuuucaggauauuuauauugaagguauaggaauggaaucugguugcacauaaaugcacuccuuaauguauugauuauucauaagagaggaacaagaagauaaagauugggcuauagcaugaggucuaggcgauagcacaaguucuagacaaauauucacaaucuuuaaguuuaucacgugcuauugaucugucuagguaugcucaaaauggucuacacugaaaaaaaguauuuaaaaacaaagcaaagaaaaauaucugggaagugggaagugguuugguucuuguucacagaagguaagcaauagacaaccuuuugaaauuaauugcugggguaguguagggugaaggaguggaugccaaagaaauaaccaguacgaucugugucuuaaaguugagaagauaacacaugaaacagaaccuuuuauuuauuuauuuauuuauuuauuuauuuucaagacaaggucucacucugucacccaggcuggagugcaguggcacgaucacggcucacugcagccccuaccuccugggcucaagccauccucccaccucagccucccaaguaucuaggaucacaggcaugugcuaccaugccugcuuuguagagacaggaccuugcuguguugcccaggcugcucucaaaccccuggccucaagagauucacccaccucggccucccaaaguaccgggguuauaagcgugagccaccacugcaagucuaagaacaauuuuuuuuuuaauuauauacugaauuuagagaaacuucaguaagugauagaauaguugauggaggagguuucagguagugaguggagcugaguggagccaugaagcuuggauauuauuugacccuaagacagugcauuuuggcagagaagugguaugggcaaugacaugaaucuaugugaguccuauguguuuaggugacacugaggugacuguccugacugcguuucuugguguguauuggagagaauauugggagaacuaggacuguacagguggauuaaagaguuuugaaaaccaggaaaaguuuauauuuacaaacugaaaagaaaauuuacagccaauguaaaaaaaaacuuuuuuugagguguagucuugcucuaucacccaggcuagaaugcaguggcacgauaucaacucacugcaaccucugccucccggguucacgcgauucuccugccucagccucccagguagcugggacuacaggcaugugccaccacgccuggcuaauuuuuuuguauuuuuaguagagaugggguuucaccaugcuggcaggcuggugucgaacuccugaccucaacugauccacccgccucggccucccaaauugcugggguuacagacgugagacuccaugcccaucccaauguauauauuuuuaaauggaauauuaacaucagcagguuagucugguauugguacauagaauagguuagguaugauggcaagagcuagaacacuuguggaguaaugagguauaugccuccuuacaaguauauguuggugcaaaaguaauugcaguuuuugccauuccuaauacuagcauucuaaaugucaaagggcauaaaucuaagguauuuuaaagaaaguaauaacagggcuuuguaaacaguaagauugaagacaguaagcuuaggggaaaagauguauggagagucuuaacacuugaaucagacuacaacaguguauauuuuucacauaauagauuuauauugcauauuguggccuggagaaaaaguucagugcccuauaaaccaaaaugucugaucucuuagaaugccucauuuccuaauauguccgaagaugaguauuuccuaaauuuguuuccaauuuaaauauuuugagcacauuucaacaaaugucagagacuuacaaaauaggaaaggauauacccuaagagacuguaagcuucuugggggcuuuuugacacuaauuuuagaguguuuagaaacuuuuuaacauucauuuuuguaaccccagcacagugcauaacauuuuguaaauguucauuuuuuguggaaaagugaauucaaacuuuuguuuaaaauuugcuuuuuauguguggcuaauucuacgcagugaauaaauaagcuaugcauaaauaaccauguguuaacuacaauuuuauaaagguuuguguguuuuuuuucugguuguagaaagguauauuuacuuuuauuguucuuuaaagaguaaugaccuguucauuagcuuacaccuguuuugcaacauuuuaggcauuguaugagaggaaauuuccaguuccaaagccaauugauuacaaucgucaugcaguggucauggaacucauaaaugguuauccacuguaaguauucauuauucuuaaagccaugaauccugauaaaugaauuuaaguuucaggguuuuuaauaaaauuuuuuuuaguuaaugaaauauugccucugggagguuaaaauuuauuuaaaggaauagacucaaagacaaauuaaaaacccaguuucauucugacaauaugaacuuuguaaucucugugauucauucauucauucaauauuaagagacuguuaggugccaggaacuuuuaaucucagcagugaacaaaacaaagucccugcccucauggaauuuacauucugauggaaggagaugugcaauaaauaacuaaaggaaauguauaucaauuguuaguaaguacuauggauaaaaaaaagcagaguaagggagauaggaaguacuaacgggacaggagacuacuguuuuauguaggguggucaagaaaagucucacuaauaaggugaaaccucaucaaauuuugauucagauuagcagcuauuggagugggaguauuuugagcagagaagagaugugaucucaucaaucagugaucucaguguuuucagagggucacucugcuugcugaauuaauagacucuggggagacaaagaauuaggaagacaaguuaagaggcuauuacaauaaucuaggcaagaaaugguuguaauucugauuacagugauaguugugaaggugaugaaaaguggucagauucugaauguguucugcagguugaaccaacaugauuugagauuggauauggaugugaaggaagggaugagucaauggugacaccaagguuuuuccccugaguagcaaauuaacuggaaggagaaaucuaccauguauagaaacaggaaagcuacaggaacagcauuuuggaguuggagggugggacagaaucagagauuccauuuuggacaugcuaaguuugagaugccugggaguuagagaagucuacauuaaaaucaguguauaugugguauuuaaaccauuaaccuagaugagaucaccaagaaugagucuaaauaagagaaaauaaaaggucauaggauugaccuuugaggaacuccagaauuuagaggucaaggaaaaagaugaaguacaaauagaaaagacuaagaagguaugaucugugaggaaggaagaacaccuggagagaauggugucccaagaguuaagugaagaaaauguucaaagaggucaacugacagaccacauaugaugaggacuaagaauugaccuuuggauuuagcaacauugaagucauuguagucucaacaagggugaucuuggaagcacuuuggccucccaaagugcuaggauuacaggggugagccauugcgccuggcccguacaugcuauuauugauucuggauguggguguguuuguuuagaauauaaucauuuuuucauaauuuuucaauuuugugauacuauuauuuaggucacucacugguuugaaguggcuaguguuaacguuauaaaaagccuguuugaaaugguaugagagaguaggaggaaacaaauuggaaaagcacauguagacaaguuuggcuguaaagaucaaagaaagguaguaguagaaaagagauacagaauugaagcaguguggcuauuuuuuuaauagaugggagauauuauaucugugugcugaugggaaugagaagaaagcugcuggggauacacagcauggaaauaauauauauguucacaugcauacauacuuucguuaaaaccguaaaugaacacaaguaaccuauuuucaugcuuaaaauacuuucagaugucagauacaccauguugaagauccugcaucaguauaugaugaagcuauggaacuaauugucaaacuugcaaaucaugggcugauucauggagauuuuaaugaauuuaaucucauuuuggaugaaagugaccauaucaccaugauugauuuuccacagaugguuucaacuucucaucccaaugcugagugguacguacuugcuauuuuuuuauuuuuauuuuauuuuauuuuuuuggagacggaguuuugcuuguugcccaagcuggagugcaauggcgcgaucucggcucacugcaacuuccaccucccggguucaagcaaugcuccugccucagccucccgaggagcugggauaacagacaugugccaccacaccuggcuaauuuuuuguauuuuuuuuuuuaguagagaugggguuucuccauguuggucaggcuggucuugaacuccugaccucaggugauccacccgccucggccucccaaagugcugggauuacaggggugagccauugcgcccggcccuuacaugcuauuauugauucuggauguggguguguuuguuuagaauauaaucauuuuuucauaauuuuucaauuuugugauacuauuauuuaggucagucacugguuugaaguggcuaguguuaacguuauaaaaauuugguuuuuuauuaaaguauaacuacuagaguuuuccccauaagaauuugaauuucucuguuguaaauugacagacguucaaaagucaaauuuucuuagccauggaacccuuuguucaaacagacuuuuagauggaagaccaauuguuaaaacagguaaaaguagggaguguaguggggaacucuagaaccacuuuugucuuucccuuuuucuugcuguuccaugauugccuccaagagagauucaccaaguauaacucaguaaucucgaugaucugaauaaaaguugugguuuuggacuggacucaguugucaaaccagugauaauuaccucuugucacuuuuagcuuuauuuauuagaaaaaaaaucacauaaaacuuuaucucugacacagugcagaaucaugauauacugcgauaaucauauucuucacauuacuuauuuaaaccaagccagccaagucaugaaacaggaccuuauccuuuauuugcuugagguuuaugauucaauugaguguaacuaaggauuuuuuuuucuuucuguuccaagcuuuaugagaaacuuuuuuccuaaacuaacaacuaguaucacuuauauaauagaguauauuaauucuuccagagauugagcuugaaguaguuuuguuaagugaagcgucucuucauccugguuuccaguagaaaaugucuauacuuaugcuacagaaagaaaugucauuugaaaauaaauuuuuaaaacguuuucaacaaaauaauacuaaaagauuaaugccuggcacugggguggucaguacucuuuggaugaugacuaaucaugauuuuuauuaauaaggaguaacauagucacacaguaaaggaacaucuaggagccuccagagugugacagauuaugacauucuagguuuaggcugcaucguucuauggagagacauugugauuuaauuucaauuuuuaugaaccaguucuggggccaaggagcugugcuaauugcuagagauugagauauaaauaaccccuauauaugcuuuagaaaauguuacugucucguagggagauguaaacauauauaaaauagucuuuuuaaaauguauuaguauuuuucccagaguacccugugagcaaagaggagaggcauuaucuuccuauuuccaaacuucaucuuucucaaagagagucaauugcacauuauccuguccuuaauucucccuugucuggaaaucuucuagagaauugaauccauuuuugcugcuuugugguggcccaaaaaggcagccugauauucagauauuguucuacuuuugguccagauuaacauguccucagauuauuuuuauaggcuguagcauuauuuaucccuuuggguguuauugcaaaucggcuaauggauaacaaagauacauaaacauaauucaguagucuccaaacuuaacuguuuaauauuaauaucuuuuuaucgucagaucuuucaguuggcuagggguucuagugaguguugcugauaagaagcauagccagacucaggacgaacagaauaaguggaaaccuauccccaaaccauaggcccauuaucuuauuuccugggguucacauucaucuuucccuaguguaucuaacuauauaccaguaacuaugacaaaaccuugacuuuccuaaccguaggaacugcauggcauugacagcuuauauccuugagauuuccuuggauuuuaguuuuucaaacacacugguuaacucauuuguaucuuuuuucuuuuguguaacaucuuuuaucuccuuguguaaggaggagcaauaccauuaaccaauaaguauauugucauuggcuaauaaggaaaaagaggagcaauaaagacuauaucauaaaugauucuugcuuuugcagguauuuugacagagauguuaaaugcauuaaagauuucuuuaugaaacguuucagcuacgaaagugagcuuuuuccaacuuuuaaggauaucagguuuguacuccccauugcuuuacauaauagaacaguuuaaauaucuggucuguguauuucuaaaaauuaacauuuucaucuaaaaaacuuuccaaauuuugacacguaaucacuguuagaugucauugcucuguaguacauaacugaaacuuaaaaacuugaaaauaccugcauuugguccauuaaggcacuguuacugaauuuuaggaagcggacauaucuagauucuuauaaauucaagaacuuuuauucuauuuuggaugcuauuugaguaacucauucauaaggaauaacaccaaacauucauugaaauuuguguuuuuccuuuaucaaggaccaggagguaucuuuaauugauucucaaaacauaacuaucaugugcauucucaaagcucaguuuucucauauuuauuuuauacacuuaagauauuuucugaucugggaugagucacauaaucugaaggaaauccuuagcccccuuugaaaguuaauuuacaaaguuaauaaacauaagcugagguuuuuauaaccuuuuuauuuauauuguugcuuuucaguuauuuuauucuuaaaaugacagccagcauauaccuuucauauuuguuuaccugugucauuuaaauauuacauuuuagggaaggaaaauuuauuuuuaacauauaagcuauuaaacucacuugaaucauaauuuaucagaguaguagauauuugcuccucuuagauaaacauuuuuucucucuuucuaugcuugacgccuuuuuuuucuaggagagaagacacucuugauguggagguuucugccaguggcuacacaaaggaaaugcaggcagaugaugaacugcuucauccauuagguccagaugauaaaaauauugaaacaaaagagggaucugaauucucauuuucagauggagaaguggcagaaaaagcagagguuuacgggucagaaaaugaaagugaacggaacugucuagaagaaucagagggcugcuauugcagaucaucuggagacccugaacaaauaaaggaagacaguuuaucagaagagagugcugaugcacggaguuuugaaaugacugaauucaaucaagcuuuagaagaaauaaaagggcagguuguugaaaacaacucuguaacugaauuuucugaggagaaaaacagaacugaaaauuacaacaggcaagauggucagagaguucaaggaggagucccugcuggcucugacgaguaugaagaugaaugcccucaucuaauugccuugucgucauuaaauagagaauucaggccuuucagguauagacuucugucgauugcuuuuuaacuuuagucuugagacugauacuuuguuagauucuaguaaaagaauguuuuuuucaaaugaugugacaaaauuguauucugccaccuugauguauaaaaugaaagccaaauaauuuuuuguuguuaaaaacucaaaauagcuuccuuuucaauugaccugauucuaggcagccuauugacuaaauuucaaguaauucugccuuaaaauacaaacugauggcugggcacaguggcucgcucaugccuguaaucucagcacuucugggaggccaaggcaggcaaaucaccugaggucaggaguuugagaccagccaggccaacauggcaaaacccugucucuacuaaaaauauaaaaauuaaccgggcaugguggccugugcuuguaaucccagcuacuugggagacugaggcaggagaaucacuugaaccugggaggcagagguugcaguaagccaaagaucguaccacugcacuccagccugggugacgagcaaaaaacuccgucucaaaaauauauauauauauacaaacugaugauuuuaaaauuauugcaggucucuggauacauugaucagguuuuagauggaugaguuauuccucauauauuuuccuaauuacacaucugauguguguuugaguuauguaaaggcauguaaauauuaaaacaugcaauaaauguacuuucuauaugaaa

SEQ ID NO: 192669 - RNA, 10857 nt, Homo sapiens
cggagagaagagagagcccggccagacccacugcgaugagacagguguguguguguguguguguguguguguguguguguguguauacagccauguggggaaaacuacugccauaugugugaccacguguguuggggaacugugugugcaugauuucauguguguauccaugugccugacagugaccauauguguguaggggacagugagcaugugaggcugagugugcaggucuguguauacauugcccugugugagcggccaucccaaguacauguaggugagacgugccauguccguauuucuguaucugcguaucuugcuacaaacuuguguaugucuauguucccugggaggcagagagaaagagggagugcgacagugagcgaaugaaagagacugagugagaaagagaguuggauuugccuguggcacaugggaauggauuucuguuucaugcguucaauagcuauuaaguugaaccaaaugaaaucgccgauacugagccacucuaaacuuggaagaauagcaauuucaucugguucaguaucagcuugacagucaccuacuauuucucuugaaaucuucccugugcaucccauugccccagacucucaguuggggcucuguguguuuguggccacguggacauccuuugcugguguugcuuuuuccugcugaggggugugugucugcagguucaccuguguggccgucggugggggucacgggaucgcuguguuuggccugagugggugucucgggucauccuguagaacacgaguaauuucauucugugugucacucaucaugugugaguucacgugugggggagugugucuacacguguguucaucuguguuucuggaaucaacucucuggauccccagcaugaauugagccaucccuaggaacucaggcaaggccagguuugaagcaaaggaagagagaagggggauucgagaagaaagaauaauguuuaauguugagaguuuaaaagcuguaccucaguuuuguccucuagaaauguaacgaaaaccacaauaucuaauuuaaaauuuucuuguggccacauuugaaaaaguaaaaacaaacaggugaaauuaauuuuaauaauauauuuuuauuuaacccagugugucaggggccagcacauuuuuuuaaauaaagggcccaauauuaaauauuugaggcuuuugggggccaucuggucucuuuugaaaguacucaacuucgaugugguaaauguagaaucagccacagaugauguauaaacaaaugaaugugguuguaugcaaauaaaacuuccuuuaaggacacugaaauuugaauuucauauuuuucaugcuccacaaacuauuauucuucuuuuggcuuucaaaaaccaucuaaaaacacacacacaaauucuuagccugcaggcugcagcaggucuuagcaugccgaccccugcuacauauaagauaugaucauuucaauauguaaucaauacauaaauguuaaugagcuauuuuacuuucuuuuccccagacuuggccuucaaaauccaguguguucauagcacuucucacuuagaugcuaccuuuucacuggaaauaccuaaucuguguuuagauuuuauaagauuuacaauuauaaaaggggcaucguagaugcaacuuguuccagacauauuuaaaaucuuuccaauaaccgaaucaaguaagaguuuuuaaauuuaaaugaauuaaaauuaaauaaaauuuaaaacucaguuccucggugauacuggcugcauuucaaguacucgguagacacauguggcugcugacaccuguguuggacacaaagaucuacaucuuaacgacgcauuuaaauaacccacaguaagccuugaggcaggaacugguggcauaggaggcaguuuagcguagaggggacgccagagccagacugccugaguuuuacuucugacucugcuuauuaccugagugaccuuggguaaaaguauuugccucucagugucucaguuuccucaucuguaacagaagacagugaagguaccugccuuauaagauuguuguagagaccgggugcaguagcucacgccuauaaucccagcacuuuagggggccaaggcaggaggaucgcuagagccugggaguucgagaccaacuugagaaacacagcaagacccugucucuauuauuauuauuauuauuucgagauggagucucgcacugucacccaggcugaaguguaguggugccaucuuggcucacugcaaccuccaccucagggguucaagcaguucuccugccuuagccuucugaggagcugagacuacagucgugcgccaccaagccuggcuaauuuuuguauuuugcuuucgccauguuagccaggcuaaucucgaacuccugaccucaggugauccacccgccuccgccucccaaagugcugggauuacaggcgugagccacaguuucuggcucccugucucaauuuaaaaaaaaauuuauauauauauauuaagguuguuguacaguagugucuggcacacagaaaguacuuuuuccucugauucugggcucuuccagcaacauuuacuggggcaccuggcucugcuggggaguugggcaguggaaaaggagaaccaggcuaugccucuggaaagucagagagaagaguccucuaccaugggcugcugaucuugugcaagccacuccuucuggccaaucaguccucaguuuggccaccuguaugguggcagagcacuaucugucccccagggcucucccgagggcuagagguuuagagauucaguuccuaggguucaaauccagguuccucugcuuuccagggacaaccuugggcaaauugcugaaccucugugugacucaguugccucaucuguacaacggggauaauaauaacaguaccuaccuuacagcgcuguuguaaagauuaaaauaaauucauucaucuuaaaggcuuagagcagggacugguacacagcauuuugguuuuuuaguauguguuauuauuauuacugucucaacccuaagaaaccuuugauugggagauaaauccucauuguaugugccacuaagaaagaggagggaaacgcccuaguaauuaaauugugacacuccaucgcaugcaaucauccucacggauuuaagagauuucaaaacguggaaaaaaguuguauuggaagaaacaaaaucaggcugggcuugguggcucaugccuguauucauagcacuuugggagacuggagccuaggagacauagugagaccccuccucuaauuguuuuuuuuuuaauuagcaaggcauagugacuccagccuugugguccuagcuucuugggagacugaggugagagaaucgccagagccuaggaguuagaagcugcagugagcuaugauggugccacugcaccccagccugggcgacagagcaagacccugucuauaaaaauaaauaauaaugaaaagaaggaaucuaaucagcaugaagccuagauagcuauuugcuccaauuauuuucguuaaugaaaauaauuuuggggcccggcgagguagcucaugccuguaaucccagcacuuaggaaggccggggcaggcaagucacuugagcccagggguuccagaccagccuagguaauguagggagacccccggcucuaccaaaaauuuaaaaauuagccaggaguuguggcacacucuuuguagucccagcuacucgggaggcugaggugggaggcugagccugagcucgggaagcugaggcugcagugagccuagauggcgacacuaggcuggagugagacccugucucaaaagaaaaaaaaaacaaaaaacgaaaggagagagaaagggagagcgagagcgagagagagagagagacagcgagacagacacagagagagagaaagauaaagagaaggaaggacggagggagggagagagagagggaggggagggaaagggaaggagggaaggaaggaaaggauuuuuaaucuucucucggaggaggcucaugcgcccgggacucaugccccuuccuuuccccucucgcucccagcaggacgcgcccaagcccacuccugcagccugccgcugcuccggccuggcccggagggugcugaccaucgccuucgcccugcucauccugggccucaugaccugggccuacgccgccggggugccgcuggccuccgaucgcuacggccuccuggccuucggccucuacggggccuuccuuucagcgcaccugguggcgcagagccucuucgcguaccuggagcaccggcggguggcggcggcggcgcgggggccgcuggaugcagccaccgcgcgcaguguggcgcugaccaucuccgccuaccaggaggaccccgcguaccugcgccagugccuggcguccgcccgcgcccugcuguacccgcgcgcgcggcugcgcguccucauggugguggauggcaaccgcgccgaggaccucuacauggucgacauguuccgcgaggucuucgcugacgaggaccccgccacguacgugugggacggcaacuaccaccagcccugggaacccgcggcggcgggcgcggugggcgccggagccuaucgggagguggaggcggaggauccugggcggcuggcaguggaggcgcuggugaggacucgcaggugcgugugcguggcgcagcgcuggggcggcaagcgcgaggucauguacacagccuucaaggcgcucggagauucgguggacuacgugcaggugaguagaggcgccuucagcccacucgugacccgaacacccaaaucccacuuuccuggggucuuuccuucaauguacagauuugaaugacucucucccuuucuuuauucuuucauccaugcaguggagagauucuuuccuucacucauucuuucauccauccaucuaucccuuuauccaauauggagaucauucguucauuuauucauucauuuacccauucaauguagaggcauucuuuccuuuuuucauucaccuacgcauuccaggaagagacaauuucacucauucuugacucauccauucaucuauccauccauucaauauagagauucauuuguucauucauccacugauucaguuauccauccauucaauguaaaauuaaacccuuccagccggccacuuugagaggcugaggugggcggaucaccugaggucaggaguucuagacuagccuggccaacauggugaaacccugucucuacuaaaaauacaaaaauuagccgagcaugguggcgaaugccuauaaucccagcuacucgggaggcugagggaggagaaucuuuugaacccgggaggcggagggugcggugagccgagauugcaccauugcacuccagccugggcaacaagagcaaaacuccgucucaaauaaauaaauaaauaaaaguucuuccuuacuucauucaguguagaaauucuuuuucuuuacucacucauggauauaccaucuauccauccaauauggagaucauuuacucauuuauucauucauuuaucuauuaaauguggagauuuguucccuuucuucuuuccuucuucccuccuuccuuuccccuccuucaguguugagauucuuucauucaaccacucagccaucuaucuauguauucaauauacagauuaauuucauuuauuuaucucauucauccaucccauuugguguagcaaucuuuuuuuuuuuuugagauggaaucucacuccguugcccaggcuggagugcaaugguugaaucucggcucacugcaaccucugucuccuggguucaagugauucucccaccucagccuccccaguagcugguauuacaggcaccugucaucaugccuggcuaauuuuuguauuuuugcagggacaggguuucaccauguuggcuaggcuggucucaaacuccugaccucaggugaucugcccacuucagccucccaaagugcugggauuacaggugugagccaccacaccuggccugguguagcaauucuaaugcauuauauuaguuuuccauugcugcauaacaaguuaccauauguuuggcagcuugaacgaaacacauuuauuaucucauaguuucuaugagcccagagucagcacagcucaacuggauccuuuuuucaggauaucaccagguugcaaucaaggugucagcuggagcugggucuuuuuuaaggcuugggguuaucuuucaagcguauguauuuguugguuggcagaauucacuuucuugcagccauagaacucaugguagcaguagcuugccucuucaaggccagcaaggagacucucugacuucuaggucugcuuuuaaagguucuccugacuaggucaggcccacccaggauaaucuccuuuugauuaacuuauagucaagagauuuggggacuuaauuacauugcaaaaccuauucaccauuuccauauuagguaauauaaucauggcaguuauaucccauaacuucugccauauucuauugcuuaguagcaaguuaggggucucacucacacaccagaggagaugguauaugucuuauuguucauguucauacaaggaugugcaucuuggaguacauguuaaacugugacuacacauugaaaaugacuuuaaaaaaucucaaaauuauguucagaucgguugcagagugccccagcugcauugcaccccuugaugccuuccucucaagcaucagccugaugcaggggucugugcugauccuggccccuuccaccuuacaggucugugacucggacacaagguuggaccccauggcacugcuggagcucgugcggguacuggacgaggacccccggguaggggcuguugguggggacgugcggauccuuaacccucuggacuccugggucagcuuccuaagcagccugcgauacuggguagccuucaauguggagcgggcuugucagagcuacuuccacuguguauccugcaucagcgguccucuagguaagcaggggcagagauugggagggcuguggaugggguggaaagggagaagggaagccggauggggcugaggaugugacugggguugggaacaaagaugcagcagggcaggaauuggggaugggauaaaacuggaagcuggcggugaggaugcugcuugggcucaagcugaguuugguguggggagugagguuggaaaaaggauauggaugacgauuggggcuggggcuggggaagaagaugggauaggcuuggagucaaagacagaguuggagccagguuugagguugcaguggguuuuggauggggcugagaauggauaugggauuggugaugagacuggggugggcagguuugcagucacaguggguauaguucaaugacaggcaaguuggagugcguaugagguugaggacaggauucgggcuggagaugggauuggagauagugcugagauugagauuaugaugacugaggaugggguuggaacuggagaugggguuggggcuggaaacagcauuggaguugguguuggugacagcagaggcugacacucuuucacaccuccccuccacccaggccuauauaggaauaaccucuugcagcaguuucuugaggccugguacaaccagaaguuccuggguacccacuguacuuuuggggaugaccggcaccucaccaaccgcaugcucagcauggguuaugcuaccaaguaagcugaggggaccagguggucggguauguguggaggccaaugaauauccuagcgugugugcaugcugagaguucuccaaauccaaaguaacucaccagacaaugggcucuaucaagugagacuuuagaggagagaggaggauaccauaaugggcagaggggccauuugcauugagccaauggacucuaccaagugagauauuagggaagaggggaagauacuauaagggacaaggcuggcauuugcauugaaccauggaaugcggugaacucuaccaagagaggcaaggugaggguagagaauuccaccuagaauugagauagggugaguugguucugucauggagaccaagguagcacaguggggagugaaguaggaagggcaagagacaaauggauagagugggaucuaacuagugagagagccacggagaaagaaacaagugagagaagaggagcaccugaacucuaguaaguucuucaagagaagacaaguaauuccaugagacucaggggaggaugaucuagaccaagugaaguucaggggagagugauuucugcaaagccagguccacugaaauacccagaggaaacuugggauaauccaggggaauccaugcauuaauucacucaacaaauauucacuaggugccuagaauguuuaagcugcggggauacagcaauaggcagacaggacaccaauugauuacaucaguuggggagacacacaagaaauaaauaaguagaacauacaguauguucaugauauguguuauggagauaaauaaugccgggcaagggugguggauaggaaguuuugggguugggggugaaguguuaaguggagugccugagguaggauggggcucaaggcugagaauaguguggcuggagcacugaacugggggaguauuaggagagcaggauggagaguuaaggagugguccacucaugaaaggcuuauaggucuaaggacucugacuaagaugagggagccaugggaggguuuuaagcagagaagugacacguuguaaugggaucccucuggcagccguuuuggguacagacuacaaaaggcaaggucggaagcagggaggccacugaggaugccaagugacacaggggaaggagucuggacacugucaaguaaugcccaggauucuccucuugugugggcuuggcuggaaaccaugcagggauugauuaaugaugucugccacaaaacaggaaggaggccugaugguucccuugagaaguucuaauacauagacuacccuggguagcaaccacacccaucuugcuccucccuauagggccugccaguaauaguaagcaugguaguauuaguaauauguuagugauaguauuaguaauagugucaguaaccaacaugauauuaguaacagcaauaguaaugguaacagcaauagucauaguaaaaacgguaguagcuaacauuuauugagcaaauacuaucuacugguccuaagcacuuggcguuuaauuucauucaauccuuacaguauccuugucuuaugagagccuuuuuuuuuuucuuagauagagucuugcuguguugcucaggcucaggcuggagugcaggggcacgaucauggcucacugcagccucaaacuccugagcucaagugauucccccaucucagccucccaaauagcugggacuacaggccaccacgcccggcuaauuuuuuuuuuuuuuuuuuuuuuuuagagauggggucucacuauguugccuaggcugaucucaaacucuuagccucaagugaucccccuaccucagccuccuaaagugcugggauuacaggcaugagccauugcaucccacccauuggugcuuauuuauuuauuuauuuauuuauuuaguagagauggggucuugcuauguugcccaggcuggucuugaacuccuuaucccucagccucccaaagugcugggauuacaggagugagccaccgcguccaggccuaggaaccauuauccacccuauucuacacaugagaacacugaggccuagagagguuaagaaacucgcccccaguggccguccacaguggucauuucugccuccagaauccugcccaggccccagggagcacgcgaugaugcccucauuccucgcccccgugcagguacaccuccaggucccgcugcuacucagagacgcccucguccuuccugcgguggcugagccagcagacacgcugguccaagucguacuuccgugaguggcuguacaacgcgcucugguggcaccggcaccaugcguggaugaccuacgaggcgguggucuccggccuguuccccuucuucguggcggccacugugcugcgucuguucuacgcgggccgcccuugggcgcugcugugggugcugcugugcgugcagggcguggcacuggccaaggcggccuucgcggccuggcugcggggcugccugcgcauggugcuucugucgcucuacgcgccccucuacauguguggccuccugccugccaaguuccuggcgcuagucaccaugaaccagaguggcuggggcaccucgggccggcggaagcuggccgcuaacuacgucccucugcugccccuggcgcucugggcgcugcugcugcuugggggccugguccgcagcguagcacacgaggccagggccgacuggagcggcccuucccgcgcagccgaggccuaccacuuggccgcgggggccggcgccuacgugggcuacuggguggccauguugacgcuguacugggugggcgugcggaggcuuugccggcggcggaccgggggcuaccgcguccaggugugaguccagccacgcggaugccgccucaagggucuucaggggaggccagaggagagcugcugggccccgagccacgaacuugcugggugguucucugggccucaguuucccuccucugcaaaacgagggggucagcccaagauucuucagucuggacuauauugggacugggacuucugggucuccagggaggguauuuauuggucagggugugggaucugaggaguggagggaaaggguccugcuuucuccucguucuuauuuaaucuccauuucuacugugugaucaggauguaauaaagaauuuuauuuauuuuc

SEQ ID NO: 192670 - RNA, 28179 nt, Homo sapiens
uuguuuuaagcccacuacguuuuguuguaauuggucaugcaccauuagauaacaaauacaauuacccauaaaucugcuggcuuucaggagaacacgucuugaagcacagcugaacuugaaucuuuucuguggaaaaauaauugaaaauaugaauuaauaauucuucucuuguugaagcugacagaaccaaggacacacaccuuguuaacgacgcccucaaggcugugaggagaaagacaaccgggugaagcaacgcugggaauucaacgcaucaauuaccuucccagguaacagcagcuacuugagcuccuaagaguugaccuucagcugcugucauggaaaauagugggggucaacuagacaucaaagaugaaaggccaggccuccagcacaacuuucucuguaagcucgauaguggcuuucucaaagaaauccuuuucucaaaaaaauuucuuguaaagacagggucuuguucugucacccaggcuggacugcagugcauggcucacugcagccucaaccucccgggcuagagugauccuccccuuuucugaggagcucagaccacaagcgugcaccacugugcccagcugauuuauaaacuuuuuuuuuagagacaggguuucaccauguuggccaggcuguuuucuuucaagguuucaccauguuggccaggcuguuuucuuuucuucucuuuuuuugagauggaguuucacucuuguugcccaggcuggagggcaguggcgcgaucuuggcucacugcaaccuccgccucccagguucaagugauucuccugccucccaagcagcugggauuacagcguagcugggauuacaggcaugcgucaccauguccagcuaauuuuguauuuuuaguagagacgggguuucuccauguugaucaggauggucucgaacuccugaccucaggugauccgccugccucagccucccaaagugcugggauuacaggcgugagccacugugccuggccaacuuggauuuguuacuguuauacaggacauggcccuuaauauucacaugaaugacagugagacacacaaugcuuucuaaagauugguuuuggccgggugugguggugcacaccuguaaucccaguuacucgggaggcugaggcaggagaaucacuugaacccaggaggcagagguugcagugagccaagauggcuccauugcacuccagccugggcaacaagagcaaaacucugacucaagaaaaaaaaaagguugggcacagugacucacgccuguaauccuagcacuuugggaggccaagacaggcggaucacgaggucagaagaucaagaccauccuggcuaacauggugaaaccccgucucuacuaaaaauacaaaaaauuagcugggcuugguggcaggcaccuguagucccagcuacucgggaggcugaggcaggagaauggugugaacccgggaggcggagcuugcagugagccgagaucgcgccagugcacuccagccugggcaacagagcaagacucagucucaaaaaaaaaaaaaaaaaaaaaaacaaagacugguuucacauucuguuuauaugaauaauuugugugugcacaaaagcagucugcucagugggugccuggccuggggcaucaguucugagcuggaagagaugaggaugcccacagcccugccucugccccacagccugccuguaccuggguccuccugcugggccgugguggggagccgcucccguugccucaaggccuccaggccugccaggucaggcugauggcaguggcugcgcaugaccaugaugcgguggcccuggguuauggcgcggcugcggcagcccagccgagccuggucccggcacauccaguacaccuucuccccagccgccuucuccuuccuguagaggaaggacucgugcaccaggaaccugccccccagggaaguccucaggaacuccaggggccggagaggaucugaaagggaaagugacacugugaguggggccacaggggccuggguggcagggcugggggucugauuuguaucccccagccaggccccaccaggaaucugcgauccccuagcacgcugcacgguggucccugcccuccuccccucugggcccugcagcccagacucccacgcuggcuggcccuuuccaagggcucuggggaugacugggcacguggccuggcaagcacuggacccugaaugcuccugaaggacucucccaaccccucagaccucaugcuugcaggugcaucccccagggcaggggcugagccuuucugggcugggcaccagggccuccuggcucccuguccaccuaccccucagccagcuggcagcugacuuuuaacaagcugaacuaaaaggucacaugauguugggguggccagagagaaccccgugagacuagaagcaguguggguggcguggggguagaccaagaguguccaggauccaccguacggcccgucagcagaugccaagcacucucuguggcugccaaugccaccccuggccaccauccucuuccucuagagagcugaguggguuucuaccuccgacagccaguccccacuacccagaggaccagcugcaggagcucggagcccgcagauggagccuccugccccuggggaguuuauggccccggcugucagaccaccaugcacaacacacaacaccccacgggcagccuccagccagcguguggggcacagguccugggagaccaggcagacccagcccagcacccuccacacgcaccugggcugucccacugcgccagguuggggaagugcucccgcugccgcagggccuccaggccgcccagguccgguggguggcagugccugcgcaugaccaugacccgccggcccugggugauggcgcggcugcggcagcccaugcgggccuggucccggcagguccaauacaccuucuccccggccgccuucucccgccgguagaggaaggacucguacaccaggaagcugccccccaggggcgucuucaggaacucggggccuccuguugagaaaugggaggggaggagcagcggacaccagcucucagagcccagaucagcauggccccgagaugagaccucccacaacgcccacaccuccuccucacagugagguggccccggagcccaggacacagaugccaccauccccccaacucugcuggggcuccagcugcugggguccgccuccugaggcuggggacuggucaggugaggccccugcagguggcggccaagcgucccaccuugccaugccuucagggaggcagugucugcugcgucacucguccguccccagcacccgcccaggcuugcaugcagggugcgccgugccugguuggucagaggaaugacccggggcccucuggggacaaagcugcucaggagccggauggggcugagagggguggcccccgagagccgcgcagguagaggugugaccccaggacucugaggaagaggcagggagcagcguccacuguccuggauguggugagagggaggaccuggcggguggcugugccuugcccagaggauacccuuuccuccgugcaggcucaggggccacagagguggggagguggccuggggcaucguggacacaucggguggcaguggaagcaggggauggggguggguagcaagcccuagaggagaggccagcggggggcgggagggugucuggcuguggaacuaccuucaagagggauggagagggcugggcaggggccauguggagcagggaggcucgggaggcaggaggacccugaggggcacagcagcacaggagccuggggaccacgagacagaagaggucaggacgaagguggggacgccaggccacgggaggggguggugugaccauggggcacgcuuuauccccuuccacacggaugaaaauauccagcaaggggcugcgcacgguggcucacgccuguaaucccagcacuuugggaggccgaggcaggcggaucacgaggucaggaguucaagaccagccuggccaacauggugaaaccccaucucuacuaaaaaaauacaaaaaauuagcugggcgugguggugugcaccuguaaucccagcuacucagaaggcugagacaggaaaaucacuugaaccugggagacagagguugcagugagccaagaccacgccacuacacuccagccugggcgacaagagugaaacugucucaaaaaaaaaaaaaagacgcccucaucugggaggaucaacaucugauuaacaggagcaacagaaagggaugaugauggggaaguuaacaaagagcacgagaggaugaccccacgaugaaggacacaagcccaaagccuaaaaaggcccccagcacagccagguacagcugggagggagcaaagacccuaaaaccucaagcaaagcugacggcacacagaggaucagucacgcaaaagcggcagggacguucaagggcaggcucugcaccugugacaccacggaggccaggcugccccuccggcggagggaagcgacagacauuucagacaugaaaggccucaacgugcuaccucccgggaccggcccaggaaacgacgggaggcaggacuucuccaaaccacaaaauuauaaagaaaaccaagaaagagaaaggcaggcccagaagcagggagucagcacagugaaccccgagggacagcugggcccggccucugcccccaggccaggcugcacugggagguuccagcaaccugcgguuguggaugaucggauccagguggggucgaccuggacacacaaaagcaggcaaacaaacgcagcagcugccaccccacagagaagacagagcuguguuaggaagaugggaccacagagcaccccccagucagccgcgagcagguuucuaggcuaaagugaaaccaaacguggccggguaugguggcucacgccuguaaucccagcacuuugggaggccgaggcaggcagaucaccugagguugggaguuugagaccagccuggccaacaugguaaaacucugucucugcuaaauauacaaaaauagcugggcgagguggcaggcgccuguaaucccagcuacucaggaggcugaggcaggagaauugcuugaacccgggaggcggagguugcagugagccaagaucacgccacugcacaccagccugggugauaaagcaagacuccgucucaaagaaaaaaaaaaaaaaaaaagccugugcaagaagugcacugaguagcugacaaggaaauggaaaaaccaauuaauaguaguggaggcacauuuuaggaaauagggcagccaagacccuaagaaacaauugcuuaguuacuuguggggucaggagcgggggugaggacgaggcggggaccucgcagcacugucucucuggagauggaacaaaaagagaaagacaaucacagcucucaaguccgagagaacuuuagggccaugaggcaacucacaugacccaaaagcugcaggauccggaagagccacuggaaagagaggccagcgccuuggggcgugaaggaagagcaggugaguggaggaggccacgaugaaauggcuccucagccagacgcuauggggacauuuacgcaacugugguugugaagucaaaacaccaggcacugcggggggccgaccguguggauaaagauggagacagccgggacccuccucgggccagcguuucaggacauuaugggugucuauggaacagcgggccgagaggagaaaccggcugcauguaaguaaauaucaccuccucaauccuuaaccacucagacguuaagacagccuuccaccauagcaacgagacugaccaugugcagucaacacccucuauuacuacuaugaacucuuaagacaaacggaggaagaggagggcagggaggucuaucccugcugcugcuacuguggggcaggucaggcuggaagggggaggcugggcugagcaggaaggugagacccauugaaagcggcaucaggggggccaaggaguaggaggccagggccauaguuccuucuaggauguucaaagaagggaagaggacguuugccagggggagccgcagcauggagagggaaaggcaguguggggcuccugccugcuuccuggggcccagcucccagcccacccccagguaccugggcucccccgcugcgccguguuggggcguuucucccgcugccucagggccuccaggccucccaggucgggcggguggcagugaccacgcaugacagucacccgucggcccugggugauggcgcggcugcggcagcccaugcgggccuggucccggcagguccaauacaccuucuccccagccgccuucucccgccgguagaggaaggacucguacaccaggaagcugccccccaggggcgucuucaggaacucagggccuccuggggagguucaagaggcagucaggggaggggacaggggcuggguaggccugaucgcacccccuucccucccuggaccucuggaggcaagagucaaggcagggccggugagccccaaaggaaggcagcucacccgggucugcguccauguccuggugcucgucuggggccucgggcuggguuggcagcuccuggucuucgaccuuugcucgcuuucugggccgaggccuggugagagucaggggacccggaccccugcgguagagcaaacuauccacgccucggagcagcguguccacuuggcucccagggccguccugcccagccugcagcgucuccacggccuucuccugcugccgccgggcuuccaggcccuccauaucgggcugguggcagugcccacgcaucacagucacccgcugucccugggugauggcccggcuccggcagccgugcagcgcguggucccggcagguccaauacaccuuguccccgacagccuucucccgcuuguagaggaacgacucguguaccaggaagcugcccccguagcacguccucaggaacucgaggggccgggccuguccuagaggagagacccaaguggucacaucaccagggguggagaggagcccaggagggacagccccugcagacugugggggcugacacgagccuuucuccuuuaaggcugaaauuuacccuggcuuccugagccagauaugucagaggccccaaacccauucccacugaaccccuaccaccaagcgacccggaggagagucucauuccucuccuagcggucagugaggccaccccagcucaccccuaccaccgagugacccagaggagagucucauuccucuccuagcugucagugaggucaccccagcucaggccugcucaauguugcaucaagguuacaccgggaggggccaaccuggacucagacucaguggucucuguuuucugucacuccugcucauauuuuuuuuagguuuuguuuaacaaaucuacccauuuuugaauaaaacacacaagguauaauacauucaaaugguucgaaaagaucacagugaaaaauaagucucccuguucccugcaccucccuucccaccccaggugcccagggcaggggccaccucagauccuuaaggcugugucaggagccacguggccuccucgaacccaagcccaugucccaguuacugguaauaaaacagccagaacucccaucugccacuugccaagccccaaaugugcaauuuacacaacaauccagguuaucacagccaccuuaggauaaagcuccugaaacuccagaaauuaagccaauuuucugaggcuacagagcuaccaucagggagggcugaaaguugaaccuaggacccaaaacccaagacucucccaccagccaucuuuuuuuuuuuuuuuuuuuuuuuuuugagacaggguccugccacgucgcccaggcuggaguacaauggcucgaucuuggcucacugcaaccuccgccuccaagcaauucugccuuagccucccgaguaacugggauugcaggcgccuccacgcccagcuaauuuuuuuuuuuuuuuuuugagacagagucuugcucuuuugcccaggcuggagugcgguggcacgaucuuggcccacggcaagcuccgccucccggguucacgccauucuccugccucagccucccgaguagcugggacuacaggcgcccgcuaccacgccuggcuaaucuuuuuuuguauuuuuuuaguagagacaggguuucacuguguuagccaggauggucucaaucuccugaccucgugauccgcccaccucgaccucccaaagugcugggauuacaggcgugagccaaagcgcccagccucgccaggcuaguuuuuuguaucuuuaguagagacaggguuucacuauguuggccaggcuggucuugaacuccugaccucaugauccgcccaccucagccuccgaaagugcugagauuacaggcaugaaucacugcagcaggccuaggugucuuuccugaacuuaauggacacuagaauugcaugggaaccagauaaaauucugauuuuuuuuuuugagacaggguccaggucucuuguccaggcuggagggcaguggcgugaucccggcucacugcagccucaaucucccuagcuuaagugauccucccaccucagucucccaaguggcugagaccacaggcacacaccacaacagcuggcugauuuuuuguagauauggggucucacuauauuggccaggcuggucuugaacuccucggcucaagugauccuccugccccagccucccaaagugcuaggauuauaggcaugaacacugugcccagcccacauuuauguauuuuuuuuuuuuuuuuuuuuuuuuuacugagauggagucucgcuccagucaccaggcuggaauacaguggagcgaucugggcuuacugcaaccucugccuccuggguucaagcgauucuccugccucagucuccugaguagcugggauuacaggugcgcaccagcaugcccggcuaaguguuguauuuuuaguagagacaggguuucaccaaguugaucaggcugaucucgaacuccugaccucaugauccguccgccuuggccucccaaagugcugggauuauaggcgugagccacugugcccggccacauuuauauuuuuaaaagucauuuuagcuuugaguacauuuuaaaagacccugugggaccccacauuucuauuugggcugaggaagggcccucggguccccugccccgaguggacgcagcaggggaguggauuguacucacccagccccaggaucgagcgcuucuugggcggcaggcucagcagugacagggcucggggugccuccuccuccuccagggccggcuugcucagcaccagcccaggagugggcucgggcuccucagggcacugccacgggcccacccccuccaggggcuccuccacucggccuccagggcccucaggacccuggggcucucccaagcccucuggcagggccaggcugggcaguuucucccucuggcgccgggccuccaggccuugcucaucgggcgcguggcaguggccccgcaucacuguggcccgcaggccucgggugauggcccggccccggcagcccagcucagcauguuggcggcacuuccaguacaccuugucccccacugccuucuccugcuuguacaggaaggacuccagcaccaggaggcggcccccgaaugguguccucaggaacuccagggacugaggggcugcugggggaacgggaaggcuagguuagcuaagcuagagcaaagcucagggucgcaggcacagagagccagggagggcguggggauccugaguauggcaggugccuucuccuccugcucccaagcaagaagcccagacucucagggcugguuuuuauuuugggggugguaguggauguuuuuagggagcugaaggaauucugcacgucacugcaacucccaggagcuccugguaccugacugugaucaucccaccagccucggacacgcucaggaucagagaccaagaggcugagcuuggagcaaggacaagacacuaugcuugaagcaggguguacagggccugcugggagcgcuggaacccacgggguggcugggcaggggcgggaagccacaccucaccugcauccagcuugcugcacuucuguucaggcaucucuagggcuggcuggaccaccccucccugcuccucaacuggcaggaucugcaaggugcuggcgaggguggcggggccagccaucuccagggacaggacgcagugcacuuccuggggcuuggaucccaccccauccucaucuuggucggaggcugugagcagcaccaguuuggagaacucccugggcuuccugggggcugccgggaugacguccgugccuggcuugggggauggcuccuggccggccuucacacucucgcccuccugcucgcugggcucgggcaggggcaucccgggacccagggccugucccucaggccacgcucagcacccagcaaggaaccuggagugcagugguuccguccuaaggaaggaagcaaaaucccgucagugguggaagcccuugggggacucuagacguggaucugggagggagguggggcagauggggcugccucacugcucgcuggggccaagacuggccgggggccugauggaacuaggcuucugcucugccaguuccucuccuggcagccuuagguacgucagccccauccaaccccacuuuccccaucuggaaaaugugcacaauaaacacccuccacaaggggccaucagagugacuaauggacuaagagcucagccacaugcugagcacggacgaaggguuuccacccgcguuuccaguccccccuccagucccuacauuaugacggcagaacguucuuauugacccaguuauagacgaggauagugaggcacagacaccugugauacacuugaggcugaagaggcgggaagcugagacccguuucugcucagaugcccagggacuugucaggaccuuuuuggaaaccaugugcuucaccaggacgccaggcaccugucucaggcaugugggccugguacgcagagcccuuuccagaggacggcaccacaucacggccugggaggcagaaagcccuuucugggcucaggcagacccagucccuauccuagccuggaggccccaggccacccccacuucaggagauaccagggccccacaguggcagccaccuugugccggagcuguugcuguggcugccucggcuggucggggacggggcugugguggugucuggagaauucugaggucaccacggguuccagccuggagaggcagaaaggucagauaauggggaaccagcacagggcuggggugggggccugggggcagucaguggcagucauggugugggguggggcuuuuuguguggggaaaagagagagagaucauauuguuacugugucuauguaggaaaggaagacauaagaaacuccauuuugaucuguacgaagaaaaauugcucugcuuugugaugcuguuaaucuguaacuuuaaccccaacccugugcucacagaaacaugugcuguacugaaucaagguuuaauggauuuaaggcugugcaggaugugccuuguuaacaauauguuugcagacaguaugccugguaaaagucacugccauucuccauuaaccagggacacaaugcacuguggaaagccacagggagcuccgcccaagaaagccuagguauuguccaagguuuccccccacugagacagccugagauauggccucaugggaaaggaaagaccuuaccaucccccagccugacaccugugaagggucugugcugaggaggaggagugaaagagggaaaccucuuugcuguugagguaagaggaagcuuucuguccccugcucgucccugggaauggcaugucucaguguaaagccgaccauucguucuauucugagauaggagaaaaccacccuguggcuggaggcaagauacgcuggcagcaauacugcucuguuacucuuugcuacacugagauguuugugugaagugaaacacaaaucuggccuacaugcacauccagacacaguaccuuuccuugaacuucuucaugauacagauuccuuugcucacauguuucccugcugaccuucuccccaccaucacccuguugcccugccacacuccccuugccaagauaguaaaaauagucaucaauaaauacugagggaacucagagaccagcgccagugcggguccucgcacauagagugcccaucuccugggcccacuguuuucuauauacuuugucucugugucuuauuucuuuuaucagucucaucuccaccugacgagaaauauccauagguguggagcggcaggccuccuucaccuggcgcccaguguggggcgugaacccacgacccugagauuaagagucucaugaucuacugacugagccagccggggaauucuuuuuuagacgaccaauuuggccacaauuauaacauuuccccccaaauguucuaacuuguccuccuaaagcaaccccagucauugcuugagccauuaggauagcuuuaugcauggcuccuccaaucccauuacaagccuucacauauucuguaacuacaucaacuccugcuggagcaauggaaucuaauaauguucucauagaaggugaguuggguccauauuguuuaacuccuuccuucaugucuuuuaacauuuucauggugaagcguucauaucuagcauuagccaccgcaggugcuccugcuggagccccuuccccggccgguaccgauuguaaaauuaccaggaacugccacgccucaagaucucccuguuuucuagcuucaucaaugaucgcgugcagugugcuaccuuguccacuagguggugcuguuggauuaagucucauagugggcggcugaggacacagcgccgcgcccuguggugcugacguauuaaacaccaccgccauggguugcuuguacgaugccgugcaauuuggcauggcacacaccacuugaggucuguauuggaccucuggaggcagccaauacugaagcucggcuggcagccaguauugauaagcuaauggcgguuggguuuuauuuucuacuggcugauauuguggauacuguaucuggauuggcauugccgagauagagacuauccuuuucuauuugauauucucuugggguuuguacuugucuaaccugcauuugagguuguaauguuacagguaucugaaccacgggaggaggaguuggccauugugguuuagacucugauggccccacuuuuccccccaauuuugaugauucaggauauguuaccuccuguaauugauuguagucaacauggcuuuauggccaauugacauuccggauuugcauuuucauaggccauuaauucuacaauaaccuuuuggguguuaucaucuguaauagauuuuggagcggcaccgugcaaucuugccacaaagucaggguagggcucuuuagagccuugucuaauugaauuaaaagacgggcaggugguuccuggguccaugaauuuuuuucccaggcccugaggcaaauaacccuuacuuguuuaagucaacauuuugcauugaccgagcgauuacagacucugcuacauacuuacaaugugaacuuuccauuccuuucuggaauucugucccuuugucuucuucacaaucuauuacauagcuuucaggggcaucagaaacugaaacgcuaucuucuccuguuugaaacgguucuaaagcugcuuuaauaauggcccaaucauuccauacuguaagugggaugauuuuaccuucccuauuugcuuguuuuaauucuuugccaauuuuuucccaauccuuuagaucuaaaguuccuuguucuggaaaccaugggcagaauuguucuauuguuugaaauagcauaguuagauuuucuguacaggcucuaacuuaaucccguggucaccacggguuccagccuggagaggcagaaagggcaaauaauggggaauggggcagggaccugggggcagucaguggcagucauggugugggguggggcuuuuuuggggcaacugagugugggcagaugguggggucuuucccaccucucagccuggaaucgagacugcagucccugacauuuucagcguccucacccccaccucacaugcugcagcuccaguucccacuggucucccacuuugauccaaaguucccuggccuggggccccacauuccacucccgaaggccuggucggcuccggagacaacgcagaggggagcggcuccuuaacuccauuaaggcccgguccccaggaaaucacagguaccaggagggccagucccaccacaccucccccagccccggcccagccuguuccuccaugccguccuucugggccuacucaugccgccccacagggugacacgaggugcaggggcaaccccagcugacuucgcaggcgccucucgagcagagcggcuccaggcaggaaaagguuagggcggaaagccccguaccccccuccccccgcaacucccccuaccccgcgcgcgcugauuggccugggcacaaguccuucuaccggcagcccgccccucccgcucccucgcucugagcuccagggaugaauggggaugagugggacugagugggacugaauggcacugggugggaccgggugggaccgggugaggcuaaaccaggaaggaugaggaugagggcaggacgaggcaggacagcaugaaccgggauguaugggaauggauggacgauggacguggcaguuccuugacccugcacccucccgggguccccccagcccaggucccgcgaggcccccgcccucuggagaaaguccccuuuguuccuggggaggcaccucccugagaacugccgugauucccggccucccucccagccagggcgaggcauggggacgccagguugcuccugacagaggccucccagacuaugcaggcuggcacagugacucgcacacuguucaccccgccagcugguccugcaggacacagcugcgccaugggagugcaggcgggcaggggccugucccaggccgucagagugaagguggggacugcgucaagcuuggccugacaaggaaagccccacauucccauggagcuguacccgagucacaggaagugacaggagagagcgcaguccucuggcgaccacuucccacuucuguuuaaagggcuuccaagacacaugugcuucaacagaucuggaaaaaguuccaauacaagaaaaggcccugaccgccggcuuguggaaggcugaggacccguucccacucuugcccguucaggcucuuggaugguagaugcugacccaccgccacuccgcccguuaaaguccacaggccccucagcaaccgggcuuugucuccaccugccugaaccuugacuagccuggggggguugcgugacccacagcguggcaggagcguaggguacacauucccacgccucacgggccagggcccugagucugcagggaaggcagcuguaggagaggccaugugcagagcacugccacauucagggaaaccaccuuguacccugcagcccagcagucucuuagaugccugcagacaugaaggagccugggaaccccacagaacccuguucacuggggaacuccuauuauuucaagccaguaagaucaugggucguaugcuacacaauagcugauaugcuuggcaaguaagugacucuaguggguucuggcuuuuuacuuuuuuuuuuuuuuugagauggagucucgcucugucacccaggcuagagugcagugcucggaucucggcucacugcaaagcuccgccucccggguucacgccauucuccugccucagccucccgaggagcugggacuacaggcgcccgccaccacgcccggcuaauuuuuuguauuuuuaguagagacgggguuucaccguguuagccaggauggucuugaucuccugaccucgugauccgccugccucggccucccaaaguacugggauuaccggcgugagucaccgugccggccagcuuuuuaccuuuuugagacagggucucucuguugcccaggcuaagugcaguggcacgaucucagcucaaugcaaccuccaccuccugaguuucaagcuauucugccucagacucccaaguagcugcgauuacaggugcccgccaacaugccuggcuaauuuuuguauuuuuugguagagaugggguuucaccauguuggucaggcuggucucgaacucgugaccucaagugauccacccgccucagccuuccaaagugcggggauuacaggugugagccacuacgccgggccgauucuggcuuuuuaauagauggaauaaugcaaacgguuaugaaauaucugacauaaaacuaugugugagcuccagauugccauaugcugugcaacacaaacaccacaucccccagaugggugcauauaaauggcuuguaacgagggaaacaaaaauaugaaguauaagggacagcaaaggagaaguaugcauuuuaaaacaucugcacugcccgggcgcuguggcucacgccugccaucccagcacuuugggaggcugaggcgggcggaucaccugaggucaggaguucgagaccagccuggccaacauaggcaagcccgucucuacuaaaaauacaaaaauuagccgggcgugguggcggacgccuguaaucccaacuacucgagaggcugaggcaggagaaucgcuugaaccagaaggcagagguugcagugagcagagaucgcaccacugcacuccagccugggcgacagagcgagacuccauuucaaaaauaaaaauaaacaaaaacagccucuucacaagauggcgcugaaagcgaagaagggagcuccugccccuuguaaagcugaagccaaagcaaaggcuuuaaaggccaaggcggcagcguugaaaggcguccacagccacacaaaaaaagaaccucacaacagccacacacacaaaacaaacuauaaaaaaaauagauccgcacaacagccacacacacacaaaaaaagauccacacaacagcccccccaaaaaaagauccgcgcgucacccgccuucuggcagcccaagacacugcgacuccggaggcagcccaaauauccucggaagagcgcccccaggagaaacgagcuugaccacuaugcgaucaucaauuuuccaccgaccacugagucugccaugaagaagacagaagacaacacacuugucuucacuguggauguuaaagccaacaagcaccagcucaaacaggcugugaagaacucugugaggugguuguggcccaggucaauacccugauugggccugauggagagaagaaggcacauguuccacuggcuccugaucaggaugcuuuggguguggccaacaaaauggagaucauguaaaccgaguccggcuggcuaauucuaaauauauguauaucuuuucaccauaaaaaaaucugcaacauacgacaugccaggcacaaggggacaaacacugucugauuccacuuguaugagguccccagggcagucaaacuuauggggacagaaaguagaaugggggugccaggggcaggaggaugaggagggaguguuucaugggcacagagcagccguuggggaagaugaaaagguucuggagauggacgguggugacggaugaacaaugaaugugaaccgcugaccuggacacuucaacaucgaggcucagggagagcagcugcucacaaagaccaaggguuguaggaugcaauuuacaugaaugaccaauaugguaaauuuuacgucauguauauuuaacccuacacacacacacacacacacacacgagccaucuguaacaaacuauacacaaaacaccccauuucccuaacauuaucagugaauaagcuucucccuacaagguagauuuucuaguaacuaaaguuaucccgccaugauucagaauaugauuuuuaucugauucaaaauguacccauuuaagauggauucuuuuuuuuaacucugucacccaguugcccaggcaggagugcaguggcacgaucucaguucauugcaaccucugccucccggguucaagugauucucccgccucagccuccugaguagcugggacuacaggcgcgcgccaccacaccuagcaaauuuuuguauuuuuuaguagagaugggguuucaccauauuggccaggauggucucgaacuuccgaccucaugaucugccugucuuggccucccaaagugcugggauuacaggugugagccaccacacccggccagaaugaauaccuuuuauuuuuuauuuuaguggcaggauuucacuacagccuaaaccggagugugguggcgugaucacuacagccucugccucccaggcucaagccaucuucccaccucagccuccagaguagcugggaccacaggcgcacacuaccaugcccggcuaauuucuguauucuuuguagagacgggguuuugccagguugcccagccugguuuuuuaauuaaauuaaaaaaaaauauuuugguaaugacagggucuugcuauauuuccagguugguuuugaacuccugggaucaagcgauccucccaccucagccucccaagcaccggauggaugccucuauaagcucuucucacccgcuucccuguccagagaaagggagcaaccauccucccucuggcuuuagaagcaaaaaaaaaaaaaguccuaaaauugaugguggugauacuuggacagcuuucugaauauauuaaaagcaaugaauuguagacuuaaaaaguccuaaaauugaugguggugauacuuggacagcuuucugaauauauuaaaagcaaugaauuguagacuuuagauggagaaaucauaugguauuauguaaauuauaucucaggaaaguuauugaaaaacaaucccugucugggaaugguggcucacgccuguaaucccagcacuuugggaggccgaggcgggcagaucacggggucagcagaucgagaccauccgggcuaacacagugaaaccccgucucuacuaaaaacacaaaaaauuaacugggcgugguggcgggcgccuguagucccagcuacucggaaggcugaggcagaagaaucgcuugaacccgggaggcagagguugcagugagcugagaucgcgccacugcacuccagccugggcgacagagugagacugucucaaaaaaaaaaaaaaaaaaaaaggccaggcguuguggcucacgccuguaauccuagcacuucgggaggccaaggugggcagaucaccugagguggggaguuugagaccagcccgaccaacauggagaaaccccgucuccacuaaaaauacaaaaauagccaggcaugguggcauaugccugcaaucccagcuacucgggaggcugaggcaggagcucacgcuauugcacuccagccugggcaacaagagcaaaacuccaucucaaaaaaacaaaaacaaacaaacaaacaauggucagaaugacucagauuccaagggucucuugguggaaaaguguuuuuuuuuuuuuuuaagacagagucucacggccacccaggcuggagugcaauggcguaaucuuagcucacugcaaccuccgccuccugggucaagcgauucucaggccucagccuccugaguagcugggauuauaggcaccugaaaccacacauggcuaaauuuuguuuuguauuuuuaguagagauggaguuucaccauuuuggccaggcuggucucgaacuccuggccucuaguuaccuaccugccuccuaaagugcugggauuacaggugcucuacuaaacaucagaagcuucuuguucuuggguuugguuuacucaucaaagaagggguggcaugcauuauauguugugaaauuuucuaaguucuaauaucauauucuaaaaauauauagaaacuauuucagaauguuaagacuauaauacuaaaaugaccccuaauccugccacucaaaugcacaacuacuuccauuguugaacuaaugccuuuaaggcgcuugcuuuucuguagcacacacugcguucaaucaugucugcuacuguaucccccucgagagcaggaagcccccaccagaggccaccuggagucuuuccaaaggaccauuacauaaggcaggaccacccgucacgggggaagcgcaaauuuaaauccucagcagcaauacuccauauggccacaagauggugguguugcuccugaaauguuccuauugccuugguaaaauuacacggguggcaauguuuucaaacaagaauuuggaaauuuuuccaaguuggaaaaaaaauucaagaggauuuccaaaauguuauauuuacaaaaaguaguacuucgagcugggcaugguggugcguauguguagucccagccacuugggagguuguggcaggaaaauggcuugagcccaggaguuugaagccaaucugggcaacaucacaugaccccaucucaagaaacaaaaaauaggccagacgcgguggcucacgccuguaaucccagcacuucggcaggccaaggcaggcggaucacgaggucaagagaucgaaaccauccuggcaaacauggugaaaccccgucucuacuaaaaauacaaaaauuagcugggugugguggcgcaugccuguaaucccaacuacucgggaggcugaggcaggagaaucgcuugaacccagggggcagagguugcagugagccgagaccauaccacuguacuccagccugggagacaaagcaagacuccgucucaaaaaaaaaaaaagaaacaaaaaauuaaaacaaaugaauaaauauacacgcauauaucagagagcagcugggugugguggcucacgccuguaaucccagcacuuugggaggcugagguggguggaucacaacgucaggagaucgagaccaccuuggauaacaucuacuaaaacacaaaagauuaaucaggagugguggugagcaccuguaaucccagcuacuugggagguggaggcagaagaauugcuuuggagguugcagugagccgagaucaugccacugcacuccagccugggcaaaagagggagacucugccucaaaaaagaaaaaaaaagaaagcaaaauccaauuaacaaauucaguaaagacuaucuuucuaaacaaguuuuuguuuccaaaaaagaccaaaauauuacuuggacaagacacuacguucuagcccucaauccacuggucuuuccuacuauuuccuuucuauucuggucauauuuguuauucauuggcgaauuuuauuuuacauguuuauaacuuaaaaacauuuaaggccaggcacggugguucacgccucuaaucccagcacuuugggaggccgaggcaggcggaucaccugaggucgggaguuugagaccagccugacuaaaauggagaaaccccgucucuacugaaaauacaaaaauuagauggucauguuggugcaugccuguaaucccagcuauucaggaggcugaggcagaagagucacucgaaaccgggagguggagguugcagugagccaagauccugccauugcacuccagccugggcaacaagagcaaaacucccucucaaaaaaaaaaaagccuggcgcgguggcucacgccuguaaucccagcacuuuagaaggccaaggcaggcggaucacgaggucaggagaucgagaccauccuggcuaacacggugaaaccccgucucuacuaaaaauacaaaaaauuagcugggcgcgguggcggccgccuguagucccagcuacucgggaggcugaggcaggagaauggugugagccugggaggcggagcuugcagugagccgagauugccccacugcacuccagccugggcgacagagcgacacugucucaaaaaaaaaaaaaaaaaaaaggaauccaaggccaggcacaguggcacauaccucuaauuccagcacuuugggaggccgagguggguggaucacuugaggucaggaguucaagacaagcccggccaacauggcaaaaccccaucucuuccaaaaaauacaaaaauuaccugggcaugguggcgggcgccuguaaucccagcuacucaggaggcugaggcagggagaauugcuugaacccaggaaguggagguugcacagugagccaagaucgugccacuguacuccagccugggcaacagugagacuccaucucgagggggaagaaaagacuccagauuuugggggguggggagaggaucgggggaggggaagagggaggccaaaggaagagggaggaacaagaaucuagauuuuucacaaauccuccugauacugauagacugugaacuagacuuugacaaacacuagaauagaugaccuugggaaacagaagacugcagcuaagcgacgaaccuaagcaacaccugagguuugcuuugugcugggcacuaaaauaccugaaguauuuuaucuacaucaucucauuuacucuuuaaugucauacagguuuccucauuaaugucacagaaaaucauuaacggccgggcaugguggcucacaccuguaaucccagcacuuugggaggcugagaugggcggaucaccugaggucaggaguucgaaaccagccugaccaacauggcaaaaccccgucucuacuaaaaauacaaaauuagcugggcgucguggugggcgccuguaaucccagcuacucgggaggcugaggcaggagaaucgcuuguacccgggagguggaaguugcagugagcagagaucccaccauugcacuccagccugggugacaagagcaaaacuccaucucaaaaaaaaaaaaaaaauuauuaacaagcuuacuuuguauuauugggaaagucauggcuuuuuaaaaauuuuuuuuacuuuuuuuuauuuuugagacagaguuucgcucuuucaccugggcuggagugcaguggcaugaucucggcucacugcaacuucugccuucugguuucaagcgauucuccugccucagccucccaaguagcugggauuacaggugcgcgcuaccacgccuggcuaauuuuuguuauuuuuuuuuuuuuuuuuacuagagaugggguuucaccauguuguccaggcuaaucucgaacuccugaccucaugauccaccccccucggccucccaaagagcugggauuacaggagugagccaccaugccuggccgauuuccucguuuuugaaaguauuagcaauuuaacaaguuucaggaaccuuagggguauuuuggggaaccucaagaagagaggaauuugcccaaauuuuaaguacuacagguaaaaucugauggagaaagcauccuggacuugccuucugugucucaggauaucaaacaacgaauuuuuaaauuucuuuuuucuuuuuuuuauuuuuuguuuuguuuuguuuuuuugagauggagucucgcucugucacccaggcuggagugcaguggugcgaucucggcucucugcaagcucugucuccuggguucacgccauucuccggccucagccuccagaguagcugagacuacaggcaccugccaccaggccuggauaauuuuuuguauuuuguuaguagagacgggguuucaccauguuagccaggauggucucuaucuccugacuucgugauccgccugccucagcuucccaaagugcugggauuacaggcgugagccaccacacccggccuguauuuuuguuuugagauggagucccacucuguugcccaggcuggaguacaguggcaugaucucagcucacugcaacuucugccuccuagguuaauuauccugacucagcuuccugaguagcuaggauuacaggcacgcaccaacacgcccagcuaacuuuuguuuuuaguagagaugagguuucaucauguuggccaggcuggucucgaacuucugaccucaagugaucagcccgucuuugccucccaaaaugcugggauuacaggugugagccacggcaccuggccaaaacaacagacuuuaaaaagucuaaguuuccuuauggagacuuccaggcaggcaaacucagguaggcuuaucuggugaaucaguacuauugcugcacuacauaaucaggccaaauaugaugaaaucagccuuauaaucaaaaauauguuuccuuggccacuguagaagaggccaguuuugccuccauuugcacauucauuucaauauuccugaucuagaaucuuguagauucuucuuuggauucucucuuuuuuuuuuuuuucucucgacacagagucuugcucugucucccaggcuggggagcaguggcuagaucucagcuaacugcaaccuccgauucccaggcucaagccauucuggugccucugccucccgugauccgcccaccuuggccucucaaagugcugggauuacaggcgugaaccacugcgaccagcccauguaauuuuaaaaauugcugacuggaaccuaaugauuuuaggaccaaugacuaagcaguuucaaaaacagugcccuagaccaaaacaaaggaaauacaauucuuuuauacucauauaaagcaaacacauguuaaagauuuuacuuaccguuagccaguaagguggagcucaggaguuugagaccggccuggccaacauggugaaacccugucucuacuaaaaauacaacaauuagcugggcuugguagcacaggccuguaaucccaguuugccgccuggccaacacgguaaaacccugucucuacuaaaaauacaaaaaaauuagucggucguggugcaugccuguaaucccagcugcucaggaggcugaggcagaacucacugaaccuaccggggagauggagguugcagugagccaagaucacaccaaugcacuccagccuaggcaacaaaaugagacugucucaggaaaaaaaaaaaaaauuucagugcauguaauaaaaaugaguauauuuuaauacauuuauauuauuuaauaaauucaauaaauaucucauuuaauaaaaauuagaaacuuuuguuacucuaguuuaagugcuuuuuuuuuuuacaguagauacccauuguuuuacaguagauacaggggcccuaauguguuucuuuuguaauguucaaucuucauucaguacaaauuucuuuuuuuuuuuuuuuuuuugagacagagucucacucugucgcccaggcuggagugcaguggcucgauccugucucacugcaaccuccgcugaauccuugaaccagguucaagcgauucugcuccucaggcuccugaguagcugggauuacaggugugcgccaccacgcccagcuaaauuuuuuguauuuuuaguauagacaggguuucaccauguuagccaggcuggucucaaacuccugaccucuggugaucugcccaccucagccucccaaagugcugggauuacagacgugaaccaccaugccuggcugcacucaguacagauuucuuaagugaauggagcacaggccggcagauuugcauggaaagcuccaaagucucaguucauggugcaucacucuccuguccucucuccccuucucccagaauugagggugcggagcaauuugagugcaaugccagauggccuacugggacgcugcgguccugcuggugaccacaagggcucagcguagaccuaagggucacauguuagcaacugucaggugucucucagacaccaagggguccaaacucuaaucaguaaggcucgaaaaccaggcggcucugucggcagcugauggagccacagaauuaccuucacacgugagugagaagcgucaccaucaucccccacaccugggucacggcgcuggcuugcugggcaggagccccgggggcaaaucccguaacuucucugggcugguuucaccugugaagaaaguaaaguggcaaaugaaauacugcaggugaaauuauuccaugaacugucgaccauuagacaagaacaagguguucagcauccaggugcaguagggguccugagugauaggagcgggaggagggaaggcccucuguuuaaaaagcuucugaaugggccgguggcacgguggcucacaccugucaucucagcaguuugggaggcucaggugagagaauuguuugagcccaggaguucgagaccagccuaggcaacauagugagaccugccccucgcccccaccauuucuacuaaaaaaauuuuuuuuuaaagcuccuggaugacuccagugucuacccaccucccaccuacccgcaacugaaccaugagcguuggaggugcacuugccucagacaugaaccacuauggugacaucacaggcucagugggugcacacagacauuccuccugaagagguugaagguggcagagaugcccagauaauuaaaauuuacucuaaaaaugaacuucacaaucucagcaccguuggcauuuugggccggaugauucugcugugggaggcuguccuguucagcgugggguguucagcagcaaccccggucucuaccugccagaucccacugucaugcccuaccacacguugugaccaccaacacugcagaacguucccuggggugcagaauugcccaagagccacagcuccaaagcaacuuagaaauuagagcgcacagaaagggagagcuuggccaaugagacccccccagcccgguauuccccagucacccuccaucauaauauaaguuuauuuacuccuucccacagccuaaugcauccucaaaucucucucccucuaugccugauauacccaucuucccucuccuucccacucccaccaacucaggacaugaucccuuaccacgaccucuuuagcccaagccaaagccucugaacgaucuugccagcuuuggcaagcagccacuccaauucuccacauagggugcugacaggucacucuuccuaaagcuuaacuuucagcaugucucuccccaauuaaaucaucuccaucuccagccuuagugcaucaucagcugggcgucauaaacacuccgcaaucuagccccaaccucagccuuguuccuuccacacgucccgccaguagcacuugggaaaggaacaagagaaacaugauauaaucacacgagaaaaucuagaucaagcccuggaaaucauauuggcccuuggaaagcagaaauaugcaaauaaaaauaagccauuucguuggaauuggaguuugcacaugauuaucugacuaugggaguucagcuuccaguacaaggaauaaaggaacaacaggcaggguuuagagcgaggguuucaacuacgucagacccguuaugugcaggcuccauggguuagcagcagccuuuuggaacgggguggaagagaauggaacggaauuuaauccgaacagauccagcugcgucaugugagcuuaaacaagcgucucccuuuaaacuugugcuucagucauccagacccacaggcacagaguacacgcguaaaaggcauuucucagugucggcugugggucaacaaaguucgaaagccgucaccggagaucuauagggucagaagcgggagcggggugcgucccgacccgcaaaagugcaaggucacugggaccgcccgagcugcaaccgugggacggggcugaugcugcggguccaggaaggcagcgcugggcggggcagacaccgccaggaaacggcggacgagugcggggauccuugaugugggggugucgggcuuaggccaggggacggggggguggggauggaggggcgaggagcaaggagggaaucgcgggagaccccacaggaggcggccugagcgccgggacgcagaccccuccccagcacccgcaacccucgggacccccgggagagccgggcugcgggcgcguccacgccggggacgcgggacauuccccgcccgcaggggccuguccucaccgacggcagcggggcccucccucucccgcgacagcgccgcggcggauccuucagccucugccgcugcagcagcgagcgucgaccccgcgacccaggccgccgccgccaccccgacccgggcaccagcucccagccccgaccugccccucgggagcgagccccgugaccgcgcgcgc

SEQ ID NO: 192671 - RNA, 6648 nt, Homo sapiens
augggcgcgcgcggggcgcugcugcuggcgcugcugcuggcucgggcuggacucgggaagccgggugagcucggggcgcuacaggcgggaccgggggcagcgaggaggccgggagguggaggccgcgagggucacuucuuguguccugcagagucgcaggaggaggagcuguugucagguagggcgcccaggacgcgcgaugccagccagggcggcugggccggggugcacgggggcccaucuacugcucucuguuccaggucccgagaacgugaugcucucaaguaacuaauggguccuaggggugggaccguccacugcccaccacgugggagggucccuagcgucaccuucuuggcgcgcgguuccccggggagccccccgcugcgcgcaccccggggcaaagccgggcagggcgggccugcccaccccaccccacccggcagcucagccgcguccgucuguccaucccagaggccugcggccaccgggaaauucacgcgcugguggcgggcggaguggaguccgcgcgcgggcgcuggccauggcaggccagccugcgccugaggagacgccaccgauguggagggagccugcucagccgccgcugggugcucucggcugcgcacugcuuccaaaagugagucuggggggcggccggggccucagacuugcuaauggccuccaggaugagcaaacaguagccacccagcagcuuggccucagggacugggccuccagcgugcucaggcggccagcccccuauuccaaggcuccccgcccucucuccuuuucugcuaggcacuacuaucccuccgaguggacgguccagcugggcgagcugacuuccaggccaacuccuuggaaccugcgggccuacagcagucguuacaaagugcaggacaucauugugaacccugacgcacuugggguuuuacgcaaugacauugcccugcugagacuggccucuucugucaccuacaaugcguacauccagcccauuugcaucgagucuuccaccuucaacuucgugcaccggccggacugcugggugaccggcuggggguuaaucagccccaguggcagugaggcuggggauagaccggguggggugaugggggugcggggugagcauuacccucuaccccuguucccgcuacacaagcacagcagcccccuccuuggucuggggcugcaaccugcgccccuccugcucucauucucuccucacuugcuuuucugcucucacugccaccugucagggcagggaccaaacacccaguucuucccccuuccagggacugugggggccagcaggacagugugagagggaggccagcuuggccugggccugaaggagugagggggaguucgggaggaccuggugacagaagccucaggcaaugauuuuuaaaaauugaggcaacucacaaaccauaaaauuuucaaguguucaguguugaaggacacaauucagugauuuguagccuacagucaugugucacuuaaugaccgggauauguucugagauaugcaucaugaggcacuuucaucauugugucaacaucauggaguguaguuacacaaacccagauggcagagccugcuacacacccagacuguguggucuagcccauugcuccugggccacaaaccugugcagcuuguuacugcacuaaauaccagagcaguuguaacacacugguaaguacuuauguacuuaaacauaucuaaacagagaagaggcacaguaaagauauggcauaaaagauaaaaaccaggccaggcgcaugagccuauaaucccagcacuuugggaggccgaggcaggugaaucaccugaggucaggaguucgagaccagccugaccaauauggugaaaccccgucucuacuaaaaauacaaaaauuagcugggugugggggcgggugccuguaaucucagcuccuugggaggcugaggcaggagaaucgcuugaacccgugaggggcagagguuucagcgagccgagauggcaccacugcauuccagccugggugacagagcaagacuccaucucaaaaaaaaaaaaaaaaaaaaagauaaaaaacaguauaccugugcccuaggcacuuaccauuaguggagcuggcuggacuagaaguggcuguugguaagugaacgaauggugagugaaugugaaggucuaggacaugacuguacacuacuguagacuuuauaaacacuguauacugaggcuacacuaaauuuacccaaaaaccuuuucuuucuuuaauagcaaguggaacuuagcuuacuguaaacuuuuuacuuuauaaaaauuauagcuauuuuaacuuuuuuacuguuuuguaauagcagcuaccuuaagacacaaacacauuguauagcuauaugaaaauauuuucuuucuuuauauccuuuuucuaugagcuuuuuuucuauuccauacacauggaacauacaacauaugauuuuuaggggucuagauucuuucauauaacauagugucuccaagguucauuuugugggauguaucaauaagggguuucacuauguuggcuaggcuggucucgaacuccugaccucaggugaacuacccaccucggccucccaaaguucggggauuacaggugugagccacggugcccagccguuuuaucaauuauuaauagugagcuauuaacaucuccaacuauuguuguagaacugucuauuucucccaccaauucugucaauuuugcuuuauauguuuuggcgaucuguuguuagguaugaagauauuuaugauugguauauuuucuugaugauuugauuguuuuaucaauauguaauguuguucuuggacucuuauuuuuuuuuuuaauuuuuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauugguaaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuagugcagaacaaaaugaaaagucucccaugucuaccucuuucuacacagacacggcaaccauccgauuucucaaucuuuuccccaccuuuccccgcuuucuauuccacaaaaccgccauugucaucauggccuguucucaaugagcuguugggcacaccucccagacggggugguggccgggcagaggggcuccucacuucccaguaggggcggccgggcagaggcgccccucaccucccggacggggcggcuggccgggcggggggcugacccccccaccucccucccggacggggcggcuggccgggcguggggcugaccccccccaccucccucccggacgggguggcugccgggcggagaugcuccucacuucccagaugggguggcugccgggcggagaggcuccucacuucucagacggagugguugccaggcagagggucuccucacuucucagacgggguggccgggcagagacgcuccucaccucccagacagggucgcggccgggcagaggcgcuccucacaucccagauggggcggcggggcagaggcgcuccccacaucucagacgaugggcggccgggcagagacgcuccucacuuccuagaugugauggcggccaggaagaggcgcuccucacuuccuagaugggauggcggccgggcggagacgcuccucacuuuccagacugggcagccaggcagaggggcuccucacaucccagacgaugggcggccaggcagagacacuccucacuucccagacgggauggcggccgggcagaggcugcaaucucggcacuuugggaggccaaggcaggcggcugggagguguagguuguagcgagccgagaucacgccacugcacuccagccugggcaccauugagcacugagugaaccagacuccgucugcaaucccggcaccucgggaggccgaggcuggcggaucacucgcgguuaggggcuggagaccggcccggccaacacagcgaaaccccgucuccaccaaaaccagucaggcauggcggcgcaugccugcaaucgcaggcacucggcaggcugaggcaggagaaucaggcagggagguugcagugagccgagauggcagcaguacaguccagcuucggcuccgcaugagagggagaccguggggagagggagagggagagggagagggagagggacguucuuggacucuuauaacaaguuuguauuaaauucuauuuugucugauagaguauaguaaccucagcucucuuuugguuacuauuuuuauggaaauuuuucccaaccuuucacuuucagccuguguguuucacuggaucuaaagugacucucuuauaaggagcaccuaucuggauccagugauuuuuuuaaaagcgauuuuaucagucucugcuuuuuauuuggagcauucaagcccuuuacauuaagaguaauugauuacagaucugcaaagaaugacuucugccauuuuguuacuugguuuuuagaucucaucauaucuuuuuuccaugcugauauuuuuuauuucuuuuguuucuuauuuccucauuuuuguuuaacugauuguuuuagaguaccauauugauucccuucucauuuccuucuccguguuuauuuugcuuuguuagugguugcucuagggauuacaauuaacaucuaaaccuuauaauaaccuacuuugaauuuauacuaacuuagcuucaacaguauuaaaaaaaaucucuguuccuauauggcuccauuccuccacuuuauguuguuauugucacaauuuacaucuuuguucauuguguaaccuuuaaccuagauuuauaauuauuguuuuauguauuugucauuuaaauuacauaagaaaaagaggaguuacacaccaaaacuacaauaauacugacuuuuauauuuaccuauguaguugucuugaccagggcucuuuguuuguaugacuuugaguuacucucuaguguucuuucauuuuaacuggaaggauuccuuuauccacuucuuguaggauaggucaacuaaugacaaaucuucucagcuuuugguuaucugagaaugucuuaauuucuucuucauuuuuuuccugauauaaaauucuugguugacuguuucuguuaaucuugcugaggaucccuuguccuugauguaucacuucucucuccauguucauaagacucucccuuuaucuuuuguuaguuuuauuauaaugugucucaguguaaaucucuuuguguuuauccuguggaauuugcucagcuucuugaaucuguggguucaugucuuucaucaaauauggcaaguuuugaccuggaucccacagcugucauguguuaaucauaaacauucucaucuacuguagcccuucuuccugccaugcuuugguugagaaauuucuccgcggacucaggcaggggcuaucaucuccauucuacagauagagaaaccgaguuucaggaagcacugcaacagccuggcccaucuauuggguuauucugugauauuguugauugcuuuugaugcacugggugcuggggagucaagagcaaugcuggguguugugggugugucagggaccuucuccccaccccuauaacacaugcccuuucuccucucccugcuccagauagcagaggagaggugaagggugcuguccuuuucuguccuaucuccagcaccucugccaccuccuuacaaccuccgggaagcacaggucaccaucuuaaacaacaccagguguaauuaccuguuugaacagcccucuagccguaguaugaucugggauuccauguuuugugcuggugcugaggauggcaguguagacaccugcaaagugagugccucuaccccaccagggaaucccacccucuccagcucuacaccugagagcagcuaccauuucucccccaaccacucccaacccauugcuuagauuucuuaggagaaaaccagugcagucucaguuacugagccuacaaaauaugcuucucauuuuucauaaauucugccuacacugauuaacccaccaaccccuggaggcuguugccccacuuugaaaguguagaaacugagacuugauuccaugggaaggaguaagguuugcauucagucugccuagccccacagccccuccugcucucauggccucugcugccccacccacucugccccagccugggcucacccaugcugcuccccagggugacucagguggacccuuggucugugacaaggauggacugugguaucagguuggaaucgugagcuggggaauggacugcggucaacccaaucggccuggugucuacaccaacaucaguguguacuuccacuggauccggagggugaugucccacaguacacccaggccaaaccccucccagcuguugcugcuccuugcccugcugugggcucccuga

SEQ ID NO: 192672 - RNA, 23796 nt, Homo sapiens
uccaaucuguuuuuuauuuuauuuuuuuacacagggucuugcucugugguccaggcugaagugcaguggcaugaucaucacucacuacagccacaaccuccuggucucaagugauccuccugccucacucagccucccgaguagcugggacuacaggcaugcaccaccacauccggcuaauuuagagaaguuuuuuuuuguauagacagggucguaguauguugucuaggcuggucucaaacuccugagcucaagugauccucccacccuggccucccaaagacccaaagacuacagaccugagccaccaugcccaccuguuuucuugacaggacuugcauaugacaagcucucugcuucuccucaccuaugcauugcaagccaggucagaggcagguuaaacaccuuaaggacauguuaggacaaguggcauacaagggaaaaaaacccguucauuuaaguuacagaaacagaaaaaaaaaaacuggcuuauucccacacuuacucuacucaaagcuuugagaagacuaauuuuggcauccucuggcuaaauacaaaacaacaaaacaaaacaaggcaaacucuuucagcaagagcugugggggaagggacuauaagggacacacacaacugacaggcaaaagcucugagcacgugauugcuaaguuuaauucaacuguuacaccccauucugccuuguaaaaauaacaaaacgcuccuaucaaaaugacauugugaugugaguacaggcuuuuuguuuugguacagcucuaaaaaauguuggcaccgaaugcacuuaagaaaaguguuaaggcuuaauacaaauacagagacgagucauuucucaaugcagcuuagagggugagaacaggaugcuagguuuuuaaaucuuccaaauacaggcaguccccaacguacagacauacaggacaccucccaaauguaaacgacagccacacagcagggcuugcaugcgcaggaacucuucuucucccagugagcagacuaagcacucugaaucccaccccacugccucgcagagggaaagaaggcaggacagaugcaagaagaguaaugucaggggcuccaucacagcugcccaggggcuucugcuguaguucauauuuuccucauucccaucucugguuucucccauaacccagaagucccugccaggggcggaaguaaagagcuuuuccucucaccuagcggacugcaagggcugggagaaucacagggcccaguaccgucacguccuauuucuuccuggcaaucugauuuggaauucgugaaucauuuucucaauaaaaaaacagaaguuauaaaugguaguucauuuccaccauuaaacuguuuccuuucaaguugcaucaaugacuuugaagcacaaaccaccugaaguguguguagagucacacagaguguuucuuggcuccaaagucuacaggcaaucaaaagggggaagcugucuuugguugacaaagccuugugcagaccccagugugccagguguaggaaggggagcuuggcaggcggcuccugcaggcacuuaagcagugaggcagcaugagccugacugaacauggcugcugcuuuucugaaguuuaauaaugaugauguuucuagcaccaagcauuagcuuuguaggcacucagagcaaagcugcugccgccacccagacguucuccucuguuaacagaugcccacccaagggcagcaugagaacugggccugcagcccuugagggggaugggcagaggcuucugccugaagaugaaagcaccaccaccuuugccaucccauuagcugagugagcaaagcucagggaauuggacaggugugacuuugcuacugaacuccuucaucuccuggccuaaggucucuagucucuucuggaagcuuguuugugaguuagauccagaaguucuauaaagcuuuguagaggguggccuccacagcucuucuuccucuuugguguaccugaacaauugacuuuuuucuggaaaggugucagaaacagaccagagucaacaaucauuuauguaaagcugguauuuaaaauuuagcuuuuuagauauuauuaaagaauccaaaccuaagaacccaagguucccaagcaucucuucuuuccaccaaccaauuaaggaauaaagaaagacacaggaagaauuuaaacaagccacuuacucggaaauaucugaauagauuuuuaaagucccgcagaggucagcgggccucauuuaugggaagaacugugacuugugaagggaacugucuacaucacuggagaacaacaaacgccuaaacuuaaggcugaugagaggaaaaaagcaagaauucacaagcaaaacuggcauguaaaggaccaagaccagcccugugugaaagacaggcagauuccaacaugagaucagaucaggccgagguuucagauggcaggaacugggcacuucagagggucagggcaccaaaacaaucuuccaugaaguagaagacggauaacuauuauuauuugguuuuuugaaagcugccgaggaaaagcaaucaagauguuucaagaaaagacuacagaacaauaugcuggggguaaaaugaaguggggaugcuggauuuagcagccgugaucuccagaauggaagcgguucugcuaagaggucaauauacuguuaguguuucugcuuacgccuccuccaucccacagcagcaguggacaggcuguuuugguuucuuucagucauuccuagacauccaaucagcuggcgggcuguugauccaaggaccaugcccugccccaccuccccacccucaccccccuuccaguuccucucaaaccuggacuacacaugagugauggccaggggugccccauuucauccccacagaggcaucucccagccaucuggaaggcacgggucuccaagcagcugucaugacggccaggagacgcugagcagccaggcucacauaagacuaacccucuucccaccccgcucauuugggcaaaaggaaaugaaaacauggcuacccuaucucuugaguuucuggucuggcuccggguggagcaguggcuucucuuaguagaaggagaugcuggauuugccucccgguggguucaggaccuuguugugagagcgaggccgcggccccagccggggcucauggcugucgacugugggcaugggcuccugcuccuuggcggggccugcuuuucuggcgcugccuuucucaccuggcucugcuccagccgggaugcuccuugcagcugugggacacaaaguuagaacaacaucccauuagaggcaacccaugacccugacaggcaggcuguggaaauaaaaagugugucauagagcaaccugcaagaaauucaugcuguaacugggaaagagaagacaauauagacaggcuuuucaucugguaccaaaacaacucacuguaauuagcagaugcaguuuugaaaugggcauaaaguuggggcuugcuacuguaaauacuccuugauuucuuccuaagugaauuguuucuuuauauugcuuguuagacaccacucccauuucuuccaucucaaguauagaaagcaagccccugagagugaccaugaggcggcgagggaaugcauccuaggugagggcuuagcaaggcaaaggcaggcucuguugcuguuacccugggcuuuucaaaggugaaugaaaucccacaaaucuuggucauuaguuaagggaaauggagacccaaaggcagaaaccgaugcccauggucaggcuaaagagccguggggagagucgaagucugccgcucaaccugagcaguggcucacucccccggggugacucaccauggagacacccgccuccccauccuccaucccucucuugugccccucucuucucgauuaguucugccagcucuaugcuuggucaugaguucacugaagguuugggaucccugcccaucacuacacagaugagcuucuaggagacgaccccauggcccugggccuaggcugaugagcaagacaaccaagucccaggguuucacccuagccuucuucaaaugcugaauccucuugcaguggauacaccugagcucguuuuaaucagguggcccagaaggugcaaagaaagacuccuuuucauucccagaggagagacuagcaacucuuccagaaauaaugaggccacucaggagaagggaaagaaaacaaaagcucaccuuuaagauccgauuuugguucuucuccuucacauaagaaaacaugauccugcaacaaggcaaaccaccaaaucaggacucacucagaaaauuuuacccucauucaaauggacaaugaaaaucaggaccauauaaccuuuuaauuuacaaaaaugcuuguauaucugaccucaggacccccccaauccucuacagacuauucugaaacaaaccugauauuucauuuauccauacauauuucaagauguagcucuuaaaacauccuuuaaaaaauaacaguagcacccucaaaacugcgaauauuaaugauuccuuaaauaucaaagucaauuuuuuuuuuuuuuuuggagacaagagucuuguucagucauucaggcuagagugcgguggcaugaucuuggcucacugcagccucugccuccugggcugaagcgauccucacaucucagccucccgaguaguggggacuacaggcgugagccaccacaccuggcuaauuuuucuauuuuuuguagagacaggguuuugccacguugcccagcucaucucaaacuccuggacucaagugaucugcgugccucagccucccaaagugcugggauuauaggcgugagccacugugcccagccucaaagucaaauuuuuaaauacuggcauaauauuucauccaugcuguaauauuucauccauaauaauuucauccaugcuguagcgugugucaaugcuccauuccuuucuauggcugaguaauauuccauuguauggacagaccacauguuguuuacccauucaucuguugauggacaaaugagucauucccgcccuugggcuacugugaauaauccuggugcaaggaucuaguguuugacuccuuguuuucaaaucuugugaguacguacuuaagaguggaauuauucggucauaugguaauccuguuuaacucugaggaacuggcaguauccacagccacugcaccaucuuccaaucccacuagcaaugcacgagggcuccaguuucucugcauccucaccaacucguauuuuccauuuuuacaucacaccauccgaacaggcaugcacuggcaucucacggguuucugaugugcauguccccaguuauuaauaacacugaccaucuuuucgggugguuuuuggcugcuuguaucucuucuuuggagaaauguauauucaaguccacuaccauuuuugaauuggguuuguuauuucguuguugaguuguaggcauucuuuauguauucuggauaguaacuccuuaucagaaaugauuugcaaauauuuccucccauucugcgaguuaucuuuucacuuuuuuuuuuuuuugacacggagucucacucuguugcccaggcuggagugcaguggcgcaaucucggcucacugcgcccuuugccuucuggguucaagcaauucucuugccucagccuccagaguagcugggaguacaggcgcccagcuacuuuuuuuguauuuuuaguagagacgggguuucaccauguuagccaggauggucuugaucugaccucgugauccgccugccucagccucccaaauugcugggauuacaggugugagccacugugcccaggcuuuuuuguuuguuuuuuguuuuuuugagacagagucucauucugucacucagguuggagugcaauggcgcagucucaacucauugcaaccucagccucccagguucaguugauucuucugccucagucuuccgaguaccugggauuacaggcauccaccaucaugcccggcuaguuuucguauuuuuaguagacaugggguuucaccauguuggcuaggcuggucucgaacucuugaccucaggugaucugcccaccucggccucccaaagugaugggauuacagguguuagccacugugccuggccuguuuucauucuuuauaguguccuuugaugcacagaaguuuauaacuuuaaugaagaccuauuuauuuacuuauuuuuucagacagucuugcuuguugcccaugcuggagugcaguugcaugaucuuagcucacugcaaccucugccuccugggcucaagugauccucccaacucagccuccugaacagcugggaccacaggugugcaccaccaugcccggguaauuuuuuguauuuuuguggagaagggguuuugucaugcugcccaggcuggucucaaaauccuaggcucaagcaaucugccugcuucagccucccaaagugcugggguuauaggcaugagccacuaugccuaggcuuuuuauaauuuuuuugagacaggaucucauucugucacccaggcuggagugcaaauggcaaaaucacugcucucugcagccuugaacaacugggcucaagcaaucuucccaccucagccucccagguaacuaggaccacaggugcacgcaaccauacgcaacugauuuuuuuuuuuuuuuuugggacggaguuucgcucuuguugcccaggcuggagugcaauagcacgaucucagcucacugcaaccuccaccuccuggguucaagcgauucuccugccucagccucccgaguagcugagauuacaagcaugugccaccaggcccggcuaauuuuauacuuuuaguagagacgggguuucuccauguuggucaggcuggucucgaacucccggccucaggugauccgccugccucggccucccaaggugcugggauuacaggcaugagccacuguacccagcccccagcuaguuaaaaaaaaguuuuuuuagaguugaggucucucuauguuguccaggcuggucuggaacuccugggcucaagugauucucccaccuuggccuuccaaaguacugggauuacaagugugagacaccaugcacggcccaauuuauuuuuaauuuuguugccucuguuuuuggugucauaucuaaaccuccauugccaaauccagggucaugaagauuugucccuauauuuucuucuaagaauuuuauaguuuuugcccuuaacuuuaggucuucgauccauuuugaguucauucuuguguaugguguaagaaagaguaagcuuuuauccuucugcaugugcauaugcaauuguaccaaugccauuugcuaaagagacuguucuuuccccacuggaugaucuuggcacccuugugaaaaaaaaaaaagcccuuuggaaggcuuuauuucucaguucucaacuugacuccacuggucagugugucugucuucaugccagugccaugcuguuuggauuaccguugcuuugcaguaagauuugagagcaggaaguaagagcuccaacaucuuuuucaauuauuauuauuuuuggauacuugggguaccaugaaauuccauaugaauuauaggacuuuuuucccauuacagaauaaaacaccauuaggacucuuauagggcuacauucuugucucucuuuaauccucaggaccucccucuauucucgucauguuguuuccuauguaagccauuguucugagcgcagcucugugguguuaauuaauauguggcuuggucugauuugagcuugauuuuuuugacgaaacagcgucaaugggggcccaugguggauuuccauucccaggcccauaaguguugguucucucucauuuugugauguuaacggccacugaugaacauuuucucagauccacgauuucaguacaaguuuauaaaacagugauauucuaauuccuuuauuccuucuucacuuacaucccagaaacuuuuauaaaagggaacuuucuuucaacagcugcuauccuaacacacacuucaugcaggaaaugcuggcuaaaugcccccuucugucaucugcccgcuuucgcagugacgagccgguccuccagcauucucccaaggucguaaauuacauuacuuuuaguaucaauaggaagccgggaauucugaacaguuggugaauuuaaauccacugcaauuauuucacuuuuugauaaucaaauggucccaucucuggccccauggcugcucuucaccuuguuccccaaguccucugacaccacccuagcagccuguaagggcuuccucauuuucuggcauuacgagauauucuacgcuuauuuuguauauucccugacccugaccuggaauuagucauuucucuggugaugcuagcgauguccaaugguccuggaccaaaagaacuuuauuagaaaaucaaagaaagcucuacucuguuuccacuuguucuaugcccaguuguacugauguccuacaguccucuaccugaucuacguucacuggaaagugugagucucagcaggaagcaccuugcucucguguccggcuaauucgagugcuuuacguaguagaggaauugcugacuuuugggacauuucuggucuugccaaaguucaccuuguaguaaagcccccaaagauacuucccaaauagaugcucucuugaaaauaacucagacagcauggcagggcacaguggcucacauuuguaaucccagcacuuugggaggcugaagcggguggaucacuggaggacaggaguucaagaccagccuggccaacauggugaaacccugucucuucuaaaaauacaaaaauuagccggacgugguggugcaugcauguaacacuggcuacucgggacgcugaggcagaauugcuugaacccaggagauaguggcugcagugaguugagaucgugccacugcacuccagccugggcaacagaaugagacucuauuucaaagaaaaaacaaaauaaaacgaaaaaacacgaccaaaccucagcagagucuaacagguccuauauaagacucuauacacuggaaagagaugucgcugcagagaugccagcacaagagagauguagggcaauccaaaccaggcuggccgcgaucaaugcccucauccacucauguccucuccuuucugucuacauuuccauuuuaauucugcaaugggccaucuuccagcauauaaaccaauaaacaugcagcaguuuucuaggcguuaaguaacuccagaaaugguuaagaauuuuccacuuuaaggaaccagaccauaucuuuuaaccacaaaaaagguagaaaagugaauagaugaaaaaauaucgcuaauuauguuaguaauaaauccuggucuuucuuacugaugaacgguggcugcaguaaacccuagaaauguucugccaccauucaaacaaauguccaagcuaggguagugcaggcucugguccucacgaaagccgagacuggccuuaggcaagcccuccaccauagcccagggaggcugcagcucugaucaaucccugcuaaggccaugcccgaggucgcaucguguaggcauuccucuccuuuccaggccacuugucuuauccuacugaugccauuacugggucagaggcgucagcuacgcuucagucaagugcugacaaucuccacagguaaccagccgaggaccuugacugugcggggaaaagcccaucagaaaagaacugucacuuuuccucugcaaggugaaacaggaagaguggaagacggacaagggcccagcucgucugcggcacguuccgcuccccaccgcuucuccgcgccccgcagcacugcagugaggagccgccacagcccgucugcagugggcguccgccaccagcacagaagagcuucccccacggcuucagucagcacaaggcuggacuguuuccugggugacucaggggaacuuccaaacucgaugacuaaugcuugcauccaggauaaucuacggcacccaccaugauucucccuaaaaacaugucgcaucugccuuggagccuuuuuggaaagagcaccuggcauacccgcugcugcgcugucacgucugaaugcaguccauaccuuggguuuguuugggugugccaagcgugaaguggcagugaccggagacccaaaaaugucgcuggucuucccuccagguggguucaggugcugucgagucugcacggggguugauucgucaaagauaccacuuccuuuacccccugcagaaacgaucacagaacacugagcaaccagacguccaccggaccccaccccaccccacccccgcagugcuuuggagaccuccucucauaggaaccccgagugccagcccugagcuccaggccaacagggcaggaugcucagacugaaaccccugaagauccaugaaaccccugaaaaccauggcuggaucaggggccugccugcagcccuuaugucuagaacugagcugaucuaggcuggccucuagaggugagauggcaucaaacugcagauuuucccucuagaauuucuuuaacccugaacauuucaugcuuuccuguugaagugucugcucacaaaacccaugaaaaguucuucaguagauuaaaaauaaacagcuaaauguuuaagucacacagauaagaguucugaauuuaauaacaugcccuauucaagggaaaccugccauccugaaaauauuuauuagucauucuucugaccucauucuggcugguacuuccagugacuagauaugucagcaaauuagacacauguaacaucuuuguugccaacuauaagugacuugauaagccauaaugaaaaugugcgucuaagagguaacuuccuaguagcaggugacuaaaggcuagaugcucagcauaaaugcccgugccuaacauuccacagaaagauggcuacccugugggaccaacugaucaucucuucacucagcagacaccaagcacccacuuuugacaaagugcuaugcuaaauggagguuggugucauuaaaaucauggcccuggugcaccaagaacuuauaaucuaagaggaaagaagaugcauucugcuaacuugcugugugauccuauggaaguuacuuggccuuucugugucccacaguccucaucuguagaauggggauaauaaaagaacucccucacaggacuggaagaaagcucagugaguuacuguagcucauaugucaaaugcuuacaacagugucugggauggaaauaaacaugucaacucuauuuucuaugcaaugauaaagagguaucuauacauaucauccagugaaaacacaagggugcaaacaauccauauagcaugcaguguuuucauguaaaaggggaaguguucuuauuugcuuuuaucugaagaaaagcaguuaccugugggggaugccuacacgugugaagaaacaggacuggggaaaugcaggggcuccacacugcuuaacauggucuccuuuuuuuguuuacagaguuuugaucuuuugcauuuucuguucucgaaaaauuacauuuuguaaauugauuuauuuaacuuaaagagaguuuauucauguguaaugcuugaguauagcccaccuggaaacaccaacuccaaaggaauggagucaguguucugaaguagggacauuaggguuucauuuauauaggcagagacagaggagcuuuuagcaggacuacaaacuuuucucacacaagguuaguguacaguuacagcaauuugguuacaggaaaaaaccacauauucaacaguuaauuccuaguguuaacaauccacacugcuccacagaagcaaccggaugaagagcccacgugugcuugcguggagaugaggcucggcugggggucugugcaccugcucgucuucagacccgcuugagggccccacugcugcggcggggccuaaagcaggguggcuuucugggacaccaguucuaggggcccagagugcagcgacaaggaggacuauaacagagcacagcaaguggggggucgggcgggcgugucuaccuuuugcaggugguaacagaacaccuggggauaugcgggacucgcccugcagagaaauguguacauuuuucacaugacuucagggugauaaaccuucugaaccucagccauggaccucccagggacccacaguccccaagcuugacaccccuggccagggagagcagcacagcacgguggggagaguguccuguggccagacugccugggucagggagucucugcucagcugcucacuaacugugagaccuuggacaaguuaugucaaccuuccuucauauccaucuucuuaacuuuaaaaagguaacaaacaguccaagugcacuggcucacaccuguaaucuuagcacggugggaggccaaggugggaggacugcuugaguccaggaguucaauacuagcgugggaaacaagugagaccuugucucuacaaaaauauuuuaaaauuagccucuggucccgcuccucagaagguugaggugagaggacugccugagcucagaaguuggaggcggugagcugugauggugccacugcacuguagccugggugacagacuaagauccugucucaaaaaaccaacaaaacaaaaaaaagguaauaaauaaucauaccuaccuagggucacuggugaggcuaaacaaguuaacucaggugacgugguuagaauaguccuggccugcugaguaagcccucagcaaugcugcagggcugugucaacaagcacgucaggaccacggggcggauaaaacugugugugcaacccccagcccccacugcaauguuccuggcugugcuauaacggcugacuuuuuuuuuuuuuaaugugacuccagcuuuuuaaaauagaagauaaaaguaacucaauuugaaguuuuuggccaaagacaucacucauuuuuaaaaaauaguuaaacugugaaacauaacagaaaagucuguaagacauuaacuaucacaaauaacuacaaggcagacaccagguaaccacugccaaagucaucgagaacagugcccguucccagaaacuccuguguuccuucacucucacccaagguuaccacacuccugaauuuuuuggaaaccacaaacauuuuuaccacguauacgugcaauagguacuaaacaauguaccucugcuuuuaaccuucauaacuagguagucauaccacauaugucuauuaccauuuuacuugaaaaauaaauucagcuuugaagcaagaaaacaugcuuaaauucacuaauaauugaagauaaacucgagagauguuuuuuccuccugcuagauuuuugauuuccaagggcucuguguuauuuuguuuuuaaaaauaucauuuauuuauuugggagauugggccucgcuauguugcccaagccaguuucaaacuccugggcucaggcaauccucccaccucggccucccaaaaugcugggauuacaggcgugagccaccgcaccuggccuacaagauuuguuuuuaaaagcaaaacuaaaagauaaauacugcuggugcaaauaagcacauacacaagaaugguaaacaccaggcaaugcccugaaaaaccgguuggaacuaucuauccauauuuuaaacucauauaucaucugaucuaccaauuccauuuugagaaauuuaucccaguggauacauucaggaagucaguuuaaggcauggaaucuggagucagaaaaaccucaauucaaaggcuagcucugccaccgacuagcacugcuaccggcuaggucugcuaccgacuagcucugcuacggacuaguucugcuaccgacuagcucugcuacugacuagcuugggauuuaugcaugccagugaccuuuuccaagccuguuuccuccucugugaaaggagcaaaacaaccuacuccuaguuauagcgaacaccaaaugaaaaauacacaugcaaagcacuuagcacaguccccgguaaauauuaacaauucauagacguuggucaucauugcuagaagaggaagaacaauucauggaacaucuaaaccaggugacuaacaaagaacacagagacuacugaagauucacugaaacacugaaugggaauugauaaacauucgauggcuaugauguggucggucacacacacucucggccucugcauacuuuucucaaucaagcccugcaacuagagggcuguggggcuaggucugugugacuaaguguagaaagaaggcaggacuccagaucucguuggguggugaacacaacuagcaguuucccuuucaggcuucccuugauaauauaccauaaaccgucuuccaagagcacuggagagauaggaaaacucccaacaaccgugagaaggaccaugagaagcaggaaccuggcauggggagccaugauggcuggcaccacacacugugaccaggaguagaggcuggcucacuaaccgcaaggggccgggcuccccacugggcaugagaccauguggaacgggcaaagugguaccgccugccuuccauggagugcucuaggaacagcuccagacaugacucugcugaguaggggccaaaugagcagauucauacaccuggaaauggcucagauaggauucuaucuugcaugcgauauauuauucugcuauccuugcuaaaaaggacaugcaggagucccugggccuaaauucauaaaccggaaacaacgagaauguuagucacuuaauaagaaacacucauuucucuaacaaccaaaaaagcaaccaaacagaccaaaaaaaggcaagcagcaaaccuagcuucggccgggcacaagggugcaugucuguaaucucagcaauuugagaggccgaggugggcagauggcuugagcccaggaguucgagaccagccuaggcaacaugguuaaacccugucuccacaaaaaauacaaaaaaaaauuaccuaagcaugguggcauacgcccguagucccagccacucaggaggcugaggaaaaagggucaccugagccugggaagucaaggcugcagugagucaugguggugacacugcacuccagccugggcgacagagugagaccccgucucaaaacagacuaaaaacaaaagaaaaaacuaguuucuggaucuacugcuuuuuuuccucuacauuuggucaauaaauauugguaccccaaaacggagugaggucgggaguggaucuggcucugauucaugaccugccugacacagugacaccuaagcacggccucucaaaccuucuaaggauggaagagaccaugcuuuccccucuuguacagacgggggaaagcgacucagguaaccuccacugggugguuauucaacuggacagucuaucagccaagagaaaccuuuuucuauuuuuuuuuuuuuuucuuuuugagauggagucuagcugucacccaggcuggagugcaguggcaugaauuuggcucacugccaccuccaccucccggguucaagugauucuccugccucagccuccugaguagcugggauuauaggcgugcaccaccacacccagcuaauuuuuguauuuuuaguacagauggaguuuugccaugucggccaggcuggucucaaacucuugaccucaugaucaccugccuuggccucccaaagugcuaggauuacaggcaugagccaccacgcccggcugagaaaccuuuuucuuuuucuuuuucuuuuuuuuuuugagacggagucucgcucugucacccaggcuagaaugcaguggugcgaucccggcucacugcaagcuccgccuccuggguucaugccauucuccugccucagccuccugaguagcugggacuacaggugcccgccaccacgcccggcuaauuuuuuuucuuuuuuaguagagaugggguuucacuguguuagccaggauggucucgaucuccugaccucgugaucugcacaccuuggccucccaaagugcugggauuacaggcaugagccaccgcgccuggccaagaaaccuuuuucaaagagucccuccuacuguaaccacuaggagguuggguaaauacugaagaacuauguagaugugugcuagaucaauucuuccuuguuaagaguuucaaucccacugacgaucugaauaaaaacacucucccucccuaggaaaaauguuuaaaugcacaauaauuugcacgcaauuucaggaaucucauggggguccguggaacaauugggagcagcucccuggcaggaaccagaagcccccguccacuuuuguguccucagugccuguauucaaccaaagucuccagaacagauggagaauucaagacuacucaagucaccuucaagagagaaaguacaaaucagaacguuuucauuuuggaagaacucugauaacaagugauuaccugaaccagacaauaugggaaaggaucaguauaaagaaacagaaaauauuuucaaaagagaaucguggaggccaaaggauuaaggauuuccaaaggcccauaccugggggauuuguccucuuggguauguucugagguucuucuguugguccaaaaauauuagaugccauccuauuaggccugcuggaaggaguagcuucuucuggacuuccaaaaagauugcucgauucuccuccugggggcuucauggcccuacaagcacagaguacaugccaauuacugauggcagaccugaaagcuugucacugugcaaggauuuuggcacaacuagacaggguaaaaguauuuuguuuuuuucuuuuugagacaaggucucauucugucacccaggcuggagcgcagugacgugauuuuggcucacugcaaccucugccuccugggcucaagugauccucccaccucagccuccugaguagcugggauuacaggcacccaccaccacagcuggcuaauuuuuuguauuuuugguagagacaggguuuugccauguugccaaaguuggucuugaaccccuaagcucaagugaucugcccaccuuggcgucccaaagugcugugauuacagguaugagccaccauacccagcaaaaguauuuucuuaacaucuacugagaaaucacauaccaccauuaguuaauacugguaugacuaguuuacagacgccagacuacuucugcugcucuuuaguuucccuuaaaaguauucuuuuuuuuuuuuuuuugagauggagucucgcucugucgcccaggcuggagugcaguggcacgaucucagcucacugcaaccucugccuccuggguucaagugauucuccagccucagucuccugaguagcucagauuacaggugccugccacaacaccuggcuaacuuuuguuuguuuuuuuugagacggaguuuuacucuuguugcccaggcuggaggaaugcaauggcgcaaucucagcucaccacaaccuccgccuccuggguucaagcaauucuucugccucagccucccacguagcuaggauuacagguaugcgccaccacacccagcuaauuuuguauuuuuaguagagacgggguuucgccauguuggucagguuggucucgaacuccugaccuggggugauccaccugccucggccucccaaagugcugggauuacaggugugggccaucgcaccuggcucuugaaucacuuuuuauuguaaaaacuuaaacuuaagaacuaauaaggaauugccacaaagcucuauuucuagagcacuaucuacauuaaaaaccggugaaacgcugaauucauaacaacuggaaaaacuuuuaaaugcauuugagagagaggcuuacugaaauugagauuuaaaccagugaguggcacaugcucucucacuaguccuaagcaaugggacugucugugaucccagacguuuagaaacgaagucagcccucuguauccacgggcucugcuuccauggauucaaccaaccucagaucaaaaugucagaaauaaaaggaugguugcaucuguacugaacaucuacagacuucuuuucugucauuauuccccaggugauacgguguaacaacuaugugcauaguauuagguauuauauguaaccuuguaaccuagagaugauuuaaaagcauauggaggaugugcauagguuauaugcaaacauuacaccacuuuauaucaaggacuuacacauccuuggauuuuggcauccuggggguccuggaaccaacucccgcaggauaccaaggaugaccauacuugaaauuacagggcucaacaucacacaaaaacuaugauaugagguuagaucucacuggaaagcuuugcaaacacugaccacucaagguuugguuaacaaaaauaacaguuucuccucaaaagaucuagaaagagcgcugagggcuccuugugacuggaugugaauggaguucucagaucuccugcuauaaagcaggaaggcagagagugcuucagucuccgccugcagagacccacgggcuggcuacuguaccccagaaaccaagcgugugcuggccgaccucugaaguggugcccagggccccuguccacucaggaggcugggggagguggaugccaaacuuccugucagcaguugccauuuccuggaggauuugaggagggagaaaaaaaaagacaggugcacuuaagaaaaauuauuuuuuaaaaauaaccaauaaccaagcuuaaaugagaaagggcuguccgggagcaguaccuggcaccuguaaucccagcaccuugggaggccgaggugggaggacuguuugagcccaggaguucgagacacgccugggcauauggggagacccugucucuacaaaaaauacaaaaauaaggccaggcgugguggcucacgccuguaaucccagcaccuugggaggccgaggugggcggaucacgaggucaggagaucgagaccauccuggcuaacacggugaaaucccgucucuacuaaaaauacaaaaaauuagccgggcgugguggcggacgccuguagucccagcuacucaggaggcuggggcaggagaauggcgugaacccgggaggcggagcuugcagugaaccaagaugcgccacugcauuccagccugggugacagagcgagauuccgucucaaaaaaacaaacaaacaaacaaaaaauuagcuggguguggugguaugcgccuguugucccaguuauucgggaggcuaaggcuggcuugagcccaggaggucaaagcugcagugaaccaugauugcaucacuguacaccagccuggacgaaagagugaggacuuguuucaccaaaaggaaaaaaaauaaaggguggugggugggagggcguggcuuaacaagauuuuaggugaggugcucuuagaguggccauaaggccaucugacuuccauauccauuuuugaaucacgcagcccuccuaauucuacauuuuuuuuuuuuuuugagacgaaaucucgcucuuguugcccaggccagagugcaauggcacaaucucggcucacugcaaucuccaccuccuggguucaggcgauucuccugccucaggcuccugaguagcugggauuacagaugcccgccaccaugcccagcuaauuuuucuauuuuuaguagagacgggguuucaccauguuggccaggcuggucuugaacuucugaccucaggugauccgcccaccucagccucccaaagugcugggauuacaggcaugagccacuguguccggccuauuuuauuuuuuugagauggagucucacucuguuaccaggcuggaauacagugacgcgaucucagcucaccgcaaccuccaccucccagguucaagcaauucucccgccucagccuuccgaguagcugggauuacaggugugcgucaccgugcuuggcuauuuuuuuguauuuuuaguacagacgggguuucaccacgucggccaggcuggucucaaacuccugaccucaagugauccgcccgccucggccucccaaagugcugggauuacaggcgugagccacugugcccagccaauucugcgauuuuucuuggauaguguagcaggucuaaacaugcacgggucucuacaguucucucuuuggaaauaagggaugaaggccugcaaucuuucgaacugaacugaauuuaucaagucuuaugugagcugagcaugagcuauaauuccuuuuacugacuuauuucaaauauggcuuuucucucaagcccucaaggugcuacaaacugucagaucugauuccagguagacucgccuugacugcaagcucuguaggacucuuucccgaccccacauucccuacauucacagucuccugucuccucugccuuucacccuugcuucaguucaacuugcacaucucucgagcaccuaucauuggcaauccuuccccagacgccguagauagaggaaagcaaguccuuaccccggaggagcuucaaguuuaaacaggaaagcuagagcucugcacaggugguuucagugucugugugagugacgugacagacgccuagugccaucgggacuccaaaauuuggaagaggugaaacccaaauugagucuguggccuccauguggaauggggaccaaugggcgcaggaggugagugguaguuacuugcaaugaccaguguuacuuuggggugauggaaacacaauauuuaauauuguucuaugugcuuuucugaauuuuauuugaaaacaagcaaagaaaaaaaagugguaccaaagacgguuuuagcagaaauuauggcgcacacaggcccagccccaggcaaggggcagcggcuaucucggucacaaaggcaacaggucccacugcagguuucacacagaccgcagggcugggcugccucaaaggggucucggaugaauggaacugagcguucaauagaccuuucaacaaaaacagcccgacaacaauggcgcaguguggcuuucucuaggcuacaggcacuuaccacuaugacacuaauagggggagggggaacgcuagagcucacacauuuggggacaaauucacaaugugaguggggggugcuucccaauuauuuuuugccuuuugugguaccccuuccauauauuucagugaagauauucaaaacacacaagagaaacucaagcgcacaggagaagaaaaaccucacacagcuggaguggacugcagcacuggagagguagggaaaagcugugugacccuccucgggggucuccaugcuccugacccucucuaauaguuuguccccgaguuucagaaaggaugaggggacuggucaggcuuagagagaagcagugagaaauaaacuuggauuaaauuccuuacaaauagaaauguuccagcuugaaggaagaccucagguuaaucgcggcuaaagcauaacgcuuuuacgaaaccccuuuaacacaagacaaucccucagcaaggaaaggagagaugugaggucucaggagaggaaaaccuggcuagguaaucuuacagccaccaccugacucgcuucacagcaaaacuaaaugugacgcuuacaaggcgcccgcccugcgacucgaccccguucagaugaguggcaaaugugcagcgucugguggaccccaagcagaagcuuccagugauaccucaucauccaguucagaccggcuuuccuuccucaccauccuaaaaggaagaguuuucucccuuucucaacaccuuguccagaaaccagucccccaggguagugugaguaugacuuuagugcggcccugugcagcuaacuucuggagcgugaaagucaauauaaaaacaucggcgucgcucagggugauaauaaacaccaucauuuaccgggcagccagugccaggcagcacaaacaaaaaggaaacguacuaaaugcacacaacugggacagggcuggggaugcagucccuccccccacugauguggguggugcaaaacucuggccaccaggaaccagaaaccggauucgcucugagcacuaguuuaaacuccuggucccacaucggugcagaccuaggcauaauaaucacuguuccauggaugaagggcuguuucuuugagacggagucuugcucugucauccaggcuggagugcaguggugugaucucggcucacugcaagcuccgccucccggguucacaccauucuccugccucagccucucaaggaacugggacuacaggcacccgccaccccacacccggcuaauuuuuucguauuuuuaguagagacgggguuucaccguguuggccaggauggucucgaucuccugaucucgugguccaccugccucggccuccccaagugccgggauuacagccguugagucacugcacccugccacggguaauuauuugguuacaaguauuacugaauacugaccuaacucccucaaaucuaaaggguuuuuuuuuuuuuugagacggagucuugcucugucguacaggcuggagugcaguggcauuaucuuggcucgcugccaccucugccucuggguucaagugauucuccugucucagccucuccaaguagcugggacuacaggcacacaccaccacgccuggcuaauuuuugcauuuuuaguagagacggggguuucaccauguuggccaggcuggucucgaacucuugaccucacgugacucgcccaccucagccucccaaagugccgugauuacaggugugagccaccacgcccggccaaucuaaaggguuuuuauuuuuagcaaguuggagcaauucuuuuacuuaguauuuauucaauauaguauuugucuucacuugaucauagccaaaaggcugagaagcaauauaguauuggucuuaacagucauggcacacauauucucuucuacuucucuggcgaggcugugccacagaggggcucaucauacagaaaaccucaggcaucugaagacccaaacuucacaaugcaaguuuacugcucaaguggcacgaaagaccuuguaagcucugucccucuaauucaugcgagucccaauacccaaagagugcuuuaaaaguucaaaaacauaagaaaagugugcucaguguuccuggcuauuaaagcugagucaggauaucuucgucccaauccacuucuuccuacagcgaagcccaggagcgccauccaccuucccaggagauagaacugacucuuccccagacgcccuggcacuuuccaaaggaaguggacucacaugaacuaguggaagcgcggccaugggcagggcacaggccacacacacaccagggacacgggcacacggccacacgcacaggagcgggggcauggccagacaccccccacgaacacaucgccgcacaccccuuagggacacccccccgggaacauggacacgcaucccacagacaaaaugggccgcacccacgggcacaccccgcccccaggaaaccccccacggaacgcaccacacggaacgcgggcgcccaggcgcgagggagcgcagcccgcccuccacacagcuuuguucccagagcccgggcgccccuccccgcccucggccucggucgcgggcagcucuccacagcccgggccucagcgagcggccccucgggcuucgggccucggucuggcggcggcgcagaaaggcgggcggcggccccgagggccucugugaggucgcccugccccccaaccccaccccaaccccacacggcugguggacgcccugggcuggcccgcucccgccacguggucgcgcuauccgcccgccucccgugugccccgcgccgcaccuggagccggcgcggccgcccucgcuauccgggaccuggaacaugucgaccgccgccacccucagcucgccgcgcgccgu

SEQ ID NO: 192673 - RNA, 17392 nt, Homo sapiens
gucugugcaaaugcuuuaaugguggauucuuagauacagugguuaauccauugcccacaauucuuuacuaauuccgaggcaccucaugccgggaacacacuuucccuuccacuaaacaaaggugaccgcguuucagagcucuccucuuacaagguucacguccuucguuaggccgaggaccgugguacuacaaaagaacauuucguuagcugaagucacuacgauuggcgagaaacauccguuacuucagaauacguuaacuacaaaauauauugaauuuccauauguauuaaccauauacauguguaacuauuacuaaauguaguucagucauuacaaaauaagacauucugggagcgggcuacaaauauucaaaccagcugaauuccccagguaaggccccguguuauaaacaaaccacaaacaucagacgucagaccgagagcucagugacugcagggugcguagccggaaaagccaacaaggcacuggcaccgcagagucgcuggaggggugguggggggcacugccggcucggggggccuuuggaagucaccucuaacuucgauucccagccaacagcggcuggagucccacacggaccuggagggugccgagcuccccuucccagggcccuggaccgcccucccugcauucuuugcuccuuuggggagccccgcccugcccucuugggacccugcacuugggccacggggacccagcuccagccaccggggggugccagggcagcagggccagcuccagccccaaggcuugaaacgaaacugaggagggccaagcucgcuaggauggggagacuggguugggagccagagguuggagggcugggagcaccgggcugugucccccagggcuucccaucucuguccacugugccuuccugcugggaggugaccggcacccaacuucccagccaggccacuuccugcaguggcucaggcagccccaagaggccuggccggcccaaccuuugcagagggcucagcgucaggacggcugcugaggcgcacagccuccccaggacagaccacacucagguggccucaggacgaagaauuccagacacaggcugcccagggcccucuaccuggcgcuaagggucggggaagcccuggagggccacggcugugggcucucccagaaaaagcaccuggcguuugccacgggugguagcaaggcugccuccugaggacacaagggacagacaccugagguggcacccuaugcacagcgcagcuccaucccugugaccuggccacugaagaggggaacccccgccagcaggcugcccggauaggaguccucaggcagcccccagcccuggucuggaccuggccuuguggcccccaagacagcuggcaccggugcaguugccagggucucgaugccaaucccgaccuaugcagaucuuagcugcccagcgcucuacagcccgcagaugcggggagcacagaaaccucagcagcacuuuguacacagcccuguuuacaaagauccagggcaagacagagccucacagccugcgugcauccgaagcagauggagagccugguccuggcccgcgguggggcugcagguggguggggagggccgggcacugggaggccgccuccucucacuuucaaugauaauaaugcaaccaaaaccuuuauauaaacaguuuauuuacucuaaacagcaacacagacaaaacgccauauaaacacaaaggaaguggcgcagaaccgagaugcugaccuggggucugaggcucaaaagcagcacagcccagguucuagaagguucuagagaggagcggcaggagggagggugcauuuccauacagccagcugaggccaagugcagcucugcacggugagaagcaugccugcaucccagagcgaggaacucgccccugggggacuuacccaaguauaaaaguuuauaauuuuacagcaguugaaauacugacaucaauauuaaaauaaaagcgaguuuuacauaacaaucaaaaauacaaaagaccgaaggaagagacccuguauggaaacgggcaauucagcgaaucgagaccgcacacccgcggcggcaauggaagauggcgcccgcccaacccccccaggugacuagucauuguauggagcaacuuuagauuugcaaaaauguuguaaacaaguucuugccaaaccaaucccuuccuuuugacgaugccacaaggucgcugcuuaugagggcgcaaacuucuuggcuugugcucggacccuuuucucguacuccacucuguuuuggcugaggaggucaaaagagaagagacguguuagagggcugagcugccuggcccucacgcucgccccggagccagcugggcagaccaggcugcaggaugggaccuccugggggagggcaguguggagcucgucauaguaacagaagcagaagcccggagaagcagggaggccugcgugguggggagcccaugcuggcucugacguggcugagacugucccguggucugacgggggcagaagggcagggaggagaggaacccacgcugggugaacgugguguucaagggggacagaggggucccgcagggcugcgaggagggcucaggcccagagggcccacgccagggccugcaacaucguugccgaugccaagucugguccuaacuaguaaucagcagcuucucuuuucuguaggucuggggacaguccuaauaaacugaaaacacugacugcuugccacuguuuuuguuaauucccaaaaauagacaccaauuucuggaggguuuuuccaugaggcucucagccgcaggggcaaaggugugggaaggcaggccugguugagaaggcguugugcccgagcugggcagugcaggggcaucagcgaacaggucuggagcuggguagagugaggcucagccugcaagcagcugcccaggagaguggcauggcacacacugcccgggcaaaacaggugggcgggagggcggccgaggcugcaccuaggggcugaugggucacagggugcagugugacccugaggaugggggaacaccaugacauuuauggagguggcuccuggggucgcaguccugccagucucgccaggauuggaccuggucugagacacugagccucacucugcaugguggaacagcccaggacggcagcagcgccggugccacccccacccacgccaagggccuggaccgcagcccagaccccagcgcccuccuugggccaccagccggccccagggcagagcagcucagcugggugggcguggaaggaaccagaggcgguggcuacacgucccagcucuuccuugaccaagcagaggccccgagaaaaggcaccugccagggcaggaacacgguccaaggccuccaggaaacccaggaaaaacgaucugaaacccgcacacaugcuucacaaagggugcuuuucaagcggauguguguaggagaaagaacguuuguuuacgugcacgcaaguguacagugcagcccagcaggcaccaagcccaggagacgcuggggagagucacacggggcgggggacugcaacccugcccagcccacgccgcagaugggagccacagcccagcucuggagauggucggcaaauggggugcaggccagacagagcucacgcccacaccaugcuggggauggcagaccaucuaagggcuaggcaggaaaacauuugccuuuuguuuuguuuuuuugagacagagucuggcucuguugcccaggcuggagugcaguggcgugaucucggcucacuguaagcuccgccucccagguucaagccauucuccugccucagccucccgaguagcugggguuacaggugugcgccaccacgcccggcuaauuuuuuuuauuuuuacuagagaugggguuucaccguguuagccaggauggucucaaucuccugaccucgugaucugcccaccuuggccucccaaagugcugggauuacaggcgugagccaccgcgcccggcaugcuuuuuuuuuuuuuuuugagacagggucucacuuugucacccaggcugcaaucuuggcucacugcagcaucaaccaccugggcucaagcaguccucccaccucagccucccaaauagcugggacuacaggcaugcaccaucauccccggcuuaauuuuuuuuuuuuuuuuuuuuuuaaagagagcaggucuugccauguggcccaggcuggucuccaacuccugggcucagguaacgucccacaguggccuugcaaagugcugggauuacaggcaugagccaccaccccuggcaaauuuuuuaauuuuuuguagagauagggucucgcuauguugcccagucuagucaugaacuccugaguucaagcaaucagcccaccuuggccucccaaaguguugagauuacagguguugggccaccacacuuggccuagaaaucauuuuccaggcacgguggcucaugccuauaaucccggcacuuugggaggcgaggcggguggaucaccugaggucagaaguucgagaccagccuggccaacguggugaaacacugucuuuacuaaaaauacaaaaauuagucaggugugguggugggugccuguaaucccagcuacuugggaggcugaggcaggagaaucacuugaacccaggaggcagagguuguagugagcugagaucacaccacugcacuccagccugggcgacagagugagacucuguuuaaaaaaaaaaaaaaaaaaaaaaaagaaaacauuuucugccucaagggccauguggacacccacgagcacuguggcuuccuguccaagggaaugcauuucacggacuccuagggcacagcaggccagcacacaaacccaggucacgccacgucccacgagccacuuccagcaauggcuuggcugacugagcggcuaugaguuuuuuuuuuuuuuugagacagggucucgcuuugucaagcaggcuggauugcggugcugcaaucucaacucacugcgcaucaaccuccugggcucaagcaguccucccaccucagccucccaaauagcugggacuacaggugugcaccaccaugcaggggagccaggcugagccugggguggcugcugugauacuugcucccugccuggggccucugugccacccucggccaccagggagggcaccuugcagacaccugggcugggcccgcauccagggagaaacacaucucuccaaaaccacgugcuuuuuuuuuuuuugagacagcauuccuccgucgccaggcuggagagcaguggcaggaucucggcucacugcaacuuccgccucccggguucaagugauucuccugucucagccucccagguagcugggauuagaggcacccaccacuacgcccaacuaauuuuuuguauuuuuaguagggacgaggguuucgccauguuggccaggcuggucucgaacuccugaccgcaugauucacccaccucggccucccaaagugcugggauuacaagcgugagccacugcgcccggccgaaaccaggugcuuuuccucacgaccugugcaggccgggccuaaggcaaccgggaccccucagccuccccccuccugaccaggagaugcacccuggagggagagggccucugaugcccacaguggcagggaugugugggguggcugcaggugagccuucugggucccuggccauugggggcccugagacccccucagagguguggggacccguggugagauggggcuggguuucucaacgcugcaggcggagcaguggggggucggaggccccaacccaccuucuuauggaccugcccagaacagcugcagagggaacaggacaggcgggcgcauggccucugcucagggcaggguccucccugcuuuccccagcacuguuuggcugucgucugcauccuaacucacaccaggcccuccucggugcagacaggaccccaggcccacggggacccuucuagccacagcagcaccucacagggacaggguggaagcccaggguccgugugacagcaucacgucacugagcccugcugggcugggcccccccacagaaggaaccaaguuguagaggggauggggacaagcagcaagggcggcgcgggaggcugggguccaugggaggcugagccgguggagaggccucucagcauggccuccucuggcacccacgcccaggguccuuccccuccuagcuggccacaacucacuggggcaguggcccaagacagcccgucaccuggccugcucccuccccgggacacggcuccggcgccauccaugcccaccgcagacggugugcaacggugccugcugcccacaggguuuaugccccccgaccuuccccacagaggcguggacccuggcuguccguagggugagccuguguccuccacucccguccugccaggcggccuuggcugggacggggaggagcugccaccagcggggccagggcugcuacuaaccaguaaaucguguaggccucugcuugagcugggucuuggauauuugguucauuuagaaguuccuguauuccuaauaggaucugugccagagacaaaaacacaagacgggugugagcaguuugaaagggagacaccgugagacucggccucagccacagagaaugaccacagacccacguguccggaggggagacuaaggcagcccugccggugccagaggcggaggccccguaccuguuugauugugauggcuggccuccaguccuuguccuccucuaagauggacaggcacacuguccccgaaggguacacauucgggugaaauaauggugguucgaauuuaccuggaggaagaggaagaaaggaagcacuuuuuggaggcaggcacugucccagagucacguccuuccccacaucacccuccucccaacacuggggccccggguugguagccagguuauuuggccaaaaacuuuucaaaaaaauuaaauuguggccaugaggagacuaaaggaagacauauccaccuuugcacacagggaacagagccuuggggacacggccgcagccgagacgaagcugugucucucccaggacagaacucccagcacagccaggcagucugggaacacaggccccaggguggccacuuaaccuguggcccccacauccuuuccagcugggccagacucaggggagaugggaggagcugcaggagacguccagggacauagccaacgcccuuccagagucggcuguuccgacgcagacccucugcuuccaggauauacgggcuuuuaggacccuguguuauuucuuuacaaaaaagcagaaaaguuugccaccauuagccccaccagggaccaucacaguugauauucuaggcuauuucccaucuuuuaccugggcauccucccucuucucucucaaugcuacggaaggacacacagugcggcaugucuagugcagccggaggaauuaccagaaagccaacgcgccacgaacaccuacagcuuccccgaacacucgcuccuaccgaccacugcaucugccccguaaucccaacugcaacauccgcaggcagcuuccuggacuucagguaccauggagaugcacagggcacacucccuggggaacgcgaagacaccaccgcagaccgucccacaccgcgaccaucccacaccgcaggagcacacgggcgacaccagcagcugcguggcuguccugagugcgaacacgcgugagcgcgcugcuguggaauguggggugacgguguuggcccucaagccgugcugcuuccaggcugcucacgcaggcugcgucgcuggcggauuccagccaccgggugaggugcacggcagccacuccguggugcuacgcugcgccugcuggugaccgcugagcgccccuuucggcccaggcugcuuccuggcgacugcuucgcagaaguuccucaagcgauacgucuuacagggcucuucugcuuggggcuugacuuuuugcuuuuuuaauuuuuugagauggaguuucacuguggugcccaggcuggaucucggcucacugcagccuucaccucccgggcucaagugauucucccgccucaccuuggccuccagaguagcugagguuacaggcacccgccaucaagcuuggccaauuuuucuauuuuauuagaaccgggguuccuccacuguuggucaggcuggucucaaacuccugaccuuaagugauucacuugccuuggccucccaaagugcugggaucacaggugugagccaacgcgcccggcccgaccuuuuccucuucuaagggaaucuuuuggcaaaaacaaaaauugccuaauuucaauuuaaucugauucucaaucucguuucuucugccgaucacaacuuacccgcagaaaggcacagaugcuggaugccagcacugccagguccaccugucccucccaagguagaggcugccuccuacuuccucauggccuccggcuuggccgcucccgcgcuucaaagaaggaacacaaagggggugcccuccugucuggacuguccgccaggcaucauguggccucuucacucuucccuaccugucauccuaggacgucugggcuggggcaagugggggugacaccggcacccaucugugccucugguggacacauguaugugcuucugugaaucucgacugacucaagugaacagccagguccuacagcaugagcucagcuuccacugguguggcaggcagcguccaggggaaacguucagaacauccgcucucuccagcgguggcugaggcucccgcugcccugcgccgcggcuccgucugcuccccugugcgcuacggcagaucccacuggggaggcuuucacucuuuggcaaagccaggcaucccugccgcauuugcuggcuggguggaggccuuuccugugagggacacgcuggacgucauggcagccuucuuacugauucccaggagcucuugguagauucagggugagggcugagguacguacauacacuguagugugcccuccugcccggcgccaacugcagucuuuaugauaaagagagauucuuaauuucaacuuagucaacucgucaaucucccuccggccagcacuucacugcaucccuggugaagagaucccugccugcccagggcucacggacaccaucccgggucuuccucuccacgcuguccugcuugggcaccacaagccaucuggaagcuguuucucuauggugggaggcagagcucgucucuccugcuggaauaucccucaggugucacagcccaaaccaccacaugcguggccuccggacuccucguucuguccgcgggucugccugccugucuucucagcaagccugcagucuccaucaccgugucccguggcaggucuaguggggggugggugggugugcucugcacccacggagccucagccugggucucgccaccccaccaagaagccaaggccuccacguuucugcauuuccuggguccaugggacaguuuccaacaagaugugcuugacuccaacugggaucacauggaaucugcagacgagccuggagagaagggcugucuguacaaugucguguguuccccuccacacacacggcagagcucagcuaccgcucaggccggccuugguuucccuugcaauauucuacaguuuucgguacagagguccugaaccaaucuuuuauugcauuuauuccaacguauuucaugcuacuauaaauggcaguuuuaaaaccuugcucgcugaaaugauauaaaagcagauuuguguaccucaaucucgacuucauuuuuauauuuauuauuuagcuuuguuuccuuuaccagguccugugcuacuuuucuuuucuuuuuuuuuuuuugagacagggucuugcccugcugcccaggcuggaguguaguggcgcgaucucggcucacuggacccgccuccuggauucaagcacuucuccugccucagccucccgagcagcugggauuaaaggcacccaccaccacacccgcuaauuuuuguuuguuuguuuguuuuuuuuaguagagacaggguuucaccauguuguccaggcuggucuucaccucaggugauccucccaccucggccuccaaaagugcugggauuccaggugugagccaccgugcccagccuugcaccucagcuuuacugagcuguuguccuggccuuccuccccaccucuuccguugugacuucuuuuucuugucuugcugcauuugcuuggaauuccaaucaacgguugaacagaaucaaugaaagcagcuacugugucucauucuuauauuuuucuuaauuaaaauaagucaucuuaaguaauaccugcucaugguuuaaaaaaaaaaucaaacagcaaaggacaauccaaaaaugaagcaagucucgaccagcuggugcugucagcaguccucaagcuccucuggucacugccacuguggaaaacacuugugugucuugagugacaauugcaguggaagcuuuuacacagcacucucgccucaccguggccaggcgcugucuaggugcugggcacguguuaaugcguggaacucaccacagaaagggccugccgauuuccagcuaugggacggcagggacguggcggcccucuccucccucuccugaguuuugcugaacugacugagaucacuaacuuagcuguaggcucaaagucgaaccuggccucagcccuuucuucucgcgccuucucugcugcuccccugcucuaugccugcccggcugcagacgcagccccgggugggagagacugcgagagcccacaggaagagcagugagguggggcaagauaaacccuccagugagacucggagugguggcgcuucugcacguccaucccauccagggcuggggucuugugggcaccaaauccugucuucaucgccaacaaucacugaggguccaggcacuccuagcccaggagcuccagccuggaucucacagccucucccugcaaaggacucuggagcuucccagccaauuagcugggaugagagacuaagucuauuacgugcaccgcccacccguggagcuggaaacagacucgcaucugcagccugaggcggggaucagggaucaaagccgaccuccaaaucugugaucucacucccucccagcuccauggaucgcccggaccagggcgccacggccacagccacgggccucuuuggagaggacuccaauccccgcaggaacaggccgacuuccaggacacugaacagggagcuacuuacauuuugguggcgaagauggauaaucaucuuugaaaagcauccguaguuuaaacaagccuccuucccacggagucuguggggaaauaaaccguggugagaugggcugcuugccugccgcaggccggcccaggaggaaggggaucgcuucuaggacacaaccuccaggacugcgaggacaccgggggccagaggcccgacagaggcggcucccauaccagccugaagccuggaccagccccaccaagggggcggucaggaccucugccaugcccagagagugagucggaaaggcccuccuggaaaggagaggaggagacgggggucgggggcugggcuggggggcaacgagugccgcacacuggggccggcagcgccaagagcacacccgugcccucaccccaggguguucugcaagccccugccccaggucccgccuggaugaggcgccuuugccaccccacaacccgacaccacucccgucuuccuuggggccgcgcgcgcaccugccucgccguaaugugaagggcaagggacguucucagcagagccucagacaagugacaaauccaagccacauccugucucgggcaaagcugaguccugcugggacugcucagcucagggggccggagcugcugugaguuucagagcgaaacccagaggcuggcaugggccggagggaacaaggccucgggcaggaccaacaccucagggaucucuccuuccuucagaguccacgagcaugaaccuuaugugcaagccggccuggagucccuggccaagcacuucaugugagccgggcaaagaggacaggcacaugggccgcccugcuugccacagacacacggggccccaagcaggcauccuagguggcugccgccagucccugugccccaggagguucuccaguagacgguuuuaggccgggguggcucuccugcaaacccagcucccgcgaccugagccacaccuggaaggacacagcagaaucccggguuccagcacgcaaaggcugcccgccccucaggccugcucccaacacacaucagagccccuuccccucugccacagcucagcccugugcccggccaggcccagccugcuuccuucucaaccagaaaugcccucgguagggacacagcugucaccccaaccuugccagcaccaccuucugagcucaaguccucacggggcgggggccaggccacagcuggggaucugagcuguugaccgcggccugugacaaggguggccgucacggacggcagggaucugagcggaguauccccauggcacugccgcacgcaucugcugagccccgacaggcaggaggccggcagcgccccuuaccccuuucuuuccuggaauggcgcacucccaguucaugagguucaucgugccaucgggauuuuuuguugggacagccacgaaacccugagagaaaagaaaacaaccacaaaagcauaucagcguggcggcaucuaguuugagcaaaaccaccaagaaccggccugcgagucccaccggcccagcccaggcacgcgaccagcucccucccaguagggagggcgcgguuucagccgagggagccuguccgcggcacugcacacagaaaugaagcccuccuuacaaauggguggucuuuccuccaugcuuuccucuccugggcgagucugcugagggcgauccccgacauguucaaagucccuggaacacaggaggcagagcacggggucaggagaggcgagcgggcuccugccaccccagcacgcgcacguggcccgcagcaggcaggcuugcuccuaacauacgguggccuggcccagcagggacucucuucuugcaagccgucguccgaccccgggggucuaccaggggaggccuugugagcggcgcccagaucaccgggaggcgggggcagguaggaccccuccccauggccccaacccagcccuggucugcgacacaugcugcggccucugcucgaaggugaggagacagauguucagaggcugggccgcugcggcugggggguagcugccacccugugguggcugacauggcaggguccucaccauaccaucagguggggacuaggcagggcuggggccccagauggauguggggugcugggucccugccuuaguaucaggcgcucagaacugagacucaggcugggccaggggacaccuguuauucuuuuuuuuuuuuuuuuuuuuuuuuuuugagacagagucucauucuauugcucaggcuggaaugcaguggcacgaucucggcucacugcaaccuccgccuccugaguucaagcaauucuccugccucagccucccgaguagcugagacuacaggcgugugccaccacgcccagcuaauuuuuguauuuuuaguagagauaggguuucaccauguugaagacagagcagaacaaguaccacagggcagaggcucagccucacugagagaggagcccuccacggggacacccuucccagaccgugcagccacuaccacgucccuguggcuucaggggacagacggguccugcagggcagggcaggagcaugggguaggggaccaggucccugaucagaggcagcggcacacacgccagauuccagcuccacacaucugcacgggaccucgggggcuuggcaccuucgccuuugcguucucggcgggagccugucggccagcacugucacuggggacaccaggcagacagggccagcagccucaaugccacccucaacugucacccuacugguggccaccuuuacccacgaaaaacagcgcucaagauacaaaacuugcccaagaauucaaaccuaagugugugcugguuuucaaaguccaugggaacacugaagcuacuacccccaagucugauaucucaacaccaaacaagagccaccucuacaaagcugggggacugagccaggucuucuaagcuguggggggccgucccuacuacggcuugggcuguccuagaauagccacaagggcccuggggaccuggauggcucccacaccuguggaggcccacgaaccucacacaccucgcagccgcagaaaggggccaggucagcagcuccaccugcgucggagccgccgcagccucaccuggcacucguuagggagacaaggcccaguccccggcagacccacggacgaaggagcucugagaggcccgcacucagguucuggguggcacgaugacuuccccagucagcagagcagaaaucgggggugggguugggaucaaagaagccaaggcagguccagugucgccagggcaccaggcuucugaagcugcuagagccgccugcccugcaggugaauuuggcuccuuuucaccaaacacagauccucagggcagccugagaaaaagcaggcgaaggaaccuggguccuccagucagcaggcgcuggcgucacagcgagagggugacaggggccagccgggcacuggccuccagguccacgacuaaguccaagacaggcagcccgggcuggaggcagccccagaccgggccccaccgggauguccuuccccacgcccuccucacaugaugcagaggagcccgcaggccgcccgcccucuggaccguuugcccuuccccgugcccuccucuaagugagggggggggagccaggggccagacagggagaaaguggggggcacagcuauggucaggcaggguucgagcccagagcggaguggagcgcccgccaaccacgguuucaaggcugucuccgcacugggcuggacuccgaaacuccacacguuccuccacccuccacucccacguggagcagcccagcugcgacuugaggacucacagcucucgcuuccccagccccaggaugggcuuccugaguggccgcagccugugcccggugcggugcaaagcagccuggcgaguggccauuucaaggaggcacgaccucccaggugcccggggucugagcgaggccaggcaucaggcaagucucugaagccucaggccagugcuccagacacugaaggaccaugggcaaggcuauccucacagccaggcaaggccaggccacagagaggccagacgggccugggacccugccacaggcagcccuccugcugaggacuggacagagccgccuagaggcccccgucccagcaccuagcuauugcugucucaggugugagaagucgugaggggugguccugcgagaccuccugccaagaccuggcugcugcugcuguguccccugccccaaagcacucagcaccacgggguggucucacaggcacugcaccgccagggcaaggagccacaggugcacacccaccgugucccagacagaagccaggccccucccccugcacccccuccuacuggccuucuggagaaagcggccaaucuguuacaauguaaucacaacacagaucaagcguucaaaauuccgcugaaaaucgaauuugcccuuccaaauucacagauaggcacuuagugaacggcuaguaguuacuaaacgcuucagagcaagaaacuuuuaugaugcaaagacaaaaacaacccucaucuauuagagccaggcaaggcccagacacugcagaaacggggacagggccgggcacuccaggagcggcccgaaagucugccuucuguccuccugcugggcgcccgcaaccggcugagcuuuagcuucucggaucaccgccuugcucugcugguugacagcaccgacuucagagcaacuuccuggcugagggugagcaaagcacucaccucccacaacuccaccgcacugaucuccacaacggguggucgccacgacaggcuggcacaagaagccuuuaaaggcccuccugcacccaaaugcaaacucucccaggcuuggggagguauucccuucugcaagacccaagcaccugcagucgggagacgcuuaccuggccgcaccugaucugccccaggccccgagaauguuucugaagcaagaucccaaacccugagacaccauacaagcgcacaccagcaaucacccaguggccuagggaacggaccucucugaaugagcaaucagggcaaacugaggauccgucccgucuuccguugcauagguucucuacccaaaggcaacguuucuugaagagcaagaaacacuugggguagguccuguaaaaggaaacaaaccgaacuccccaaagacaggcacuuugcaaacagagaaacuaagcguaacuuccaauuauacaaacaaaaccacuucauucugcgauucaagcgugacuacaggccacgaucacaagcccaacuaaucauucccuuacauuccuccuacgcacguuaacuaccagaaccaacuacuauucaaccgauaaaaagagauguccaaaacagaauaaaacucccccuccagcgaggcgcucacguucagggccccagcaagcgccagcggagcaucuucagaggcacaagaaaacuuacacuuguuuugguuuuaaggcaccgaaaacaagcccgcucgccggcccccacccccgcgagccagcgauguugcaauccaagacucuccccccgcggcccauccuauccguccgcggggcgaccgugaccccggaagccgcuccccgcgcaggaggaaggcgcggccucgcggggccccggcugcagguggcugccccggccccgcgccaggcgcaccucgggggcgaagugggggagccccggccccgaaggccugcggcggcccggccgcucgggccgcagcccagcggcgccagcagcgcggaccgagccggcgccgagcgcggggccucucgggcuccccggaaagcucggccgcggcgcggggcccggcucggcggggcggggcgcggggcagucgggggcccgggcccaacaggaguagaggccucggcccgacccccgccccgcggccccggcccggcccccgcacgcgcucaccucgggcggccgcagccccggcgagcguagcggacagguggaggaccgagcggggcggcggcggcggcgcuucccuuugucucgggacuucccuccggagcccgcuccgcgcgcagccagagcagcuccgaggacccuggcgcgggc

SEQ ID NO: 192674 - RNA, 17392 nt, Homo sapiens
gcccgcgccaggguccucggagcugcucuggcugcgcgcggagcgggcuccggagggaagucccgagacaaagggaagcgccgccgccgccgccccgcucgguccuccaccuguccgcuacgcucgccggggcugcggccgcccgaggugagcgcgugcgggggccgggccggggccgcggggcgggggucgggccgaggccucuacuccuguugggcccgggcccccgacugccccgcgccccgccccgccgagccgggccccgcgccgcggccgagcuuuccggggagcccgagaggccccgcgcucggcgccggcucgguccgcgcugcuggcgccgcugggcugcggcccgagcggccgggccgccgcaggccuucggggccggggcucccccacuucgcccccgaggugcgccuggcgcggggccggggcagccaccugcagccggggccccgcgaggccgcgccuuccuccugcgcggggagcggcuuccggggucacggucgccccgcggacggauaggaugggccgcggggggagagucuuggauugcaacaucgcuggcucgcgggggugggggccggcgagcgggcuuguuuucggugccuuaaaaccaaaacaaguguaaguuuucuugugccucugaagaugcuccgcuggcgcuugcuggggcccugaacgugagcgccucgcuggagggggaguuuuauucuguuuuggacaucucuuuuuaucgguugaauaguaguugguucugguaguuaacgugcguaggaggaauguaagggaaugauuaguugggcuugugaucguggccuguagucacgcuugaaucgcagaaugaagugguuuuguuuguauaauuggaaguuacgcuuaguuucucuguuugcaaagugccugucuuuggggaguucgguuuguuuccuuuuacaggaccuaccccaaguguuucuugcucuucaagaaacguugccuuuggguagagaaccuaugcaacggaagacgggacggauccucaguuugcccugauugcucauucagagagguccguucccuaggccacugggugauugcuggugugcgcuuguauggugucucaggguuugggaucuugcuucagaaacauucucggggccuggggcagaucaggugcggccagguaagcgucucccgacugcaggugcuugggucuugcagaagggaauaccuccccaagccugggagaguuugcauuugggugcaggagggccuuuaaaggcuucuugugccagccugucguggcgaccacccguuguggagaucagugcgguggaguugugggaggugagugcuuugcucacccucagccaggaaguugcucugaagucggugcugucaaccagcagagcaaggcggugauccgagaagcuaaagcucagccgguugcgggcgcccagcaggaggacagaaggcagacuuucgggccgcuccuggagugcccggcccuguccccguuucugcagugucugggccuugccuggcucuaauagaugaggguuguuuuugucuuugcaucauaaaaguuucuugcucugaagcguuuaguaacuacuagccguucacuaagugccuaucugugaauuuggaagggcaaauucgauuuucagcggaauuuugaacgcuugaucuguguugugauuacauuguaacagauuggccgcuuucuccagaaggccaguaggagggggugcagggggaggggccuggcuucugucugggacacggugggugugcaccuguggcuccuugcccuggcggugcagugccugugagaccaccccguggugcugagugcuuuggggcaggggacacagcagcagcagccaggucuuggcaggaggucucgcaggaccaccccucacgacuucucacaccugagacagcaauagcuaggugcugggacgggggccucuaggcggcucuguccaguccucagcaggagggcugccuguggcagggucccaggcccgucuggccucucuguggccuggccuugccuggcugugaggauagccuugcccaugguccuucagugucuggagcacuggccugaggcuucagagacuugccugaugccuggccucgcucagaccccgggcaccugggaggucgugccuccuugaaauggccacucgccaggcugcuuugcaccgcaccgggcacaggcugcggccacucaggaagcccauccuggggcuggggaagcgagagcugugaguccucaagucgcagcugggcugcuccacgugggaguggaggguggaggaacguguggaguuucggaguccagcccagugcggagacagccuugaaaccgugguuggcgggcgcuccacuccgcucugggcucgaacccugccugaccauagcugugccccccacuuucucccugucuggccccuggcucccccccccucacuuagaggagggcacggggaagggcaaacgguccagagggcgggcggccugcgggcuccucugcaucaugugaggagggcguggggaaggacaucccgguggggcccggucuggggcugccuccagcccgggcugccugucuuggacuuagucguggaccuggaggccagugcccggcuggccccugucacccucucgcugugacgccagcgccugcugacuggaggacccagguuccuucgccugcuuuuucucaggcugcccugaggaucuguguuuggugaaaaggagccaaauucaccugcagggcaggcggcucuagcagcuucagaagccuggugcccuggcgacacuggaccugccuuggcuucuuugaucccaaccccacccccgauuucugcucugcugacuggggaagucaucgugccacccagaaccugagugcgggccucucagagcuccuucguccgugggucugccggggacugggccuugucucccuaacgagugccaggugaggcugcggcggcuccgacgcagguggagcugcugaccuggccccuuucugcggcugcgaggugugugagguucgugggccuccacaggugugggagccauccagguccccagggcccuuguggcuauucuaggacagcccaagccguaguagggacggccccccacagcuuagaagaccuggcucagucccccagcuuuguagagguggcucuuguuugguguugagauaucagacuuggggguaguagcuucaguguucccauggacuuugaaaaccagcacacacuuagguuugaauucuugggcaaguuuuguaucuugagcgcuguuuuucguggguaaagguggccaccaguagggugacaguugaggguggcauugaggcugcuggcccugucugccugguguccccagugacagugcuggccgacaggcucccgccgagaacgcaaaggcgaaggugccaagcccccgaggucccgugcagauguguggagcuggaaucuggcgugugugccgcugccucugaucagggaccugguccccuaccccaugcuccugcccugcccugcaggacccgucuguccccugaagccacagggacgugguaguggcugcacggucugggaaggguguccccguggagggcuccucucucagugaggcugagccucugcccugugguacuuguucugcucugucuucaacauggugaaacccuaucucuacuaaaaauacaaaaauuagcugggcgugguggcacacgccuguagucucagcuacucgggaggcugaggcaggagaauugcuugaacucaggaggcggagguugcagugagccgagaucgugccacugcauuccagccugagcaauagaaugagacucugucucaaaaaaaaaaaaaaaaaaaaaaaaaaagaauaacagguguccccuggcccagccugagucucaguucugagcgccugauacuaaggcagggacccagcaccccacauccaucuggggccccagcccugccuaguccccaccugaugguauggugaggacccugccaugucagccaccacaggguggcagcuaccccccagccgcagcggcccagccucugaacaucugucuccucaccuucgagcagaggccgcagcaugugucgcagaccagggcuggguuggggccauggggagggguccuaccugcccccgccucccggugaucugggcgccgcucacaaggccuccccugguagacccccggggucggacgacggcuugcaagaagagagucccugcugggccaggccaccguauguuaggagcaagccugccugcugcgggccacgugcgcgugcugggguggcaggagcccgcucgccucuccugaccccgugcucugccuccuguguuccagggacuuugaacaugucggggaucgcccucagcagacucgcccaggagaggaaagcauggaggaaagaccacccauuuguaaggagggcuucauuucugugugcagugccgcggacaggcucccucggcugaaaccgcgcccucccuacugggagggagcuggucgcgugccugggcugggccggugggacucgcaggccgguucuuggugguuuugcucaaacuagaugccgccacgcugauaugcuuuugugguuguuuucuuuucucucaggguuucguggcugucccaacaaaaaaucccgauggcacgaugaaccucaugaacugggagugcgccauuccaggaaagaaagggguaaggggcgcugccggccuccugccugucggggcucagcagaugcgugcggcagugccauggggauacuccgcucagaucccugccguccgugacggccacccuugucacaggccgcggucaacagcucagauccccagcuguggccuggcccccgccccgugaggacuugagcucagaagguggugcuggcaagguuggggugacagcugugucccuaccgagggcauuucugguugagaaggaagcaggcugggccuggccgggcacagggcugagcuguggcagaggggaaggggcucugauguguguugggagcaggccugaggggcgggcagccuuugcgugcuggaacccgggauucugcuguguccuuccagguguggcucaggucgcgggagcuggguuugcaggagagccaccccggccuaaaaccgucuacuggagaaccuccuggggcacagggacuggcggcagccaccuaggaugccugcuuggggccccgugugucuguggcaagcagggcggcccaugugccuguccucuuugcccggcucacaugaagugcuuggccagggacuccaggccggcuugcacauaagguucaugcucguggacucugaaggaaggagagaucccugagguguugguccugcccgaggccuuguucccuccggcccaugccagccucuggguuucgcucugaaacucacagcagcuccggcccccugagcugagcagucccagcaggacucagcuuugcccgagacaggauguggcuuggauuugucacuugucugaggcucugcugagaacgucccuugcccuucacauuacggcgaggcaggugcgcgcgcggccccaaggaagacgggaguggugucggguugugggguggcaaaggcgccucauccaggcgggaccuggggcaggggcuugcagaacacccuggggugagggcacgggugugcucuuggcgcugccggccccagugugcggcacucguugccccccagcccagcccccgacccccgucuccuccucuccuuuccaggagggccuuuccgacucacucucugggcauggcagagguccugaccgcccccuugguggggcugguccaggcuucaggcugguaugggagccgccucugucgggccucuggcccccgguguccucgcaguccuggagguuguguccuagaagcgauccccuuccuccugggccggccugcggcaggcaagcagcccaucucaccacgguuuauuuccccacagacuccgugggaaggaggcuuguuuaaacuacggaugcuuuucaaagaugauuauccaucuucgccaccaaaauguaaguagcucccuguucaguguccuggaagucggccuguuccugcggggauuggaguccucuccaaagaggcccguggcuguggccguggcgcccugguccgggcgauccauggagcugggagggagugagaucacagauuuggaggucggcuuugaucccugauccccgccucaggcugcagaugcgagucuguuuccagcuccacgggugggcggugcacguaauagacuuagucucucaucccagcuaauuggcugggaagcuccagaguccuuugcagggagaggcugugagauccaggcuggagcuccugggcuaggagugccuggacccucagugauuguuggcgaugaagacaggauuuggugcccacaagaccccagcccuggaugggauggacgugcagaagcgccaccacuccgagucucacuggaggguuuaucuugccccaccucacugcucuuccugugggcucucgcagucucucccacccggggcugcgucugcagccgggcaggcauagagcaggggagcagcagagaaggcgcgagaagaaagggcugaggccagguucgacuuugagccuacagcuaaguuagugaucucagucaguucagcaaaacucaggagagggaggagagggccgccacgucccugccgucccauagcuggaaaucggcaggcccuuucuguggugaguuccacgcauuaacacgugcccagcaccuagacagcgccuggccacggugaggcgagagugcuguguaaaagcuuccacugcaauugucacucaagacacacaaguguuuuccacaguggcagugaccagaggagcuugaggacugcugacagcaccagcuggucgagacuugcuucauuuuuggauuguccuuugcuguuugauuuuuuuuuuaaaccaugagcagguauuacuuaagaugacuuauuuuaauuaagaaaaauauaagaaugagacacaguagcugcuuucauugauucuguucaaccguugauuggaauuccaagcaaaugcagcaagacaagaaaaagaagucacaacggaagagguggggaggaaggccaggacaacagcucaguaaagcugaggugcaaggcugggcacgguggcucacaccuggaaucccagcacuuuuggaggccgaggugggaggaucaccugaggugaagaccagccuggacaacauggugaaacccugucucuacuaaaaaaaacaaacaaacaaacaaaaauuagcgggugugguggugggugccuuuaaucccagcugcucgggaggcugaggcaggagaagugcuugaauccaggaggcggguccagugagccgagaucgcgccacuacacuccagccugggcagcagggcaagacccugucucaaaaaaaaaaaaagaaaagaaaaguagcacaggaccugguaaaggaaacaaagcuaaauaauaaauauaaaaaugaagucgagauugagguacacaaaucugcuuuuauaucauuucagcgagcaagguuuuaaaacugccauuuauaguagcaugaaauacguuggaauaaaugcaauaaaagauugguucaggaccucuguaccgaaaacuguagaauauugcaagggaaaccaaggccggccugagcgguagcugagcucugccguguguguggaggggaacacacgacauuguacagacagcccuucucuccaggcucgucugcagauuccaugugaucccaguuggagucaagcacaucuuguuggaaacugucccauggacccaggaaaugcagaaacguggaggccuuggcuucuuggugggguggcgagacccaggcugaggcuccgugggugcagagcacacccacccaccccccacuagaccugccacgggacacggugauggagacugcaggcuugcugagaagacaggcaggcagacccgcggacagaacgaggaguccggaggccacgcauguggugguuugggcugugacaccugagggauauuccagcaggagagacgagcucugccucccaccauagagaaacagcuuccagauggcuuguggugcccaagcaggacagcguggagaggaagacccgggaugguguccgugagcccugggcaggcagggaucucuucaccagggaugcagugaagugcuggccggagggagauugacgaguugacuaaguugaaauuaagaaucucucuuuaucauaaagacugcaguuggcgccgggcaggagggcacacuacaguguauguacguaccucagcccucacccugaaucuaccaagagcuccugggaaucaguaagaaggcugccaugacguccagcgugucccucacaggaaaggccuccacccagccagcaaaugcggcagggaugccuggcuuugccaaagagugaaagccuccccagugggaucugccguagcgcacaggggagcagacggagccgcggcgcagggcagcgggagccucagccaccgcuggagagagcggauguucugaacguuuccccuggacgcugccugccacaccaguggaagcugagcucaugcuguaggaccuggcuguucacuugagucagucgagauucacagaagcacauacauguguccaccagaggcacagaugggugccggugucacccccacuugccccagcccagacguccuaggaugacagguagggaagagugaagaggccacaugaugccuggcggacaguccagacaggagggcacccccuuuguguuccuucuuugaagcgcgggagcggccaagccggaggccaugaggaaguaggaggcagccucuaccuugggagggacagguggaccuggcagugcuggcauccagcaucugugccuuucugcggguaaguugugaucggcagaagaaacgagauugagaaucagauuaaauugaaauuaggcaauuuuuguuuuugccaaaagauucccuuagaagaggaaaaggucgggccgggcgcguuggcucacaccugugaucccagcacuuugggaggccaaggcaagugaaucacuuaaggucaggaguuugagaccagccugaccaacaguggaggaaccccgguucuaauaaaauagaaaaauuggccaagcuugauggcgggugccuguaaccucagcuacucuggaggccaaggugaggcgggagaaucacuugagcccgggaggugaaggcugcagugagccgagauccagccugggcaccacagugaaacuccaucucaaaaaauuaaaaaagcaaaaagucaagccccaagcagaagagcccuguaagacguaucgcuugaggaacuucugcgaagcagucgccaggaagcagccugggccgaaaggggcgcucagcggucaccagcaggcgcagcguagcaccacggaguggcugccgugcaccucacccgguggcuggaauccgccagcgacgcagccugcgugagcagccuggaagcagcacggcuugagggccaacaccgucaccccacauuccacagcagcgcgcucacgcguguucgcacucaggacagccacgcagcugcuggugucgcccgugugcuccugcggugugggauggucgcggugugggacggucugcgguggugucuucgcguuccccagggagugugcccugugcaucuccaugguaccugaaguccaggaagcugccugcggauguugcaguugggauuacggggcagaugcaguggucgguaggagcgaguguucggggaagcuguagguguucguggcgcguuggcuuucugguaauuccuccggcugcacuagacaugccgcacuguguguccuuccguagcauugagagagaagagggaggaugcccagguaaaagaugggaaauagccuagaauaucaacugugauggucccugguggggcuaaugguggcaaacuuuucugcuuuuuuguaaagaaauaacacaggguccuaaaagcccguauauccuggaagcagagggucugcgucggaacagccgacucuggaagggcguuggcuaugucccuggacgucuccugcagcuccucccaucuccccugagucuggcccagcuggaaaggaugugggggccacagguuaaguggccacccuggggccuguguucccagacugccuggcugugcugggaguucuguccugggagagacacagcuucgucucggcugcggccguguccccaaggcucuguucccugugugcaaagguggauaugucuuccuuuagucuccucauggccacaauuuaauuuuuuugaaaaguuuuuggccaaauaaccuggcuaccaacccggggccccaguguugggaggagggugauguggggaaggacgugacucugggacagugccugccuccaaaaagugcuuccuuucuuccucuuccuccagguaaauucgaaccaccauuauuucacccgaauguguacccuucggggacagugugccuguccaucuuagaggaggacaaggacuggaggccagccaucacaaucaaacagguacggggccuccgccucuggcaccggcagggcugccuuagucuccccuccggacacgugggucuguggucauucucuguggcugaggccgagucucacggugucucccuuucaaacugcucacacccgucuuguguuuuugucucuggcacagauccuauuaggaauacaggaacuucuaaaugaaccaaauauccaagacccagcucaagcagaggccuacacgauuuacugguuaguagcagcccuggccccgcugguggcagcuccuccccgucccagccaaggccgccuggcaggacgggaguggaggacacaggcucacccuacggacagccaggguccacgccucuguggggaaggucggggggcauaaacccugugggcagcaggcaccguugcacaccgucugcggugggcauggauggcgccggagccgugucccggggagggagcaggccaggugacgggcugucuugggccacugccccagugaguuguggccagcuaggaggggaaggacccugggcgugggugccagaggaggccaugcugagaggccucuccaccggcucagccucccauggaccccagccucccgcgccgcccuugcugcuuguccccauccccucuacaacuugguuccuucugugggggggcccagcccagcagggcucagugacgugaugcugucacacggacccugggcuuccacccugucccugugaggugcugcuguggcuagaaggguccccgugggccugggguccugucugcaccgaggagggccuggugugaguuaggaugcagacgacagccaaacagugcuggggaaagcagggaggacccugcccugagcagaggccaugcgcccgccuguccuguucccucugcagcuguucugggcagguccauaagaagguggguuggggccuccgaccccccacugcuccgccugcagcguugagaaacccagccccaucucaccacggguccccacaccucugagggggucucagggcccccaauggccagggacccagaaggcucaccugcagccaccccacacaucccugccacugugggcaucagaggcccucucccuccagggugcaucuccuggucaggaggggggaggcugaggggucccgguugccuuaggcccggccugcacaggucgugaggaaaagcaccugguuucggccgggcgcaguggcucacgcuuguaaucccagcacuuugggaggccgaggugggugaaucaugcggucaggaguucgagaccagccuggccaacauggcgaaacccucgucccuacuaaaaauacaaaaaauuaguugggcguaguggugggugccucuaaucccagcuaccugggaggcugagacaggagaaucacuugaacccgggaggcggaaguugcagugagccgagauccugccacugcucuccagccuggcgacggaggaaugcugucucaaaaaaaaaaaaagcacgugguuuuggagagauguguuucucccuggaugcgggcccagcccaggugucugcaaggugcccucccugguggccgaggguggcacagaggccccaggcagggagcaaguaucacagcagccaccccaggcucagccuggcuccccugcaugguggugcacaccuguagucccagcuauuugggaggcugaggugggaggacugcuugagcccaggagguugaugcgcagugaguugagauugcagcaccgcaauccagccugcuugacaaagcgagacccugucucaaaaaaaaaaaaaaacucauagccgcucagucagccaagccauugcuggaaguggcucgugggacguggcgugaccuggguuugugugcuggccugcugugcccuaggaguccgugaaaugcauucccuuggacaggaagccacagugcucguggguguccacauggcccuugaggcagaaaauguuuucuuuuuuuuuuuuuuuuuuuuuuuuaaacagagucucacucugucgcccaggcuggagugcaguggugugaucucagcucacuacaaccucugccuccuggguucaagugauucuccugccucagccucccaaguagcugggauuacaggcacccaccaccacaccugacuaauuuuuguauuuuuaguaaagacaguguuucaccacguuggccaggcuggucucgaacuucugaccucaggugauccacccgccucgccucccaaagugccgggauuauaggcaugagccaccgugccuggaaaaugauuucuaggccaagugugguggcccaacaccuguaaucucaacacuuugggaggccaaggugggcugauugcuugaacucaggaguucaugacuagacugggcaacauagcgagacccuaucucuacaaaaaauuaaaaaauuugccaggggugguggcucaugccuguaaucccagcacuuugcaaggccacugugggacguuaccugagcccaggaguuggagaccagccugggccacauggcaagaccugcucucuuuaaaaaaaaaaaaaaaaaaaaaauuaagccggggaugauggugcaugccuguagucccagcuauuugggaggcugaggugggaggacugcuugagcccaggugguugaugcugcagugagccaagauugcagccugggugacaaagugagacccugucucaaaaaaaaaaaaaaaagcaugccgggcgcgguggcucacgccuguaaucccagcacuuugggaggccaaggugggcagaucacgaggucaggagauugagaccauccuggcuaacacggugaaaccccaucucuaguaaaaauaaaaaaaauuagccgggcgugguggcgcacaccuguaaccccagcuacucgggaggcugaggcaggagaauggcuugaaccugggaggcggagcuuacagugagccgagaucacgccacugcacuccagccugggcaacagagccagacucugucucaaaaaaacaaaacaaaaggcaaauguuuuccugccuagcccuuagauggucugccauccccagcauggugugggcgugagcucugucuggccugcaccccauuugccgaccaucuccagagcugggcuguggcucccaucugcggcgugggcugggcaggguugcagucccccgccccgugugacucuccccagcgucuccugggcuuggugccugcugggcugcacuguacacuugcgugcacguaaacaaacguucuuucuccuacacacauccgcuugaaaagcacccuuugugaagcaugugugcggguuucagaucguuuuuccuggguuuccuggaggccuuggaccguguuccugcccuggcaggugccuuuucucggggccucugcuuggucaaggaagagcugggacguguagccaccgccucugguuccuuccacgcccacccagcugagcugcucugcccuggggccggcugguggcccaaggagggcgcuggggucugggcugcgguccaggcccuuggcguggguggggguggcaccggcgcugcugccguccugggcuguuccaccaugcagagugaggcucagugucucagaccagguccaauccuggcgagacuggcaggacugcgaccccaggagccaccuccauaaaugucaugguguucccccauccucagggucacacugcacccugugacccaucagccccuaggugcagccucggccgcccucccgcccaccuguuuugcccgggcagugugugccaugccacucuccugggcagcugcuugcaggcugagccucacucuacccagcuccagaccuguucgcugaugccccugcacugcccagcucgggcacaacgccuucucaaccaggccugccuucccacaccuuugccccugcggcugagagccucauggaaaaacccuccagaaauuggugucuauuuuugggaauuaacaaaaacaguggcaagcagucaguguuuucaguuuauuaggacuguccccagaccuacagaaaagagaagcugcugauuacuaguuaggaccagacuuggcaucggcaacgauguugcaggcccuggcgugggcccucugggccugagcccuccucgcagcccugcgggaccccucugucccccuugaacaccacguucacccagcguggguuccucuccucccugcccuucugcccccgucagaccacgggacagucucagccacgucagagccagcaugggcuccccaccacgcaggccucccugcuucuccgggcuucugcuucuguuacuaugacgagcuccacacugcccucccccaggaggucccauccugcagccuggucugcccagcuggcuccggggcgagcgugagggccaggcagcucagcccucuaacacgucucuucucuuuugaccuccucagccaaaacagaguggaguacgagaaaaggguccgagcacaagccaagaaguuugcgcccucauaagcagcgaccuuguggcaucgucaaaaggaagggauugguuuggcaagaacuuguuuacaacauuuuugcaaaucuaaaguugcuccauacaaugacuagucaccuggggggguugggcgggcgccaucuuccauugccgccgcgggugugcggucucgauucgcugaauugcccguuuccauacagggucucuuccuucggucuuuuguauuuuugauuguuauguaaaacucgcuuuuauuuuaauauugaugucaguauuucaacugcuguaaaauuauaaacuuuuauacuuggguaagucccccaggggcgaguuccucgcucugggaugcaggcaugcuucucaccgugcagagcugcacuuggccucagcuggcuguauggaaaugcacccucccuccugccgcuccucucuagaaccuucuagaaccugggcugugcugcuuuugagccucagaccccaggucagcaucucgguucugcgccacuuccuuuguguuuauauggcguuuugucuguguugcuguuuagaguaaauaaacuguuuauauaaagguuuugguugcauuauuaucauugaaagugagaggaggcggccucccagugcccggcccuccccacccaccugcagccccaccgcgggccaggaccaggcucuccaucugcuucggaugcacgcaggcugugaggcucugucuugcccuggaucuuuguaaacagggcuguguacaaagugcugcugagguuucugugcuccccgcaucugcgggcuguagagcgcugggcagcuaagaucugcauaggucgggauuggcaucgagacccuggcaacugcaccggugccagcugucuugggggccacaaggccagguccagaccagggcugggggcugccugaggacuccuauccgggcagccugcuggcggggguuccccucuucaguggccaggucacagggauggagcugcgcugugcauagggugccaccucaggugucugucccuuguguccucaggaggcagccuugcuaccacccguggcaaacgccaggugcuuuuucugggagagcccacagccguggcccuccagggcuuccccgacccuuagcgccagguagagggcccugggcagccugugucuggaauucuucguccugaggccaccugaguguggucuguccuggggaggcugugcgccucagcagccguccugacgcugagcccucugcaaagguugggccggccaggccucuuggggcugccugagccacugcaggaaguggccuggcugggaaguugggugccggucaccucccagcaggaaggcacaguggacagagaugggaagcccugggggacacagcccggugcucccagcccuccaaccucuggcucccaacccagucuccccauccuagcgagcuuggcccuccucaguuucguuucaagccuuggggcuggagcuggcccugcugcccuggcaccccccgguggcuggagcuggguccccguggcccaagugcagggucccaagagggcagggcggggcuccccaaaggagcaaagaaugcagggagggcgguccagggcccugggaaggggagcucggcacccuccagguccgugugggacuccagccgcuguuggcugggaaucgaaguuagaggugacuuccaaaggccccccgagccggcagugccccccaccaccccuccagcgacucugcggugccagugccuuguuggcuuuuccggcuacgcacccugcagucacugagcucucggucugacgucugauguuugugguuuguuuauaacacggggccuuaccuggggaauucagcugguuugaauauuuguagcccgcucccagaaugucuuauuuuguaaugacugaacuacauuuaguaauaguuacacauguauaugguuaauacauauggaaauucaauauauuuuguaguuaacguauucugaaguaacggauguuucucgccaaucguagugacuucagcuaacgaaauguucuuuuguaguaccacgguccucggccuaacgaaggacgugaaccuuguaagaggagagcucugaaacgcggucaccuuuguuuaguggaagggaaaguguguucccggcaugaggugccucggaauuaguaaagaauugugggcaauggauuaaccacuguaucuaagaauccaccauuaaagcauuugcacagac

SEQ ID NO: 192675 - RNA, 26781 nt, Homo sapiens
gccccgcggcugaggagcgggaggccguccgggcagcgcggccggcggcgagaggggccccgccgcucuccggaggcagaaguuguggaucggccggcgggggcgagcgggcccgggggccggggccgcgcugcccgggccgcgaggacgaggcggcgccgccgggcuguggaggugagucccgucggccgggcccggccgggcgcccagccggggaccccgggcggggagcgcgggcccggagggcggcggggagcgcgggcucggcggggcgcaggaggccucgggggccgggcgcgccgggcuccgagccagggcagggacggcagggcccccggaguggggucagcccgccgcccgcuggcgccuccaggcuggugggggccagggcugggcgaugcuucgcagaggaacccagaggaaggcgggaagucggcagggaccugggccaugugggucacuugaggccagccccgggggccgcgcacaccggaggcggccucggcccugccugcccuugagugcccuuauauccgggcccaucgugcgguccuggccgccuuagggauguugugcuuggugcgggcaucacuccccucacuuggggaacggccugggggcggccaccuggcguggaggggcuggcgggagccccgucugugccagccaugccaguguucucuuccguguuccucuggggcugcugcggcaccagcugggaaguugcaaaucugcuguccucccgcuggcugcagaaggggccccucuaguccugaccgggggaacucuuguguggucagcuggcccuggccgggcgagcucucggggcccccuuacugcucuggaguuuguuaccggacugcagguaacaagacccggaaagcaauggugaggcccagaaccugaggccaggccuggguguguggggccaguggggaagacugggacuccguugggugcugaagaguugugugcuucuccuucgggaaacccggaucucuuccucugcccaggucugaggggugcggaaacgugagucacaguucagugugggagugccccguaauugccuccgcguuuccagagucuggggcugggcaaggauauaggggugauucucccuuccgguucugagugacuucucaacugugaaguggggcaagagaaauuguuuuucuggccugucugggggaggcagguccugcaggaaaccagcuuggccuggccuuggguugggugugccuugccuccuccgagguccuucugcuugcgggaggagcaccccucuuuuuccugcuucugucugugucugaggcucuccagagcuccuugauuggcagaggagccagugaccucugaguccccaggagagcccgaggcucaguaacugcauaacugcgcagggccucuugucugggccuccacagaccguggucucugagagcaggaaguggcugguccccuguaaugcugcaucugugugacagccucaagcccugcuggcucucucuccgggcaccccucacuugcuucuugcccuggccuugggcagcacuccgguaaccccagugccacaggugaggaaccgaagcuggagacagcuguucauggcaggggaggggccgagggaggcugagcgccuggucucucccuccugcugguuccaccaguucacacgaggcaauuggagggaaggauucugcugcccggaaaauccuccggaaccacagguguuguucaugggccugagccgcucagugaagaacucggccguugguggccgaguugccccugguccagcccucuggcccgcggugugaugccucuacucauggcaacaggcguggacaggugcugagaaggaggacgacaucauuaaacaaaacagcuuggggucuuugaaaaacagugacagaaacccaggaaggcuggugacuugucaggucugugucuguccuggguggccacucggcccuggaccgugaggcugaaaugacaggagacacggagggugggcuugggugguuuccucauaagacacagaagaaggaggcccccaacccgggggcugccucgugcgcuuugcucuccuguuuuccugcucugucccucugguccugcccucugaccccuggcacagcaggagugcccagaagcccagugggacuuguucucugccuaaagcccuuccgcaucccucguacccacucgguguggauguggguuuucucaccaccaggcugugccucagcuguguggagccacuggccucucaugccccacgcuggagagaacgcugaggucugugcgguucucaugugacccuguagcuggucccuggcuccccacugugggaucugccugcagcacuuacacuugggaccgcccugucucccugcuggauguggcgccgagggcaggguccguuucuguuucuugguaggccuagugucuagcgcuaugcagccgugcgcagagcaggcggucagugagcaccugggguuggcccucaccacaggcaguucugaauaccuggguucuggcagcccagggggacuccugcgugcuccaggaaaguagcacagcagccccuguggcguggacacggccacaccugagcucggccuguuucugagucugagagaacaggcuugcuggccugugaucuuugcaugugugucucgcugcagggaggcuguggguuggggcuggaccuagacccguucagccacacccugucacuaugugggucacacacagcuggguggagaccucccggugcguggcccagggaggugucugggcguggagucuguggacagccacauuguaccacuaggacaggggcugcugcugggcccacagggugcacggaauggggucugugggaggaugggggcauccuagcccagggcagggaccccgugggccccccaagaugagcugcgucaggcuguugcuuugcacacucugaggggccugccugagugcugcaugggaagccagcaguguggccgcccuccccagaacucauccagggcaccaggguggacccaugagucccgucgggucaugggcaucagccucgccauccuggccuccagauacaacgauuugucagauucccugaggucaaagggaagcuucaaggguugccauccccgccucccuggcgguccuagacgggaugucaggaggacgcagggccaucgcugcuuuuuaaaugucacagugacugcagcgucugcuccucuguggaaggagcuugcuccgcuaaugagggaguuccuccucauggccuuccccucacuucucuucaaaaaguugcccuuuauuuuaacauuuuuuaaguuuuauuuuuuugagccagggucgugcucuguugcccacgcuggagugcaguugcaaucauagcucgcugcagccucaaacuccugggcucaagugaucuuccugccucagccucccaaauacugggacuacaggugggcgccaccacacccagccucugcccuuuguaagugaagucccccaggcagguugaaccucuuacaccuucugccccugccugauccccacucccuaccccccaccucccuguccccuguaaugagaaaggcaauaaguuuuggagcuuucuggaguuccugccccuccugaaaagguggcugcagagaggcuggagcugauggggaaagaggugccacgaggccuccucuggguuagggccacacggcucccaaggcccccgucuccuucucuggggugacaggugcccccagggccacacggcucccaaggccuccgucucccucucuggggugacaggugcccccagggccacacggcucccaaggccuccgucuccuucucugggaugacaggugcccagggccacacggcucccaaggcccccguccccuucucuggggugacaggugcccccugugucccagaggcuucugcuuggccaccagugaggucaccgggcugcccagaccagggcugcuucugccaccacauggcaagcagagaaguagagaagugccaaaaaccacgagugcuugucugguccuuuuuuccuguuaaaaauagaagucggggcugggugcgguggcugacaccuguaaucccagcccuuucagaggccgaggcagguggguugccugaggucaggaguucgagaccagccugaccaaaauggcgaaaccccaucucuacuaaaaauaaaaaaauuagcugggugugguggugugugccuguaaucccagauacucaggaggcugagacuguagaauugcuugaaccugggaggcggagguugcaguuagccgggauggcaccacugcacuccagccuaggcgacagagcuauacuccgucucaaaaaaaaaaaaaagaaaaaaaaguagaauucgguugggcucaguggcucaugcguguaauccuagcacuuuggaaggccaaggugggugaaucacaugaggucaggagguagagaccagcauggccaacgugacgaaacccccaucucuacuaaaaauacaaaaauuagcugggcgugguggugugugccuguaaucccagauguuugggaggcugagacacuagaauugcuugaacccgggaggcagagguugcagugagucgagauggcaccacugcacuccagccuaggugacagagugauacccugucucaaaaaaaaaaaaaaagccagccgcuguggcucacgccuguaaucccagcacuuugggaggucaaggcggguggaucaccugaggucaggagauugagaccauccuggcuaacacggugaaacuccaucucugcuaaaaauacaaaaaaauuagccgggccugguggcaggcgccuguagucccagcuacucgggaggcugaggcaggagaauggcgugaacccaggagguggagcuugcagugagccgagaucacaccacugcacuccagccugggcaacagagcgagacucugucagagaaaaaaaaaaaaaaaacaggugaugccugugccacuggacacaccugcacaccauccucaugcugaucacaaaagagggugaggggccgggcaugguggcucaugccuggaaucccagcacugggggaggccgaggcggguggaucaccugaggucuggaguucgagaccagccugaccaacauggugaaaccucgucuuuacuaaaaauacaaaaauuagcugggcacgguggcgggcgccuguaauccgagcuacuugggaggcugaggcaggagaauagcuugaaccugggaggcggaggcugcagugagcugagauugcaccacugcaccccagccugggugacagagcgaggcucuaucucaaaaaauaaaauaaaaaauuuaaaaccaacaaaaaagagggugauggcugagugaggaguccauggugggcccuacacagggcccaggaaggacagggcgggaagcgugagcauccugcccaccgcaguggguccgccauggagagcaugaccuuagagaagcaaagccgccuggcucgaagcaguggccgcccugcugacagcuguaguggccggguggcacucgggcugggguccgggggagucuagguggccaccuggcugugugccugugccugcccaagcugggcaccuuucccuggcagugccugggaagcucggccgcccucccuggcuggugcugcucugcagccccgcucauggacucuugcccacggccugcuccuuguagcagggucgggccgugggagguccggacaggaucuugaauggcccugucugcgguccuggcuggccggagguugaccgcacuggacaggucaagggccuuaaaccaggguagugaggagccugcugagccccugcugcuccccgggcugccuuuggcgcucggacagacacccaaggacagaagcucggacagcuucuaaggcgaagggucucccggggcugauuucccgggacucuggcuccugcagagagggcuggaggcggggcucuguguuccagggucagaguccuccugguggaagcugaggugccugauuaaaugccucccuuucuaggcagcagcccagacgcggcacagagagggccugggagcuugcugcagcuucaggugaguuuguucccaagcccugcggcucguuuauggguuugcuugcgcugcagaacuguuuguggagcagcaggguuggagugcccacggcuggggggccucucggagcccuugauucacagaaccccuggaggccggcagcccugccugcccugaagagccucguucucccagccguuugggccgugguccugucgugggaggcgacggugagggcggcccggggucccgacagggguguuugucccuuuggggaccuccccugugcuguggccccggcccccagauggagcuccccauccccacggcagcgcuggggcuggggcuggugaggagccugugcacggcccccaccgcuauccucagccaggagggugccuggucccuggggagcggccugcaccuguuucuggagaaugcuguccugccaguugucauuuggggcgggcggucggaguccacguccucccccagggcggggcccuggccuuguuucuuguagggacgaugggaagcccuguccucagcccucccacccgacucaugcaggagcuuccuguccuuggggucaucuccuccacaggggccuuagcgucaguggggacaaaggcagaguugccugucuucagguugugggcaccgacugagcuucgucccgguaguggcuggcucuuguuuccugccuggaccagcagccucuggucuggugggugcaguuuuagggcgcagugggguugccguggggcaaggccaggccaccagcugccuggacacaggggcccccgcuuuccaucugcugccccccacacccccagcucgggcaggggugacaccggggcauccuuguuggggucgcugugguucccaugguggcaagauggcucugugaaagauugacggagauguagggcccaggagcaggugcugugugagugggacacgccugugucaccugcggggcaggggagggcucggggguacagccguguacaugauuaguuagcgagacagugaggaguguaugcggaguggacacagcugugggugccgcccgcgcaaggcugggggucgcugugccagcccugcucccaugugggcucccagcuccccagguagggacgcugaccccgggaggugccuuugccugcauccacuggagccucaggagcaugcguuccguccccacgggucacccccacugagcccaccaccuaccgagaggcaccucgagacccuguccugccacgggugggcugucaaggccagcaccagagacccccagcagaccucaguggccgcagauggagcggggcggcaauggucaccuccgggacucagcccugugcugagccccgggcagugugaucauccuggcccuucucgugcacguccccuggcuggaugcuccuugcugcccucacgggguguguguguggcauacaggacagggaccggccaguuggcccugcucauuaaccacuuguccccacagggcaguggcggccucaccucugcaauucucugaggcuggaucuaggccaccgccccguuuaaaacuagggcaucggcucccagggagggcggggagcugcacaguuggacuugugggggucaggcauggauccacacagcccggggcccuccgcacccugccccuccagggagcccagaggcgggcguggcugcagccuggcucuguggcagucaugagucacggccacucuugaggcgccgcccugagagucagcccuguggucacggcuccugcugguucccauucgcgagcaccugaaacagccuggcccacagcagaggcccggggggcacaugcagcucacgggagcagcacagaugcuuggccggcggcaggcccuacaggagcagcagcggcccagggcaugucccuggggucaggggucagaguucggcaugcucugcgggggccucacccugcugucccucggccuggccugggcacacuccuuggugacagugccccugcacgcccccccccccccccgguuauucagacagggagccaggaugggaaccacggacugaccugaccugcguccucggggccacugcacugggugauucacgugugcccaggcccugaggugggccggaccugggaguggcaggugagcguuccucccaagagccucuggcuggccgcagcaggcccugucccugcuguccucaguggcccuggacaugauaaccccccugccgaggucuggccggagccagcacccacggccgagaugcagucagcccuggcugggcgcugucccuggggguggcugcuggugcugcccucccuccuucccaccacuucuugcuccucuuuccuggggcccucccaucggagucuuccuccuaaaugcaguucccucccucuaggggaacgcgggcugggagccuauuuuuuuuuuuuuugagacggagucucgcucugucgccccggcuggagugcaguggcgcggucucggcucacugcaaccuccgccucccggauucaggccauucuccugccucagccucccaaguagcugggauuacaggcgcccgccaccacgcccagcuaauuuuuuguguguuuuuaguagaaacaggguuucuccaucuugcgcaggcuagucuugaacuccugaccucgugauccacccaccucggccucccacagugcugggauuacaggcgugagccacugcaccuggccugggagccuuuuccguagcugcucauccuguacuagcaucuguccaucaugaguggacggaacacagggggacccaggacccacagcugcacucgggaaggccagcaggguggauuucgggaagagcaucggugccaguuucccacagucacccuugcgaugggacccucagguuggcacguggcuggcagcugugucccgggagcucuugcuccuuagugggccucgccagccagggcagggcccccggcaccccucacggggcucuugacuccucuggcagcggaucggggcgguucagcgauaccaucucuggagauccccuggcgugugcuggaaaaaccccggagagggcuuaacagagccagcuguccagccucugugacagggacguuugcuuuucucugcaggguccucucuucucuuccgagcacccacgggaggggacugugcugucccugcucuccuaggacaggccucccuccuguccagauggggcccacagggucaguugccugagacuggcuccagcucaagaaagguuuucugagugagcgcaggggagcaggaggcuggugagcagcucgcuuccugcccugggugcagcugggcaccacuucugccuugggccuaaaggcaucagugaggagcaggcggggccugguaggagccuguguuucuagcggcacgcgugaccccaggugccacgugggugagugcgugggugggugaguggcgaaggagcugagguuggcccuggcaggugugcaguccucacacagaacgggcagggcuccugucagagccaaaccagcucagggcccagugcaagcagcuucugucccguggcaccuccgcuagucgccgcucccacccaagcccugccccgcccugacccgcucaggguuuggcuacagaaggggagugucggaaaugcccaacccgucucccgugagggacuccugcguggccugggcuggggaacgcaggggccguuugggugguuccggcgucuggcguagccacgcgagaggcccuggguugaugcgugggcucccugcuagcgagccugcuccgugcgugcugggcucccggccuugcuuccguguggcauucgagaccccguggaccucgccugcguccugcauguuugagcgcugccccuuguggaggccgccagcacugguggcugcagggccuguaguguggcacguccagagacccggccuggagaacggguccuggaugucuccgucauguuuuacguucgcuucacacggacgcagcgaugucucagauaccucggaucacacagagcacgucgccaaggcuuguuuugucuguuccuuuccaccugucuuacguggauaccaggagauccgccacgacucccguggccccguccacacugcgcggcgcucuccggcguggccgccaggugccccuucgagggcaggugugaguacaggguggucccuguggagaagcgccugcaggcgagugagccaggcugugcccugcugaccccgaggccugaauuucauggaacucccaccucucacagaguauuguuuuuuuuuuugauuuuuuuccaaccauuuaaaaauguaaaagccauuguugacuugcgggcuggaccaggcuuagggcugggcucugguccgcaccccacacuggccccguguguccugugaccguucugccuacggggcaggccugagccaccacaggauggcagggucuccagggugcagggcccgcaaugcuucaacccucccacgaccccagcaccuucagagaaaacggacccucgugccgagugaagugguucaggcgaacguuaucaccacacgggggacucggcggcuucugccccaggccucaaaggagaggggauccagaauucucugucucacccccucagccccugcccuugaagcuucuguccccaaggcuguggggaggaaccagggaagggcuggcgcgucugcugugcgaucccaggugcucgugccucgcugagcucagccccuguggccucagagcugcaggccccucccgggugucagagcacugacuggaaaggccccccacaucccugcccucugcugcuccccaucgucgcgggggagaagcuggaacugcacccccaccccccccagcccgcucaccuagggcugcccccaggccucccugagcuccaaaggauauguucuuuggugcuuuuuuuuuuuuuggcucugucucccaggcuggaaugcagcuguggugcucacgccauccucccacgucagccuccugaguagcuaggucuacaggugcacaccaccacacccggauaguguuuaguuuucuauaaagacagggucucacuguguugcccaggcuggucucaaacucuugggcucaggugaucccccacgcacggcagcuuugacacuuacuugacccuuuccuccuaagcucuacccugacgcuggcugugugucccagagacuuaaucagaagcuggaagaagggcugugacgugugugacagcaggaacugcuggucaacccacagccggccagccugccgggacgccaucuuggccccaaucuuggcagggagaggggaguguaucggacucuggggagagcagcugccugcacgggcaggguccucccgucucaggauuaacguucucaacuguauuugauuucuccucagccagaggggguaagguggccuucccagaagcacaggugggccgcgugucagaggcccuggacagccugugccucucccaggccucccagcagggguggcucucgccccucuggaggggagaccccaggaaccggcccccgcccucagccauagccucacaggguccuuguuucucggggccuggcucugugggugcacaaggcauggucgggcucccguccuucuggaagucuccagaguggcaugugggcagcugugugaagcggccccccagaucuucauccagccuggccugcagcagcucccuacgcccucugcuaccuccccugccuaccuuuggguagacguucucuugacccuuccuucugugauaaagcaaaagcgugugaucucuuuucucaccaaggaauaaaacgucucugaauaccacagacgugaugccgggcuuuugggggccgggggguguccuagggccccgagggaggagcccugugggugccgaagucgggccgcaggcccugcacugagauguccccucagccuaccccaggcggcugggcaugcugggaaguccucccgggcugugugugugaaucaugcuguuucuucucuauuuucucucucugucuguuuauuuuuguugugugucacucugcccagccggccguccugucucuucccuccaugcuccgcuucgcccgcugcuggccagaggugaccagguccggcucucagcacggccgccggccggggggccauggggagcuccgccuccucccuggccgcagagaccgagucggaccacagcuuccccgggggaccgcccuacccgggucccccggcagcggcuggcugguguaggagcggcccaggggggcccgucuggggaggugcccuggucagccggcagcaccagcccccacggccccgggcccgaagguaagagguggggagggguggccccggagggcucccgggggcagagggccucguucucagggugcccccuccuuggcagaggugcuugcagagaagugggucccugcuccuuccaguuguggcagcucucuuccccagggugcaggagcugagcaggucugagaccccggccucggccuggcugguuggugguggggaugggggcuagugcgcccaaucccggcggcccuguguuucucacaggcugugcugcuccacgcagagaagcuguuccugaagcuucuuuuugggcuggggucgcuggcggcugcaggcucugggcauauugccugcugcccacgguuucaaagcugccagcacucgcugggcuccgccugcugcccccccgggggucacaggccacauggcuugguggccgaacuccacgugcuggcuccucacagcugucaccauggccuuggcuacccgcugcgucccucaggagcugccaucagguucugaggugccuggucuggaggcaguccagguggugaggucuggacuggcuggaccccaccgaugcuccugccgucaccccguccuggcccucacuggaggcagggacacucaggggcccggggccucggggccagugcugcaguggccgccguugcucucacagcggguccaggccuggcuucugaaggcaaugugccugcgucucacacucaaaagggccugccaggcugcaccuggcggcagcucccacgggggacgauguccugcugucuguuggcccccaggugggagggacgggcguggagcugcaggcagugggcaaggccauggcagguggccaggccugggaaccagccuccagguggcauccacgcugaggccugagcuccggccgacaaggacuggggaugcaggggauuagccaggggcugugugggggagcccuggagcccugucugcgaguuaccccgaugaacagggagacgcggcagaggcagggccggggaggggccgugugggggagcccuggagcccugucugcgaguuacccugauggacagagagacgcggcaaaggcagggccggggaggggccguguggggccugguggucggcagaggaagggucugugcuccuccugcgugugguggcaccggagcgccucccaguuccugguguuaccgcaccagccgccucccagugagcaucuccacgugugccgacaacagcuuuguugagguagaacuuaccagacucaccuguuaaaagagugcaguuuggucacucuuagugguuuguagaguugugcagccgucauugcaauccagcguugcagcauuccacagcccacagggacccccagccccacaguccaguguuacagcaucccgcagcccagagggacccucagccccagacggccacugaccggcuuccugucuugguuugccuugugcagaaggugcguggauguggggccacaggacguggcuggcuggguuugccuugugcagaaggugcguggauguggggccacaggacguggcuggcuggguuugccuugugcagaaggugcguggauguggggccacaggacguggcuggcuggguuugccuugugcagaaggugcguggauguggggccacaggacguggcuggcuggguuugccuugugcagaaggugcguggacguggggccacaggacguggggccccgugucuggccucuucacucggcaccgugcccuccagauucaugcaccugcagcccgaggcaguuucauucacugcuccuuugcgggaugaaccgcauuuuaucuauucauggacgcuaggacugcuuccacguggcuucuguggacaaugcugugaacauuguuuacgagguuuugcguggaccuguuuucauuuaucuugcauagauaccuaggagugggauugcuggggcguguggugaacuuucauaaugucuugaggaacugccaagccaucuuccgcagcggcugcauuaccuaguucccaccggcaacgcuggggaggguccuggcgucuccacucccucgacagcuccugccguugucuguccuugugauucuggccgucccagggggugggagcugguguccccuuggcuuugaucugcguuucccugguggccagccauguggggccucucucccugucucauccacccgugccugucuuuuuuucauucauucacuuauuuauuuauuuagagacagggucuuacucugucacccaggcuggaguacaguggugugaucacagcucacugcagcuucuacuuccuggguucaagagaaccucccaucucagccucccaaguagcuggaacuacaggcgugcaccaccauagcugguuaauuagaaaaaaaaaauuuggccaggcgcaguagcucacgccuguaaucccagcacuuugggaggccgaggcggguagaucaccugaggucaggaguucaagaccagccuggccaacauggugaaaccccaucucuacuaaaacaaaaauuagcugggcguggugacgggcaccuauaauccuagcuacuagggaggcugaagcaggagaaucgcuugaacuugggaggcggagguugcagugagccaagauugcaccacugcacuccagugugggcgacagagugagacucugucucaaaauaaaaauacaaacccugagcuugggaggguccaggcugcaaugagcugcgaucgugccaccgcacuccagcuugggcgacacagugagacgcuagacggugucucaaaaaacuuaaacagaaaaauguagaaaggauugucguucccuuucucguuuuccagagggcagaggacucucggccccugcuuuuugagcaccaggccgaguuucagaccucgggauggccucuccagucugcagcucccggcagccucgggccacacucccgggauccccagggacuggccugggacuaccggggguggcggccguggcucuggcuauggggagggaggcagagccgcggggcaggcguggggucugcugugccggguauguggggcguguguuagacuuuggaccuggccugcggggucaggccgugguguaugaugacgccacgccgcucuuucucuuucacccuggccuccugccuggcccuccccugggucggcaucccuggggccacuccugcccgugcccgcugcuguggggccugggcuccaggcagcuccugucugcugcugcaaacaggcccccaaggugcauggugaggagacccccaggcuagagaugggcgagagcggugggcgagcagacugcgggaaggcagcugggccuccacacgcggagcccuccccaccacgugcaugcacaggcgaccccugccgugcuccgacggagggcgccgggacuggggagggucagcgcgacagcccuggcguuuacugaagagcugccugccuggcucgcugcccugguggccgcugaauucucccaacgccccaggacagcaggugcuguggccccaugaccgcucccccacauggaugaagggguggugcacaggcugguggagccugggagagccagggcagccugcggccaugcggccaugcggccggcguggggcugaggucccuguacagcugacagagugccuggcgcccucaaucaguaagucaucuacgggccgggcaccggcggcucagcacagagaggcaacaaggguagacccccccuggcaaggcugaccggcgccgggcuguggccagaccaggagacugcagcccagcucgagggaggcaccacgccugccccucagagcacugagcagagccccccaugguaucccccgcccugggcacagcaggaggagcugccgaccaagucuggcaccccggugugccccgagagcugucugggcacagguugcggggcugccccggccggacggggcaucuguguuucucgguguggccucagggcucugguggcuuugaccgaggccccgggggacagaaugcagcuuccugcuccucacuuuuccuaagaaaggggccgccucccaggacuggggcugcgccagucacaggcccgcggccuccacgcuccgggugcugcugucccggcugcuucagggcgggcucugucuugcacgcagcgagcggcuucaucaccucccuuuugaauuggagcugagugucggcaacgcccagauaacuggggcgcgcgggucuuuugugcuggauuuuucuguacaguugccucgaucuuccauccagcuuggccucugugcaguaaggagcggcccgucgccucccccacgucgccucccccacgucgccucccccacgucgccucccccacgucgucgccucccccacgucgccucccccacgucgucucccccacgucgucgucucccccacgucgccucccccacgucgccucccccacgucgccucccccacgucgccucccccacgucgccuccccucacgucgucgucuccccccacgucgucgucuccccucacgucgucugcccugagcccgcucccuucgaagguaaccauccugcaguagugagggcuccuugcugagcacguguggcugcgacuucaggagcguucuggguugagaauuccaaaagggcuucgcucaggccuggcuuugggucuuugggcuccugacgcgagcuuuuacuuccaggcuuuggcggucuggccucaggaggucaaggcugcagugagccgugcgcgagccacugcaccauccugggcaaucagaccccaucucuaaaguucaaaacaacaucuuuguaaggguuucgggucucugagcccaugaaccugcccaggcccugcagaggugaggguggcccuagaguggcugggggguuguggagaccagaaccagggcagaagggcagggagggugggggcccugccgaggucucccaccgcugaccccugaccccuggcccccuuccaccucggcccaccgagagaggccggcacagcgcagacugcggggucagugacacuccccucagcgucuccagccacagaagggccguggccugccuucgcccuccucacccgugucccggggccacguuugaacuuuaggccuuguucugacuucauugaaacccuccugaagugcagacgucuuccugacccaccuggguuuugccaggaugacuccgaaaggugucucccagcagacacaccccgcuggcgauuguuugguccuggggacccggguucucauucuccucucuggagcuggugaggcuguccuugcuagucggugacaacuacagggccaaagggagggugugucccaggaggcccagcccaccucugccugcaccugcggucagcggggugcagagucugugaaggcaccucccggagugggggcugcaaagaucauggccacugugccacccacaggggcccaggccggacgccugggcugugccgccucggcagccaggccgaggaacgugcaggugcggccgggagcccgccggccacagcugcauccaugcccuucuccgaguggugauggcggggagaggccuggcugucuacgggcagauugcuugggcuuucacagaagcccgcuguuagagcagauucccggccuugggucucucugcuccagcuggacgcccugagccucgccgggcccaguccacccccguccacucugccaggggcagcucagagcccucgccacgcggggcugagcgcagggaaggcagcaucacggaguucgcucggcuccacagaacacccguguugcucgcggagacuuuuuguuuuugugcuucuuaugaagaggcagguuuucuuucuuccugaaccaaaaggguuuagauggagcacaagauucaggccauauuuacaagaacaauugauuuuucugccaggcagagcagccagucugucucggaggcugugcugugguguggggaggccccuugcucagaucagccugugccuuccccaggccccggcccaugcaccugcccuuccguaggucugagcaccuguucuuccacgcccaggacgaccugguccugaguuuggccgggacccccugcuaucugccguccacaggccuggugacagagaaagcagugcccuggaacagcagcccggcuguggggugcucagcccucucuguaggauccuguguggcucaaggggucugcugagccuccaacgggcaagaggggcccugagccauggauccauucuggguggaggcagcccccaccgccgccugccucaaaugcucagcccuaggcccucggccccguagcucugcagccacagacgggugccuuccccaggccgagaggagggugggguccagccacucaggaccucacaggguggcccugaugagcaccuucccuugcagccacacccacucgcccgggucuauggccacggucggagagugguccugugugcgcugcaccuuccugaacccggccggccagcgccagugcuccaucugcgaggcuccccggcacaagcccgaccucaaccacauccugcggcucagcguggaggagcagaaauggcccugcgcccgcugcaccuuccgcaacuuccugggcaaggaggccugcgaggugugcggcuucaccccggagccugcgccuggggcugccuuccugccaguccucaacgggguccuccccaagccacccgccauccugggggagcccaagggcagcugccaggaggaagcagguccagugaggacugcggggcugguggccacggagcccgccagggggcagugcgaggacaaggacgaggaggagaaggaggagcaggaggaggaggagggagcggcggagcccagagggggcugggcguguccgcguugcacgcugcacaacacgcccguggccagcuccugcuccgucugcgggggcccacgcaggcucucgcugccacggaucccuccugaggcccugguggucccggaagugguggccccggccggcuuccacgucgugccugccgcgccuccaccuggccuccccggggaaggugccgaggccaaccccccagccaccagccagggcccagcugccgaaccagagccgcccagggucccgcccuucagccccuucucguccacccugcagaacaaccccgugccgcgcagccgacgcgagguucccccccagcugcagccaccggugccugaggcugcccagccgucacccucugccggcugcaggggagccccccagggcucgggcugggcuggggccucccgccuagcagaguugcugucuggcaagcggcugagugugcuggaggaagaggccacggaggguggcaccagccgcguagaggccggcagcuccaccucgggcagugacaucauugaccuggccggagacaccgugcguuacacgcccgccagccccuccagccccgacuucaccaccuggucaugugccaagugcacgcucagaaaccccacaguggcccccaggugcucggccugcggcugcuccaaacugcacggcuuccaggagcauggcgagccccccacccacugccccgacuguggggccgacaagcccagccccugcggcagaagcugcggacggguguccucggcccagaaggccgcccgcguccugcccgagcgcccgggccagugggccugcccugccuguacccugcucaacgcacugcgggccaagcacugcgccgccugccacacgccucagcuccugguggcccagcggcggggggccgcgccccugaggcgcagggagagcaugcacguggagcagcggcggcagacagacgagggcgaggccaaggcacucugggagaacaucguggccuucugccgggaggugaggcgcccccucgcccucuuccugcuccugagccuccugcucccgcccuccccuuccuaggcuuugggcucuggcgaugggcuggggaggagcccacaaggccuaagacgugauggggagggcagcacccuccgccccgaggcuccaagcucccaauggcccugggguccagcuuggccuccugacccuugguccuugcuggugaccgagaugcacgaccuucaccccccucaacccuccaccguggccaggagggccccgagccccgucugaugugccgcaggaggcgagggcuucccaggggcagcguggagaccccgcugaagugcgaggucgggauguacccgugcuccgcccucuagaguccaggauggcaucacccacgggucaacuggggcgcagccugcacccuccccagcagggccagggccagagucgugcugccacccacugggggcugcgcugucccccugggcccacacguccccugcuccucaccugucgccagccgguggccucuccacuagggcugagggcuuccucgacacagggccggcgccaggucuguggcuguccacgcuccacccgucccuuuggggcucaggcagugcuuuugggcgcucuccuggguggggucuugucccugccagguggagcgaggccacccugcccagccugagcacauggccguggucucugcagaacaaugugagcuucguggaugacagcuucccucccgggcccgagucugucggcuuccccgcgggugacagcgugcagcagcgugugaggcaguggcugcgaccccaggagaucaacugcuccgucuucagggaccacagggccacguggucuguguuccacacacugcggcccucagacauccugcaggggcugcuggggaacugcuggugaggccuucuccaaggccgggguggggcgggugggcgggcgaccggccgcgguccccgcgaggucacccugaggcucugcgcagguuccugagcgcccuggcggugcuggcggagcggccggaccugguggagcgggugauggucacgcgcagccugugugcagagggcgccuaccaggugcggcugugcaaggacggcacguggaccacggugcugguggacgacaugcugcccugugaugaggccggcugccuccucuucucacagguggggcggccugcagggugggcacgggcggcaggggcagccucugaccccagccccgaaaacaaggccggcugcuuccucuucucccagggcggguaguguggggggcgggcggggguggccucugacccggcccucugcaggcgcagcggaagcagcuguggguggcccucaucgagaaggcgcuggccaagcugcacggcuccuacuuugcgcuccaggcgggccgcgccaucgaaggccuggccacgcucaccggcgcccccugugagagccuggcgcugcagcucagcuccacuaacccccgcgaggagcccguugacacugaccucaucugggccaaaaugcugaguucuaaggaggcuggguaagaggaggggcacugcguggucagccgcguugggaggagaggcgaggcggagcggugggagauguggggcugguggccccugacccaguucugcuuccacgaggugccccuggcgugggcugaccccgcguggccaggccacagccccaaucaccucccccucccugggcggggcuggagcuggccuucucaugccaggaaggccacauccuggccaggccguggggcgagaccgaugccgucaccccggagcaggugugagcggcgugucgaguuugaccugggccguggggcgagacugaugccgucauccgccucggggcaggcgugagcggcgugucgaguuuggccacacucuggucagcgggucugugccucgacccccaggggccuccucggagugccccggugcgagcaccuugaagcucccggagcccuccucucagcugacccugggcagugcugcugcccaccccccacccgcccgggagccacagagcccagagccagccccacaaggccuccaggggacccaggccugccaccccugacucaggcccugugcgcuucaggcaugguggagggggcugguccagacccuccugaacacuucacguggucccuacaggcaggagugggcccuucucugcugcgccugccugucuugguggcaaggucgcggccagcgagggcacuggucagcaaggccccggucagugagggccccgcucagccaugcccccagucggugagggccccacucagccaugccccugguuagugagacccccugucagugaggguucccugucggugaggguccccggucggugagggcccccagucggugagggucccggucggugaggguccccugucggugaggguccccgucggugagggucccggucggugaggguccccugccggugagggucccggucggugagggucccggucggugagggccccggucggugagggugccccgucggugauggccccggucggugagggucccggucggugaggguccccugucggugaggucccuggucggugagggucccggucagugaggguccccuuucggugaggguccccugucugugagggccccggucggugaggguccccuguuggugagggucccggucggugaggguccccugucggugagggccccggucggugagggccccggucggugaggguccccggucggugagguccccggucggugagggccccggucggugaggguccccggucggugagggccccuguuggugagggccccggucggugagggcgccccgucggugagggucccggucggugagggccccggucggugaggguccccagucggugagggucccggucagugaggguccccggucggugaggguccccugucggugagggucccggucggugagggccgcucugccacacagguuccucaugggugccuccuguggcgggggcaacaugaagguggacgauucggccuacgagagccugggccugcgcccccggcaugccuacuccauccuggauguccgagauguccagggcaccagguagggccggccuggcugaggguggguggggugccggugagacucgggcagugugguucagauccucaccccuguggucugcaggcuucugcggcuccgaaacccguggggccguuucuccuggaacggcagcugguccgacgaguggccacacuggccggggcaccugcguggcgagcucaugccgcacggcagcagugagggugucuucuggauggaguacggcgacuuugucagguaucggcaccguggggcggugugcacgccgcccccgcccuccuagggccgaguccuucucuggagaacaagccugucccuccugcugaccugggguggggcggcuuguucguggcccaaaugggaccuggagcuucagcuccaaggugccaaccucagaauucagguccacccaggucagcagauuccagcgcccugaagagccggcccuggagggcuuccuauuauaggccucagggaugggcccccgggggccgggcugcaagaggacggugacggagcagcuggcaccugcuggggucaccggccugugguugcgguaggcgcugagccacggaggugugggccgugguaggcucagggccccguccucccgccaccugcagguacuucgacuccguggacaucuguaaggugcacucggacuggcaggaggcgcgggugcagggcugcuuucccagcucggccagcgcgcccguggggguaacagcgcucacggugcuggagcgggccucgcuggaguucgcgcucuuccaggagggcagcaggugggugcugcggggccccaucgggcugggcugggcuaggcuggcggccgugaccacgcgugacccuggcccguggugucuggcgcaggcgcucggacgccguggacagccaccugcuggaccugugcauccugguguuccgggccacguucggcagcggcggccaccucagccugggccgccuccuggcccacaguaagcgcgcggucaagaaguucgucagcugcgacgucaugcuggagccuggcgaguacgcuguggugugcugcgccuucaaccacugggggccgccccugccgggcaccccugccccccaggguacguggccccuaccccaggcucaugccccaggcccacggggagggcugcgguucacacgcccguccuuguagccuccagccccucggcaggggucccgagagccuccccagagccgccgggccacgugcuggcuguguacagcucgaggcuggucaugguggagcccguggaagcccagccgaccacgcuggccgacgccaucauccugcucaccgagagccgcggagagcggcacgaggugggugggggucccgggggaggguggcguggggcagggggaguaugccccagcaccuccccugccccacaacugccauuccugugcccagggccgugagggcaugaccugcuacuaccugacacacgguugggcggggcucaucguggugguggagaaccgacaccccaaggccuaccugcacgugcagugugacugcaccgacagcuucaacgugguguccacacgcggcagccugcguacccaggauagcgugccaccccugcacaggugcgcccccgccccugcccccccaccccugcacaggugcccccuccccuaccccgcugcacccacacccaacucgugcccccccaccccugcacaggugcccccuccccuaccccgcugcacccacacccaacccaugccccccccaccccugcagaggugugcucauaccccugcccccaccccuguacggguguuugucaccccacuccugcuccugccccuguacaggugggcacagcccugcccccauccccacccugcccuccacagguccucaccgguccccucccccaggcagguccuggugaucuugucccagcuagagggcaacgccggcuucucuaucacccaccgccuggcacaucgcaaggcagcccaggccuuccucagugacuggacagccuccaaggggacccacagccccccacucacgccagaggucgccggucugcaugggccccgaccgcugugaccaccaugccuggggcaggggcugugcacagacggaccccccacccccacacgcacuuuaugagggagaccccgacagaggacgcuugagccagaaucucaggaccccgcccagggagcugccagcccagggcucagcuucccaugggccccccgccccccuccuuccccucccugaaccccacaguccgccuggccaggccuccuggccgccacgcagaauaccucgaaccaggcgggcugugaaccagccccgcucaccugccagccccaacacccgacgggggccgaggccaggcugccccucccugugggcucagggucuccugcgggcuaggcagccaggagcucuguccgcaaaaccaaaucugggugucagaggccaagacccuggggugggaucagggaccaccccucacggggcauaaggucaguuuucccccagagcccgggucccugucccccacagggcaggcggggucccuggagcccugguguggagcggcgagucccggggcggugccugucucagaagaaggggcccuuggccagccccccagcgacacuaugcaaauccuggagugcccgccaggaucgaagccaugacugggugcaggcgggcgccaggcccgcugugggugggcaccaguucucagcaccgcucacugcugccgggcacacugggaccagcaggcuccucagccaacccugucccucggcccggcccugccagagagggaccccagcacaucgugggcacgggcagggcucagccgcucccaccuccccacagaagcccaggaguguguggacgucugagcccagcuuucugcgugcccuccuggccccucacucccggcagcgggccggccucgcccccacucccccuccuaccccggcaggggcuuccggggccuuuucaccuggagaaacauucccacuccccuuuggccucccuguacucugagcugugaauauuuuuaacccuguaaauacggccagcucuugugacacagagacuauuuuaucaauugucagucccguuccuuuaccauaggauucuccacaguggcuuccgacucaggcuccaauggaccaaauaaaagcguuuuguuuuguaa

SEQ ID NO: 192676 - RNA, 10630 nt, Homo sapiens
aguggggcggggcucccgguuccaggcgaguucgcagcugcgcgccggguccuggaggccgaggccgcucccgcccguuguccccgcaguccccgacgggagcgccauggcccagccgccgcccgacguggagggggacgacugucuccccgcguaccgccaccucuucugcccggaccugcugcggugagcggggccugggaagcgagcgcagccuuggugcgggguccgguccgcgggcgccggcgcccccacgugguccccgagggcucgcguguuaggaaaccugucuugccuggcuccuuucuuucuuuuuucuuucuuuuuuuuuuuuugagacggaaucucgcugugucgcccaggcuggagugcaguggcacgaucuccgcucacugcaaacucugccucccggguucaagcgauucuccugccucagcccggcuaauuuuuauuuuuaguagagagggggugucaccguguuggucaggcucuuuucgaacuccugaccucaggugauccacccgccucggcuucccaaagugcugggauuuacaggcgugagccaccgcgcccggcccaaccuggccucuuucuuaacagaaaauuuuagguugaaaucauuuuuccggaagacccagaaggcccaggaaugccagguuuugcccagcagcucuucauuuuccugcaaacgccuugguguucacaagagaaggcagcccgggcaaaggucgauccuccccggucaccugcccucacucggcuaaugggcggauccuuuuuuuuuuuuccuuuucuuuuuuucaauuggcaacauuuucaaguuucuauuaaaauuuugaucuuuugccaggagcaguggcucacgccuguaaucccagcucuuugggaggccgaagcggguagaucaccagaggucaggaguucgagaccagccuggccaacauggugaaaccccgucucugcuaaaaauacaaaaaauuagccgggugugguggcgcacaccuguaaucccaacuacuugggaggcugaggcaggagaaucacuugaacucgggagguggagguugcagugagccgagaucgcaccauugcacugggcaacaagagugaaacuccaucucaaaaaaagaaaacaaguuuuaaauuauguucuccaaggacagguauugacaauucucucugaguguucugcaggaaaaaaaaaaaguuuuuuuucgaaacggagucucauucuggguugaagcaauucuccugccucagccucccaauucuccugcuucagccucagugcgcccaagugggacuauaggcacacaauaccacgcugggcuaauuguauuucuaguagaggugagugucaccauguuggucaggcuggucuggaacuccugaccucagaugauccaccugccucggccucccaaagugcugggaugacaggagugagacgcugcaccuggcccaaaauuaaucuuuaauaauuaagaauaggaaaggcaacuuggagaucagcaaaaguuugccauccaucugguacaguuugugccagucauaccgaucaguacacauuuaaugcguacaagaaaaucucuaauaaauaaaaaagccauauuaucccgacguagcuugcugaaucucagguaucauauuugauauuagugccaugcagggcuuaggagagaggaaauuauaaccucuaucuuguuuaagccaggguauuuuucucucuuguaucuacuucuguccauuucugucaaaagacacagaaauacccuuucccccacugcacuuugcaaguuugugucagcacaaguucaggaccagccugagcaacaaaacgauaccccucucuagaaaaacuagaugaaaaauuagcugggcacucuggcaugcaccuguagucccagcuacuggggaggcugaagcaggaggauccuucuagcccaagaggucaaggcggcagugagccgugauggugccacugcacuccaaccuggaugacguagcaagaaccugucucaaaauaaauaaauaggcccggugugguggcucaugccuguaaucccagcacuuugggaggccgagguggguggaucacaaggucaggagaucgagaccauccuggcuaacacggugaaaccucaucucuacuaaaaauacaaaaaauuagcugggcgugguggcaggugccuguagucccagcuacucuggaggcugaggcaggagaauggugugaaccugggaggaggaguuugcagugagccuagaucaugccacugcacuccagccugggcgacagagcgagacuccaucucaaaaaaaauaaaaaauaaauaaauaaauuaaauaaaauacuauaauuuuaugaauuuucauuuuauuuauuuauuuauuuuuuaagaccauguuucgcucuuguugcccaggcuggagugcaauggcgcaauuuuggcucaccacaaccuccgccuccuggguucaagugauucuccugccucagccucccaaguagcugggauuacaggcaugcaccaccacacccggcuaauuuuuuauauuuuuaguagagacgggguuucuccauguuggucaggcuggucucgaacucccgaccucaggugauccgcccgccuuggccuccuaaagugcugugauuagaggugugagccaaggcaccuggccgaauuuucauuuuaaaucauugccguauagcaauaugggagguguauuuuaacagggcucuuuuauuuuuuauuuauuuuuauuuuauuuuauuuauacauauuuuuugagacggagucuugcucuuuugcccaggcuggagugcaguggugcgaucucggcucacugcaacaucugccucccggguucaagcuauucuccugccucagccucccaaguagcuaggacuacaggcacccaccaccacgcccagcugauuuuuguauuuuuaguagagacgagguuuuaccauauuguccaagcuggucucgaucuccugaccuuguggcccacccaccuuggccuuccaaagugcugggagccaccggcccggcccaauagggcucuuuuaaaagagccuccuuuuuuauucucagggacaaaguggccuucaucacaggaggcggcucugggauuggguuccggauugcugagauuuucaugcggugagacugcucugugucccuucccugcuccucgcuucucccugcccgggcccugcuggaugcccgaccccuggaaagauguuggugggagguagauguccccugcucaccuacccgacaggauccaggugccugccagagggacuggggagcggucgaggauugcccuggggggagucaggacuucaaggccccuacaggucaguggagauuguguggcucuggucuggggccugcugggaccucgagagucagggcugugucgggccccagugcuggcgcccugcagagcacauuuucuccugggacacaauucuguggcuucaggccagggucagcaacuuaucccaccugacaguggcuagaguuaggcuggggugggggaaagggacccuuccucaguuccccugaggccccugcuuuucagaccaaaaaggugagucccacaggaagagauauggccuuuccacugguggcuuugugcucagggcaucugaggaccagaugggacauugcagcuccagugggaccugccuagcagggguagcuaccuuuaugguuauugugggcaagcaacccccgaaccagaagagccgagaaaccaaagaacaaggcagacagaucccguuugucugugucaggugauuuuaccagggaauuugugggcagaagcguagucuuggguggcugugagacgggcgucuccaugcuguuacccccaggcccagggcuucuauaccacagggaaagggguccugcuucagagggaguguguaggaauuuguuuaggauaacaucaaggugguuuugaccuaaaggcaggacuucuuugugcucuuucgcaagaacaguagauaagcuggaaauccuagcggcauuccuggaaccaggguucauagaggccaacgugguggauucgcauccacguggucaggaaggggagcagggagcaccccgcuucagaacaguccuccacgccagccccacagggagaaggggguggagaaugugggcccagcaggccccaggcagaugugugggcugggcgucuguggcucacagcugucucuguaccugguguuuggggcaggacccgcaggccugugcggugggaugucccaugccagaaaccccggggugggcaccaccugaggucccuccagaguaccucaguccuguucacgccccugugcccucugccagcugggccuucagccuggacugguacuuccgccugagagacuccugcucaggagcugggcagaugccccgggagugccccucgcccacacugcccucacaccugcuucugguuuugcaggcacggcugccauacggugauugccaguaggagccugccgcgagugcugacggugagagggccucucccaugguccccuguucggguggcugugggggggcuggggcugggccugggccaggagaguccagaggcuauggggauguuggcaccaaaacuuuuuuuuucugagacgggagucucgcucugucacccaggcugaagugugguggugcgaucucggcucacugcagccuccaccucccaggaucaagcgauucuccugccucagccuccggaguagcugggacuacaggugcccgccaccacgccuggcuaauuuuugcauuuuuuugguagagauggguuuucaccacguugaccaggcuggucucgaauuccugaccucaggugauccgcccaccucagccucccaaagugccaggauuacaggugugaaccacugugcccggccggcaccucagccucccaaagugccaggauuacaggugugaaucacugugcccggccggcaccucagccucccaaagugccaggauuacaggugugaaccacugugcccagccggcaccaaaacuugcaccuauccuaaauauggagcuucaguguaaguggccucccagagacaucuuugacuuuuuaaaaaaucuaguuauuggguucugggagggaccuuccuguuuggggguaauguggccccaagaaagaccucugggcucaccuggguuauuuaggugguccgugcgucccaccuacuggagcccucgaccugggaggagagucucaccugugccaccucuggucugcagcaggggcaggacaugggugacaguggccuggagggcgacgcagagggaggauucuaggacagguggcagguggggggagagcguggcagguucccacaaacauccacuggggucgugggcacuugcaggcugugcuuccccagagugggguccagcagcaaacccaggguccccgaggaacccggaagcaucguccucugcagauuccaaaggccuuuucuccaggccgaggcugcagggcugcugucugccucuuuaccuggcuucuaggccgccaggaagcuggcuggggccaccggccggcgcugccucccucucucuauggacguccgagcgcccccagcugucauggccgccguggaccaggcucugaaggaguuuggcagaaucgacauucucauuaacugugagucggugcugagugagguugguggcuucucacagguuggugguaccauuuggaggcccuagaacucuggucaugggguggggaccaugccagggaaccuagcugccugugcuggggugggcugcaccccauccagguaccugaggccaagacucaggcuccggcccccugucuccggccccaucuccggcccccugucuccgggccccugucuccgggccucugucuccgggcucugucuccgggccucugucuucggccgcaucuccggcccccugucucugggccucugucuccgggcgucucucuccggccccaucuccggcccccugucuccgggccucugucuccggccccaucuccggcccccugucuccgggccccugucuccaggccucugucuccggcccccugucuccgggccccugucuccgggccucugucuccggcccccugucuccgggccccugucuccgggccucugucuccggcccucugucuccgggccccugucuccgggccccugucuccagcccccugucuccggaccucugucuccgggccccugucuccgggccucugucuccggcccccugucuccgggccucugucuccgggccucugucuccggcccccugucuccggcccccugucuccgggccucugucuccgggccucugucuccggcccccugucucugggccucugucuccggccccaucuccggcccccugucuccgggcuucugucucuggcccucugucucuggcccucugucuccaggccuuugugucccgccuucugucucuggcccucugucuccggccugacuccgcuucucuggguggcagcaggucagcacagcugcagcccaaguggacgccaugaacacagcucaaugguagagucgggugcccuuguguccugaaauuccgucuuuaaaaaaaaaaguaauagccuuuuuuuuuuuuuuagacagcaucucacucugucacccaggcuggugugaucauggcuuacugcagccuccaccuucugggcucaagccauccuccugccccagccuccugaggagcugggacuacagacgugugccaucacgccuggcuaauuuuuauauuuuuuauuuuuuguagagacagggucuuaguguguguugcucaggccagucucaaacuccuaggcucaagcaaucuuccugccuuggccucccaaaaugcugggauuacaagcaagagucaucaauaaaauagaagcuagccuggccuagcuuuuuuuuuuuuuuuagagggaguuucgcucuuguugcccaggcuggaguaccaugguacaaucucagcuuacagcacccuccgccucccggguucaagcaauucucccgucucagccucccaaguagcugggauuacaggcgcccgcuaccacaccuggcuaauuuuuguauuuuuaauagagaugggguuucaucauauuguuuagacuggucucgaacucuugaucucaggugauccgcccgccuuggcuuccgaaagugcugggauuacaggcgugagccgccgcgccuggcccccagcuuuuauuuuuauuucuuuauuuuuuauuuuuauugauuuuuauuuuuauuuuuugagagagucuugcugugucgcccaggcuggagugcaguggcgcaaucuuggcucacugcaagcuccgccucccggguucaugccauucuccugccucagucccccaguagcugggacuacaggugccugccaccacgccuggcuaacuuuuuguauuuuuacuagagaugggguuucaccauguuagccaggauggucucgaucuccugaccucgugauccgcccgccucagccucccaaagugcugggauuacaggcgugagccaccacgccuggccgauuuuuuuuuuuaaaucacaguuuuagguuuauagaauaauuaauaguauauggaauuccauacucccaccuacaguuuucccuguuaacaucuugcguuuguuacaauugaugaaccaacacugguuucacucugcagaaauucccuuuuaaaaacauccuguguauuaguuuccugggcuaacagaguacuacgaccuguguggguaaaacaaccgaaauauaaucucccaguucuggaggccagaacguccaaggggaaggcgucggcagagcuaugcucucugaaggccccaggggagagccucuuccugccuucugcguggcuucggguacugccauagcccuuggcccucccgggcucggagaccgucgcugcacugucugccacugucuucccguggcgugugucuguguguccucuucccuuguuauaaggaugcuggucauuggauuuagggcucacccuaauucguugugacuucaguguaauucgauuaucucugcaacccaccccauuuccaaacaaggccacagucgcagguacggagccagggcuucagcaugucuucucuucucggggacacagugcagccaggacgcccgucuugcucuggucauuuuggaauuuauccuagggcaugggucuccucccugugccacagggcaccugggcucccuccugcacccuccgcucugcccaccuggccaccacccacuuggcaucccucuccccaggcuccagcagcuccugcggucucccauucugcaggugcggccgggaacuuccugugccccgcuggcgccuuguccuucaacgccuucaagaccgugauggacaucgauaccagcggcaccuucaaugugucucgugugcucuaugagaaguucuuccgggugggugccucgugcgcucugugagaaguucuuccgggugggugccucgugcgcucugugagaaguucuuccgggugggugccuugugcgcucugugagaaguucuuccggguggguguacucccagcgggggccucccccugacggccgcccgcucccugcccugggccuccccaugacggccgcccgcucccugcccugggccucccccugacggccgcccgcucccugccccgggccucccccugacagccacccgcucacuguccugugaccucccccgacacccgcccgcucacugccccgggccuuguguguugcaggaccacggaggggugaucgugaacaucacugccacccuggggaaccgggggcaggcgcuccaggugcaugcaggcuccgccaaggccgcuguggguaugaccacccccccccgcccagguuugcccacguggguccccaaugggccgucugcuuccaucccaggaggccagcagucuccacuugaagcugagcccagcugcaggcagcgagaccuggccuuggcccugcgcccucgcagagggcagagcggcccuuucauauccaacuuucuucugugcagacgcgaugacgcggcacuuggcuguggagugggguccccaaaacauccgcgucaacagccucgccccuggccccaucaguggcacagaggggcuccggcgacuggguaaggcucucagggagcccaggccucccacagauccucuccuggggcacagggugcccaugaagcuuccagaaccuuggcaggguguauguugaaaagcccugugcugguuccaugguggcaacuauguucugugccuggccugauccugcuccaugcuaggccuuggugacacugacuguguccuugcuguucccagaugccucucagggaaugagcugggggagaggggagggugcugggucuuggggcucacggggccugagccuucugcugcccuccagguggcccucaggccagccugagcaccaaggucacugccagcccgcugcagaggcuggggaacaagaccgagaucgcccacagcgugcucuaccuggccagcccucuggcuuccuacgugacgggggccgugcugguggccgauggcggggcaugguugacguucccaaacggugucaaagggcugccggauuucgcauccuucucugcuaagcucuaggugagguacugcucccgcuucuuggggucaucuguguccuuggacgcuggucacugcaugggcaggucucugcgggacccacggggcuggcgucuccuuuguccccauccucccggccccugcgccagccugcccacacaugggugcugcccaguggggcugagcaggaggcgggcgcugguguacuugcucuucuguagcggccucggccucugccggcauuucuggcaggugcuggguggccgaggcagccgagguguuuuagggggaagccguccucagccggcuacuaaguucugaaacuccugcaggaaucuuccggccgcugcuuccugccgccucacucagccagguggagagcaccaaucugaaccagcaaugccugcagcccagccccuccucugaacacucagcuauuacugcgcuuucccuccccacggccccaacuccagggcaggagcaacuggacagugggccuggcccguggagcugccacgcaggugccugagggccaggugccacgcaggugucugaggaccaggugccacgcaggugguggggguacagacaagaugcugggauguccccugccccauggucaaggguguccugccugccuggguccagggccugagggagccacauggaucccgagacuuguguucucuuggcugaaaacacugaggugcucccaucugugcguggcccaugagcugggaugguccuccagcugcccacaagguccgccccucugucucugcaccaccuguuugcauaaacacacuuugcuacaaucuugcuagugcguuuucuuaaaagauaaucuauuuacuguaaaaauaaauuggacuuugcaaaagcuuuuagaaggaaaagaaagaggauuaaagagaauugcuggugauccua

SEQ ID NO: 192677 - RNA, 40480 nt, Homo sapiens
gaaagagccgagugggcucgaggccgacgcgaccaucguuugucgacgccgcugccaccgccugccugagagaagucgucgcggccgaccccgucgccuccgccggcuaccauguccgcccaggcgcagaugcgggcccugcuggaccagcucaugggcacggcucgggacggugagucagagcggccaaccaggcgagggucuggggugggagugaggcgaggccgccgggcggccugaggcgggggccgcgaucgucugcgccugcgccugcgcggggcaucgcuccuccucccccgcgcuccgaccgcaggcgccgggccuuugucuaagccggugcgucucugaggcggccguggguccaggucgggcuccucucucggagucugcgccauggauggggcuucagccuccuuccuauguaccguccugcuacuuccuccccggcgggcgccgcggcuccgugccccuccgcgaacuguggagucggcggagggcuggaaucagcgugggcuccaggucgcuggcagccggguggcagaacucuuccgaggcuccuugggaagaagcuacacccgagggagccggaugggccucgaaaaccuggcccgcucugguucuguaccauugcaaggggaaccguaaacugagcuuuucuaacguggguuucugccaaguacuuuuccagcugcccccuuccccccagcacacaggagagccucuguguagccagcgcuugacagucguuagguagguuguacuguguagggaggagcucaagaucaugaugguugucacaggagaaagcgguugcaucuuugcaaaacuauauaccugcugugguuuguguuuucuuuucugcugaguaaugaaguuguaaguucacacuggcacauucucagggcugugcagauuauuugcacuuuauuucauaggugaauaagugcuuuuuagcuuucuuuguauauugaguugcuuuugaauugcuucccauauuuuuauuucauacaaacugaacaauuguggccccucuauuuuauuuauaaagguucaguguaucuuugccugccuacaucaaucugcaagggaguugcagaaagccucauguucaucgagccgugagucacaaccaauuucuaagcuguuauaacaaaaaaguguuugcuuuuuuucacaaguaacuuuaaaaguguaguuuagaaagaaaacauuuucaauaaaaagacacuacauuaauccuggaugcuugcaaauccuaaaauauauuccuccucuagcguugcacagcucuguguuguauacacagacuagcuuuaaaauuugucacauaccacuuuaccuuuacuuuuauguaucauucccccgacuuccuuacugcaggugugggcaagaaaacuuuuccuuuaacacuuuucaacagcgggcauaaaauucugcagcugaggucuugaagaaugcagauggguacaguauguguuggagcucacaguguguauugacuaaccuaguuccuuuuuugcuuuuuuugguauugucuuguuaaaagugacucccagguagcaacucucuuuuuuaagggugggaacgaaagggacguaggaagaauagaucuagauuauuuaacagucuucgauagaguuugaaagcuuucuucuucauucaauuuugggcaaaauacugccucugcauuuguucauaacaaaaagauuagauuaauaaguagcuuuuguugguggaaauuaccagcucuauaagucacccuuggugguucauggaccucugauuagcuuggguuuugcagucucauugccacauguauauguggagccaauggccuuuuggugcucagcuguuuacgucugacuccuugacuucuuugguacagugauggagucagaucucauuaagugugauucuccaugauauaacuagccucaaaaaaauguguauuccacuccaguuguaaauaucuuuagaucagcuuuucauugcauuugauggggagaacacagaaaugauagucugcaaaucauccaggugaauuguuauacuaguuauuuuuuggugguuaaugugauaauauugucuuauuuaaaaccacaaaugaauuucaggagacgaaaccagacagagggucaaguuuacagaugaccgugucugcaagagucaccuucuggacugcugcccccaugacauccuggcugggacgguaggugcauuuugggggaccucauggaacacucugacaugagugcuguauaggcagugacgguuuuucuauguugaauuuuguuuuaacuuaagucucuuuuucucuaaguggcuuaauuauggcagguguuccuccacucguauguauguuugcaugcaugcaugcgauggagugucacucuguguugcccaggcugaagugcaguggugugaucacagcucacugcagccuugaacuccugggcuccagcaauccuaccaccucagccucuugagcagcugguacuacaggcaugagccacugcuccuuucucaauccuccacucuucaacaggcagaaaucccugaugcccuuaaaaugauagauucuauucauuugguaggauuuuauauuauggaacaaauuucacuguuguaaaauucugucuguaaaguuaccagauuuuuuguaaagucauuuauacugagauauucacaacuaaauagggcaaguauucuaauuuggcuguagcaaaaaauaugcuuuaggucagccugaaguucuuugaagauucugcguggguuuguuugaccucaaguugguuguguggaaaacuuuugaucuagcaagguacauuuucuucccgcaauuuuuugguuuuuaaaaaucaguugaggauacauugauuuuguaguuuuguguugugccaccccuucaagaaaucaacaugcuaucuaaugaauauagaacccuacaauuuuaaguucacuucagaugaacaaaacagauaaacgcuagcuuuguauaaugugcauuuauucgaaguaagaauuugaaaagacugaauaguggaagguuaucuguggugauuacgccacugagagaaaaggaguccuguagagaccacccccauuuuaagguuucacagcuaccucacggagguuaaaaacuauccucucauuuuaaggaugaaaugugcauauguuaaaggaaguuuucuucaugaugaaucauugcuuauauuagggaggagcaccuucuggaaaaccgcucagauguauuaaaacuucucaagcugaguuuucugacagcaaaugcgaaaugaaugccaaaccuugugccucuguuccuugggguguugucugcuguuuggccugggaugggaaaacguuacuguuugaugcagauuguuguguguaccgaggucaauacagauuaaugauuucaacucgucaaaggaaguuucacuguaggguauuuucauaggaugcacaacuuggaauucuugauaaacccauagugaaggaagucagagggagcagauagaugugcacucucgggaagauuucaaccauguuuuccuuggccagacccuguguagcauagcugcagaauacuggugagaaaaauaaucugagugagaguauuucuuuucuuuucuuuucuuuucuuuuuuuuuuugagacagaauuucaggcugggugcgguggcucacgccuguaaucccaguacuuugggaggccgaggcggguggaucaccugagguugggaguuggcgaccagccugaucaacauagauaaacccugucucuauuaaaauacaaaauuagcugggugugguggcgcaugccuguaaucccagcuacucaggagacugaggcaggagagucacuugaacccgcgaggcagagguuguggugagccgagaucgagccauugcacuccagccugggcaacaagagcaaaacucugucucaaaaaaaaaaaaaaaaagagacggaguuucgcucuuguugcccaggcuggagugcagugaugugaucguggcucaccgcaaccucugccucccagguucaagccauucucuugccucagccucccgaguagcugggauuacaggcaugcaccaccucgcccggcuaacuuuuguauuuucaguagagacgggguuucaccauguugaccaggcuagucuggagcuccugaccucgugauccacccaccuuggccucccaaagugcugagauuacaggcaugagacacugcgcccggccagaacuguguuuucugaagguuccggaaacuuuggugcccuuccuggucaguaguguuagaccaguagaagguacagaagagaacacagguuguggaguaaaaaacgccugacacacuggauuuagcagccauguggaauauuguggaaggacuuaaugaaugugauauuucagcucugcuugauguugggcauccaggggaauggccaguaguauuuuucccugccuccuuggcaaagcugaaaagcuacauccaaagaggguaaucauagaacccaagccuauccucagugugcuuaagcagggacucuuuugggagcucucacauugaaaaguaagugcugaauuuugcuucaugugagguuuuuuuuuuucagacggagucucacucuguugccuaggcuggagugcauggugcuaucucugcucacugcaaccucugucuccuggguucaagcaacucuccugccucagccuccugaguagcugggauuauaggcgcccgccaccacaccuggcuaauuuuuuuuguauuuuuaguagagaugggguuucaucauguuggccaggcuggucucaaacuccugacuucaggugauccacccaccucugccucccaaagugcugggauuacaggcaugagccaccgcgccuggccucaugagguuuucuuuuuuuuuuauuuugagacugaguuucgcucuuguugcccaggcuggaauguaauggcuccaucucagcucacugcaagcuccgccucccgggcucaagcaauucuccugccucagccucccgaguagcugggauuacaaacgugcgcuaccacacccggcuaauuuuuguauuuuuaguagagacgggguuucaccacguuggccaggcuggucacgaacuucugaccuaaggugauccgcccuccucggccucccaaagugcugggauuauaggcaugagccaccgcgcucggccucaugagguuuucuaaugucauaucuuucuugacaguugaguuuuuuauaauggaaaucaauuuguacuucauacuuuguuguacuucagguuuuagggucugcuuccuuugguaguagcuuuuucuuugaacaacaaagccuugauuaguuuaaagcauuuuuucugauagcugccauucauuuuucagcuacaaugcuuaguuuguggaaacuauauauuuuaaaggacaacacccacaacuuagaagagugaaugaggccaggugcgguggcucauaccuguaaucccagcacuucgggaggaggaggaggaggcggguggaucacuugaggucaggaguuugagaccagccuggccaacaugaugaaaaccugucucuacuaaaaauacaaaaauauuagccgggcgugguggcgugccccuguagucccagcuauucgggaggcugaggcaggaggauuacuugaaucugggaggcagagguugcagugagcugagaucgugccacugcacuccagccugggcgacagagugagacuccgccucaaaaaaaaaaaagaaaaaacagagugaaugagguaaaaguugucagauuuucagugacagugauuuuaagugcaaauuuggcuucuagaaccacuauuguccuaucucuaagucuucuauguaaccgaccauaacgugagucccaucugacuucagaguaagaaugauaaaggagaaaagucaaucuuucgucaaaauaaacaucaccauacaaggcagacccguugucugccgccuccauguuagcuuuauuauuggugauacugaaggauguuuuguuagugaguaugccacgugcuuucuuuuuuuaucuauuauuuuauuuuauuuuauuuuuuugagacggagucucgcucugucgcucaggcuggagugcaguggugcgaucuugacucacugcaagcucugccucucugguucaugccauucuccuuccucagccuccugaguagcugggacuacaggcgcccagcuaauuuuuuuuguauuuuuaguagagaagggguuucacuguguuggccaggauggucuugaucuccugaccucgugauccgcccgccucggccucccaaagugcugggauuacaggagugagccaccgugcccagccuagcaugcuacaugcuuucuaugagacugcaucccaagagucagacaugcaagccucucuauuuuuuucccccucaagauggauuaaagguuuaaagccuuccuuucuuuuuuuuuuuuuuuuuuuaaaagacggggucucuuuaaaaagcugggcgagguggcucacgcucguaaucccagcacuuugagaggccaagguggguggaucaccugaggucagcaguucgagaccagccugaccaacauggagaaaccccaucucuacugaaaauacaaaauuagcugggcgugguggcacaugucuguaauuccagcuccuugggaggcugaggcaggagaaucgcuugaaccugggaggcggagguugcggugagccgagauugcacuacagucugggcaacaagagcgaaacuccaucucaaaaaaaaaaaaaaauuaaaaagacaggggucucuguugcucagacuggagugcaguggcucagucacagcucacuugaagccuugaccuccuaggcucaagcgaucucuuccccucagccucccaaguggcugggacuacaggcacauaccaccacacccagcuaauuguuaauuuuuucauagagacagggucuugcuauguugcccaggcuggucucaaacuccugggcucaagugauccucccaucuugcccucccaaagguguugggauuacagacaugugccacugcaacugguacuaacgucuuuuuuuuuuuuuuuuucugguuauguagacauguucuuuuguccuacugggggugucuccuaguugggauguuggguuuuguuaacaugcacucuauaacuugacacgaugauccucagcacacaaaccucccuguugcuguguagauggcgagaggcagaaggugucugcauagaguccuauacuuaggauuuagauuaaaaucauacacuguuuucuaauuguacugcauaugguacacauaauagcacaucaugcuguucuuacugacaacauaaaucauuuuguuuuaguaauggaacguuuugcuugucaaauggaggaacugagugggacaauuaucuguccucacuuagauguccagggucauuucccaggcuaagaaaauguguagagcauguauuuggcuacgaaccagccuguucuccuuuauucccuuugauacacaaucagcuacacaaagccaaguguuagguugugauguaauugccaaaaucuaacuucuguccgcucuuuccucuuccucugucucugcaucuuaagcaucgagcaucucaaguagucaagauugcaagacaaugccuagaaauuuguugcagugagacuguuuucuggcccuuuccuuuuuuuuuuccccuuuucugagacagagucucacuuuaucacccaggcuggagugcaguggcacagucuuggcucacugcaaacuccaccuccuggguucaagcgauucuugugucucagcuccccagguagcugggauuacaggugcccugccaccacaccuggcuaauuuuuguaguuuuaguggagacuggguuuuaucauguugggcaggcuggccuugaacuccugaccucaagugauccgccugccucacccucccaaagugcugggauuacaggcgugagccaccacgcccagcccuggccguuuccuaucccugccaccccacaugcugccauuuacugaauccuuggacugaugcauaaauaaaacugggccaggcaccguggcucacaccuguaaugccagcucuuugggaggccaagguggguguaucacuugaggucagagguucaagaccagccuggccaacguggcgaaacccugucccuacugaaaauacaaaaaaaaaaaaaaaaaaaaaaaaaaaaaauuagcugggugugguaucacgugccuguaaucccagcuacuugggagaaugaggcaggagaauugccugaaccccggaggcagagguuacaguaagcugaggucgcgccacuguacuccagccugggugacaggugagacuccuuaaaaacuggcaaaagccaauuaauguaguugugaugauuacaguccaauuaucucugggucuaaaauagaaacuuuacacuauuaaaugcaucaguuucaaguaucacguagucacgaugguaaaagugaaaugaggcuucucagccauaucuccuuucuuaauuuucuuauugcagugucaguguuccaaaagugaucauuucuguuggugacaguugaaacaccaagucgcguugugugcuuucuacaguagguaggcacugaggucugcauuuucuguuucuuucccacagcgcauggauuuaggagaauguaccaaaauccacgacuuggcccuccgagcagauuaugagauugcaaguaaagaaagagaccuguuuuuugaauuagauguaaguuuuauuuaauguugauuuauuccuacugcgaagaacccaauauugaacuaacaagaaaaauguaacauacguaaguuaugaagcaaaauaauaagguaguugcuuguuauccugccacucaagcucagagcuagaauacagccaguacuguuuauauguuguguccagcguccugucaguguccuaaaugauaauauguguuaucucauuuuguugcuuuuaaaaauuuuaauuacauuuuuaugaguccuugaacaguguuuauuuuugcuuaguuuugaaugguuucauaguguagagucuuuaaaauuagauuuuuuugguucaguaucauguuucuguuugcccagguuguugcauauaguuuucauugcugcuugaauaauucucaaacgaucuuugcuuuauucauagacauuuagauugauucuaguuuugcuacugcagacaauaugaauauuuuugcauaacuuccuugucacguggauaaggauuuauuuuggguauauuccuaggagagggauugcugguuuauaggagauacccguauuuauccucgcaagacaauuuuguaauguugucuucuuguuucuauuugguaaagucccauagcagugucugcacgcucaccaacacuuuguauuaucagacuguuuaauuuuugcaguuuagugguuguaaaauggcauuucuuucugaucucaauuugcauuuuuuuaguacucaguaguuguguuauuuuaucuacauuaguaaauucuuuuuuuuuuuuugagacggaguuucacucuuguugcucaggcuggagagcaguagugcgaucuuggcucacugcaaccuacuccucccagguucaagcaauucugccucagccuccugaggagcugggaauacaggcaugagccgccaugcccggcugauuuuguauuuuuaguagagaugguguuucuccauguugaucaggcuggucucgaacucucaacgucaggugauccgcccgccucagccucccaaagugcugggauuacagguugagccaccgugccuagcuucuuuuucuuuuugauacagaguuucacucuguugcccaggcuggagugcagcagcaugauuauagcugacuguaagugaauugcugggcucaggugauccuucuuccacagucuccuaaauagcuaguacuacagaugcacacgaccaugucuggcuaauuauuuauuuaauuuauuuuaauuuuuauuuauuuauuuauuuugagacagagucuugcucugucaccaggcuagagugcaguggcaccaucuuggcucauugcaaccuccgacucccugguucaagugauucuccugccuuagccucccaaguagcugggaugacaggcaugcgccaccaugcccagcucauuuuuguauuuuugguagagaugggguuuuaccauguuggccaggcuggucucgaucuccugaccuugugauccgccugccucggccucccaaagugcugggauuacagcugugagccaccgcgccuguccuauuuauuuuugagacagguucuuguucugucacccaggcuggagggcaguggcgugaugauggcuugcuguaaccuugaccucuucggcucagugauagcccugccucggauuccugaguagcugcggguauaggugugugccaccacacccggccuuuuuuuuuuuuuuuuuuuuuuuuuuugagacaggguuuuacuauguugcccaggcuggucucaaacuucugcccucaagugauccugccaccuuggccucucacugguauugggauuucaggugugagccacuaugccuggccaguaaauucauuuagaguagcauuuuucagcuuuuuuucguuguugcccccaguggagccuuuuaagauucuuuuuucuguuuuuuugagacagagucucccucuguugcccaagcuggaaugcaguggcgcaaucuuggcucauugcaaccuccgccuccuggguuuaagcaauucuccugccucagccucccaaguagcugagauuagaagugcccgccaccacacccagcugauuuuuguauuuuuaguagagaugugguuucgccauguuggccaggcucaucuugaacucuugaccucaggugauccacccaccucacucucccaaagugcuggguuuacaggugugauuacacugugccugguaagaauacaugauuuaaacucacucaauuuuaauuguuuuuuaaucccuaaucacccaucgcuaguaugaccagagguuaguagagggguuugaugccauucugguucuugagugaagaccgggaaggcacugagcaugggaugagggagccagugaaaaauauaaaacccaagggaaagggucccuccgcuugcauuacaagaugucaauacguuuuacaguaaauucuuccuuuuuuuuuuuugagacggagugucacuguuguugccucggcuggagugccguggcaugaucuuagcucacuguaaccuccaccuccuggguucaagcgauucuccuaccucagccuccugaguagcugggauuacaggugccugccaccaugccuggcuaauuuuuuuuuuuuuuuuuggagauauaguuuugcucuugucgcccaggcuguaguacaguggcaugaucucggcucacugcaaccuccuucucuucucaugccucagccucccaaguagcugugauuacaggcacccgccaccacgcccagcuaauuuuuauauuuuuaguagagaugagguuucaccauuuuggucaggcuggucucaaacuccugaccucaggugauccaccugccuuggccucccaaaguguugugauuauaggcgugagccacugcaccuggccucaaguaaauucuguuuauuuauuuaaaaaaaaaauuuuuuuuuuuuuugaaacagagucucacucuuguugcccaggcuguagugcaguggugugaucucggcccacugcaaccucugccuccugguuucaagcgauuuuccugccucagccuccugaguagcugggauuacaggugcacaucgcuacgccuggcugauuuuuguauuuuuaguagagacgggguuuugucauguuggccaggcuggucuuaaacuccugaccgcaggugauccacccgccuuagccucccagaguguugagauuacaggcgugagccacugcgcccagccuauuuaaaaaauuuguuguggcuacauaauagguguauauauuugggggguaccugagauguuucauuugacacaggaaugcaauucucaauaaagaauaaauuccuggaccgugugcaguggcuuacagcuguaauuccagcaauuugggaggcugagguggguggaucaccugaggucgggaguugaagacuagccuggccaacauggugaaacgcugccucuucuaaaaauacaaaaauuagcugggcaugguggugcuguccucuaaucccaacuacucgggagacugaggcaggagaauggcuugaacccaguuggugaagguugcagugugcugagaucacaccauugcacuuuauucuacuugggugacagagcgaaacucugucucaaaaaaaaaaauucuauuuaaaauaguggccuuggccaggcaugugguggcucacgccuguaaucucaacacuuugggaggcugaggcaggaggauugcuugagcccgggaguucaagaccagccugggcaacauggggaaaccccgucucuacaaaaaaaugccagaguuagccaggcgugguggcaugugccuugagagaauggguuagagagcuagaacaggucagagaccuuuuuguccuaugugaaaauguacaauauacaagaguuacucccugaaaacuacccgcaucucccacucccuaaaagucauuuuugaccuuacagggggcucauauuaaaauaauuaggucaggcgagguggcuuaugccuguaaucucagcacuucgggaggccgaggcgggcagaucacgaguucaggaguucaacaccagccuggccaaauaguacaacaccgugucuaccgaaaauacaaaaaucagccggucaugguggugggcaccuguagucccagcuacuugggaggcugaggcaggagaaucacuggaacccaggaggcggagguuucaaugagccgacauugugccacugcacuccagccuggacaaccgagcgagacuccgucucaaaaaaaaaaaaaaaaaaaacaacuauuugauaaccaguguuuauaagcauguggaaaagaaaaagguccuccucacucaaagaauuagaguaaacaagggccgggcccuguggcucacaccucuuacccaagcacuuugggaggcugaggcgggcagaucaccugaggucgggaguucgagaccagccugaccaucauggagaaacccccaucucuauuaaaaauugaaaauuagccgggcguggugcugggcaccuauaaucccagcuacucgggaggcugaggcaggagaaucacuugaaccugggaggcagagguugcagugagccaagaucgugccauugcacuguagccugggcaacaagagcgaaaucccaucucaaaaaaaaaacaguaaaccgggcugggcaggcaagggggcuucugcuuguaauccugucacuuuuggaggccaaaagugaaggaucacuugagcccaggaguuuuugccugaagaacauguuucuagaaaaaaaauagaaaauuagcugggugugguggagcagcaguguugugggagagugaucugucaagacacugucgauguuuuuuuuuuuuuugagacagugucucacucucguccaggcuggaguacaguggcaugaucucggcucacugccaucucugccuucccgguucaagcaauuuucccaccgcagccuccugaguagcugggacuacaggugcaugucaccacaccuggccaauuuucuguauuuucuuuuuuuuuuuuuuuugagacggaguuuugcuuuugucgcccaggcuggagugcaauggcgcgaugaucucggcucacugcaaccuccgccugccggguucaagcaacucuccuaccucagccucccaaguagcugggauugcaggcacgcgccaccaugccuggcuaauuuuuuguauuuuuaguagagacgggguuuuacaauacuggucaggcuggucucaaacuccugaccuugugauccauucgccucggccucccaaagugcugggauuacaggugugagccaccgcgcccggcccaauuuuuuguauuuucaguaggcaggguuucaccauguuagcgaggauggucucaagcuccugaccuugugaucugcccgccucacucucccaaagugcugggauuacaggcgugauccauugcaccuggccuacuguugguguuuuaaacauuuuuuuccagaauuccacuguugggaaugugucuuaaggauaugugaaaaugaaugcagagaaaagauguuuaucguaacuuauuuuaagaggaaaaaaaagauguaauacaacuauugagauaggaucuuguucugcccaggcuggauugcaguggcgugcucauagcucacgguagccuccaacuccuggccucaagcuauucuccuacuucagucuucgaaguucugggauuacagucacaagccaccaugccuggccuaaaaguaucucugccuugugacuuauuucuagaaaucucuauccuaagaaaguaauuggaaauacauggaaacaugguuauaguaaagauguuugugggccagguguagugguccaugccuguaauccaagagcuuugggagacuagggugggugggucgcaugagcccaguuggagacuagccugggcaagaugacaaacccugucuguacacaaaauaccaaaaaaauuagccagacaagguggccugcaacuauagucccagcuacucgaggggcugaggcuggaggaucaguugagcccggaggaucaaggcugaagugagcugugcuugcaccacugugcuccagccuggagaacagaacaagagucugucucagauaaaugaaugaauggauaaaugauacuuaugacaaaauuguuuaugagauugaaauuuggaucaagaaaaaugcccaagaagagaaaugagugaauaaauuauaaugaaccuauaugauagacucugcccuucaaacuaauguuugugaaaccugucuaaugauuucaaauugcuuaugauaggcagggcucaguggcucacaccuguaaucccagcacuuugggaggcugagguggguggaucaugaggucaggauaccagccugaccaacauggugaaacacugucucuacuaaaaauauaaaaauuagcugggugugguggugcgcaccuguaaucccagcuacucaggaagcugaggcaggagaauagcuugaacccaggaggcagagguugcagugagccgagaucgugccauugcacucuagccugggcgacagagcaagacuccauuucaaaaaaaaaacaauugcucaugagaacacaaaacaaagacacaaaauauaaagcuguaacgauuucaacucaagccaggcacaguggcucacuccuguaaucccagcacuuugggaggcugaggugggcagaucacaagaucaggagauggagaccuuccuggccaagauagugagaccccaucucuacuaaaaauagaaaauauuagccaggugugauggugggcaccuguaaucccagcuacuuuggagggugaggcaggaaaaucgcuugaaccugggaggcagagauugcggugagccgagauugcgccacugcacuccaguccaggaaacagugcgagacuuggucucaaauaaagaaaaaaagaaaaaagauuucugccgggugcgguggcucacgccuguaaucucagcacuuugggaggccgaggcagacggauugcaugaggucaggaguucgagaccagucugaccaacauggugauaaccugucucuaauaaaaauacagaaauaaaauuagccagguguuguggugugcaccugcaaucccagguacuugggaggcugaggcaggggaauugcuugagccugggaggcagagguugcagugagcucagauguugccucuacacuccagccugggugacaagaugacgcugugucucccuguccccuuccaaaaaaaaaauugugggccuuuauuuucugccuggaccaucaccuuaagcuugauggauggaacuccuggcacauuucuacccaggauccucccaguacucaguuguuuuaccugggagaagauacccucccuguccucaucauuggcugcuuccagccugagucagccucagccugaccacaaaagacccaggccuugauauguuuuaucuggaaguugccuaggaaaggaugugugcuauauuuguuauaaggcagucuauaaauaaacuaaguuucucaacuuguaaacugucaaacagcaauauuaaucauauuaagcucugaaaaaguuacagauggccaggugugcgcucacgccuguaaucccaguacuuuggugggaggcagaggccggaagauugcuugagcccaggaauucgagaccagccugggcaaagucucuacaaaaucagaaauguuagcuggguguagugacguguuccuauaguccuaccugcuuuggaggcugagguggaaggaugguuugaaccugagaggucaacgcuaaagugagccgugaucgugccacuguauucuagccugggugacagagcaagauccucucgggaaaaaaaaaaaagguauauuucuuuaguguucacauguugaaaauguaaugaaugugucuuuguaauucaccaaaaguguaauuaaccuuuacucccauguugucuggccaugugauguuuugaaaaguuuucaaaacaacauauaugggcucauuucaaagcuguuuuuaauauaccacaugagaccaguucugauuguauguaguuuuccugucuuacaguuguccaguauaagagugacauuuuucuaggucaaaugucuugaguuagagucccugugugacccugggcaaguuauuucaccuucuuuuuuucaucuauaaacugggcugacgauggcugccucagauuugugaggaugaagugcaggucuuuggagccagaccacaaggguccuuggauccugacuccauugcuuacuuagugguuugguagcugugcuucacuuucaucauccaugcaauggagacccgacgagcuccucugcggcuguguuuuuugagauggaguuucgcucuuguugcccagguuggagugcaauggcacgaucucagcucacugcaaccuccgccucccgaguucaagugauucuccugccucagccuccugaguaguugggauuacaggcaugcaccaccacgccuggguaauuuuguauuuuuaguagagaugggguuucuccuuguuggucaggcugaucucaaacuccugaccucaggugauccacccaccucagccucccaaagugcuaggauuacaggcgugagccaccgcgcccggccccucugcggcucuuuggagguguuuagcgcacgugccuagugcagcacaagggcaccugucugcugugacaguucugacugacaucaugggcuuuucucaggcucagugaccaccggccugugucagugcugcugggccgggagagcugguaacagcaccaggcaguccguguguggagggacagccuccucaguggagaugacgugugcugauauuguccaguuuugccauacuguuaggacacaagucuuugugcuggugcugucugugcucaggggcuuuuaggguuuauguuucauaacgcuacucagagauagagagagauugggugacuuucuaguaagugguagguugugauuaggacuuaauuuuuggaaucgaaugucuuuuuuuuaucauuuagaucugcucuuuuaagaaacaggcuaaaguugagaaacacuuugaagggagagggcaguagaacagaaagccaccuuuuaaagaacuuggcagcucuugguuggcuuguucucuguugugaaguuuaccauuuauaguuguuguuuucuguuugagccagucuugcucugucgcccaggcuggagugcaguggcgugaucuuggcucacugcaaccuccgccucccagguucaagcgauucuccugccucagccucccuuguagcugggauucaccucguaaggcgaauuaaccuuagcauaugauaguucuuuuaguguuucccaccacccuuuucagaguaagcaauuagacgucuagaguuucuuuuccucuaucucuuuggguaaauagcaaccaguggugcccgccaccacgccuggcuaauuuuuuguauuuuuaguagagaugggguuucaccauacuggccaggcuggucucagacucccaaaguguugggauuacaggcgugagccaccgugcugggccuaccauuuaguguucuuuuuuuuuuuuugagacggaguguugcccugucacccaggcuggagugcaguggcacacagucucugcucacugcaagcucuaccucccggguucaugccauuguccugccucagccucccggguaccugggacuauaggcgcccgccaccacgcccggcuaauuuuuuguauuuuuaguagagacgggguuucacuguguuagccaggguggucucgaucuccugaccccgugauccgcccaccucagccucccaaagugcugggauuacaggcgugagccaccacgcccggccaccauuuaguuuuuagguuaucagacaucugaguccauagccaauuuggauucugcuuaaggugcagguaauugcuuugauggguuuagguauugggagaguugucagcugccuauuucccauuugaccccucgagugaaucccugaaucugucucagguuggugauugauugcucagcuugagcagacaguacagggccacugugugggugaaccuggagcaucucagacuggucuguuaggggcuguugucugagguaagcacagaagagaaggcacagugacccuugucagcuccuuaauacuuggauccugaugagcuccagccagcucuucaccuuuccagaaaguccaguguacaggugcauagaagcagucaaaugccggaucauuuguuuuccugauucuuugauuugaacauacugaaauguugacuagagaauaucugggugaccaacaagaagcaguuuauguauuuuuuugagagggagucucgcucuuguugcccaggcuggagugcaauggcgcgaucucaguucacugcaaccucugcuucccagguucaagcaguucuccugccucagccuccgaaguagcugggauuacaggcaugcaccaccacucguggcuaauuuuguauuuuuaguagagaugggguuucuccauguuggucaagcuggucucgaacuccugaccucaagugauccacccgccuuggccucccaaagugcugggauuacaggcgugagcuaccacgccuggccaagaggcaguuuuugaauuccaaaauuauggagugauaucugggagucagccuucaucagugaugcugcuugugcuuucuccagcuucuugggagacugggcaccaggagacuuggagguucuucccuaucuuaccuacucccaaguaugcauguuuuugaaaaaaauauuuaagauuucuagagaagaucacaaucuucuccagugucuguguaauccauuguggagcaguuuauuacagcugaccuacugucuccugucuguuuuaggagcggugacuuagguuaucaccccuuaguguuuuccugucaucugccuucucaucuccaccuaaaauuuaguuuuugguaaaagaucaugcuaucuaaccuugucaucauugcaaaacaaacuuauuuauguuuaucaugaugcugacauuagcaagcugacucaugguuuaauguuaguguuucuuacuacuggucacuggcugacagucggaaaagugaugcccuauuuuuuuuuuuuuuuuuugagauggaaucuugcucuguugcccaggcuggagugcaguggugccaucucggcucacugcaaccucuuccucccagguucaagcgauucuucugccucagucuccugaguagcuggaacuacaggugcaugcuaccacgcccagcuaauuuuuauguuuuuaguagagauggggcuucacuguauugggaaggcuggucuugaaccucugaccucauggauccucccgccucggccucccaaagugcagggauuacaggugugagccacugggcccugccuuuuuuuguuuuuguuuuuguuuuugauacggagucuugcucuguugccuaggcuggagugugguggucuggucucaguucacuacaacuucugccuccgaggcucaagcgauucuccugccucagccaccugaguagcugggauuacaggcacccgcuaucaugcccagcuaauuuuuguauuuuuauuagagaccauguuggcuagacuggucuugaacuccugaccucaugauccgcccaccuuggccucacaaagugcugggauuacaggugugagccacugcguccgguccugucucuguuuuuaucugaaauuauguuagccuuugccuaguuauggugaauuaaccuuagcauaugauaguucucuuaauguuucccaccacccuuuucagaguaagcaauuugacgucuacagcuucuuuuccuuuaucucuuuggguaaauagcaaccaauuuuuccugcuacuuuagauaguaggcaauaacaaaauguauucauagcucucaguaauauuuguucuauuguuuuguuuuugaggugaaaggggggacccuacccucagaacaugagggaauaauauuuacguggcucacaaagaccagugaguacaucauaugcaucucucacaacuccccagaagagggccuccagcacgagucuaggcucagccuuuucugucccuccgagaacucuaugaauugcugccaaguguuuuaauuuuccucagaauuucuuuguaauguuauugaggguuggagguccuuuuacaaauuuuggaaauaaguaaaucaaaugagaagaccaugcuuccaaacaaucauucuguuuaacagauccccuugauuuaaugcaauuaugaaugcguuagugguaguguaguuuaagaucuuucccuugaauguacaggcuuuaaagaaacgaaccuaggaguguauuuccuaucaagcaaauggguucuaagacuuuacgcuuuacacaucauugauuauagcgcugugcuuuucccgugcuaggcaauggaucacuuggaguccuuuauugcugaaugugaucggagaacugagcucgccaagaagcggcuggcagaaacacaggaggaaaucagugcggaaguuucugcaaagguaugcuuggguggcuucggugucugguguguucuuaaaaauacuggcuugucaauagcuuuuuuuuuugagauggagucucccucugucacccaggcuggagugcaguggcaugaucucagcucagugcaagcuccgccucccggguucaugccauucuccugccucagccucccgaguagcugggacugcagacgcccgccaccaugcccggcuaauuuuuuguauuuuuaguagagacgggguuucaccguguuagccgguauggucuugaucuccugaccucgugaucugccugccucagccucccaaagugcugggauuacaggcgugagccaccgcgcccggcguugucaauagcuauuaacugacccucagcacugauuguguggacaguacucucugccuuacuccaguuaaggauagagggcugugaucaagcauucaugugucauggaauucucaucccucaggagcugcuaccucugucuuuuuauucucuccauuuucguccucuguacaugguuuaucauuauuuuuuaauuuuaauauauucuucgcugaguuugguggcuuaugcuuguagucccagcacuuugggacaccaaggugggggcagacugcuugagcccaggaguuuuagaccugagcaacaugaagaaaccccaucucuacaaaaaauacauauauuagccaggcuugguggugcacauguguaucccaguuacucaggaggcugaggugggaggaucacuugagcuuggggagauugaggcuucaaugagcugugaucaugcuacuuugcuucagccuggauaacagagugagacccugccucaaaagaaaaaaaaauuauugucgguuuuuuuuuuuuuuuaagagacagagucuuguucugucgcccaggcuggagggcaguggcgugaucucgacucacugcaagcuccgccuccuggguuuacgccauucuccugccucagccuccugaguagcugggacuacaggugcccaccaccacgcccagcuaauuuuuuguauuuuuaguagagacgggguuucacuguguuagccaggauggucucgaucucuugaccucgugaucugcccgccucguuuucccaaaguacugggauuacaggcaugagccacugcacccagccaucuuuuuuuuuuuuuuuuuuuuuuuuaauaaagauggagucuguugcccaagcuggucuggaacucuugggcuuaagcaauccucccgccuuguccucccgaagugcugggauuacaggugugagccagcaugcccagccucugcauguuguuuuaaacuuuaauaucuccacauaaaacuggaaagaauugguaaggaaauggucaaacugugguacauccauaucauagaaugaaaaggagguagauuuauauguaauuagacugagugccauuuacaucacucuucuguuuuucucuucaguggaacuaagccucuccuuguuuuuucuuuucaguguuguaaaagcauuucuuaggauuuaugcaauugcuaauuugaccaacggugcuauuuuguuucagaagguaaauccuaguaauuagguauuuugguuacagcuuaaaucuguacauuuaaaccuaggcauuuuauuaccauacccagaagaaaaagucauaaagagagacagccuagacaaugaccaaucugugaugauccuuggaagcaugucggaagugacaaaggugccacugguuucauuggaacauaggacucguuuaugguuacagucucaaugcuggcaguaaggaugccuucauuguuaaguguggaucuuuagcucuuccacuuauuuucagacuggaaauggagcaggagaaacccuuguugccuuugcauucacuuucauuuucagaugucugcuuaccucauucuuucuccucacaggcagaaaaaguacaugaguuaaaugaagaaauaggaaaacuccuugcuaaagccgaacagcuaggggcugaagguaauguggaugaaucccagaagauucuuauggaaguggaaaaaguucgugcgaagaaaaaagaagcugagguuggugagauaagugccuuagggcaagagaaaucuuaguaauuuggcagcguugaccguuggaauuaauugagcccaugcuugcucccauuuuuuaaaaaauuuauacauuuugggcccagcacaguggcucacgccugucaucccagcacuuuggaaggccgaggcgggcggaucacgaggucaggagauaagaccauccuggcuaacacagcgaauccccgucucuacuaaaaauacaaaaaaauuagccgggcauggcgccaggcaccuguagucccagcugcuccggaggcugaggaaggagaauggcgugaacccgggaggcggagcuugcagugagcugagauugcgccacugcacuccagccugggcgacagagcgagacucugucucaaaaaaauuuauaaacgcuguuuuugcaagcaguuuuagcuucauagcuaaauugagaggaaaguacagagauucuccauguacccucuccucagacagccuccuccauuccuagcaucugcccacagucagugggucuacguugacuugucauuaucacccaaagucugcagaaaauguuagguaugucaugaauacauaaaauauaugaggauacuagucuuuuauuuacugccauaaaauauacacaagucuauuaugaaaagguaacauuugucaaaacuuaagcauauggccagcuaugguggcucuuggcuuuagucucagcuguucgggaggcugagaugagaggaucccuuaauccuaggacuuuuggaguccagccuggauaacauagcaagacccugucucuaaaaaagaagaggcuacaugcaaacgcuuacagaccauacaugacagcauucgccguagagagauguuaacaaacguagugcagaggugcaguauuaaaucagggcugccuaagaauaacuguaauagguacuguacuacuguaauaauucaugccacuuccuguugccauuguguggagcucaagggucgugaguauccccuugaaacaccacgugacacucaucaucuccgaaggagcaguucaccucuccaguacauuccuacugcaguaaaaagugaacucacaggguuccuaggcguuuuucaucguguuuagugcaauaccauaaacuuugaguaaugccauaggauccauaugccacuagugaugcugaaaaugcucccaagaaggcaagaacagccaugauauuacaagaaaaaguugaguugcuugauguauacauuagauugaggucugcagcugcaguugcuaccauuucagacggacaauucaucuuguaaaugagcaguguaaacguacagaagugaucaguacagcacaguacuauaaauguauuuuauuuucucuuccuuauaauuuucucucuuuuuuuuuuuuuugagauggagucucgcucugucccccaggcuggagugcaguggugcgaucucaguucacugcaagcuccgcuuccucgguucacaccauucuccugccucagccuccagaguagcugagacuacaggcgcccaccaccacgcccggcuaauuuuuuuguacuuucaguagagaugggguuucacuguguuagccaggauggucucaaucugaccucgugguccacccgccucggucucccaaacugcugggauuacaggagugagccaccaugcucggcccauggcuaauuuuuuuuuuuuuuuuucauuucuaguagggaugggguuucaccguguuggccaagcuggucucaaacuucugaccucaggugauccgucugccuuggccucccaaagugcugggaucacaggcgugagccacuucgccaggccauuugauaccuuuuaugagucuuguaauuuuucucauagugaagaucucaugcauguuuuguuagauuucuaccuaaauauuucaugcuugcgggugcugguguaauuggucauuuguuuuuugguuuuuguuuuuguguuuuuuugagauggagucucauucauucgcccaggcuggagugcaguggcgugaucucggcucacugcaaccuccgccucccgggcucaagcgauucuccugccucagccucccgaguagcugagacuauaggcgugugccaccauaccuggcuaauuuuuuguguuuuuaguagagauaugauuuaaccguguuagccaggauggccucuaucuccugaccucaugauccgccugccuuggccucucaaagugcugggauuacaggugugagccaccgcgcccagcccuccccaccuccaccccgccccccgcccugagacggucucacuuucucacccaggcuggagugcaguggcgcgaucuuggcucacugaaggcuugaucuccugggcucauuugauucucccgccucagccuuucaaauagcuaggacugaaggcacaugccaccaagcccagcuaauuuuuuguauuuuuuggagagacuggguuucgccauguugucaaggcuggucuugaaauccuuggcucaagcgaucugccuagcucugcuucccaaagugcugggauuagagucaugagucaccaugaugccuggccucuuguaauaccuuuaucugguuuugguauuaugguaauguccccauagaaggaguuagaagauacucucucugcuucuauuuucugaaagcgauuguagagaauuggcaugauuugcucccuaaugcuuugguagaauucaccaguaaacccaucuggaccugaugcuuucuguuuuggaagguuauuaauauacagauucauucagaucaucuguuucuucuugugugaguuuuggcagauugugucuuucaacauuauuauacuuuuuuuuuacacggagucucucucuguugcccaggcuggagugcgguggugcgauggcucgcugcaaccuccaacuccuggguucaacugauuauccugccucagccuccugagcagcugagauuacaggugccugccaccaugcccagcuaauuuuuguauuuuuaguagagaagacgggguuucaccaugucggucaggcuggucucaaacuccugaccucaagugauccaccugccucagccucccacagugcugggauuacaggcgugagccacugcuccuggcugucuuugaagggaucgguccauuucaucuaguuuaucgcuuuugugggcauggaguuguuguuuuuaagaguuguuuguauuauuccuuuaaaguggguggauccguaaugauguccugucuuucauuucugauauuaguacagucauaucuuucuuaaugacaaggauuaaauauucugagaagugcguuccaugguucaucauugugagaacauuauagagugugcuuaacaaaccugggugguauagccaugugggcuguaugguagagcccauugcuccuaggcuccacaccuguacagcauguuacugugcugaauacuauaggcaguugcaacacagugggccccuaaauauuuguguacguaaacauagaaaagguacaguaaaaauacaguauaaaagauaaaaaauaacacuugauacgguuuggauguguggcacguccaaaucucauguugaaaugugaccuccaauguuggagguggggucuagugggagguguuugggucaugggggugguucacucaucaauggcuuggugcccucccugggauagugaguucaccucagagcugauuguuuaaaggagccuagguccuucucucugucucacuccuucuuuugccaugugauaugcugacuccccuuuugcugccuucugcccagcguaaaagcuuauggaggguggguaugguggcucaugccuguaaucucaacacuuuggaaggucgaggcaggaggauugcuugaguccaggaguuugagaccagccugggcaacauagggauaccccaucuuuacaaagaaauuaaaaauauggccgggcacgguugcucaugccuguaaucccagcacuuugggaggccaagguaggugcaucaccugaggucaggaguucgagaccagccuggccaacuuggugaaaccccauuucuacuaaaaguauaaaaauuagccaggugugguggcgggcaccuguaaucccagcuacuugggaggcugaaguaggagaaucgcuugaacccagaaggcggagguugcagcgaacagagaucgugccauugcacuccaauaugggugacagagcaagacucucucucaaaaaaaaaaaaaaaaaaaaaaaagccuggugcgguggcucacgccuguaaucccaucacuuugggaggcugaggcggguggaucacgaggucaggagaucgagaccauccuggcuaacauggugauacuccgucucuacuaaaaauacaaaaaauuggccgggcguggcggcgugcgcuuguagucccagcuacucaggaggcugaggcaggugaaugguguggacccgggaggcagagcuuguagugagcugagaucgugccacugcauuccaggcugggcgacagagcgagacuccgucucaaaaaaaaaaaaaaaguuauguaaauggaaucauacaguagguaaccuuuugggacugacuuuuuuuacucaacauaaucagaguuuauuuugaaagauguuagaagguggcauuuaagguuucaaaacuauagaaggggacagaguaauguuaugaauauuuguguaccacaauauuguuuuugcuuaaguuuuuuuuuuuuuuuuuuuuuuuuaguuauguagcauacuauaauggaaauucaaguucuugcuaguuccuugucuacuuuuuuuuuuuuuuuuuucucagacagagucucgcucugucgcccaggcuggauugcuguggugcgaucucggcucacugcauccucugacucccggguucaaguaauucucagacucagccucccgaguagcugggauuacaggugccagccaccgugcccagcuaauuuuuuuguauuuuuaauagagacgggguuucaccuucucggacuccugaccuugugauccaccugccuuggccucccaaagugcugggauugcagguguuagccacugugcccagccuauuuuuuuuaauauuagaggguccugcugucagccagggucacccaggcugaaguacaguggcgcagucacaggucacugccccuucaaccuccugggcucaagcaguccucucgaaucagucucuugaguaggugggacuauaggcacgugccaccacagcgggcuaauuauuuucuuauuuuuagagacugagucuugcuguguugcucagggugaucucaaucuccuggggccaagugaucuucuugcuucacucuccuaaagugcugagauuauaggugugagucacuacaccaggccuggaauacaauuuuuuuuuuuuccuuuuuggaguuuuccucuguccuccagguuggaaugcaguggugugaucucagcucacugcaaccuccaccuccugggcuuaaacaauuugugccucagccucuccaguagcuggaauuacagaugccugccaccaucuggcuuuuuuuuuuuuuuuuucuuuugagacggagucucgcucuuucgcccaguggcaugaucuuggcucacuacaagcuccgccugccggguucacgccauucuccugccucagccuccugaguagcugggacuacaggcgcccgccaccacgcccagcuaauuuuuucuguuuuuuuaguagagacgggguuucaccguguuagccaggauggucgugaucuccugaccccaugauucgccugccucagccucccaaagugcugggauuacaggcgugagccaccgcgcccggccaauuuuuguauuuuuaguagagacaggguuuugcuauguugccaggcucgucuugaacuccuggccucaagugaucugucugccuuggccucggaaugcugggauuacaggcgugagccacugagcccagccuguuaguaccuuuuuuuuuuaagauggagucucgcucuguugccaggcuggaaugcaguggcacgguuuuggcucacugcaaccuccgcuucccagguucaagugauucuccugccucagccuccugaguagcugggacuacaggcaugugccaccacacccagcugauuuuuguauuuuuaguagagacgggguuucacaaaguuggccaggauggucucgaucucucuuuuuuuuuuuuuuuuuuuuuuugagacaggguuuugcucuuguugccugugcgaucucagcucaacagcaaccuccgccucccgaguucaagccauucuccugccucagccuccagaauagcugggauuacaggcaugcgccaccacacccggcuacuuuuguauuuuuaauagagaugggguuucuccauguuggucaggcugaucuugaacuccggaccucaggugauccgccagccucagccucccaaagugcugggauuacaggcgugagccaccgcgccuggccuggucuugaucucuugaccacaugguccgcccaccuggccucacaaagugcugggaccgugccuggccgcguuucuuaaauaaacagugaaaauugaguugguuauaaauaucugaaguuuuguuuguguuuuuuuaauauuuguuuaaaagucaccucugucaucuuaucaaauauuuucauuuuggagauugaauuugugguggcaguucuauauaccucacuuuuauuucuccauuuuccuucuucaggaagaauacagaaauuccaugccugcauccaguuuucagcagcaaaagcugcgugucugcgaggucuguucagccuaccuuggucuccaugacaaugaccgucgccuggcagaccacuucgguggcaaguuacacuugggguucauucagauccgagagaagcuugaucaguugaggguauguucaucuguuucuggagaaagcugaggagucuugggguguuuucacauuucuuuaauuuuuaaaaaccuuauguuuuggccgggcgugguggcugaugccuauaaucccagcacuuugggaggccgaggugggcgaaucaccugaggucaggaguucgagaccagccugaccaacauggugaaaccccgucucuaccgaaaaauuagccagguguguuggugugagccuguaaucuuagguacucgggaggcuggggcagaagaauugcuuaaacccaggaggcagagguugcagugagccgagaucaugccauugcauuccagccugggcuauagaguaagacuccaucucaaaaaaaaaacaaaaaacauuauguucugaucucuaagaacuugaguuuuauagugaaauacgcagauuucaucacuuggauucacacaagagacaugauagcucagaguccaaaggagccuuggagauuuauuuuggacccugucguuaagggaagaaaauggcagagccuguucccagaauacauacagcucguuguguaucucugaaauaacuucuguuaggagaugagaaagaaucucugguuggucaagacagagugucacacauccuggcuccuugccuaugagccaccucagaagggcggggugaagaugggguuuuucugguagcauuguaccaucccagcccagagaaaaccucuguuccuucuucaagacucuaagacauuuaaaaacuuuuuuuuuuuuuuuuuuuuuuuuuuuugagauggagucucgcucugucgcccaggcuggagugcaguggcccaaucucggcuuacugcaagcuccgccucccagguucacaccauuuuccugccucagccuccacaguagcugggacuacaggugccugccaccacgcccggcuaauuuuuguuguuguuguuguauuuuuaguagagacggggcuucaucguguuugccaggauggucucgaucuccugaccucgcgauccgcccgccucagccucccaaagugcugggaccacaggcgugagccaccgcacccggccgacauuuaaaaacuuuaaguacggaaugcuaagaaggaagguuggacguauuuccacuacuuugaauugucucccuucacacugauggagccccccuuaccgcauacuaggaccucaggauaggauggugggaaauuagccagccucccccuguauaccugaaauguaguggagggacagacgugucgcugacugcagaaugcugcagugaccacggcugagggccuuuugugccccaggaaagagcugcucacucaggccgcauauggcagggcugugcaccucaggagggucccauaggugauggugugaaccugggacugugaugggagcuggugcagcagugagguuauucucggccacuggucuugaaacauuuuacuuccguguucccgagagaauuuugaaaagcaauguacucugucaaaguuggaauuuuucuuuauaaguuuauagguaugaaagauguaaaagugaggcugggugugguggcucacgccuguaaucccaaacuucgggaggccgaggcagguggaucacgaggucaggaguugaagaccagccuggccaacauagugaaaccccgucuuuacuaaaaauacaaaaauuagccaggcauggcagcgggcgccuguaauccuggcuacucgggaggcugaggcaggauaauugcuugaccugggaggcagagguagcagugagcugaaauugugccacugcacuccagccuacgagacagagcaagacuccgucucaaaaaaaaaaaaaaaaaaaaaaaaggcugggugcagaggcucagccuccuguaaucccagcauuuugggaggccgaggcgggcagaucacugggucaggagauugagaccauccuggcuaacaaggugaaaccccgucucuacuaaaaauacaaaaauuagccgagcaugguggugggcaccuguagucccagcuacucgggaggccgaggcaggagaauggugucaacccgggaggcggagcuugcacugagccgaaauugcaccacugcacuccagccugggcgacagagcgagacucugucucaaaaaaaaaaaaaaaaaaagauguaaaaguaucuguauccaauagaauuauaaaucacaauuuaguaugcauuuaccacucuauuaaaaauuugcuuuuggccaggcaugguggcucacaccuguaaucccagcacuuugggaggcugaggagggcggaucacuuaagucaggaguucgagaccagccuggccaacauagcaaaacccugucucuacugaaaacacaaaaauuagcugggcauggugguacacauuuguauucucagcuacuuggcaggcugaggcaggagaaucgcuugaacccgggaggcagagguugcagugagccgaaaucgagccacugcacucuagccugggcaacagagugagacuuugucuuaaagaaaaaaaaauuguuuguuagccacuggaaauguuacuuucccauuucuccuuuaaauuacauuuucauuucacagcucagaauuuuguccuacuguaguuguuggguuuuuuuuguuuguuuguuuguuuguuugaggcagggucuugcucugucacccaggcuggagugcaguguaacgaacucagcucacuguaaccuccaccucccagcuucaagagauacuccugccucagcccuccaaguagcugguacuauaggcgugcaccaccaugccuggcucauuuuuguguuuuuaguagagaugggguuucaccguguugcucaggcugaucucgaacuccugagcucaggugauccaccugucucggccucccaaagugcugggauuacaggcgugggccacagugcuuggcccuaauguaguauuuuuuuuuuaauaucugcaaucuuuuauuuccuuaauguguaucucugcauuagaaaugugaauauugugaaauguuuuucccuucuaccuuaagaagcauuaacuugguuagaaagcuuguuuuaucauugcagcauagaguugaccaaaacaacacaacucguauuacagacuuugauaaauaauuauuaaaguaacagugcacaauguauuuggaagugcaccucuuaaugauagggagagugggaguucugugcccuaguuagaggaggccucacucacaguagucccagagguauccaccuuccuaggccucccagagugcugggauuacacaugagccacugcaccuggcuaauccuuaauuuuuuuaaaaacugccauccuugaggcugggugugguggcucacgccuguaauuccagucuuuaggaggccaaggcaggagaaucgauugaauccaggaguuugagaccagcgugggcaacauaaggagacccugucucuaccaaaaauuuaaaaauuagccaagcaugguggugugugccuguagguccagcuacucaggaggcugagguaagaggauuguuuggaccuuggagcucaaggcugcagugaacugugaucacgacacuacacuccaaccuagacaacagaggauuuuuuucguuuuuuuuuucagagacagggucucccucuggcacccaggguggaguguacugaugugaugguagcugauagcuuauugucacuguaaccuggaacuccuggacucaaguggcccugcauccugagucuccugaguagcagagacuacaggcaugcaccaccauaucuggcucauuuuuuuuuuuuagguaggaggucuuacuauguuucccaggcuggucucaaacuccuguccucacaugauccucccaguucagccucccagagugcugaaauggcaugagccaccguaccuggcuuaaaugccauccuuaaacaucaccuuaaagguguccauccaugugugcccugcuucagacacaggaugagcaugggugaaaguuuagagcuggagauaccagucacccagcucugcauacuuuccgugcccuuguggggagcgugcucucauccacacuggguauggaagauuauccuuaugccaucguggcucucuggauggagaagacucgugauucuuugucuuacuggcucugacuugcucccacucagggcuucacuugacacagaugaggggcauuaaaugucuuagaguugauauugggaguaguggguauacagaacggugcccggugcuuuuccacucagcuuguguugacgguauuuucauuggcgagguuucucauccccuuauauugcuuucuucaucaagccugaugauucacaucauccuguguugaaagccaguugcagaggauuugugguccaccuccccuggccugcuguccuccaacucaguuuguucuaaagccagcguagcacccagcacccugagguugggcugcuuuuuggcuguagggauucugcucccaguagcaagauguguuugaugagauacauccguccuuuuuuaccauaaaguuuguacagucuccuaccuaucuggguugguuugaaacaaugugaucaauucccugugaguuagaaguauagcaccacuuagaauagacaguuuguuaccacauuguuaaaaucuaaugauaggcugggugguucaggccuguaaccccagcacuuugggaggccaaggcaggaggauugcuugaguugaggaguucaagcucagccugggcaacauagcaagauuccaucuccauaaaaaauguuuaaagauuagucugccaugguggcacacgccuauagucccagcuacucaggaggcggagcuaaagaggcuugcuugagccugggaggucaaggcuccggugagcugugauugcgccacugcacuccauccagccuggguggacagagcaagacccuguuucaaaaaaaaaaaaguggccaagcgcgguggcucaugccuauaaucccagcacugugggaggccgaggcgggcggaucgugaggucaggagaucgagaccauccuggcuaacauggugaaacucugucucuacuaaaaauacaaaaaauuagccgggcgcagugccgggcgccuguaaucccagcuacuccggaggccaggacaggagaauggcgugaacccgggaggcggagcuugcggcgagccgagauugcgccacugcacuccagccugggugacagagcgagacuccgucucaaaaaaaaaaaaaaaguaaauguaaacgaggccgggugcagugccucacgccuguaauugcugcacuuugggaggccgaggcaggcauaucacaagguuaggaguuugcgacaagccagaccaacauggugaaaccccgucucuacuaaacauacaaaaauuagccggccgugcuggcacgcuuguaaucccagcuacucaggaggcugaggcagaagaaucgcuugaacccaggaggcagaggcuucagugagcaaagaucgcgccacugcacugggcaacagggcggacucugucucaggaaaaaaaaauguaaugauaaagcauuuuuucauguguuaucuucuucauuaagaaguuuuaaaaaugaauguguuggccgggcgcgguggcucaugccuguaaucccagcacuuugggaggcugaggcaggcgggucacaaggucaagagaucaagaccauccuggccaacauggugaaaccccaucucuacuaaaaauacaaaaauuaguugggugugguggcaugugccuguaaucccagcuacuugggaggccgaggcagaagaauagguugaacucgagguggaaguugcagugagccgagaucacgccacugcacuccagccuggugacagugagacaccguuucaaagagaaaaaaaaaaguauucccauuuccuaaaagugucccuucaauuuuuaaauuaccaauacugagcucauauaaaggugauuuguuaaguagcauucacacucugguuuguguaacuugcucuuccucauuuuuuguuucauuuauuuagaaaacugucgcugaaaagcaggagaagagaaaucaggaucgcuugaggaggagagaggagagggaacgggaggagcgucugagcaggaggugagccugagggcuggcacuggauggccugcauuggccucgggcauucccugcucgguccauuccacuguugcuuggaauaggcagggccugcccaauaggccguuauaaaagaaaauaguaaggccaggccuggcggcucacgccuguaauccugucaguuugggaggcugaggcgggcagaacacuugaggucagggguucgagaccagccuggccaacauggugaaaccuugucucuacuaaaaauacagaaauuagcugggcgugcuggcaugagccuguaauccuagcuacucggaggcugaggugggagaaucacuugagcccgggaggcagagguugcagugagccgagaucgugccacugcacucuagccugggcaacagagacuccaucucaaccaaaaaaaaaaaaaaaaaaaguaaacagcauauucaguccaacaaaacaaaacaaaacacgucccagcgcaggacugugugugcauggcagucagguaagggauccaagcuguuggaggcugugugugggcacugcuguuuacuuacugagugcuauggggccauuggacaccuguuuacgcaggagggguggugccugcuccccuuuggcaagcgugcugggcuggaguagaagcagcaggaccuuggggagcuaggugggaaaauccagauggaggagguggcaguuuaagccagguaaggggugcaaggagucggggaaaguucugggauagaacugaugggauuugcugguagugugugaagcgugcagaggaggaaaugaagcuggucuccugguuucuggcccggaguugcugcuuggugagguuggaaggcugggugugguguauuggagugggaggaggugggaaguagaagaugccucuggccacacucagcuugagaggccaucuugagguggggcuguugagucuguuuggaguucaaagagguaggagccagaaguauccacauccuccuggagacagcucauuguccaggaagguucccaaaccacuuuuccugaaauaauuccucagugcauaacucagggcgaauguuuauuguguuuguuuuugagacagggucucgcucugucaccaggcuggagugcaguggugcgauaucggcucacugcagccuccacccccuggguucaagcgagucuccugccucugccucccaaguagcugggacuacaggccugugccaucacgcccagcuaauuuuuguauuuuuaauagagacaggguuucaccauguuggccaggcuggucucgaucuguugaccucaugaucugccugccucagccucccagagugcugggauuacaagcgugagccaccacgcccggccguuuguuguuuuaccagcaggagauucugauuggagagaaacuuaaacaguauagaagaaaauauuaagcaaaacacacaauccauuuuuugcauggaguuuacauuuuuacaugcacugucauguuuaggccauuuguguugcggauguacauggggccacuugaccuuaauggcuuacgggcauagaaugaggccucauagcuugccuuuuucagccucuugguuguguggcagaaugagcugaugacucucaccugacaggaagccugugccuggaacuucgggcuuugcuuuuccuuuucuguguuuuuggugugccccacucgcugucugcacauucugugcuggugucuguuguaaagacuggagaaucauuuguaggacuugagugcagcacagucagugugcacagacuuuucacggcccuuguaauguuacagggcugcgucugaugcucggaugugggccugucugugaggcucaggugacacugagugugccacagaguggcuguggggaugggagcauuggcacuucccauucagacugggaacaugcaggcagcuugaaaacagcaggucuuugggggaggugccucacuucuuaaauuuggaguccucccccaagagggugaggaauaggggugcuuucgggaagucauucacuuuuuuuuuuucuuuuugagacaaaguuuuauucuuguugcccaggcuggagugcaguggcacaaucucagcucacugcaaccucugccuccuagguuaaagugauuuuccugccucagucuccugaguagcugggauuacaggcacccgccaccacgccuggccagguuuuguguucucaguagagacgggguuucaccacguuguccaggcuggucuccagcucgugaccucaggugauugccugccuaggccuccccgaagugcugggauuacaggugugagccaccaugccuggccuuguucaucuuuuuuucccccuuuuaggucgggaucaagaaccagagaucgcaggagguagguuuccagguccauuaaaauguucucaaauuuuuuuuuccauaagcauuuuucuuaauauuuaaugauuaugccuuuacaaauguuaccuggcagguagggcuggcuugugaagggcacagggcaagagguugcuuggugccguggaggguucccaguguuaaugagagggaaggucggggccugcagggugacaggaguauccaggccacauguuuucaggagaccucauuggaaggaccuagccauuggagauuaacugauggaaauauuuuaaaccuaaauuugugggaguaaaggagaaaaugucaguaaagcagcaagcagaaucugcugagggguggggcccucauaguguuggcaccuauagagucucagccuuggagccuucugauuguucaggucacgcucccgggaucggcgucggaggcggucaagaucuaccucccgagagcgacggaaauugucccggucccggucccgagauagacaucggcgccaccgcagccguucccggagccacagccggggacaucgucgggcuucccgggaccgaagugcgaaauacaaguaacuacucugacuccuucgguagcugcaaccaggagugagcccuucucuguguucccagggucugcugagggccgugucugguggggauggggcugggcucacccucaggaguagggcuggggagucgugaacgggacucaggugugggaagaggcgagagggcuguggaggagcucgcacggcgccaggugaugggcugcacaggcacuguccccugccugcguccuggggccugugcacuguugcguccaugcucagaguggcugagacuuguguccugaccaggcccugcuuaccucuguuuugguuuuuguuuuugauauuuuuuuuuccauuguguuuuuacguagugucauguucugugcauauaguguuguauucuccuuugcacuguuuauguuacagugaaggcucuccuuauuaaaaaucuucgcaaaggucacuuuuuaauggcuaucuaacacuccauauguggugggcaagucugguuggccuccgggggguuuccagguauaggggauguagggccuugccuggccuggucugcggguccaucgucagugccugagcggccagcagaaggggggcagcagccuccacugagccucugguucccauuucccagguucuccagagagcgggcauccagagaggaguccugggagagcgggcggagcgagcgagggcccccggacuggaggcuugagagcuccaacgggaagauggcuucacggaggucagaagagaaggaggccggcgagaucugaacccgucucccgggugcuguaaauagucugauaaacguucacacagucuaaaauuacccuuuauauuugcugaauacaacucaucuuuuguaguuuaaaauuucuauuguuuuggagcuagcugugaguuucuagaaguguacagaguugcuccuguguucccgggucauguugaguaggaauaaauaaaucugaugcugccuccugaggcugcgggggguuucugc

SEQ ID NO: 192678 - RNA, 11827 nt, Homo sapiens
accugggcccagggcaacacugaagacaugggcaagagcaucccccaauaccuggggcaacuggacauccgcaaaagcguagucagccuggccacaggcgccggggcgaucuaccugcucuacaaggccaucaaggcuggcauaaaaugcaaaccaccccucuguagcaacucacccaucugcaucgcccgugaguguccgggcccuggggagagggcucugccccaggaggcaccugcucccgaggccucugcugugggagggcccaaaggugaugccuccaaguuccucuuuccuuugucuuucucuuguccaucuuccucaagcccacccugcagcguccuaggcaaggcccugccagagaugcuagcucagggucccuggaucucacucaaguggauccucagacucaucuggcaggucuccaaauacuacauuuccucuggcucccaggauuccacuucuuggaaacuuggugucggcagcuccccccaucccuuuucugcccuaggaacgugaggcuuuaaggaaagggaagauuggaggacuuacuauaugcccagagcuuccacuaguccacauguucuuuugugcagaguaggaaaaugagccccuucugcaagacucuuuauugccaucugcuggaauaucauugccacauacugguuaugaugaaauacuacuuguuaccgccauaugccagacaguuguuagaguaaauggacaaaucuaugaugguacguuauggacaauacaacauuagauagggugcccuugugcaguaaacauucguucaacuguacauggugguccugcauauggcgagaaggcuucuccgaaaaggcaaggcagccuuguccccaagucccuguccccuacuucccaaccccauucuuucaucacuucugaguccacagccugaacugggcugggguggcugucuaggccuggcagucgagcgagagcggcacgggcgggacucaggugagcuccggaggcuccucaacucuuuggagugcaaacaggaugaguaugccaagagcaugauccugcacaguaucacucgcuguguguacuugcuggaggcugagguaagggaagcaggagguccccccuagccggccuggccccuggggguuacggccgaucccugccccuggaauggccagacuauauccugggaccucucucuggcugauagcgguggggggggggugugcggagggaucuuggugacauggggggcagugggcccagaacacccgcuucuccugccucuuccaucucuccccaauacuccaggccucugcuuguacuacggaugacaucguguugcugggcuacaugcuggaugacaaggacaacagugucaaaacccaagcucugaauacacuuaaagcuuucucuggcaucagaaaauucaggcucaaaauccaggugagcccagggaugcgugguggggcaugcaggaugucuauaguccuuaaguccuuuaauugccauaggauaaauggucauguuccagaaguuuguuugggugugaauuuguaacccagaaauaagugggaaaacgguggucagauucccagcagggucaugaaggccuuugaauuucaggaugaaacugaauugaggcacuagugguaucucucaaccccaaagagaaggacccccacuaccccacaagcucccuaccacugccacguuuuuucugacaccaauucccaacacuggcuggguguucaacaauucaauucaguucagacacuauccauaguuagggcagacuucacagguuaagggcugagucccccaagacuuccccccgacuucagguaccaaucauaggucugacuucugacuggcccgcuaugaauucggggguucccacaacucccuuuuuagaucuacuaauuugcuagaauggcucccagaacucaggaaaggacuuuacuuacuauuacugguuuuuuauauaaaggacacaacucaggaacagcuaaacggaggagacacauagggcagggugucagggcgcggagcuuccaggccuguuccuggaccaaacugagggcugggcugcuauugcuccuggcccaauaacgagaugcagaugaacuggggaggaagagaguuuuuauuucuguaaccgguuacagggagaaggccaggaaauuaucgcuggaccaacucaaaauuacaaaguuuuucagaacuuauauaccuucuaagcuauaugucuauguguaaaugugcauucaucuaaagacgugauuaacuucuuuuaauuuauaacuaaggucugaguccugaagaccuuccacuggagccucaguaaauuuacuuaaucuaaauggguccaggugcuggggugauuacccuuauuuugucucuugcuaaaucaaggaguuuugaggaauuccuucagaucccaauaaacuuguuuguggagaccuguggcguuucuucagauccacaguaaaacuuguuuaauccuaaaugggucccauuaagaauuccuucguaauuuugucaugcuuuaaggcccaggaaaggccuaggcaaaacuccuggugggcuuuuguuacauuccagccuuuguauaagggcacuggcuuuuaacauuuaacuuaaccacgcagucaguacugaaacaguuguuauggaggccugccacaagcucacuucaggagugcccugcuguucccagcaccuccacacguucagcaaccaggaagcucuuugaaccccauuggucagagguuuuuauuauguagucuugaugaauuaaaucauguccagcugcucaccccuccccagaaguugggagcaaaacugaaaaucccaaccuucuaaucaugcuuuggucuuucuggcaaccagaagcuauccaaggacccugccuggagucacuucauuagcauaagcucuguugugaccaaaaaggguugguuugcaguaacaaaggacacugcugucacucaggaaauuccaaagguuucaggagcucuguuccuggaacuagggacaaagaucagauguauuuuuuauacucuauccccugggccuguguuaaucagagguuggugucauggccacggauaacuucuccauuacuccauagacaaaauguaaaacaccacaugucacuucccccuuucccugcuaucauacccccaaacuuacaguauccacacccauccucccugcuuuccugcugcugccaugaaaaaaauggcuuucuccuggucuguggccagugauagucucaauccugccucccaccccuuccuuaagggccucucugauugcuuacgcuccgcucccccaucagcaugcaguaggcuccaaccccucccaucuuacaaagcaaaaccaaaaaagccucucccuugaccuccacaucucuuccuggcaaauagucuaucucucccaaauuaaaaacaaauaaaauauguaaaacuugcaaauauuguauauguguaaguuagaaggaauaacaauaaaacagaacaugcccaggccaagaaauagagcacagcccccucccacaucuuggcugccucccccaccagaggcagucauuacccugcauuuuguuuagcaguuccaaauuuucuuuguaguuuuaccauauauguauguauccuugcauauucuagcagggcauagcagauaauaaagagguaaaauauagucugguauguuuuuaagcuucauguacauggaaguagaugguuucuauucugugguuggccuuuucucccugcuacguggagagauucauccuuauugggcagcucugcuuccuucugguuuuuuuuuuuuuuuuuuuugagacagggucucguucugucgcccaggcuggagugcaguggcgugaucuuggcucacugcagccuugacuucucaggcucaagcaguccucccaccucagcuccccuaguagcugggaguacgggugugcucagugaguacgggaguacuauguuucucaggcuggccuugaacuccugggcucaagcaauucuccccccugggucucuuucaccgcucugugguggucucuuucgugaauacucugccacuugcccguuguuaggcauuugcauuguuuccaggugcuugucacacucacauugugcugugaacauuccuguguucgucucccuugugugccugagagaggauucuaggguguguaugcaggaguggaaugguuuggucaaaggguaugcccaacuuuuccaggagggagguauccauuuucaccccaccagcccugcacgaguguucuauugugucauaaccuaacguuugauaauuucacauuuuaauuuuuuuuuuuuuugagacagagucuugcucuguugcccaggcuggagugcaguggcacgaucucggcucacuacaaccucugccucccagguucaagcaauucuugugccucagcuuccagaguagcuggaaucacaggcgugcgcgcaccaccaugccuggcuaauuuuuuuguauuuuaguaaagacaggguuucaccauguuggccaggcuggucucaaacuccuggccucaagugaucugccugccucggccucccaaacugcugggauuacagacaugagccaccaugcgugguccacauuuuaauuuuuggcaucaaacuuuuuuggggaaaaaauucucuuuacauguauccucaaaauaugcacaacuaugauauaucaauaaaagcaaacacacaaaagaauaaaaauagauugagaaacaaacagaaaaaaauaccuagagagaucucugcuugcugccucaucccucagccuucucaagugcagugguacgaucuuggcuuacugcaaccuccaccuccaggacucaagugauccucccaccucaaccucccuaguagcuaggauuacaggcaugcaccaauaugcccggcuaauuuuuguauuuuuuuagaggugggguuuugccauguuguucaggcuggucucgaacuccugagcucaagugauccaccugccucagccucccaaagugcugggauugcaggugucagucaccacaccuggucaggcugugauucucaagcauauuauaaucaccuggagagcuuguuaaaagcaaagauuuuggcugggcgcagugguucaagccuguaaucccagcacuuugggaggcugaggugggcagaucaccugaggucaguucgagaccagccuagccaacauggagaaaccccgucucuacuaaaaauacaaaaauuagccggacgugguggcgggcaccuguaaucccagcuauccgggaggcugaggcaggagaaucacuugaacccgggaggcagaggcuugcagugagccaagaucacgccacugcacuccagccugggccacagaacgagacucugucucaaaaaaaaaaaaaaaaaaaaaaaagcccagggaguucaguucaacaggagaacuuuguuuuucacaaaucccccaggaaauucugaugcaggcggccugagucccacucuuccuuuuuuuccccagugucuuuaugcugagggccugaccccuggucucuuuucaggugaaaguaguuacuccuugaucucaauuuccaucuagcugugcccuucuggaucucugcagccugugggcuccccugccuuccccaugggcagcugcuacuaggcauauccacuuagaugcccuccaaguucucuaacccaacauauccaaaauggagcucaccccauucccugaaucagcccacucucuccagagggcucuuaggccaucaggcccuuugggucugccucaaggcucucagcauaaagugcgugauuggccaugggcugcaccuccuugcccuaaccccagccacguacaaugcaugcuuuaugcucucacaugcccccuugcugcuguucccucguucugaaacccugucccagacuugcugacuccaaccuguccugcgggucgccacggcuuuugaggggugggggaagggaagggcagguacugaugggaaugcucacuuccacuccaggacucuugcuuacuucuuacauggcucauaaaggugcagcucgugagguuaccugucuuugguaaugccucuagguccaagcaucuuacuuuuuuuuuuuuuuuuugagacggaguuucgcucuuguugccaaggcuggagugcaauggcgcgaucucagcucaccgcaaccuccgccucccggguucaagugauucuccugccucagccucccgaguagcugggauuacaggcaugugccaccacguuccgcugauuuuuuguuuuuguaguggagaugggguuucuccauguuggucaggcugauccugaacucccaagcucaggugaucugcccaccuuggccucccaaagugcugggauuaaaggcgugagccacugcguccugcccgcaucuugcauccuagaaccgaagaucccuuuauucacucaauaaauguaauauugaacacuuugugccaacacgcugcucuaaguacaggagagaaagcaguaaacagaacagggaagaucccugugcuuguggaauuuauauucuaacagggcaaggcaagcaauacacaaauaaguaaaauauauaguguguuucaugugguaagugccauggagaaaaauaaaaggcgggggguggauaaaggagucugggugggggugaugcaguuuucaagaagaaaaucuugaacccaggaggccuguaauccuagcuacucaggaggcugaggaaggagaaucacuugaacccaggagguggagguugcauugaaccgagaucaccacauugcacuccagccuguuugaugggagugagacuccaucucaaaaaaaaaaaaagaaaaaagaaaaagaaaaucuuuugagauguugggcuuggugaagaguucaugacaucaaaagcaugaucuauaaaaggaaaaucaauacauuggacuuuauuaaaauuaaaaacauuugcuccaugaaagauccuguuaagagaaugaaaaaagcugcagacugggagaguguauuuguuuuuguuuuuguuuuuguuuugagauggagucuugcucugucacccaggcuggaguucaauggcacaaucucggcucacugcaacuuccgccucccggguucaagcgauucuccugccucacccucccaaguagcugggauuacagguguacaccaccaugcccagcugauuuuuguauuuuuaguagagacgggguuucaccauguuggccaggauggucucggucucuugaccucuugauccgcccaccucgaccucccaaagugcugggauuagaggcgugagccacugugccuggcugagggaguauauuugaaaaucacauaucugauaaaggacucagcuaaauuguaucaagugcuuucaaaacugaauguuaggccaggcaugggggaucacgaggucagggguuugagaccagccugggcagcauggugaaaccccaucucuacuaaaaauacaaaaacuagcugggcaugguggugggcaccuguaauccuagcuacucaggggacugagaaaggagaaucacuugaaccugggagguggagguugcagcgagccgagaucgcaccacugcacuccagcgugggcaacagagugagacucugucuaaaaacaaaaacaacccugauguuaaaacaagcaguccaauuaggaaaugggcaaaauacaugaacagauauuucacugaagaggauauauggauggcaaauaagcacaugaaaccauguuuaauaucaccagccauuagggaaaugcaaugaagaccaugcugagauauuacugugcaccuauuagaagaucuaaaaucaaaauuagugacgauaccaaaugcuggcaaagauauagaaaaaccggaucuuucauauauugcuggugggaauauaaaaugguacagcagccacucuggaaaauaguuuggcaauuucuuucagaacuaaacauacauuuaccaauucagcaguugaacucuugggccuuuauccuagagaaaugaaaacuuauaucugcacaaaaaccaguacacgauugucgauagcaguuuuauguggaauagccccaaacuggaaacaaccaaaaaugucugucaaucggugaaugguuaaacaaaaugguauagccauuaccauggaaugcuacuuaguaauaaaaaggaauauaauauugauaugcacaacaacuuggaugguucucaagggcguuaugcugagugaaaaaagccgaucucaaaugaucacauaaagugugauuucauuuauauaacauccucaaacuuaaaaggucauauauagagauggaaaacacaagugguugccugggcuuugggcugggggagcaggugggagugagucuaaaggggucucuugagauagaucuuuguggcaaugggacaguucuggugggauaaucuguuggcugcaguugugguuacacaaauaugugcaugugcugaaaugacauagaacuaugcacacauauuacaccaacaccaauuuccuaguuuugcuauuauacuauaaugcaagaugugaccauugaggggaacugggugaagagcacaugggaccucgcuguacuauuuuugcaacuuccuguaaauuuauaaucauuucaaaauaaaggccgggcgcggaggcucaggccuguaaacccagcacuuugggaggccgaagugggcauauuaccuaaggucaggaguucaagaccagccuggccaacauggcgaaaacccgucucuacuaaaaauacaaaaauuaguugagcacgguggcguacaccuguaaucccagcuacuugggaggcugaggcaggagaaucgcuuguaccugggaggcagagguugcagugacccaagaucucaccacugcauuccagccugggcaacagagugagacggucuccaauaaaauaaaauaaaauaaaauuaaauuaaaaaacaaaauuaaagaaaugaaaauguguguuacacgugacaaugcuguagagaaaaauaaaauaacaguggagggugguaaggaaggcugggaugggggugguuagagaaggccuuacugagaagguaacauuuuaaugaagucuuaaaggaggugugagagugaguugugaguaucuggggauagagugugcuaagcagagggcacagccuaugcaaacacccuaagacagguguguaccuggcauguucauggaauauguaagaggccauugugaugggaaccuuggucaugagggagagaagagaagauggaguccaagacauaauagggagagaggggcagaucacauuggaccguaugccacuguaaggacuuuagcuuuuacacugaaugaaaugggggcucuugagcagaggagugacaugucuaacaugucagcugcucugaaaguagaugcagggggugagaauggaagcagggagacaggaggcuauugcagaaaucccggugagaugccaguggcuugaaagagggugguaagaagugggggugaggagaaguggcuugaauuuugauagauuuuugaagguagugccuacaggauuuucugaaggguuggaaaaggagugugagagaaagaaaggaguugaugccagcaguuuuuggcccgagccacuggaaggaaaguguaacccauagcugagacagggaaagcuauagaaggagcaggucuggggaugggggagcguguuaacucugagagcucuauuagacauuuggggagaaaaguggaauugguagcugcauauaugagucuggauucaggggagggacaacauagcuggagcuagagacauaaaggggagagucaccagcauguggaucguauuuaacacugugagucuggaugauaccgguaugggagugagguagguagaaaagaggagguugggcagaauagcuaggaaagaagucuguaaaaaaaaaaaaaaaaaagccaaauaaagaauuucaaggcagugggagugggcaacugggucaaauuauguugagaguuagggagaauugucuauuggguuuggcccaggggacauccauggggacagugaagaguaaagucagauacugggauaguggugaucaccuguaaaaguaagcccuuuuguucucccccacuccaggaacacuccaucaaaguacucgaacugaucuccaccaucugggacacggaacugcacauugcgggccucagacuccucaacaaccuuccacugcccgacuaugugcauccacagcugcgacgggugaugccugccuugauggagauccugcagucagacuacauccuggcacaggugccugaggaccauggccaaggcccugccuugcugaccagcccuagcacaguacuuagagggaggagcagagguuuauaucuuccuugcugaggcccagacucaccugccuucucaugcuuuacucuuuccuuuauucaggugcaagccguacgacugcugagcuaccuggcacagaagaaugaccuucucuaugacauucucaacugccaggugagaaagaaauugaagaggggcugaugaaugccaacucagguauagggggagggaagaaucauggcaucuccagacagauuuaccccugaugaauuguuuuaguaucuuccugccucugcacuaaaugcacugaaaaucaugccucuucuguuccccccaguagaaggagacuccauuuuauugggagggggaucccccuuugaggcauuuccugaacucugagaguuaggaacacaggagacaaaacaaaaguuaauguagguauuuuaauauuggggggaaauuacuauggcaaagagcauuauuagggauagaaaagguuacucugugauaaucagugguucaguucaccagaacaguagggcaacucuaaacuuguaugcaccuaauaacauagucucaaaauauauacgacaaaaauugaaaggagaaauuaacaaauauaccacuacagugggagauuuggaauauuuuaaccauucuugcagcaacugauagauuaaaaagccaaaauuagugaggauauacucuuagugaauaacacaaauaagcuugagccauuagacauacucagaacagucuacaaggauuaaaugcacaguccucucaagcacacacacaauacuuaagaaaauuagucacacacuaagccuuaaaauuugucucaacaaaauuuccagaaugaauauuaucauaucacucauguuuuaugaucacaaggcaauuaaauuagaggauaauaauaaaagaaaaacuaaaaaauuacuauauacucgagucugaaauuuagguauauuugggaguuuaggcaauaggaauauacaagaacaagaauuuuguaacuugccuaggaguuuauucccauucuuucucuauucccaucacagguucacuccaacuuccuaaaccuguuccagcccacacagucagggagucuccuguaugagguacugguguuugcugagcggcugagugagggccggaacgcaccccacuaccacguggugaaauggcauuacaacgaacagucccugcaugaaucccucuuuggggaagagucccgacuggcagaccgacuacuugcccuggucauccacccugaggaagauguucagauccaggccugcaaggucauugucagccugcaguauccccaggacuugagagcccggcccuccuccugccagcccagucguuccuacuuuaaaaacacggaauaaaauuaaggagagccaauaaaugaguauaggagagaaac

SEQ ID NO: 192679 - RNA, 83560 nt, Homo sapiens
uucucucacgaagccccgcccgcggagagguuccauauuggguaaaaucucggcucucggagagucccgggagcuguucucgcgagaguacugcgggaggcucccguuugcuggcucuuggaaccgcgaccacuggagccuuagcgggcgcagcagcuggaacgggaguacugcgacgcagcccggagucggccuuguaggggcgaaggugcagggagaucgcggcgggcgcagucuugagcgccggagcgcgucccugcccuuagcggggcuugccccagucgcaggggcacauccagccgcugcggcugacagcagccgcgcgcgcgggagucugcggggucgcggcagccgcaccugcgcgggcgaccagcgcaagguccccgcccggcugggcgggcagcaagggccggggagagggugcgggugcaggcgggggccccacagggccaccuucuugcccggcggcugccgcuggaaaaugucucaggagaggcccacguucuaccggcaggagcugaacaagacaaucugggaggugcccgagcguuaccagaaccugucuccagugggcucuggcgccuauggcucuguguggugagugucgcugggccuggggccgcugugggcaggguggccccucgcgcccgagggccaggccugcuccacugcucagcguugcgucaaguggcaggaauuuuccucgggggagggcauugcugccccuucgagcucugcccguucugcaccuccagcaccccucgcccugcacucacgcagguaugcgguccaccgugugcagcacucagguccgcugcgagagguaggugguggugcuggagcucgguucuggcuagcacccugcgccuuccccucucggaggguugcugcucggcaacaggcaccgggggaagggccgcuuccuugggggucucccugccuaccuggagcagaaggacccucucccgugaugcgcccacgcuggggcuccggacccuggguccucugagcagacaagcucggggaacugccgggagaagcagaagggcacagcccaacccgaagacugcggucaucugaacaaaacugaccaggaagggagcucucuccgggccuuuuuuuuuuuuuuuuuuuuucaaaacucugucgaaaucccaucuugaaaagcguucuuuuugaauucgcacuugaauuaacagcgauccauagagcuuaaaauaccgacuuuaucucggugagcacugugccagcuugagugguguguuuccgauucgguugaaagcguauuuccuuuccguggaggggcggcggugguagugccugcaagaacacugcagcuugagaaacuggcaggcucacugauuagucacauaccacugcucauuuaaguauuguucgacaaaacaauuuucucauuuggagcaagaaagauucagaucuguaaggcgcccucaagaucaaaaaguuauuaacagugcugggagguauuguaaauauuuuuugagauaauuccugcgaauacuguguuuuaaaagucccuuagagagcuugcagggaguuaucuaguuaucugcauuuauggccugagguacacgaugguuuucguaaggauauggaaccacauagaaaaggaagggaagagauacuuuuuagcuuuaauuuacaccgugaguguguuuuaaauuaagucgauagcauauaauuuccagaccugaaauauuucacuaacugcucucuuaacuuccaagguuuuauacccuguauuuuagauuuucuauaauuugaaagcuacggaucuuaaacuaaguaucagauuuaacuguuagcuuuuucuguguuuuaguaauucguauuguaugcgucauuugaaaacgggccuguaaaaucguuuuuuuguuuuggaacaaauuccaggcuuuuggauguguuaaucuuuaaauaugauuucuguguuucccaaagucacaucaugaauuuccuguuugguagaaucuucuggguaauugagauugugcaauuguguccagcaacagaucauauugcauuuucuaguucaaguugcuuaaguuauguugcagauagcaccgugcuugacaucuuucucccauuuuuacagcauggcaguuuacauuuuaaaggaauuugcagcauuuuacauucagagaguguguguguguaguugguuugcagcauuuuacauucaguauauacauauuauauagguauauacauucaguauauacauauuauauagguauauacauucaguauauacauauuauauauaucuaguugauuugcuaauuuucaaagacguauuuggaucauugcucuuuuaauauuuuauagcucauuaauauacuuccauuuuuucauucuugaauugacauacauuucuguaguaucacguuuucguuuucaaugcuauuuaaauuuuaauggagugauacagcagaauaacucaacuauagaggguuugggugaacuccaauugaauugcuugcaaggguucgcuacuauuggugacuagcucugcacuggaacaggagauucagauuuacagugaaguaccauuaaaauuaacuccacaguucuuuagugguauacuuuucugugguauagaagccagcaguaucugacacuuaaaaguacuuuuauuuuauugaacagauuuuuuaaaauacauugacauuguauaaaauuugaaaguuuuacaaagguacucagugggccgggugcaguggcucacgccuguaaucccagcacuuugggaggccgaggcggguggaucacagcgucaggagaucgagaccauccuggcuaacacggugaaaccccgucucuacuaaaaauacaaaaaauuagccgcccgugguggcgggcgccuguacucccagcuacucaggaggcugaggcaggaggaugauuugaacccgggaggcggagguugcaaugagcugagaucgcuccacugcacuccagccugggcgaaagugcgagacgccgucucaaaaaaaaaaaaaaaaaagauauucagugaaaagucuccuuuccuuuuuguucuccagccacucuacucucucaaagacaggcacuguuaagugucuugugucuuuccagagaggcaguuuuuuuuauuugcuuguuuguuuaguagucuuucuacuaaagggauuuaagauguaaccuacagcauauuggugaaagaaaauacaacugaaacugaaauuguaugacaauugacaauaaacaaauuauaacuaauguuggaaugaaaauaccagaauuuagauuuacaauuaaguguuaucuuauucagagauucagcguaguuauuugaaguuuuucuuuucuuugagacgaagucucacucugucgcccaggcuugagugcaguggugccaucuuggcucacugcaacuuccaccuccuggguucaagcgauucuccugccucagccucccuaguagcugggacuacaggugcccgccaccauacccagcuaauuuuuguauuuuuaguagagacgggguucuccauguuggccaggcuggucucagacuccugaccucaagugaucugcucuccuuggccucccaaagugcugggauuauaggccucagccacggugcccagccugaaguuguucuuucaaugaguaccuuuuuagguguggcagaaaacauuuuuuggaacuucuuuuagaauccacuuuggagccugugauauucuucuucuuuuuuauuuugagacagagucucauucuguuguccaaguuggagugcaguggcaccaucucugcucacuauaaccuccaccucauggguucaagcgauucuccugccuuaggcucccaaguagcugggauacaagugcgcaacaccaugcccggaugauuuuuguauuuuuaauacagacaggguuucaccauguuggccaggcugaucucuaacuccugaccucaggugauccacuugccuuggccucccaaagugcugagauuacaggggugagccaccgucucuggccauccaucuucauuuuuuugagagcagauuugauuuuagggaauaacaguucauuugaauccaaauaauuuagggaauuuggacucaagucugauaagaaagauaaggcaaucagguuggugauacuacuguuuuaggucagauaggaguuauaacuauaaaguaacaacacauaauuuuuugugugacuucuugaacuggaccugaagucuacuuccaaaaaaaucuccgaauuuuauuuuauuuauuuauuuauuuuguagagauagggucuuacuguguugcccagguuggucucaaacuccuggccucaagcaguucccccaccuuggccucccgaagugcugggauuauagggaugagccaccacacccagccccugaauuuuauuuucaagaaugaaaauaaaugaauagaauauuucaaugaauaaaauucauucauugaaauauuugucaguuuccgaauuuuauugcucuaaagugugguauacuuuguaacauuuacaaauuauuuuaagccuauauuauuuuaauuuauacuaaguauaguaaaaaaacaaguagaagccugugugauaaccaacuaugaaucaaaauagaguuuuacaaauaugccuuuccguuaaaggguaaagggaacuagacuaggucuugcaguuuuaaggaacuuuaugcauugucugugaggggaaaugaagcaaaauuguuuaagaauacauuguugcaaagcauugauuuugggguuuugggacagaaggggagaaucuuuguggugaguuuaaggaaauacaaacaggaacuuaagugccuuuccucugggguaggguucuuccaggcccuugcuguugauuagaggaggugggacacugguaaccaugaaauaggaggugacaguugagaauuacucuuagaucuuauucaacuguuuauucaacaguguuuauugaauaccuaccaugggccagauagcuagguucuggaaauagagugcuaaacaagacagaaacaagacaauccauucucuccuggaacuuacagccuaguggguuuaauaacuacauuuuguggauugcuugcuauguucuagcauugugcugugcacuuuaucaucagcauaaaaaguauauaacaaaaccuuugguaaaaggauagcaaaacuugcuaagaaaucaaauacaacuuccuaagugcuuuguggaacaagauuauucuaguauaaaagaaauaagugaagcuaacuuuuuuuaacuauuaauggccauucaccauuuuaaaucuauuuuuuuuuuuuuuuagaaugagccagggcacaaagaaauaaaagugcaugauuauuaaguauacaagggugacuuucuugacuccugaccagugagaagggugugcccuuuacuuuucuaguagugauaguagguccaugcugagcuuuccauucuuuucuuuguaaccaaaaguaagguaguugccuguauguuaccagugccagucaauaagaagucuuuaaacauaauuaacggcaagcauuuguauuauugauguauaaagauuguuuuaagaaagaguucauucgaagcuggcuauaaagucauuuuauuaucaaaucccauuuuuccacuuuuuuuuuuuuuugagacggagucuugcuguguugcccaggcuggggcgcaguggugcaaucucggcucacggcagccucugccucccgaguucaagcaauucuccugccucagccuccugaauagcugagauuacaagugcgugccaccaugccuggcugauuuuuguauuuuuaguagagacgggguuuuaccauguuggucaggccagucucgaacuccugaccuugugaucugcccaccuuggccucccaaagugcugggauuacaggaaugagccaccacacccagccuccacugguucuucuuuaaaauaagcuuauccuggaucuccagguuuucaguucugccaguuugauuucuugauacugaggaguacucugcuuuugauuucuuucuagcccagucucagagaugauguguugacuuugccuuucaugggcaagagugcagauauugcugagccccuggggccuagaauucaaagauggaagaauucacugggguagaucacccucacuuuagaauuaacugacauuuuuagggauuuuugcaguuuauaaaguguuuucauucaaagcauuaucaaucaguucucacuagcuccauggaggcucauauuuauuaacuccauuuuauagauggggagcuggacucauucauuaaaggaauggcauacuugucaaugcuacuuuuaguagucuccuuucugauagaugugggcugcugagguugcgcgguggcaccuucucuuaugcaguuaaccuccucuugugaaaaagggguugcugagucacucggaauagagcuugaguguaggaaagcaguuccaccagugucauugcccaguuuaugugagggguaaugacuuaacccauuuaacccauuagagucaugucucuuccucagaacugauaaaucaaaaaugcacucauugcccagauuaaaauuuuuucugaaggaauuauuaggcagugcaaauaguuaauuccugaauuuaugaauccuauuggauugaaauucuucaguguacauuuauguaaaguugggacugucuguacauguuuguguuacauaaguauaggauauaaauagaaauaacugccucuccagcccuuugaaaauacauuagauuuuugcuuuuugcaguaaaauuugggguaaaacugauuuguucuuaucuaagagguauaauuacugcagugcucagaaaagccucauuauaaagugggcuccccugacuuggaacuuagggaugucuucucauggcugcuauggaagucaugcagcuguuucgucaggaaaauaaccaaaaacuucuuuaaacuuggaaauguuuuuguaaaagaaacuuucaguauucagaguaguuugucuuucacagugcuuccauaaauuaagcacaggcacaacucguuuuauuaugcuucacagauaauugcuuuuuuuuugcaaauugaagguuagugacaacccugugguaagcgagucuuuuggcaccauuuuuccaaaagcaugugcucacuucaugucucugugucacauuuugguaauucucgcaauauuucuuucuuucuuuuuuuuuuuuuuuuuuugagacggaguucugcucugucgcccagacuggagugccauggugcgaucucggcucacugcaaccuccgccuuccgguuucaagugauucuccugccucagccucccaaguagcugggacuacaggcaugugccaccacaccuggcuaauuuuuguauuuuuaguagagaugggguuucaccauguuggucaggcuggucucgaacuccugaccuugugaucugccugccuuggccucccaaagugcugggauuacaggugugagccaccaugcccggcaguucugcugggauuacaggugugagccacugugcccggcaguucucgcaauauuucaaacuuucucauuauuauuaaauauuauggggaucugagaucacugaucuuugauguugcuguuguaauuguuuugaggugucuggaaccaugcccauaggcagacuuaauugauaaacauuguguguguucugacugcucugccaaccagcuguucccucucuccaucuccuaaggcguccuuauucccugagacacaauaauacugaaauuaggccaauuaauaacacuacagugguuucugaauguucaagugaaaggaauguuugcaugucucuuacuuuaaaucaaaagcuagaaaugauuaagcauagugaggaaggcaugucgaaaacugagauaagcugaaagcuaggcuucuuguaccaaacagccaauuugugaaugcaaaugaaaaguuuuugaaggaaauuaaaaauuauauuccaguaaacaaaugaaugauuagaaagcaacacagccuuguugcugagcuggagaaaguuuuaguggucuggauaaaagaucagaccaaccacaacaugcccuuaagucaaagccuaaucuagagcaaagcccuaacucucuuuaauuguaugaaguuugagacaggugagaaagcugcaaaagauaaguuugaagcuagcagagggugguucauagguuuaaggaaagaaccugucuccauagcauaacuuauagugcaagguggcugggggcgguggcuaacaccuguaauuucagcacuuugggaggcugaggcaggcagaucaucugaggucaggaguuugagaccagccuggccaacauggcgaaacucugccucuagaaaaaauacaaaaauuuguuuuuuauauuuuuugguguugugguguacaccuauagucccagcugcuugggaggcugaggcaggagaauugcuugaaccugggaaguggagguugcagugagccacugcaaccaaguggcaaccgagaucgugccacugcacuccagccugggcgauagagcaagaguacaucucaaaaaaaaaaaaaaaaaaucaauagaugagaaauugcuucucaggaaugaauaaauaaaguaguuucuugagguggaaucugcuguuggggaagaugcuuaugaacauuguugaaaugacaacaaaggguuuagaauauuacauaaacuuaguugauaaagcagcagcaagguuugagaggauugacucccauuuugaaaguaguucuacuguggguaaaaugcuaucaaacaccauugcaggcuacagagaaaucuaucacgaaaggaagaauaaaucaaugcagcaauucaccguugucuuauuuuuagaaauugccauagucauuccagucuucagcaguuaucacccugaguagucagcagccaucacccugaguaggcagcagccaucaacacugagacaagacccuccaccagcaagaagauaauaacuugcugaaggcucaggugacccuuagcauuuuuuagcaaaaaaauauuuauuuauuuauuuauuuuuucuagauggagucucgcucuguugcccagccuggagugcaguggcacgaucuuggcucacugcacccuccaccucccagguucaagcaauucucccaccuuagccucccgaguagcugggauuacaggugugcaccaccaugcccagccaauuuuuguauuuuuaauagagaugggguuucaccauguuggcuaggcuggucucaaacucuugaccucaagcgauccuccugccucggccucccaaagugcugagaguaauagguaugagccacugugcccggcuaauaaaauauuuuuaaauuaagguaugugcauauauauauuuuuuugacauacugcuagugcauacuuaauagacuacaguaucauguaaauauaacuuuuauaugcacugggaaaccaaaaaauuuaugucacucauuuuuuugugauauucacuguguugugguugucuggaacugaacucaugauaucuuugagguacaccuguauguauguguuaaggauuuacaaaauuaaccagcuuucccgugcaguguucaagucuuuuaauaauuuauuauagggaagaagaaguggugguuuguaaauucuguacuugacaaauggauacuggguuuugggcaugcuuggcuccaaggcugaauguugggggaaagaaguauaggagagugaggagucuaggauuucuaaguuuuggccuugggcaaauggauauauuuuagugccauuuucugaacuuuguguuacaaaguuacaaaagaguguuacaggguacaagauuguagagagaaaggggaaggagcauagguucaugguaaucuccuugaggacaggacucauuauaccuugagugccuaccauguaugguuugccguaagugcuggagaugaaaugugaacaaaagagacaaaaauuucugccuuaagaagcuauauucuggccaggugcagugaguggcucacaccuguaauuccugcacuuugggaggccaagguagguuuccuugagcccaguaguuagaaaccagcauccugggaaaaauggggaggcuccucuacuaaaaaauaaaaauaaaaaauuagggaugcuugguggcacacuccuguaguuccaacuacuugggaggcugagguggagggauugcuugagccuaagaggauugcuugagccugggaaguugaggcuguagugagcugugauccugccacuguacuccagcuugggugacagagugauacccugucuccaaaaagaaaaaaaaaaggaagcuauauucuaauggggauggcaguggaaguagauaauaaacaaaauauauagugugucagauaagugcuguggagaaaaugcaagaagggaaggagagugagugcuaggauggcuguugcacuuuuaagaaaggugaauacgguaagcaucauugauaaaguaacaauugagcaaaaaccugaagaaggugauauaggacacugguuggacaugggugaggaugugauaacauucuaggcugaggauuagcaagugugcaaaagcccugagguaagggcccugugcuccaggaaauagcuaagagaccaguacagcuagagcuaaaugaaccaggggccaaauauagggagaaaaguggggugaggagaggguugcagauaugcagggaucauguagggucuuauuugccuuuguacagacugugacuuuuccuuuaagugagaggggaagccuuggaggguuaugaccagaggaaggacaugaccuaaaucuuguuuuaacagauuacugugcucuagggucccaaguuuuucguuucgguuccuuacccauucuacccuaaaccacuacugugaauaggauagaacgguggaguuagaugaauuggugcaagcccugacccaugcucacaacucucauuccagcagucccagagugccagagccaguauuuuuguugggcccuagaaauuuaggguauuccaguccagcucuuuaaauaacaugggcugacuuuacuuuuucagguuuuuguugccaaaaggaaggagcagagauuagcucuugaguuuagcugaaaaaggaagauuagucugcuggcagauugaguguuuuuuaacuucuuuggcuuuuaggguuuuucuuacuuuuggaucauguuuuaaaagucauuuuuaccuucuuucaacaguuaaacauuuaaguuuuauuugauuuuauuugacccuuuuucugcuuuacauuccucugccuuuuccccauuauaauacuuuuaguagagguuagaccauuguuaucugucauuaaugucuuagcuuugaggccccaaggacuucucuguuaaacuuaaauauaucauauagauugaaagauuaucuacagacaugugauccuauaaaaacccauauuauuuauuguccucccugccuuuacagauguaaaccccucuccucuuuucaucagagcucccccucuuuuacugcucuaucaucagguugcagaaaauaaguuuuccugcaaacauagauucccauggcaacauaacaaaaagguaauagaacaaauguuuauuuugucuagaccugcugucugaguaccauuagacccugaacauguuggcuccuguuauuugaauaugugguuacaaauuccuuauuuuccucaaaacuuacuucucuuaggccuuggugauauugucacugugccugugauaugaaggaaggugugugugugugugaguaugugugucuuacugucauucuacucaaaaguguguauugauugcauuuucaaacuuauggcuuaaaauguagacaccacacaaucugagcaugugaagaaaaaaagcauaccaguuuuguucuuuguuuucguaaguucauuaauuuaauauuuccagugcacuauacuagauauuuuguuuacagagauuuuaaaaaaaagaagggucccuccuuucgaaaguaucaguccaggcugggugcaguggcucacgccuguaaucccagcacuuugggaggccaaggugggcggaucacuugaggucaggaguuugagaucagccuggccaacauggugaaaccccaucucuacaaaaauuaguugggcaugguggugugugccuguaaucccagcuauucaggaggcugaggcacaagaaucacuugaacccgggaggcggagguugcagugagccgagaucacuccccugcacuccugucugggcgauagagcaagacucagucucaaaaaaaaaaaaaaaaagaaaguaucaguccagaggagacauauuuauguuuccucauagauggcuuuggaaguccucuguaguuuuggaucuugaagcauuuuagguuuuggauuuucagauuagggauacucaaccuguauaacccaggguaauucaaccuauugacacuuuaggugggauaauguuuuguugugggggacugaccugugcaguguaguauguuuagcagcaucccugucuccaacucacuguauacuaauagcaauucccaguugugacaaccaaaaaugucuagacauugccacauaucucuugacggguagggagggcaaaaucaccuuuaguugagaaccacuuauauaacccuauauauuuggauugauaacccuguauauuugauugaguaaaaacuagaugggauaacaugaaccuuccaccugcaaaaaggcagaaaugcuauacuuucugcauuauaaauugggccucucuaaacaugauuuuuguuauuucuaggagaguaacagcauuucuaauggucaagguccuagcuauaacccaauaagcuuaauggaugggagaacuugcacaagcauguuugcaagaggccagguguaucacuggcacauuugagaaacaacuaauuagugagggagacccaauuuucaugaauaauuguguuuugucauugucauggccccaacuuaggguguuuugaauuuuuucuggaaaggaaauuagcaugaaguccaaguugguagguagguagcauuuucccuagugucucuucugguauucuguguccuuucucuccugucuucuuucaguauuuagcguuuucaaacuccuagaaauaaaaugcuguuuagaagaccacaaagagagcugcacauaaacuaaggagcaagaaguaguacauugugaauuaauuuucuguauguuuuugaagguucuugcaucugggaaggcuugcuuaguuuuaaaaauauuagguaauaacagacugaaauuuugaagaucuuguggaucucagguagcaguaacucaggaagaucagccuucuuugauuuagaaugucauuuaggcacauuauguauucugguaccuuagaagauacaaugcauuuuccugaauuaucauugcuacugcuuuaauuacuuuaagggugugaggcaguaacuaacuuuagugucacaauguauacaucuuaacauuuauugugcucuuuuuuuuuuuuuuaaacaccaccuuaaaguacucugcuauucagauuuuuccuuguguuucucuaauucuccuauuucauccauuggucaguuuuuucuuccucuuuucuuucugcuccaugauccauucuuaaauuuucuuuucucuuucugugcauauucuuuuugaauucauuaucugauagucucaacaauggucuuguucauauacuauccuuccaaauuuguacuuucaaaccuaaucucaagaaugacugauccuuuggauucuaaaucuauugagauguaauguuucaugcuuuuccuugauuacuuuccuacacacuucuugaagauaccagagauguagcacuaacuuccguuggaaugggauucauguuacaagcuugaaugguucaguuuagauaugugaagcggaugucaucauuagcacugaugacugacaguaguuauaaaaauuacaaucaggaaugaaccaauuuaccugaaguuuucaauaacucuagguauuaaugcaacauaauuuugaaaguuugaaauauauagguauaaauauugaugcuuauauuuuagauuuacuguagugaaggaaauuugccagucguccaucaguguuaaaugcccaccaauguguaaaagaaauagaccuaaaauauuaauaaauuguguauauauguaugaagguauugauguguacagagaaguggagacauugugaguuauaguggucaguaugguuuuauggagcagaaaggauuugaagauuauuuagaaagauggguauuuggagagaagaaaaggaaacauuuucagacaagagaaaacauaaaccaagagaauagauaugaaaaggacuguucugacaggaggaacaucucagguagggugaacccaguugugguucucauucuuguugugcuucagacucacuuguggaacuuuuaaacauaccucuggaaauuaagaaugagaucuggagugggacuuaggcaguugcauuucuaaaaagucuacaaaugguucuuuagguaguagagagcuguuggaguuucuugaguugugaacuguggaggaaaauuguuuuaaaauuggucuugguggaguguaaagaauggauuagaggaaacaaauguauugcuuugucaaagucugguaaauuuaugugugccucuguucauuuugacuccucggcuagauuucuuaguuccuugaggucauaaacaaucagcuuuuaaagcuucagugaaggaauaucuuuuuuuuuuuuuuuuuuuuuggcuggguugggggacaggguuuugcucugucaccuggguggaaguguaguuacgcagucaauggcucacugcagccuugaacuccugaguucaagugaucuuccuaccucagccacccaaaguagcugagacuacaggugugugccgccaugcccaccuaauuuuuuuuuuuuuucguagacacgaggucucacuaugucaugaaguugcccaggcuggucuugaacuccugagcucaagcuuccuccugccucagacuuccgaagugcuaggauuacaggugugagccaccgcaccuagcaggaaacaucuuauaaaaucauucuacuuucauuuggaacuugcaggcucgugccugcaaucccagcacuuuggcaggcugaggcaggugaauuacuugagcucaggagcucaggauuucuaaaccagccugggcaacauggugaaacuuugucucuaccaaaaauauaaaaaaauuagccaggcgucguggugugccucaguaguagcagcuacucgggaagcugaggugggagguuuguuggggccugggaagucaaagcugcauugagccgugaucaugccaccacacucuagccugggcaacagagcaagaccccgucucaaaaaaaaaaauuaaaaaugaaaguaaguuucauuaaaaaauacuauauauguaauuacaguggugaaauuguuuugugauuaaauaaauacuguuguguugacauuaaaacaagauauuugagaguuagcgaagauauuaaagcuaauguuuuaaauuuugaguuuuuaaagucaaucuuaaaucuccugcuacucugaagaagauaaauguauauaauuuuaauuuuucuauuucacuagguuugaagaauauuuuuugagguuccuaaaucaaaacuuaaguuccaauuuuugcauaaaguugccuuuauuuucaagacguuauuuccaaaauggcaggacagagcauccgcuucagagcaacagugauauuugcacauuuacuugaauauggaaggaagaaaagcuaggcuucuguaauagaauguaacaugugcagaaaaauauuuccaguaugucauuuauugaaauuuguuccaggugcuacagguaaagagaaaguuccaaguuaguggucuuaauuauuuaguuauuuagaaggcaaguuuugaagacuauuauuaauuauccugauucaguuggaaaaaaagccugaaauuguaugauccggagaagaggugucauguuuuugcaaauuauuucuucucacuuuauagauauucuuuuuucuuuuucuuucuuuuuuuuuuuuuuuuuuuuuuugagauggaguuucgcucuuguugcccaggcuggagugcaauggcacaaucucagcucaccacaaccucuaccucccggguucaagcgauucuccugugucagccucccaaguagcugagauuauaggcaugcaccaccacaccuggcuaauuuuguauuuuuaguagagacgggauuucuccauguuggucaggcuggucgcgaauacccaaccucaggugaucugcccaccucggccucccaaaguucugggauuacagucgugagccaccgcacccggcccucacuuuauagauauucuaaugaauuuaauguauuaaugagacuuugcuaauucaguguaacuacagauuucaauauauuuaaauauuuccauuaacuuccaaaaguaaaccaaauuguguuuaucuucuuagaagucaucuaugaccauugaaagaaauuguaaaaucacuuacgauccccacaaauuacucaaagacuugcugagugauuacucauucuucauauucuguugaugaaaacacagauuguuuuuugaggaaaaucauggugcagucguuuguacuuuaauacucuguggacaugggcacuuguccagcaccuuaccuuucuuaagagguugucucccuuucucuacucagcugauguuaaauuuauugaucugccauuaccuuauaacagaaaaucuacaagucaggugcccaucauggaauauaaacacaaguucccuauaucucuauaccuaucaaaagcucaguugacagccgaacaugguggcucaugccuguaacccaaacacuuugagaggcugaggugggaggaucgccugaggccaggaguucgagaccagccugggcaacaagcaaggccccaucucuacaaaagaaaauuuuaaaaauaauaaacaaaaagcucauugauagcuccagucaucuuuggaggauugucugaagaauauggagcuuaucuguuuuucuaaauguauuuaagauuuccucuuggauuaagucugucagagaggccagguaugguggcucaugccuguaaccccuguacuuauugggaguccaaggcaggaggaucacuuagccuaggaguucaagaccagccuagggaacauagugggacccugugucuacaaaaaucaaaauaauuagcgaagcuugguggcacaugccuguaguccuggcuacccaggaggcuaagguuggaggauugcuugaggccaggagguugaggcugcagugagccaugauuacaugacuccacuccagccuggaugacagagugagaccuuaaagaaaaaaaaaaaaagcaacaccguaauauuuuguacuccuacccucuuugcuaauaaugaacuguauuuuggccuuacgacagcaaucuguacugauggaugcucuaaaaagaaaaccaucugaaacccacuauuauauucuuuuaaagauguugauuaggacauuuuuaccacauuauaugucuccuucuugaacagacacagaaugaacuuuucccugguuuauuacaggaauaauuaugccucucuucagcucuccugaguaccugguugguuuuuauuguauggcuucugugauucauguccuaacugauucuguucucuuuguuaauggcuuuagugagcuuugagccaaauuugaggccuaccucuaauggguauuuaaaaaggaccucuggccgggugugguggcucacgccuguaaucccagcccuuugggaggcugaggugggcggaucacgagaucaggagaucgagaccauccuggcuaacacggugaaaccccaucucuacuaaaaauacaaaaaaacuagcugggugugguggcaugcaccuguagucccagcugcuggggaggcugaggcaggagaauggcgugaacccgggaggcggugcuugcagugagccgagaucgcgccacugcacuccagccugggugacacagcaagacucugucucaaaaaaaaaaaaaaaaaaaaaaaaagaaagaaaggaccucaugauauaugcuaaccucagcuguacagacuuucuuauuuucccuuaaucacuuaccauuuugucagguuuuauauauauaauuccagucugcuuuaaauccauugugaauaaaggaagguauacaucaauaaauuuagaaguuaaacagaauuauauuaggauauaugaagaaucuaguaacccacauuuucuaugugugugugacacaaggggaggcaaguaugaauguguaacaaaacauugaaguuuauuuaaugauuauccuuguguguuauguacuggauucacggucagcaguagaugagugagaaugacauccuaauauuguaauaacugcuucuaauuuuuauauuucuuucaguuauuuuuuacuauaccaaugauuuuauaaaaugugaauuaauuugauaauuuuggaaaaguucauguaaauucacaauugggggaaaaacuuguuaaacaguauguccugaauuuuaguuuggagaaccuguuuaucauaaagauaauuucauuuuaugauguuguucaugaaaacaagguuuuacuuguagcucuacuuuuacagaugugauugagaggcguauuugagcuuugccauggaccaagcuccuugccaaaccuacuauaaaaguuauuacauuuaauccuaacauauccaacagaugaaauauaaacauaauucucauuucaugaaagaauuuaauuaacauccucaagauuauauagcuauuaaguggcagaacuggaauuaaaauccagauagucuaauuccaaagucccagcucuuauuuaaucacucuguuggaguauuauaaacauguaauaauaaauugugauuguuggggucuauaggguacugauuaauucuagccugccuuuugcugaauagauucaggagucaaauagagauaaaaauauuuacuuuuauuaguaaagcuggcaugcagagugccuugggcgggcaacucaagugggcuucuuauuucuuccccaguuaauugaacuugcacacuuaaucagucagaucagcuagaaaacugcugcuguuccuugcuccccagcaggcuuaccaauggaggagagaagaaaguguucagcuugcagguggaaggcaaacucugaggugggaaguugaagaagcugggucccacaggggcaauggccauuuuuccagucucaccagagcuaguuuagagaacuggguuuagagaugaguauacauuuacuugcuacuuuugagagggaagaaguuacuaauuuauggguuuguaggagcaaugggaguggaaaagaagagaaccaccacccucuuuuaugugagauaaggaaggagucagugaggguguugugacagaguaauggcuucuuagaggucccuaacagguuccugagcaggugacuauuuaaaccaauacuugaaggauaaggauuuagcuauggggugggaugggggcggaggagaagaaaauccuaggaaccaggagcagccugucugaauaguuaaaagaacugaaaggagcuagcagaacauagcagcugagagagagggaaagaguagcacaggaacagguggaauaaucaguggugaccagaucaccugggccuuguaggccaucaugagaaauuugcauuuuacucuguaugccaaggagauuccuugaaugguuugaaggaggggaguguugugaucuaauuuguacuuuuauugcuauuuuuuauuuuucauuuuugagacagucucacuguaucuuccaggcuagagugcaguggugccaucauggcgcaccacaacaagguugagcagcuucagccuuccugggcucaagcaaucuuccugccucagccucccaaguagcugggcaugguggcccaugccugacuaauuuuuuuuuuuuuuuugagaugaaguuuugcucuuguugcccaggcuggagugcaauggcaugaucucagcucacugcaaccuccaccucccugguucaagcaauucuccugccucagccucccgaguagcugggauuacaggugccugccaccacacccagcuaauuuuuuuaaauauauauuuuuaguagagaugggguuucaccauguuggccaggcuggucucaaacuccuaaccuuagccucccaaagugcugggauuauaggcgugagccacugcgccuggcugccuaauuuuuaauuuauuuauuauuauuuuuuugagacagagucucacucuguugcuaaggcuugagugcagugaugcaaucucggcucagugcaaccuccaccuccuggauucaagugauccucccaccucagacucucaaguagcugggguuacaagugugugccaccacaccccacuaauuuuuauauuuuuuuaguagagacggguuucaccauguuggccagacugguauugaacuccugaccucaagugauccacccgccuuggccucacaaagugcugggauuacaggcgugagccacugcacccaacccguuuuuuauuuuuugcagagacagggucuugcuauguugcucaggcugaucucaaacuucugggcucaagcaauccuccugcccuggccucccaaagugcuaggauuacaggcuugagccauugugccuggcauaauuuauauuuuuaaaagacuguauuggaugcauuuggaaagcauauuagaaggagguaggccagugacauggacuaauaugauauuggugaaaugaagagcaguugacuuugagacgucuuuuggaggugaaaaccaugagacuugccaauagauuugaaugaggacugaggaaagggagaaaucaaggaugacaaucaaaugucuagcucgagcaacuggaugaacaguccauuuauugagauaacagagccauggagaagaauaguucuggguguuuugaacuugguacgcuucaggugcuuaugugucuuucuuauggagacaucagggcucagagaagagauuucagugagagacauaaauuugggaguuuucaauauauagauggcauuuaauuuaaagucaugggcauagaugagauuaucuagaaagagaaugugggagagagaagagggcccaguaccaaguccugaagaacuccaacauacagaguuugaguagaagcagcacaugcaguggagacagagauggagcugccagaggggucauagaaaaccaauggaaguguugauauagacuccaggauggacaguauuuagagaaaguggugacuaugucaauuacuaaucuuagaaaaguggauuugguagcagaggucauuaaugaccuugagaagagcaguuucaguggaauuggauugaggaaagaaugggauugaaaugagucaguuguguagaugugugcuucucacaccuuaagagguauauuaaucaccuggaaaucuugucaaaaaguaaauucuauuuuagggcccaagaucuccuuuccuuuccuuuuccuuucuuuucuuuuuuccuuuccuguugucugcagagauccugcauuuucuaaugagcucccagauaaugucaaugcugccgguccauggagcacacuuugaauagcaaagguauaaauuagugguucucaaacuguaauauguauuagaauaacauggagagcuugauaaaauacagauuauuagacccacuucaaaguuucuuauuccauuaacucuggggugguaccugagaauuuucauuucuuauaaauucccaggugaaacugaugcugcugaucugggaaccucugguguaggugacuuuuuuggagaauuuuaacugugauggagaacuguuaagggaagucuuuuguuuguuggcugaaggcgguaaacaaguagagcaaauuuaugcugaugagaaugguccaguagauagggagacacugaugaugcaagagagaagaggaaugaagaagugaaauccuugagaagaugagggagguggcuccaaagcauguauuguggucuugaauuuugauaagcaggggcauauucuuaguuauagcaagagggaagguggagacgauggguuuauagauuuggggcuaagcaaauggagcuccccuccugaugguuucuguuuucucagugaaggcaagggcaacucuugagggaagagggugaauuggagauuugagagagaacaugucaaacgaucauuuucgaguaggaaaaugaacuuacuagaagaaaauggcuuuauugagagccucuuugagauuaaggucagaaacuaagaaugaaaaucugauucuacagucuuucuuguucaaccucaguuccuuggauucagucauggagaauuaagugguugagauuacccaagguuagacuuuauccaggugaguacaucagagagacagacagacagagagagagaagugcaagggagugauuauaaucauggaacaggaagggagaugaagacagaagagggcugaaggauagaaacaagcaaugacaaugagguuaacaaauuguuguagucaggguacaaguaaacuagagguaacuagguuuuugaugaaaagcaaaugcugcuggcauucaaaauuuuguagguggggcaguuuuugguaggaauaaaggucuagaaugugaccaugaagauggcugggugugguggaguuuccuagagaggucaggaaacaggauguugggugugccguucaccuggauguugaaguugccaagaaugaugacagaaguugagaguguagagagaucuucuggauagaaacuaacuuuucaaugaaugauggaaaauuucaggucaguggauaccugcagcagagagggauaguuuaucaggguugugagcaggagguauuuuauagaacaaacggaaaguaaugguccugaagugguaacggcugccaaggaagacuccuacgcaccugcuagccaggagguaucugggcuauuagagaaugcuuucuaauggcagggcuauaagagaagcagugucuucuagaaauggccuaguuucagagauggaggggagguucagaaaagagguugaagauuuauaggaguuuaucacaaauugggauuugaagauugaggguaugccauaaaaguuugggagugaaaggaagggcacuggaguagguacagaguuguaaaagcaaguuuggcaggcagagaguuuggugauaacagaugaccagaaagucuuggauacauguuagagacugagacaaacuggaggaugaggcauaauggaacuggcccagacaauuucuguuauuacuauuuuuuuuuuuuuuugagaccgaguuucacucuuauugccaggcuggagugcgauggugcaaucucagcucacugcaaccuccgccuccugggaucaagugauucuccugccucagccuccugaguagcugggauuacaggcaccugccacugcgccuaauuuuguauuuuuaguagagaugggguuucaccaucuuggucagacuggucucgagcuccugaccucgugauccucccgccucggccucccaaggugcuggauuacaggcaugagccacugugccuggcgacgauuucuaaaaauaauuaaaauacacaucgcauuuuugcuauagauguccuccaugaucuagcugcugccugcaucucuuacgucaucccuucccacucuccccuugcucccugugcucuacccacacagccuuucugucuuucugucacucacuccagcaugccauacguuuccuaccucuguuucuuuuuucguuuguuugcacuugcucuucugagagauagcagagucaaguggucaguagcauaagcucuggauccagacucccugcucugccgcuuuuaagcuuugugaccguggucaaguuaccuaacuucucucugcuucaguuucuuacuuguaagugggagaaugauaauaguacuuauuucauaggggauucggggaaauacaaaagcugaauugagacaaauaaauguaaagggcuuagaacaauuucuuguauguguggguaaagacucuauaaacauuaauauuauuauuauuucuucugcuugaagcucuuuuucuuauauauuuauauagggaauuuaaucauuauauuguuuccuucucagcucagaugucauuccucagccauccuagcuaaagugguauaacuccacuggcuuucugucacucuuuaucccauuacccuuuuauuuagucauaguauuuucaucacuacuugaaauuauuuuauuauucuguucugcucuucccccauucccugaaggugccaaguacuuuguaggugcucaagaaauauuuguggcaauuuauuguccugaaaacaugguuuccugggccucgacucugagcaggcagcagauguggcaaggugacgacagugaggccuaggcagggaagacagaauucaacucuguuuauuaaucuguuggcucaucuagaucaggcagcugccaguuuuuguaaauuuuauuagaacacagccacacccauuuuaaaacuuauuuucuggcugcuuuccucauacaaccacagaguugaguaguugugacagaggucuuacuuacaaaguugaaaauauuacuaucuggcccuucauugaaaaaaauuugcugacuucugauuuagauacauagaaaagacaaggagaaaacaccaaaaauaauaacagaagcuuuauuuggauaaugggauaauaggucauuuugcuuuuuaucuuuaugcuuuuuuuugguauuuuguuauagacccuuuaauuuggaaauagccuuauaaauaccccaaaauaauauuuagaacagcuuuuuaaugguggguuuuuucccuuuuuucuccuuagugcugcuuuugacacaaaaacgggguuacguguggcagugaagaagcucuccagaccauuucaguccaucauucaugcgaaaagaaccuacagagaacugcgguuacuuaaacauaugaaacaugaaaauguaaguuauucauucaaggaagaauacauuuugaucuugaauagacuggggaaaaauguuuuaauuacugcagauggaaauacgcuggagugcaucaaacguuggucccugcuccuuguccugggguguuaguggccacuugguuaugucaggucaaagacuuggaaugaaagugaugcaucuuccuggaguuuuaguuuuacucaaagauuuuuagaggagaaagaacucuuuaaaauuuuaaaauuaaaggauauguuaugaaauacaacacaaaauucacaauaauuuuuaagagaaaauauuaaaaagaaguuauguauucuuugccugguuuuccuaaggcuauauuaugagaauaugggagucuguggcuauuaaaagacaaaauagccacagacucccauauucucauaauauagccuuaauauuuuuaaguggaaaaaucugagaaagagugccuuaggcucacugaaaguccuaucagagauggcuauuauuuuauauauuuguuaauaauuuuucuuuuuuuccagauucacguauuuuaauaaauaugucagaggcauuguuuaaguuaaauauaacuuuuucuuuuuuaccaauuuguugauucaguugccauucugcaaagaugcuuacaaauucuaauacgauaaauaaguggauauaauuggaauacuaacugaaaguaaaaagacaguugacugaagacacuuauuuuacugaauuucaaaaucaaguuaugaauuucugugacugcuauaugaaggguacugugaaguuuguagcauuguggaaacaauggccauagagauuucaaaguccucuggcuguacugcuuguuaccuuguggaagaaaauucaaaaucugugaauuuauuauuugacuauuuagacuguuuuaguaauuuaacuucuucauagcgagaaaaaagucacagauaagugacucuucauuagcguacauuuguuucauuagugcaaauuucuucuaaauugagaacauuaagacuuaaauuuguaauuggauuauggaugccauuauaaucacagcugcugcuuuuuauuuucacauuuuauuuugauuguaugcuauugaggaaauccuauuucuacagacaacuucuauuccugaguauaauuuuacuuaaguagcuaugugcaaaccagaguuuuaagaauguucagugugaagcugcagccuuccuaaucagugacauguuuacaagaaguugagauaugcggaaaaagcuggcagcagaaacuuuauuccuaggucugcauaaaaucaaaguggccuggcagcuuuaagggauguguuugcguuugauuuuuaacacauuuaaguguguaugcuguuuuucauuacacauuauuauaugugacagagacagugucacagcuuugcaaguauaaaggauauuuugaaagugaaaugcaagccaaacauuuauggaaccccagagcaccuuugggagccacuaggauccuauugauguggcuaugcuaauuuaagaacaucugguuuaggagauuaucagugcuacacugauuguuuugcuuuucuucauaaauauguuaagccaauguuuagggaucaugguauuagaaaaauaggauuuuaauuucuauacauuguuuuauaaguggcuugcuuacuagcagucuuuuuuuuauauaaagauguuuaaguucuaacaguugguggucaccuagauaucagugauuuguuauuuaaacaaaauaaggcacauggcugaaugucucauaguucucuauuccauuggcaaauguuugaagccaaaagacuugacucaauguagaaaaauuccugcauuuuagccuauuuugaaaacauuuguuaggugcuuauaaugucaaaguaguuuuacccaauaaagaaccaaaacuuccgguaaguuuaauugaggguuuucagagaaauucaucucguuuacccuccucuucuuuuuuaaaaaauuacuguuuugggucaccauccaauuuuuauagcggccaaaccucccacaggcagcagcaacaggcgcuuaaaacuugugaacauuuuagguguugguaacaaauacaauuuucaggugccagagggcacaugugaucuuuuacacaaaaaugccucugacccacaaucgguaguucaucuugaauugucucuucuguuagugaucaugaauaauagauaaacauuuauuaggugagugacugaagcuaggggauguccucugugacugugagaguuucucucugaacaaaguuaguuggaccauuccugauugaacuucugaccuugaucucguuaacaccugcucuaaggaaagauuaaagggaggcagccugccagcugcauccuuugcugucugggcagacacuacagagauggcccauauaugggccuagagaucuguacauuuuagaauuuaaaaaugaucaaggaaauuguuuuguaaauuuuauuugggagccuuagauuuaaccuuaccauuguagaccaagagauuguuuuggugugcuuuuguuaaauaugcuaaauauugucucuggauacugaguuaaaguauuuuuuuuuggaugugugcuaauuuaauaaaaauacgacuuaauauuugccaggcuuuggaccaugaugggauaaucauuagagauauuugcugcuuauuuguauuaugaaugucuuuucuaaaaauuugauuccuggguuacuuugaggugacugaagucauguaacagcagaaggaguuaaggaaauagacuaaaauaugacuugauuuagaagggaauuuccauuuaagaaaugagaaauggcugggcgcaguggcucaugccuguaauccuagcacuuugggaggccaagguggguggauugcuugaacccagaaguuugagaccagccugggcaacauggcaaaaaccagucucuauuauuauauuaaaaaaaaaaaaaagaaaugagaaaugaauagauuccuaaaauauuuuccagaucuauuuuaaugcugauaagcuuuuguuuuacaguauuuuccuuaugauuaauauucauaaguaugauuaauggagugagggauauuuuguaaaaacccaucaaaaauuuaaguacuuugauuuagcauggguaguuuuaaucucaaaauuguuauuuucggugugcuuauguuaaacacauuaaauauuguaaauauugcccuuuuuaggaaauuaaaauuugguaggguauuuacuaguuggcuuuucucuauuuuuuuucagguuacuuuauuuuucuucuugcagucaugguuuuuaaucauuugaauaguugagcuuuaugucucauauucuguuaauggaaguagcugcuucagauaguuugcuuagguauauuguauuuuguaauugucuauucaacugugugggcuguggucaccacuuauuuugaugauccacagugggucagccuuuuguacuaggcaccuucagauacauugucugcucagucuugcugucaguacugugaaaauaagcaaugauguccucauguuuuucauaugaggaaaaugggacucagagaagauaccaaauguauuugccaauuauuauuuacauaacagccauucauugaacuccugcugaaugccaggcuccauuccaagugccagcguuauuggaaugaagaaauuauaagcucuuggacccaagaaaucacaaacugauacugggguucaaacuuacagcugcuugguuccaaaaugucuguuguguuuucaguuugaaauuggaguuuuuauuugaaaauaguuuugacuuuugucuuuugagguaacucuugcauguguaaaucagaucucuaaugauuuaguuuuauuuccauaggaggauuuucacaaucacaauggaaacacuguaaaacaauguaaauaguuuuaaacuuuucuauuguuuugaggagaugggcaucucagauaacaagaaucauugauuagaaaauauuggaacggugaauaaaguuagcuucuagaccucaguuaccuuaaguagaaguggguauaagggagagugauuaaaagaccagaggucuuaagccaggaguauaccaaacucaagggaaacgauuaugguuuagauggagaagguaaaaggaaauggauuugacuuaaauuuaaagcacuauugugaaugaggucacagguacucuauugggaggcauguaaguuggccuuaccucuauggaggaccauuugacaauauuaagauccuuaaauauauugguguccuuugauucuguaauucuguuucuugaaauuuauuuccuggaagaaaauaugagaugugcaaaauacauauauuuuucuugcaguauuccuuaaaugucuagagauaggaaauugguuaaguuaugguauacacaaaugauagauaugcuguauacaaauauuuaaauauuaaguaaaaaggcaggauauaaaacuaugcaugguguaaccccaauuuaauuuauguacaucagaaaaucaaaggaaauauaucucaaaauguuaaugauaguuauaaugggugguauaauuauggguaauuuugguuuucuuauguacuguugucuggguaagaucugaaagugauucuauuuccuuuggaacaauuuucaaggacuugaaaccuauucuugaauuccaaguaugugucccaccaccuccuuuucagguucagacuguaaaauuaaaguugcuuuuaaaaagugacauuuggagucgggcgugguggugcaugccuguuaucccagcuacucgggaggcugaggcaggagaaucacuuauacccaggaggcagagguugcagugagcugagauugugccaugcacuccagccugggcaacaggagcgaaacucugucucaaagaaaaaaaaaaaagucugauauuuggaugaguggaguaacauccuaauuagaagaucuuuuucaugauaauguuuugaguguuaacauaucuuacuucuagagcuuuguguuuaaguuggcaguuuagaacagugugcuagugaggccacagucuugcuucauaaccagauacucucaaauauggcugggcguauuacaaaugaauuauauauuucuuauuugccuugucaaugccuaacuuuguagaaaugaauggccuggguuuuaaggaaaauagaugggagguagggguuggagggugcuguauguggauaaaucaguauaaauuccugaucagaaaaacugcucaaagaccauggguuauugaguauuaaguagcucuuugcuuuaucccuguguaaaaauagacuuuuuuuuucauuuuuaaauugucugauuuaaauacccuauacauuaagacuuugugagaauaauaccaagaauauacugagaauauuuugagacuuuaaaaaugucaguuuugaagcauauacaguuaauauggaaauuuuucguggaauacauuuuuaaaaaacacaauauuacgguaacaaccauggaugugugaccuuuuucaccuguuggauuaauucauuagaccauuaguacauacguaaggcaaggacccuaaaucuuuuugccuucugauaaacuacugacuacauaugaauaaauucuaaagagaugaagauuuuuaaugguaaaguggguuaauaugagaauugauguuaacaaguagaaaacaaaagcauaauuuggguagaaaauuaguuggaguuauuaaguauaugaugugauguuauggaacugagguagcugguuuugaauuaguuccuauuaaaaugauugagacguggcuggccgugguggcucacugcuguaaugccagcacuuugggaugcugaagugggaggaucgcuugaggccagaaggucaagaccagccugggcaaucuagugagacacaucuguacaaaaaaagaaaaauuagcuaggcauggugguggcacgugcuuauagucccagcuacuugggaggcugagacaggauugcuugagcugcagugaacugugauggugucacuguacucuagcuugugugucaagagugagauccugacucuuuuuuuuuuuuuuuugagacagagucucacucugcaccugcacucucccaggcuggagugcaguggcgcaaucucgggucacugcaaccuccgcuucccagguucaaucaguucuccugccucagccucccgaguagcugggauuacaggcgcccgccaccacaccuggcuaauguuuguauuuuuaguagagacaggguuuuaccauguuggccaggcuggucucgaacuccugacuucaggugauccgcccgccucggccucccaaaguguugggauuacaggcgugagccacugcucccggccuagacccugacucuuuaaaaaaaaagaagauuaagaccugauggguacuauacugaguuuaauauuuauuuacuuuuuaauuuuuauauuuucuuacaggugauuggucuguuggacguuuuuacaccugcaaggucucuggaggaauucaaugaugugugaguaaauuuuuugcauuugccuuccuggucuacagaaugaagacuaauagcccauuucuauuccugaaccauuuagcaacauauagacuucaaaaaauucuuuauuccuaucaugcaccucuuuuuggguguagggauggauaccagaagauguauguuauggguggugcguguuaguauuuacaucauuucaggcacauuguaccccauugaagagucagucuugaauucuuacaaaaguuccauggagaaaggaguggagagaguuuugacuauggauuuucuuuucaaaguguuuaucccagguuugguuuuguuguuguuguuguuguuguuguuuuuguuuuaaaagacacggggucuugugauauugcccaggcuggacucaagcuccugggcuguagugauccucccaccucagccuccugaggagcuggaacuacaggcacaugcuaccaugccuggccgaucccaacuuuuaaaggugcucuucaagaaauguaacggauccccagccauauagacucccuccucuuuuaucgcccaugcaugugggagaugauacuagaacuacaugcugauccuugaaguauuagauuucuauacugggauaaggggcagacucuaccuguugagaaaggcuucuucucucagcuuuguaaccaccucuguuguuuuagccugggauaccccuagaaagcagagccugggauucucaggaaccaguaguggggggcuagggaaaaugaaacaggaaaggagagaaagcuucuaugaguauauguugaguuggucaccacuauggacaauugggcugaaaacugccaagaucuaagaagcuguacguaaugcaccucagauggggaucauuaauacacuggcuccugaccccauuggcaaggguugccacguaugucauuagugccuucacaugcccagguugcacauuggugggccauaagacagauuccagcaaguguucccauguaugugugaacucucuacuauaguagcuuuucuaguaucugaguugacacagcucucccugcccccaguucacauauacacuauaccaugaaagagaaaaaaaccuuaaacacaguuauacuuuuggucacauugaaauuuuggcauuccuaaauggagaguguuacuauuaugaaagccaaaacagaacugaagaucgugacuucucuuccuuaaccuccauucccccauugaccccagggcugaaccuaaccaguuucuccucacccuuauccugguuucaguuucucccauucuuauccugggcugauugcaaacaccguuuacuccuuccccacagaacacaaaggggauauguuugaacuucuauguucugucuaaggaaagggagaaagaaauaaagaagaugaaauggaaagggaaggaggaaagguggcaaaaacauuucuccaccauuugaauuuaguuggaacaguguauggcugagaguagaagaguagaaguuaagagaggagaauuugguccaccuacaagaucuccuuggcuacauuaaccuugauccugcuaaugaaaguuuaagaaacaaaggaaaaaaauagccaauaacuaagaaaaauuguucuucucgcagcccugcuugauacaacaauauggaggcuuccagagauuacuggauguuacucaggggcauguauauuacaguuuguugagcccuacuguaugcuauaguuggaaaagggaauguuacagaaugaugguuuuuaaaaauaguuuuccuaaauguagaagaaaugcugaaguaauguguuugugaauuacuuuggaaaacauuugaguuagaucugagcuguaucccaaaauuuuagguauacuaaggauggauuuauauaacaaaggaaaugauuugcugacuugugcaaagugcaaaaugcuguauuuuggccuaauugggcauucuggaaccggauuaagaaccuauuuuuccuaugugaaaagaccuuaauuaaggccagugucuauuuagaagguuaaguguuacugauaguggugccuuuguuuggcuccuucauccauguaaggacccagcaacuacaaaucuaccuuugaacuaagguuucauucauucauucaaccauucauucauucauuuauucaauaaauacuauggcuguugagcaggaauccguucuuucuauuuaacucuagcuggauacuguuuuuuauaaacaauaacugaguuuaccucuuggaagcaaaucucauuacuacuuguugacuacuuacugaaugcagaacacugagcagaguguuagcacaggcucagaauaaucagaaacagucgcccuuccuuuugaugaaagugucugguugggggaaacgaauucaaagcacuuuuguauccaagcuaccaauuggccauaugaccuuggacaagucacuuuaccacuguaggcccagucauuucacuguaaaaugaugagaauugaggucguugacuucugaaguguuuuaaauuacagaaagucucugaaaauagaaugaacuuguuugcccuaagaaaaauauuccauuguuuacuuuuuauugugauguucauaucacugaaaaaaucacuguaguucgacuauaguuauuucaguguuuucuuuuuuuuugagacagcgucuugcccuguugucacccagguuggagugcaguggcaagaucuuggcucacugccaccucugccucccagcucaugcaauccucccaccucagucccccaaguagcugggacugcaggaaugggccaccauguccagcuaauuuuuguauuuuugguagagacaggguuuugccauguugccuaggcuggucucgaacuccugagcucagguggucgcccuccuaggccacucaaagugcugggauuacagacaugagccgccacacccagccauuucaguauuuucuaaaguuauuuugggauaugcauaagaaacuaaacaucuucaccuacacuugcaggguuugcaaauuuaaauaccuucagggucacacaaagaacauaaaugagguucaguguuacacaauugggagugguggggucuguggcaaaauacaucugcaccuccuaaaaguauucaaauucacauugaaacaaaacaaguaaacaaacgaaaaccuacacuucuggccaaaccagacauaauuuaggcuagagugguucuacaagcugccuguuuagagcaggcuauaauuugaacacaaauuuuuaaaugcuaauuagcaaaaucucuauaauuacuuucagauuuauaguuuuuuuuuuuucuuuuucuuuucuuuuuuuuuuuuugagguggagucucgcucugucacccaggcuggagugcaguggcacgaucuuagcucacugcaaccuccgccucccagguucaagcgauucuccuaccucagccucacaaguagcugggauuacaggcgcacaucaccaugccugguuaauuuuuguauuuuuaguagaggugggauuucacuguuuuggccagacuggucaugaacgcuugaccucaagugauccacccaccucagccucccaaagugcuaggauuguaggugugagccaccgcgccuggccuacaguuggcuuuuaaucaugugauacguguauuugucccuuuauguuucgguuagcacuuuuaauuuauauacagucaugcaucaguuaaugacugggauguguucugagaaauaugucauuaggugauuuugucauugugcagacaucauagaguauacuuccacaaaccuagaugguauaaucuacacaccuaaucuauaugguguaucuuguugcucccauacuacaaaccugcauggcauguuacuguacuggaugcuguagguaacuguaacgugaugcuauguguuuguguaucuaaacauaacuaaacauagaaaacaacaguaaaaauaugguacuguaggccaggcuuaguggcuuacuccuauaaucccagcacuuugggaggccgaggugggcagaucacuugagcccaagagcuggagaccagccugagcaacauagggaaaccccuucucuacaaaaaaauuuaaaaaauuagccgagcauaguggugcaugccuguagucccagcuacuggggagucuaaggugagaggaucauuugagcccaggggcagcgguuauauugaaccaugauugcgccacugcauuccagcccaggugacagagugauauaugugguccacuguugacugaaacauuguuaugugguacaugacuacuucagauuuuugcuauguuuuaaauuuuaauucuuacaaaugaagacuauaccuuugagaaaggaacaauagguagugcauuuugaacauuaggaacaauauacaguuacugaaucuggauggagaugauuuuuggaaaauguaguguuaaaagauggauauacuaaguugcucuugaccaccauaggaugugguuguacagauggcaaaauuuuguaaagauacaguacaucuagaucucuuaaaugacuggaaauccuuugggccuuucuguuggcuucuugauaguaauguuuggcaagauacugcaugcauauauauuccuguguauucagcagauauuaccaguagaaaugcaaaaaucuuaaauagccaauauuugaaccuaacaccagagcaagcuguaauucaguauuacuauaauauugccuuuucuuuguguguguguguguguguguguguguguuuguuuucuuuuuguaguuggggcuacaggcucacaccacuagacucagcuguuuuuauuuuuuuguaaagacaaggccuugcuauguugccuugguuggucuugaacuccuggacucaagcaaucccccaaccuuggccucccaaaaugcugggauuacagauaugagccaccaugcccccccccaccccuuuuucuuaacuguagugguucuuugcgcaagcauaguagacaagaauuuuuugauuccuccugggaacuauuuccucaaauuucauggaaacugaauugucaugaguuaaguggaaauuagucuucugauacuuuuuccuuuauuuuacaaguucccaucccagguuucuuauacugaauuccuuaucucugccucauucuugaagagggaaauggaagugggguuuuggauucuaccaugauagaagggaagaccuacaacaaggcuauucagcagccuuuguuuuagugaaagccaaugagaagagaucacuucuuccacuuacuaacaaugauugcucaacuaauaaguuuagcuuuuuuauuucaauguaaaaguugcugaaaacacugaauugguaaaggaaauuucuggauuuacauuuuaaccugauguuguucaauaaauauuugaauaucuaccuuaugcuaggcacaguaauagucucugaggaauauaacaguaaauaagagcugaggcuguuaaugggagagaagaacaauguaaaugaucaaacaaaauaccaugugguaagaccugaaagguccuacaugaguuggucuccgguguacucucuaaucuaaccucaccuaguccucuuuccacucugucuccaccccagucacucuggccucuuguucuuugaguacagacaaccacauuugcaauaagaccuuugcaccaguuucuguuauugcccuggaacuuuuuccccacauaccuacaugacugucuccuuuccuucaggacucuacccaagggucuucucaucagaagcucuucuuuuguuaccauucuaacugaaauaguaccccuacugucacuguuuacuccuuacccugcuuuguucuuagcaaauuuuguuauugucugucuucucccuuucuuuguaagcuguguucaagcacggaguuuguuuucuucguugcugaaucauuauuggaguauaugcacuccauuguuuguuaaacaggugaacacaagaauugccauuauagggcagguauagagugcuaaaggacugcauaguauggccaccuaacccagacauggggugucuucaggaaagccucugcaaaaaaaauguauacacagagggcuuaacggaugaaggagaguuggaaagguggggaaaguacaaguucauccaggggccgagagagggagcugagggcagaaaagguguguguguguguguguguguguguguguguguguguguuuggugggaauagagguguauauggcaaaagaugaagcuggaauggggagggacuagaucuuuggggcuuuauaagcuaagccucauuaaggugguugcuuuagagaagagaucaaaggguacugggaacuggaaaugggauuggaaaaaggaugaaagguuuuacuuuuaugugggaugacauaguuacaacucucucccccuuccuccccacacaaacacauuccauagugugugauaaaaagauaucauuuuaccagaggcaguuuucuccuggauccuuaacacauuaggaaauauuuuggaugagcauacuaguugaaaaucugaaauggauauaagacuuuucugggaacuuaaauuuauguaaugaugcuucucauuguuaauaucugacuuuaauuucuuuugguuugacuucuugccaacauuacaacuauguccuuucuucaaaaaacagggucuuaugcuuaugagugaaacugacaaaacaugugggugagcaguucuauaaaaacucuuuuuuuuucaguaacaucuuggaggguacaaagggcuuucacauaaucuuauuugacacaacaauccugugaaacagaugguauuaucucuaauuuucagaugagggaacugagguugagagagaugaaccuaauuguauaauaucacauacaaaauugcaucucucccuggucuuuuggcucuaaaccuauuucucaucacauuuuucugaucuaaggcuaugauuauuauuugaaagucugcuaccccuucuuauugaguaaauauuguguuaaguucuauguaagaugccaaaacuaagggccugucucguuuuccaauugcuauggucuuauuaaagaaaugaggcauuucuuauuaagaaaugcuuaccuaaaauaacugaagggcugagucaaaucuguaaugucuagacaacuuacagggugcugcaugaaacucagaauauuagagaagcuuaguggagaaaagccucuaaagaagguaauaacuguguccgaagaaacaaauagggauaggauguggaaguugaaauuuauuccagacagagaaugaaggaaauauguaaaguguacagaaaagagauuuguauggaauggagaguguuaaaugagaauaacuauugauacuucuuuuguacuuggauaaaaauugugcauugaugaauucuggguguguguguguguguguauguguguauguguguauguguaggguuauuccugauuuagcuaauaaaugugaucuuuuuggaaauaauggugaaagaaauaccuagccgaguugcuuggacuuacagguuauuuccuaauuuagcuaauaaacaugguaguuuuggaaauaaugcugaaagaaauacuagccuaguugcuugaaacuaggcuaagugcucaagauagugaacacaggaagagaaguggucuaggaaaaagauuaaugaguuaacuauuaacauuuauguuuacaauuuuuuuuuuaucagagaggucugcugaaauggagaugguggguggcgaaacuccuuguagauguuuuuacaaacucacauuugaaaucuaaauaaguuacauaucucuuaagaaaauaucauucaguuuuugccugacaugaucaauaagaugccaccuuuuucucagauuagcuaguuuuaaaagguaaagaagcuucaaggccuagcuuagaguuugaguccuucagcaaucucucucuaauucacuucuuccuaagucugugcugggacccucuccuguguguucuccaucaccguaugucccuuuauuaugauuauauauucauauaugccuuccuuucaucuaaaggcuguaucugucuuucccacugcugcauccccagggcccagaaauacguauuuguugauggagugauagaaugagugaauaacuuugugcugucacuguuuauaacugguugaugauuugguugucugaaagcaugcucagugcucucuccuuugacuagcuuuuuuguuuucauccuguaauguagacugugugguaaaauauugagucuaguuucacugaugcagguaauguagagggcaucuuuuaguaaucuuugcuucaagugagaauaauuuguugugaaauaagccuacuaagcugccuacuuggcugcugaaugauucuuuuaccccuaaauuagaacagucuggucugcuuaccaguaagaucuuuggcacauguauuucaauaaaaugagcccuugucuuaucuuacuaguagugcugugugaguuguccugagucauucagugguaauugagugccuacuaucuaucagacacuguucucgguacuuuagauacuacagggaacaaaaaauaacccuguccuccacgaacauuguacaagcagauaacaauaaacaacagugagcauauaaaaaaggaaauuacauagucuguuagcagacaauaaugcuauaacuaaaaagaaaagguagaaagguagaacaggaaaggggaauuaggaguacaaggguggggggaagaugaaauuuuaaauggauaggccuuauugagaugaauuuugagcaaaagugugaagaaguagaggaauuagaccuggggauaucuagaggaagagcauuccaggcagaagaggaagucagugcaaagguccugaggcagacugcaugauauauuggaacuggagcaaggaggccaguguggagcugaguaagagcaagggacagagacauagacuaugaaaucagagacauaauuaggggcaguguacuggauuagguagggcuuuaucugccauugaaaggaauuuuguguuuuacucuuaguaaaauagggagccuuuugaggaaaggagugcccugaucugaguuuuauuucuaaagaaacacucuuccccuguguugagaauagacuguaguaagucccaaggaucaauaggugaguugcagaagcuugugcuuacaaauugucaaucccugugauuguuuuaagcacccuguuuaaauauggaauaaauggguuuuuuuguuuuguuuuguuuuuugccuuuugauaauugcuuugaauaggacugauaguaguaagagacgccagucuauagauaucgaagaguuuuuucuacauagguucuuucugauuguucugugcuuuaaaaagugggagguggggaggaagagggcgggggcaguggugcuggucuuaacaauuggguauuauccaagaaguauaaaugaagcuguaaaauggggugcugucuagaguacugaaaagcauuuaugacagaguucuuccuucuugcugucacaguacauuuuacucacaggagucacauugagaaaugugauuugugcucucuauacuuugauuaaauuuaaagaagaccaacuucacaagaaaagugaaaaacaagauuuguaucaguccaugaaauuguuuucagcuuuuagccuaauaaaguccaacuuaacuuaauuccuuuguaaagaugugagaacuagauagcuuuccaaccauacucaagucuaaccuuccuuaauuuacuuuaauuuacuuuacuuaauuuacuuuagguguuauauacauugacaauauuaggcaugucuuuacuaaaauguaauugacuaugcuuuccagaaacaaauacuauagaaauuaugugacucuccauuaaugccucuuuuggaaugugcuucuuaaaaugugcucauuuauauuccuugccccccauccuguucauuauuuuuagaaguuggugcaucuuccauaaacaaucagcaacuuugcaugaugcuugcuuuuguccccuguuguaagacuuauuuugaaaaucuuucuauaugggaguuagaauguaacaauugguggucauggauuggucuuugggccuccuggaaacaaguauagugauuaaguuaguuccugcaagaugcuucugccauaaauaaugccuuucaguuuauuucauuguagcuuaguaguaaugcuugauaguuauuacuauauagacugauuaaucuuauaaacuuacauaauguuuuggcagucucacccucguucuaaauuuuggugauaaaauggauguggucucugagggggaaaggauuugagagaaauuacauagugguaaacuguucuaauuaaaagcucuuucccucucucucucucucucucuguugccaugcagucagugguccucuggcugccuaagauuucuuaacucacugguaaccauuuacacauaauagcuguacuugaaguugcuaugguuucauuaguaguuuugccuaaccuuugugaacuggcucaggccuauuaguuaggacuaguauuauuuuuauuuaaaaauaaguuauguuugucucuucuccauaaaauuauuuagaaaaguucaaagaauaacccucuuauuauccaaugucaaaaaauauaauuaugugcaaaguagucuuauaugaccgaaauuagauucugucuuccucagcuuaugcaucaauuuaggguuaaaaaauacaguaacugugauuaggacagaauacugcuauguucuugccagccugagaacuuuguuaagauuaacuuugauaguaaauacaguauugagaauuacuaaggaaauuauucagacauauugcuucccuaguuauugugacguuuaaagaguuuuaaaaaggucauucccuugauguaaauuuuguaucagcugaaagaauuguuggaagaauaugugcugugauuaagaucauggucuguggggucaguuaguuuuagauccaacuccugacauuacuacucuuuuugaccuugaguagauggcuuauccuuauucugucucuauuuccuugucaaugaaaugggaacgcuaauggacauuaucucacagaguuauugggaagaguacaugagacauaaugaguacauggacauaauaaacugcuugcugcagugcuggacacagaauaagugcuaguuagugccuuugguuauguuguguugagauuggaacauuucuuaaaacguuucagucucauuuacuuauuaauuacauuuagagucuacucuuuccucaaggccguauaaacaugcaaguuuuaaaaauaugaaaugcuaacaucuuaagguugcaacuagguuaaguccuguugaucuucaugaaauugagaacugaccauggcagcccuaccaggaaauuaugacagagaaaaaaauuccauuccucuuggaggacagaaaguaauaaauauaguguauuaguuguguguguagguauauaaagagaggucacacacacacacguuuauucuuauaauauauuaauaauagaucuaaauuacugaccugcuuucuucccuccaaaauucauaaaaaaaugaaaauagaaaugaaaucagcauucuuuauagcucagcugauauauauuauuacccaaucucaggaauaggaaugauucuuagacaguaaauaaaacuuacacuuauuuuuaaaaauucagccucuuagccaggcacgguagcucacuccuguaaucccagcacuuugggaggccaugguggguggaucacuugagaucaggaguucgagaccagccuggccaacaugaugaaaccccgccucuacuaaaaauacaaaaauuagccaggcaugguggcgaguaccuguaaucccagcuacucgggaggcugaggcacgagaaucgcuuaaucccaggagguggagguugcagugagccgagcuugugccacugcacuccagccugggcgacagagcaaggcucugucucaagaaaaaaaaaaaaaaucagccuuuuuagaaccgaucuacuuucuauguuuccauagcuguguaauacaguaaugaguggguuaaggcauugugucuagaauauguguggugaaccuguuggacuugaauguaaucauucccuaaucuuaccacauaaagaugggauuaauaaccagcaccacaccugugaggagaaauucuggaaugccucaucuugccuccagauaaaacauguuccuccuuccuuuaagguaaaugcaggaauauugucaaugaacaaaauccuuucacuagucauuccugaaaaagaauuacaguuggaaaauaaaaaaaauacuccuauuuuagaaccuguaauguggaagacuuauaaugaggugaaaauguagcgguggauuuaaaacuacaagauacuuaauuauagccaugcaguaaguuauacuauauauuugucaugcaagaauaacauuuguaagaaaacugauacugacacauguaucuuucuaaucccuaccuuugcuguuuuuguuuucuuuucucuuuuauuuuuuguagagaugggguuucccuguguuacccaggcugaucucacacuccugccucagccucccaaagugcuaagauuauaggugugagccacaaagcuuggccugguuucuuuuuucuugagauaaccuggaaaaagauaugucaaguaggaauaaguauguaaauguuuagaacagauggcagguaguuaaaguuagaauaguaauguugggaggcuaaauugggaggaucaccugagaccaagaguuagagcccagccugagcaacauagugagaccccaucucuacaggaaaauuuaaaaaaauuagcugugcgugguggugcacaccuuuaguccuagcuacucggaaggcugagguaggaggaucacuugagcccaggaguuugagguugcagugaauuacuaugauugcuccacugcaugacagagcaugacccugucucuaaaaaaaagaaaaguaaaagaauagcgauguugaaaaugagguaaugaggugcccuuccccccaaaaaaugaguaguuguuagcuuuuagcugucaucgugguacagcuaccauuuuaagggaaggguagccuucccuuaaaaacuuagaagucgggccaggugcgguggcucacgcuuguaaucccagcacuuugggaggcugaggcggggggaucaugaggucaggagaucaagaccaucuuggccaacacggugaaaccucgucuccacuaaaaauacaaagauuagccgggcaugguggugggcaccuggagucccagcaacucgggaggcugaggcaggagaauggcgugaaccugggaggcagagguuguagugagcugagauugcgccacugcacuccagccuggcaguagagcgagacuccauuucaaaaacaaaaacaaaaaccaaaaaaaccaaaaaacuuauaaaagucuucugaagauaagaacuuucuuagggguucuagauuguuauguaacuuuucacuaauuucuagguaucuggugacccaucucaugggggcagaucugaacaacauugugaaaugucagaagcuuacagaugaccauguucaguuccuuaucuaccaaauucuccgaggucuaaagguacagauaauacaaguaauaauuuuuuaaaaugaauucucccuuucuccccuccuuuuagggcuuaaacaaacaaguaaacaacuuuucuaauggaaaauucaaacacauaaaaucacagguaaaggucauauaguacaguaaacugccauguucacucagugacaacaguuaccgacauauggccaaucauguuucuuuuguauuucccaagcccuggauuauuuuaaagcaagucuagacauuauauaauaccauccauagauacuucaguuugcauaucugaaagauaaggacucuucauucuuacaucuaaacaauaauuuauugauguaaucuaauaucuggucagcguaauguugagauuuucaaaaaauccucaagaaagacuaauuuauuuguuggaggggcagauaaacaguguuuuaaaauuaaacccaucuuugauauuuagcugcuuugaguccuuauugagcuccagagugccaaccagaaaauagauuaaaagcucaacugaguggagucaauggcuguggaaauuauaguaaugguaaauguacacaauacugauaguuacuuaugcugauuucuaaucuuacuauuaacacuagcaguucuuacugauucaugaaaaugugcagcaaauauguuauauaauaugacaauagaagguuggagguaacuuugacuuuuuucucuuuugcaguauauacauucagcugacauaauucacaggguauguauugugacuuugauuacauuauuuuggggaaguggggugagaguggaagaauggcauuuagccaagauccuaaucuaaacuuuagccauugaaauguugauugauugcaacuuuacuguagguuuaagcugauuaaagaaagaagauguguaguuuuuuucuauguaaggcuaacuuggacuggauauugacuguaggauggagauugucuuuugauagcuggaugaagucuuuuaugucuggauccucauuauuaccuguagggggagaauugaucaugcaucauaaaguugauccugucuucccuguauuugcuuccuaggaccuaaaaccuaguaaucuagcugugaaugaagacugugagcugaagguaaaaugaagagacaguauucauuguuugcuuuacuuugagauuauauguuugacuaagcaggcagacuuucuuagggaguagcuuugugagccaugacuaucugaaauucguauuauuuuuauuaucagacuuugaaauuuaaaccauuucugaguaagcuaagugacauugaaaguggcaucacuuguuuuuauuuuaacauaaaguuaaauuauaaauuugauauauuagucauaauaaaggaggauaauagucaaauaucaaguaaguaggcccaaagaggugauaacuagauuaaauacauuucuaagaggagaaauggcagaaacccacucacucaaaauaauucaaauaaaaaauaagugaauuaauuguuucuaaauagcaagcagcucuagaacuuuuguuccauuucauuuuuuuaacuugaaaaaaugucuguacauuagaaugcaccauuucauuuggcaaaauuauauauccacuuaacucacauuuaugauaaagaccauuucuuuuuuuuuccuuuuuuuugggaugcagucucacucuguugcccagucuagagugcaguggugugaucuuggcucacugcaaccucugccucccggguucaagcgauucuccugccucagccucccgaguagcugggacuacaggugcacgccaucacacccggcuaauuuuuguauuuuuaguagagaugggauuucaccauguuggcuaggauggugucgaucuccugaccucgugauccaccugccucggccucucaaagugcugggauugcaggugugagccauugcucccagccaagaacauuuggauuacuuuaaaaaguuuauggccaggcgugguggcucaugccuguaaucccagcacuuugggaggccaaggcggguggauuaugaggucaggagauagagaccaucuuggccaacacggugaaaccucaucuccacuaaaaauacaaaaauuuaguugggcaugguggcgggcaccuggagucccagcuacuugagaggcugaggcaggagaauggcgugaaccugggaggcagagcuugcagugcgccgagauagugccacugcaccccagccugggcaacagagcaagacuccgucucaaaaaaaaaaaaaaaaaaaaaaaaguuuauugugucccuuccuagucaaucccuaccccuccaccccuaacucuggcuccaggcaacuauggaucugcuucuaacacuauagauuagguuuaucuuuucuggaguuucauguaaauggaaucauauaguguguauuuuugugugucuggccuuugcuugguguaaugauucgguauuguugugugugucagugguuucuuccuuuuuauugguaauaguauuuuguuuuaugaacauaacagaauuuuuaaaucuauccaccugcugauggacauuugcuugaguuugaggcuguguaaagcaacugugaauguuuaugugcaaaccuuuguauggacguaaguucucauugcacuugauuaaauaccugggagugacauuuuuguuuugcuuuuuguaauuucauuuuaaguucuugcuguauauuuaccauacauucuaaguauggaccaggaaaucucuuuaugaaagugcuauuuuguucuccuuuuuaauaaggcaacagagguuuguuuguuguuguuguuuuguuuuuuuuucccugccuguuucuaagucuuagcaguuugucuguuccucuucugcccuuuagauucuggauuuuggacuggcucggcacacagaugaugaaaugacaggcuacguggccacuaggugguacagggcuccugagaucaugcugaacuggaugcauuacaaccagacagguauuacucgccuugguuauuuagggccuuauuuaauuccauguuggaugcauuugggauucucagaaauagagauggugggagugggaagaaaugucuuuucuucccucagugauccuuuuaaagccugcaaguaaaaauauuucacuuccucagauggggaagugggguuuuauacacagcuuuuaaaccuugugauuuagcaauuggguuuuuauuuauuuagauuuugaauauauucucugaguacuuauaccuaaagacaauuaguccauaauuuuaaccccucaauguuacuuggaagaaucuaccauucuacuaauaagaaacuugccccuuuuuaaacagcuuauuucucuuaaguguguuuugacuuaccccaccuuugaacagcccuuuagucaggugaagaucuuaguaagcuauuuauuucuguaaaaaugaguaugauuguugagccucagaugucuuaaauaguaauuugaauauuucaccccuaguuacgguuucauuuguugccaagaauuguaacagugacauugcauauacuuuuacuucuuuuuaauuuugccaguugauauuuggucagugggaugcauaauggccgagcuguugacuggaagaacauuguuuccugguacagaccguauccuuuaaaaaguuuuggauucuuguuucuuaucuguauuccaguguccauggguguauacuccuuuuacuuaucucuagggaagacucucaguauuuugcuuuuauagucuagauaaugcauuaugaggucuuucuucaaacugaguagcuugccuugccaagaaagaggcuucaguuuacuuuugugaguuggaaaaauuccucauaaguugaaaaacccaucaagucugucuucuuuuugcaacagucccuuauuaaucaucccacagcaguucugagaccugagcauacucaugagaaacuccagaucccagugacaguuuuagucuucuuguauaaacacuuaaugagcacaagaugcccauuuauaaaugaagggcaucuugcuguuauguuuauguauuaaaagggcuauguuugguaccugcagugauauacugcuuacuuguuauguuuguuguuugacaacaaauaguaaaagcaagaagugaaaagcuuaccauguaauguacuuuuguuuuuccagcacaacuuuuucccagauugcagccaaacccuaauuuacuccaagacuuacugucuaguuuaugguuuauuauagccccuuuauuuuagcuccuuuccuaucugcgguaugcuuguuucaugguuuaguauuaaugucaugaaaaauguggucuguuggaacucucaucaguucuacuuauggaagauguuuaggugagaaagauuguuaaaauauaugucuagaauuaguuuuggggauuuuuucuuuuuuuaauagaauugaguuaacuagccuucaggugguuuugguuaggcaauauuagacaugcuaccucugaucuauuaugccuagagaucuaaaagccauuuuagucccuuaccuaaauaaacuaauugaguuuauaaaccagaaugucaauucacuugcuuacaguuugggauauacuucuguaauggcuaugauguucaugauaucuacccacguguucuaacuaucuucugcuagagagaauguacuuucauuaugaacugaaaaaaccucuauuucucagguaaagcuguuucuuucucucugaauauuaggauugauaacagaguucagucucccuguauuuagcuuaccuuauuacucccuaccucuggauuuuaaauuaguuuaauaccugguguuucuccuuuguccuuuguuucauucaccuuauaucuguuucucagaaauuugguauauauauauuacaguccaagguaagagaauuagggaaaauucauacuucccccuuuccucagguacauaucucagagucccauccuugcuuuguccucuagaguagcugcuguccugaugcuauucucuguucccugcuccccuuccucuucuugugucuguaucuccagcuaccauuuagucagucacagaccuccaugccgguguagacacacaagguggcagagagggaaaggcaguauaacauacagguuaagcacaugcucuggagccagauuuccuggauuuagaucuuagcucuuuuauuuccagcuauguaacuuugaguaaguuuccuaaccucuauuucucucaguuuccuuaaccguaaaaugauaauaaucauacauacucacaagguugucguaagaauucagccagaaaauaacuggaaaguacugagacgagccugccaguaaauguuagccaucauguucaguaauggccuugcaaaacagauuaccccuucaccuucucacuuaauugucuaccuaugaaucauuaauguuuuguuuuguuuuuaauucugugauagguaggaaaggauggaacuccuuggcagacuaguguuagaaaguuuucgaagcagugugagucuuguaccuuugugguccugucucacagacaccugucuauucccugacccuuuuaaaugcuaacuuucugccuguaggaaaucuucccuuugugcuuaggucuuuuucuucugugagcuuuagauaaacaaccuaguguuuaaacuuuuuaauaagggauucauuuuuuaauacaugagaauucauuucaaaauuuugguuuuaguuauuuauuuuauucuacuuggcucuuuuucagacagauguucucuccuggauuguaaaagucgaauucaaaggauuuuuauuuguaauauacuuaaccuuucucuuguaaguugccaucuguguagauacagcuuugauugccugacaagaggaaaauguuucccauuaucuuuuccugccugaacuauacggucacuuguguuccagcauagugguucuuaacccucauagugugucagaaucacuuugcagagcuuuuaaaaacucuagaugccuggggaccaccccaaagacuccauuuuguugucaugggucaaagcacagucuucuaguuugcagcuaguguugaguacaacuagaguuuaacccaguugaauuuuaguuuaaucuuggcuggucuugaagauguuaguaaucucuauucauuuuuuuugaaaaguaccaaugagaucagaaaguuaauuagaaaacaucuaguugaauccccuguuuuuaauagauggggaaaccaagacccagagaauauaauccaaagcuaccugucacauaggccacaauuucuuuuccaauauucuguucuucgcuguucuucuaauuugcagaacuccucuuuaaaaaaccuuuggagaauguauuggccucauacccucuuccuucagccugaaagacaugcaccugucacuuauuuaugauauuuaaaugcaaccucuagaacagggguguccaaucuucuggcuucccugggccacauuggaagaagaaauguccugggccacacauaaaauacacuaaugauagccgaugaacuuaaaaaaaauugcaaaaaaaaaaucucguaauguuuucagaaaguuuacaaauuugugaugggcugcauccaaagcccugggccacgugcagcccgcaggcccuggguuggaaaagcuugcucuagaagguacucauuguuugaguguccaguuuucucccuguuuuccuuauuuauugaucauuuugcauuuggaauuggugguuugggcuuguaaguaagaacuguguacuagaacuuuugugguauugcaaauguuuuauaucugugcuauccaauguggugguuauaggcaccagcugccuguggcuaauuauuaagcaacugaaaugcagcuaguggugagcaguaacguuguggagaagaaaaaaaagaaauguagcuaguuuaacuuggaaauugaauugaaaauauuuuugugguuaaauguauuuaacauaaaauuuaccauuuuaaccuuuuuuuuuuugagacagucuugcuuuguugcccacgcuggagugcaguggcaugaucuuggcucacuacaaccuccgccucccgggcucaagcgauucuccugccucagccucccaaguagcugggauuauagguguguaccaccauguaauuuuuguauuuuuaguagagacaggguuucaccauguuagccaggcuggucucaaacuccuggccucaagugauccgcccaccuuagccucccaaauugcuagauuacaggcgcgagccacugcacccggccccauuuuaaccauuuuaaguuuacaauucagcggcauuaauuacauucaugauguacaaucacuacuacuaccuauuuccagaauuuuuucaucaccgcagauggaaacacucagcccgugaaacaguaacuucccauucuccccucugguaaccucuguucuuucugucucuguggauuugcuuauucuagaaauuucauagaaguagaaucauauuauacuguauuuguccuuuuguuucuggauuauuucacuuaguauaauguuuucaugguucuuccaugauguagcauguaucagaauacuauuccauuguaaguauuuaauauaucccacauuuuguugaccuguucaucuguuaguagacaguugaguuguuuuuaccuuuggcuauugugaauaaugcugcagugaacauugucauacaagcaucuguuugagucccugcuuuugauucuuuugguuauguaccuaggaguggaauuguugcaucauaugguaacucuauguuuaacuuucugaagagccaccaaacucuuuuccauagugucugcaccauuuuacaugcccaccagcaaugcaugaggauuccuguaucuccaaacuuguucuuuuuuuuuuuuuaauagucacccaaguaguuacaaagugguaucucacugugguuuugauuugcauuucucucaugacuaaugauuuugagcaucuuuucaucugcuuauuggccauuuguaugucuucuuuggagaaaugucuauucaagucuugccuauucuuaauuagguuguuuguguuuuuguuguucaguggugguucuuuauauaucuuagacccuuaucagauacaugauuugcaaguauuuucaccuauuuuguggguugucuuuucacuuucuugauaauguccuuugauacauaaaacauuuuuaauuuugauuaaguuccaauuuauuuuuuuucuguccuugcucaugcuuuuuugaugucauauuuuagacuguauugccaaauucaaggucaugaauaauuuaccccuauguuuucuacuaagaguuuuguaacuacuaggaauauaauaggguuuagcucuuauacuuaggucuuugauccauuuugaauuaauuuuuauagaugaugugagguaggggcccaacuucauucuuuugcaucuggaaguccaguuauucuagcaccauaaagagacuauuacuucccccaucgaaucaacaugauacccuaggauuucuccuuuguuuuuuguuucuuucaccuuuuaccuguuucuuagaaauuugguauauauaauuagcaauacacguguggguuuaauucuggacucucaguucuauucuauugguuuauauaucuauccuuauggcaauaccacacuguuuugaucacuguagcuuuauaguaagcuuugaaaucaggaagugugagucuuccagcuuuguucuucuuuuucaagauugcuuugacuauucugggucccuuguaauuucauaugaauuuaacaauuggcauuucuauuucugcaaaaaaaaggcuuuagaauuuugauagggauugugucagauuuuuagaucacuuuaagugauauugacaucuuaaccacuauuaagucauccuguucaugaacaaaggaucucuuuccauuuauuuaagucuuuauuuuuuuuucagcaguguuuuauaguuuucaguuguaaaguauuuuaccuugguuaaauuuuuuccuauguauuuuauuauuuuugcugcgauuauagauggaaauucuuugguguguucauuguugauauauagaaaccaaauuaauuuuugauuguugaucuuacacccugcaaauuugcucaauuuauuuauuagcucuagcagcuuucuucuagauucuuugugauuuucuauguauaggguuaugucaucugcaaacagagauaguuuuauuucuuccuuuccaauuuagaugcuuuuaauucuuucucuugucuaauguaauggcucugucuagaacuucugcuacaaugcugaauagcaacagugaaaguaggcauccuugucuuguuccugucuuagggggaaagcuuucagucucuucccauugaguaugauguuagcuguugguuuuucauaaaugcccuuuaucauguuggggaaguucucuucuuugguaguccauuucacauugcuaugaaggaauaccugaaacuagguaauuuaucaagaaaagagguuuauuuggcucacaguugcauagcuguaaaagaagcauugugccagcaucuguuucuggucaggaccucaggaagcuuucacuuauggugguagggggaacaggcaugucacaugucaaaggagggagcaagagagaugccagacucuuuuaaacaaccagcauuugcaugaacugauagagcgagaacucacucauuaauguggggagggaaccaagccauucaugagggauccaagacccuaacaccuucaaucaggccccaccuccaacauuggggaucacauuucaacauacuuggaggggacaaaacauccaaacccuaucaccuucuguucacaguuuucugaguauuuuaaucugaauuuuaaaugccauuaaaauuuuauuuagauuacauugaaacuuaauuacacauggcuagugguauugguuuaugcauuuuuagaucccuucaaguuaucuuccuguucuaccuuuuucuuggguuuuguaauuagucuccuucuugaaagauuauuuugguacugguuguuaguaauuccuggauuuccuuuaaagauauaagaaauacuggggaggggacaagauggacaacuagaaauagcugcaaucagaggcuuccaacaagaagaacgaaaacggugagugaauccugcaccggcaacugagguauucaccuucucucaaugggacugacuaggugguuggcaugacccauggagagugaggaaaagcaggguggagcgacagcccaccugggagcugcaaagggcaaggggagcucccaccccaagccaagggagguggugagugauuguucuacccuguccaggaaaucaugcuuuuuccaaggaucugugcaaccugugauucaggagaucccccucaugagcacaugccaccagggccuugggucccaagcacagagcuguguagguucuugguagcccuuuggcuggagacuacauaagacuacugaguuccuugggggagggguugcugucaucacugcagcuccagucugcuguuuuccccugcuggugcuggagagacugggcgguugggacccagaaggaauucccuacagugcagacccuacaguggugguggcacaucauggccagacugacucuuuaggcugaacucugacucaucccccuacacggggcagggccucucugcgggaauuucagcaacuccagccagggguuuacagacagaauuccaaucucccugggauggagccccuggugggagggguggccacagucuccacagaucagcagaguuagucuuuccccuugcuggcucugaggaauccaggcagucuggaugagugagauuucccccagugcagcacacccccuccaccaaggggcagccagagugcuucguuaggugggccugugccucuugacuggaugagaccccuccaacaggggucgccagacaccuuaugcaagagcauucccacuggcaucagguuggugccccucugggacggagcucccagaggaaggaacaggcagccaucuuugcuguucugcagucuccacuggugacaccuccagguacaggagggacccaggcaaagagucuggaguggacccccagcaaacugcagcagcccuauggaagaggggccugacuguuaaaagcaaaacaaauggaaagcaacaacaacaucaacaaaaagguccccaccaaaaccccuccaaagguuagcagccucaaaguucaaagcuagguaaagucaugaagaugagaaagaaucaaugaaaaaacgcugaaaacucaaaaagccagagugcuucuuuuccuccaaaugaucacagcaccucucuggcaagggcauagaugugggcugaggcugagauggaugaauugacagaaguagacuuccgaagguggauaauaaugaauuucacugagcuaaaggagcauguucuaacccaaugcaaagaaucuaagaaccaugauaaaacauuacaggagcuguuaaccagaauaaccaguuuagaaaggaacauaaaugauggagcugaaaaacacaacaugagaacuucauaaugcaaccacaaguaucaauagccaaauagaccaaguggaggaaagaauuucagagcuugaagacuaucuugcugacaagauaagagaagaaugaaaggaaaugaacaaaacuuuugagaacuaugggauuauuuaaaaagacugaaccugcgaaugauagggguaccuaaaagaauuggggagaauggaaacaaguuggaaaacacacuucaggauaucagccaggagaacuuccccaaccuagcaagacaggccagcauucaaaucaggaaaucccuagagaaccccaguaagcuaccccaugagaagaucaaccccaagauacauaaucaucagauucuccaagguugaaaugaaggaaaaaauacuaagggcagccagagagaaaggcuaggucaccuacaaagggaagcccaucaggcuaagaguggaccucagcaaaaacccuacaagccagaagagauucggggccaauauucaacauucuuaaagaauuuccaacccaaaguuucauaucuggccaaacuaagcuucauagucaaagaagaaauaaaauccuuuuuagacaagcaaaugcugagggaauucgucaccaccaggccugucuugcaagagcuccugaaggaagcacuaaauauggaaaggaaaaacuuacuggccacuacagaaacacacuguuuucuuuuaccaguaacacuaugaagcaguuaccucaacaagucugcaaaauaaccagcuagcaucaugaugauaggaucaaauucacacauaaaaaauauuaaccuuaaauguaagugggcuaaaugccccaauuaaaaaacacagaacggcaagcuggauaaagaaucacgacccaucaguaugcuguuguauucaagagacccaucuaacaugcaaagacauacaaaggcucagaauaaagggauggaggaaaauuuaccaagcaaauggaaagcagaaaaaagcagggguugcaauccuauuuucugacaaaacagacuuugaaccagcaaauaucaaaaaagacaagggcauuacauagugguaaagggcucaauucaacaagaaaagcuaacuauccuaaauauauaugcaccuaauacaggagcacccagauuuauaaaccaaguucuuagagaccuacacagagacuuagacucccauacaauaauagugugagacuuuaauaccccacugucaauauuagacagaucaucaagcagaaaauuaacaaggauauucaggacuugaacucagcucuggaccugauagauagcuacagaacucucuauacagaaacaacagaauauacauucuucuuagcagcacaucgcacuuaggcuaaaauugaucacauaauuggaaguaaaacacuccucaguaacugcaaaagaacugaaaauauaacacacagccucucacaccacagcacaaucaaauuagaacuaagauuaagaaacucacucaaaaccacacaauuacguggaaauuggacaaccugcuccugaaugacuccuggauaaauaaugaaauuaaggcggaaaucagaaguucuuugaaaccaaugagaacaaagagaacauaccagaaucucugggacacagcuaaagcaguguuaagagggaaguuuauagcacuaaaugcccacaucaaaaagcuagaaagaucucaaauugacacccuaacaucacaacuaaaagaacuagggaaccaagaccaaacaaacccuaaagcuagcagaggacaagaaauaaccaagaucagaguggaacugaaggagauagagacaggaaaaacccuuccaaaaauaucagugacucccaagaucugguauuuugaaaaacauaaaauaaaauaaaauagacuccuagcuagaguaaugaagaaagaagaaucaaauagacacaauaaaaaugauaaaggggguaucaccacugacccugcagaaauaugaacaacuaucagagaauacuauaaacaccucuaugcaaauaaacuagaaaaucuagaagaaauggaugaauuccuggacacauaugaccucccaagacugaaccaggaaaacguugaaucuaccaauaacaaguucucaaauugaggcaguaauaaauagccuaccaagcaagaaaagcccaggaccagacagauuacagccaaauucuaccagagguacaaagaagagcugguaccauuucuucugaaacuauuccaaacauacaaaaggagggacuccccuauaacucauuuuaugaggccaguauuaucccaauaccaaagccugccagaaauacaacagaaaaagaaaacuuaaggccaauaucccugaugaacaucgaugcaaaaauccucaguaaaauacuggcaaaccaaauccagcagcaugucaaaagcuuauccauccaccacggucaagucagcuucaucccugggaugcaaggcuguuuuaacauaugcaaaucaauaaacauaauugaucacauaaacagaacuaaaggcaaaaaccacaugauuaucucaauggaugcagaaaaggccuuuaauaaaauucaacaucccuucauguuaaaaacucucaguaaacuagguguugauggaacauaccucaaaauaagccauguaagacaaacccacagccaguaucuuacugaauaggcaaaagcuggaaguauuccccuucaaaacuggcacaaggaugcccucuuucccuacuccuauucaacauaguauuggaaauucuggccagggcaaucaggcaaaagaaagaaagaaaggguauucaaauaggaagagaggaaguaaaacucuguuugcaggugacaugauccuauaucuagaaaaccuuguugucucagcccaaaagcuucuuaagcugauaagcaacuucagcaaagucucgggauacaaaaucaaagugcaaaaaucacaacuauuccuauacaccaacaguaggcaagcagagagccaaaucaugaaugaacucuuauucacaacugcuaaaagagaauaaaauacccagaacuauagcuauuaauaacaagggaagugaaggaccucuucaaggagaacuacaaaccacugcugaaggaaaucagagaggacacaaacaaauggaaaaacauucugugcucauggauaggaagaaucaauaucaugaaaauggccauauugcccaaaguaauuuauaaauuuaaugcuauucccauuaaacuacuguugacauucuucacagaauuagaaaaaaacuuuaaaauucauauggaaccaaaaaagaguccauauagcccaaacaauucuaagcaaaaagaacaaaccuggaggcaucacacuaccugacuucaaacuauacuacgaggcuacaguaaucaaaacagcaugguacuaguacaaaaacagaccaauggaacagaauagagaucucagaaauaaaacugcacaucuacaaccaucugaucuucaacaaaccugacaaaacgagcaauggggaaaggauucccuauuuaauaaauggugcugggagaacuggcuagccaugugcagaaaauugaaacuggaccccuuccuuacaccuuauacaaaaauuaacucaagauggauuaaagacuuaaauguagaacccaaaacgauaaaaacccuagaagaaaaucuaggcaauaucauuaaggacauagacaugggcaaaaauuucaugaugaaaacaucaaaagcaauggcaacaaaagcagaaacugacaaaugggcuucugcacagcaaaagaaacuaucgucagagugaacagacaaccuacagaaugggagacaguuuuugcaaucuauccaucugacaaaagucuaauauccagaaucuacaaggaauuuaaacaaauuuacaaggaaaaaacccauuaaaaaguuggcaaagggccaggcacagugacucaugccuguaaucccagcacuuugggaggcugaggcagguggaucacgaggucaggagaucgagaucauccugacuaauuuggcgaaaccccaucucuacuaaaaaugcaaaaaauuagccaggcaugguggugugcgccuguagucccagcuacucaggaggcuggggcaggagaaugacgugaacccaggaggcggagcuggcagugagccgagaucacaccacugcacuccagccugggcgacagagcgagacuccgucucaaaaaaaaaaaaaaaauauuggcaaaggacaugaacaaacacuucucaaaagaagacauuuauacagccaacaaacaugaaaaaaagcucagugucacugaccauuagagaaaugcaaaugaaaaccacaaugagauacugucucaugcuagucagaauggugauuauuaaaaagucaagaaacaacagaugcuggugaggcuauggagaaauaugaacacuuuuacaccguugguaggaauguaaauuaguucaaccauuguggaagacuggugaaauccucaaagaccuagaaccagaaauaacauuugacccagcaaucccauuacuggguauauacccaaaggaauauaaaucauucuguuacaaagauacaugcauguguauguugauugcagcaguauucagaauagcaaagacauggaaucaacccaaaugcccaucagugauggacuggauaaaaaaacaugguacauauacaccauggaauacuauacacccauaaaaaugaaugagauugugcccuuugcggggacacugauggagcuugaagccauuuuccucagaaagccaaacaccacauguucucacaagugggagcugaacaaugagaacacauggacacauggaggagaacaacacacgcuggggccuguugguggggugggggucaggcggagggaacgcaucaggauaaauagcuaaggcaugcggggcuuaacaccuaggugauggauugauagguggagcaaaccacgauggcacauauuuaccuauguaacaaaccugcacauccugcacuuguaucucagaacuuuaauuuaauuuuaaaaaaauauaagaaauacucauuuuugucuuaaagccaauaauguguuaucagauuagaaauuauucuuguuugugacuuugcagaacccuuccaucuggccuaaugauagcauuauuauuuuuuaaagaaugaagcccuuucuuaaaagccuaguugacuagggauaucaaguggacacagcugacagaacuuuguacuagaaaggagggaggauacagaaugucucuucagguacaguacuaacuuauuucaaauaccauagaucuugaaaugaauaagccacuuugaaaauucuguuaccaacgcuuaacacucugcagcuuaaggaagagagaaaguuuuauagcccuguuaugcaucaaauaccguuuuucuaccagagaucacagccuuggcuugcuguuguuuuccuuuucuccauaaucaagugaauuuccuuauguguaaaaccuucuuuaauuuuaacagaaauggugcucuuaagacauaauggguuaauggagcugaguuaaaauccacuugccaucaguuacugcccuggucuaugggaguuuuccuaguguauuaaauuugcuucuuauauauuuuuuuuuauuucuucuuuugcaaacauguuuugaaauauuucagacauacugcuagacaaagaauaauaaacaccucuguucauacuguccugcuugugaguuaaaacacuggcaauagagcuaaagcuucuggagacccuucucucacaucugcccaucacuuucagucauugguuucaaauacucuuucuuuuuuuuuuugagauggagucucacucuguugccuaggcuggaaugcaguggcgcaaucucggcucacugcaaccuccaccuccugaggcuggucuagaacuccagaccucaagugaucugcccgccuuggccuaccaaaauguugggauuacagguguggccacugcacccugccaaauauucucccucucucucuuuuuuuuuuuuuuuggagacagagucucgcucugucgcccaggcuggagugcaauggcgcaaucucugcucacugcaaccuccaccucccguguucaagcgauucucccugccucagccucccgaguagcugggauuacaggugcacgucaucacgcccggcuaauuuuuguauuuuuaguagagacaggauuuugccauguuggccagccuggauguucucucauuuuuaaaaagcaguuucacuuuagacaccaaaagcaaguguccaauaaaugcugaagaagaaaaauauuuuauuagguuauuugcccuuuccucucuaacuugaaaauacauuuucucaggaaaagguagaauccucagauuuguccauaaaccaagggucccuuaagaaauuuucuuuguguuacagugaaaaugacuauuuugacaacuuggaagauaaggagcuaggcuaagucuuauucuagucuauccugucugucaccaggaagauuuccuaccuucccaaagguuagugcuccacuucaccccuauguggauuuaugucuuugaaaauuacugcucauggcagguagguccugcaauugguccuuuuauuuaucuucaacuuucuggccuguggagguuuuuuaggagugccuggagcacuuagaacugacuagaauaucccucuuuuacuuucccuagaaauauccuguuaugcuuaguuuuuuuguuuuuuuuuuucuuuaccuguucauucugacugacuugcuucuguuaaagaugacuucgucuaaagaguaaucuuaggcuuaaguuguucuuuucuucauuuguuuuagaaagauucaggagauuuaugauuuaaauuuugacguugugaucauuacaauuaaaacacauuuuaaacuaauaguaaaaauauuuucuaccuaagagaaacagggcuaaaccuauuacaaaggauggcucacuguggaaauaacugauugucaugauguggugaguuuugcuuuacuccgcuaauguggcuacgugacgcuccuucuggucuuaacugccuggacaaaucauaguggccuuauaguagcugguacuguuggaagacuggccuguauuucaguggauuugccagcuuuugaagaacccauggugauuucuucugagguuugcauguuuuaacuuccuucaugcaaaugcuuuuaguuacuaagauuuuuauuuuauguuguguguuuuuccauggaguauggucauucuguguuuugagggcaaggcagugggguaaagcugaguugaaaagcauaauauggcucaucuuuucuuuucuuuuuuuuuuuuuuuucauuuuuugcugcuuuuauuuuacgaaaaagcuaauucaaaucuacauuaaacuaaguugaauacaaagccuuugugaagaaggccugguagucucauuuacaaaaauggccagugucgucuuuggccuuaaaauuucaggacgggcacuucagauggcuucacauuugcauguuucagugcuagagcaugggaauagacuuuggcauccacuguaagauguuuuucagcuacgagagcaucgagucccugcagcaggucauucuuggguaacgaaaugacuuccacaaauucuccauccccuggcuuuggcuugggccuuacauuuucugcgucaucuccguuaaugauuacugucacgaugugugugguacaguuugacaaaccuggguccauauagaccacuggagaacauucagcagcguccccuuuguagccaguuucuuccucaagcucccaaagagcagcugcuccugggguuucaccaucuucuaugaguucccugcagggaacucuaugcaguagccacccauugguggucaggacuguuucaccagaacgauacacucguagugaagcguucucugcagcacagggaugaccgcuacaucaucaccagucuguucuuuccugguuguauguuucacugagucccaaguuccaguuuuaccaauaggagccauguauguuguuuuuucaaguuugacccauuuuccuucugaaauuaacuccucugaaauaauauaguguuuccauucugagacaauucaguugguucuuggcucucccuuuucaaacuagucuuuacagcccucaggagagaaguucaccuccaaaguguaggggugacaaagggaagaggacaaaagaacuacuggaggcagcagugucagcauacgccggugucacgacucaagacaucggcaccucccgaggugaugaaaggaugugccauggcucaucuuuucaagucaacuaguauuuaucaagcugcucuguggaaggugcuggggacaggaugguaccuguccuuaaaaccagaaugaucagacucaguggaaagagaguuacaagaguuacuugaacaacugucucugauuauaaaauaagauggagugauaaauacacuagaauagaguuauagauaagcuauugaaaaaaauccaagaagacuucauggcagaguucuuguuugaauaggacuucaaaguguaaauaggaauagaaaaggcuuggaaggacgggagaagggggagguauucugguuuaugaguacauaaauaaguacuuggaagcuuagaagugccuggaauaucugaugugaguugaagcauugagugcauuaaagaauaauaauuugagccagagucaaacuaggcuugauucuucaggccugauauuguuucaugccagcagaggugggagagagaggguuucucagcucauugauguaaugagccacugugacuaauggaaauugcguauucuucagguagguuggggugaaguucagguaguugagaaauucacagcucagagagccugucuuccuuagagagaguauaaaaauugacucucagccaggcacgguggcucacgccuguaaucccagcccuuugggaggccgaggcaggcggaucaugaggacaggagauugagaccauucuggcuaacauggugaaaccccgucucuacuaaaaauacaaaaaauuagccgggugugguggcaggcgccuguagucccagcuacucuggaggcugaggcaggagaauggcgugaaccugggagguggaacuugcagugagccgagaucgcgccacugcaccccagccugggcgacagagcgagagacuccgucucaaaaaaaaaaaaaaaaaaaaaaacaacugacucucauuguuaaguagucagaaagaagucucuuaaacaagaguaccaauaucaaaagcuucauuuuagagauuacuuuugaugcauauauuguaaagccacuuguuugagauuugaaguagucaagauuuuucccauauaugauuuacuuuaucuugugguggcuacccaguuaaauauauuccugaagaguguuaaugugaggaaacuaaauuuuuugaauugagucauuuuagaugagcaagaauuuuuuuuacugauuucuauuguaauauaauuaaucugauuauuuuagagcaagacaguauccaucccacccccauuccuacucugucccaugaacauaugcuauaagauuuuuuacuugucaacaucuugaacugagaagccaguauuaaaaucuuaaccuuuauaacacaaugauuuuugccauuugcagaugacaaaauucccuguuauucuuaauuuagaaauaaugugaguggacuuguuucuaguuuguuuuugcuugcuaaagaacacaaguuguuuggguuuagggugggguuuggcgcaccuuuucugaaagggccagguaguuaauauuuuaggcuugggaaccauaugguaacugugcuuguuguaauuggaaacaccuauagacuguacauaaaugaaugggcauggcuguguucuaauaaaacuuuauauauaaaacaggcagagccugggguuuggugacuccagccuagaauuuucuuccauuuaagcugauuucaugucugaaagaaaguaaaagacaggaugucaaauuacugcauuaaguuauuccuauaacguaggcaccuguggcuuauagagacuguuguuuuuaagugcugcuauguugccuuuauauguauaaccauaagcaaaaauuucuuucauccugcucuaccuuuuccucaaauauuuugacuaccugucauguaccagauguuaggcuggggauaaauggugaagaggcagaguggccccuguccucguagagcuguagaccaguacagggggcagacaguaagcaaauaaaguaauucuaggcugugauaagcacuaugauguuaucaagcauggugcugagagagaauuggggggugggguguuauguauauagaguguugaggggaggccucccuuaggaggugaaguugaagcugagaccugaagccaagaggauuuagucaugugaaaaaccugaugggucagaagacagucauccuccccuucucccucccuggaaugucagucaguauaaacguggauaaacuguucacauuuucagaggaaauauuaaaagcuauuuuauaauauuuuucccccucuuuuuaacuuccuuuuuagguaagauuaaaagcaaugagaacaaacaaauuuuugucuucugguuaacacaugcacauacauucugaguauacauugaaguguuagcuaccaggauaaaaguuauggcauuguggccuauuauuuagagccuuugggaugugugaaguuuguuaagcauuguucauuugcauuuuauaagguugaaaccgccuguauuugcguucucauggcgcuccuaaaggaacaugcgaugggagagcgcccucugcuggcgacucucccucauagugccugcuauagccagugugagaggcgaggcuucccuuuccagagggugugcuccaguggucaggcuuuggggucucacaggccuuccacugucauaucacaagcucuuuaggucacgcuugggagaauauucauaaauagacuuguacaucccuagcuccugucuucugcugcuuuuuuccuuaucuguggcccucuaauuaucagugcacuuugcugaacugguuacugacacugugauggcagaugaagagggcaguguaaacugagugaagcucuuguguuuucaccugcugucuuuggcagcuaagaaccagcuaaaguugccucacuuuacugauacaugcuguugacagaugcauaaaaugaauauaaaguggauauguguuugguagcauuuugaaucuuuguacaggaggagcaugcccuacgugaagugaucauccugcaggagccuugaccuagagggauucaccguguuggcuagguuugggguguuucauuuuuguucucgguguguucuguuuguuuguuuuuguuuuguuugucauuguuuguuuuucauuuuuauuuugucccaacauuuuccuuuaugguccaccauuagauauugaucaguugaagcucauuuuaagacucguuggaaccccaggggcugagcuuuugaagaaaaucuccucagagucugugaguugaugcuuuguaauuaucugcccuguugggagccucugccacuugccuucuaccaaucuguacuuugaccuggguguguuuguaagcacacaugcccuuugugugcugacuucccggaugagugagguauaagacagugugagugugugugugcgugcacgcaugugugccugcuugcaugcacaaguguguuuuauucucuaucuggguacacacuaagaucacgggagccuccauuagacaauaguaucccaguaaagcaaugagauuugagauucuaauucauuccaagagauuaauguaaacuuugugucucuguccucaagaccugacuuucuucuuucucagaaguuucacguaugcucuagagcucuuuucacuguuucuaguguuuguucucagagcaugagcuucaccauguauuuaguuuaacuuaaucacuaaaagaauaaaauguacauugucugcacacuguugccccuucccagaaguuauuuuuuauuguuuuagaauagauacucacauauccuauguaaaauguuuguucccaacagagggaccuuucuacccagucccuagaccccacucagaagaaacagcuucacuccugauaccucagauacacaggaaugugguuauaaauuuuccuccuauugccuuguaauuauaaguuagauaaccugagacagaguuuggaacuagugcuuucuugcuucuaagcagggacuuagacagaagccaugggaaugugagucuggcuuacuuuugcuaugauuuccugcucuuggucauuuucuugggccagaggcaugagagaagccaugaaagcccagcuuuucuuuuucccucgaucugcugccaggcaguugaacaaaagaaaaaaagagcuauggagccaagcuccaguuaugccuuccuggauucuccucccaacauuuaugacugaaggggcccuuugccuaguugggaagauggcuggguagcuugaggcaagcauaagcaggugaguuggaaccguucaucaucuuccugacaaaauaaagaauaccgucaucugguauguauccgguacauuucuugaaaggaucccaaagcccaguguauuucugaaccuccacucugaauuuguuucauuuacuuauuuaagauaaagaagcaaaagcccagaagggcagugacuuuuccaugucaugcacugaaucacguggcagagcugaguauagaucccagauguucugauaacaugauccaaacuauaaucccaugugauuacacacuauuuugaaagucauugucaguguuaccacaaugucaaccuaaagagguauuuuuuucuccuuuaugauauguagaagcugaauuagagugaaucaaagauaucagaugaugcuuagaaagagcaguacuuuuuuuuuaauguuuuugcuuagaaacacugucuuacaguaagaggaccuaagggcagagggaggagcucaauuaauaaauagugcuaaugagaccaagcaaauucauuuccuuccugagagugucuccuagcagcccuuucuuagucuucucuuccaucccaaccaucugcccuauagauacgugcuauuagucauuuggaauuggauuaggaauucaaaccaaagucuagguaaaauagucaauaguauuuaucugucauuaauccaucacuuauuuuuaagaaagaaacaaugagugcacagccuaauaauggaggucucucugugaaaugaggcacauuauacauuucaacagcucuacugaaauugaguaccagaauacagaacuuaacucaaauaauauuauauugaguauaagaauaagaaagguuuuuuuuuuugguuuguuuccuacauaauuggggugaguggauaaaaguaguuuaaacauccuaagggguagacaagauuaauuugauguucgugacacggcccaaguaccuguuuaucuuaaaagcgcaugauguaugggaacagaauggaaaaauaaggccaggugaguaaaauuguucagagauuuuaaaaauuaaaaaaagaaaaaagacauuagugaaggagugcaguaaauagccaacagcuguuuucauucuccugaaaaguagugaaguagugauggcaauaauuaugaagaaauugaaugccgaguaagagaaugcaguaauggauuuagaaccuauuagaaugagccauaggaaaagguauaaauggguugugauggaggccaaggacagagaauucauuugguuaaugucccaguaucuauaauaaucagugaaagaacaagaaaaucauauuaagaaagcaaaagcagacugggcacaguggcucacauuugucaucacagcacuuugggaggcugaggcaggaggaucacucgaggccaggaguuugaggcugcagggaguggugaucaugcacugcacuccagccugggcaacagagcaagaccuugucuuuaaaaauaaauaaacuaauuaauuaaauuagauaaaaaagcgaagaccugacucauucacauuuuccuccagaaauagaaucuuucuaacuucuugacagaaaggggauauaauaaccucuuugacuaaaggagacaaagacagaaaaugugcaggccagguaucauucacagaaagaaaggggaaguggaggauuuuuacauuuuaagacccaacugguauucugcuauugcugguuuacuuuguggccccuuuuuguuauuucccuuggcaugaaaaguaucauuuguuaugugauuuguuaaagguaacucuaaauucuguuaucuguacuccuaacaaaauaaagaauuccaucaucugguauggaucuguuaacguuucuuaaaaggaccgcaaaucaaaguguauuuccuauccccuuuuggaauuuacuggccucugucuuugggcuuagggagcguaaaaggcagcguggagcacauggcucuagcucccucccuguggccagccuuaaacagauuacugcuaagucaucugaccacuagggaguucaguucagaggacgagcuaaaguagaaaaauuauuugggaaagccaugaaguaaaauugcuuggccauggugcuuauuaaagaugacacuucaccugaaugagggaauuaguaguuaacaagaacaggacuagaaaagggguuuauugaauuacauugaauauuuuuaaaaucucaucacuucugcucuuaguaggaacaugauaaacaguucugacauuuuagaagagggugaguuguauuaacauugauggaacaguuaaaagagagaaguuguaguacagcuuacauaugugccuauacauauagaaaaucucauaguucugcccuuaucagaugcuugcagaguauucugcagacuucccuccagcuguuuguuaaaugagguuagucuguucgcuaguugaagagacuuguggaggaaaucauguggcaugcuuuaacacucucagcagccugugacuucuguuuugccuuugccauuagccucuaaccuucuccucuucuccucuuucuucauuuaccauuuuguguuuguggcaaguauuuuaaauguaccacuaacuaaugucuuugaaauguggcauugcuuauuaacccagaugcccacgugugucuuaauucggagggauggugccuuggagaaccugugccgcaaaaguuuagucucuuccuugaauggauauguuggauauuuuauuuuguucaaaguugagucaaaauuuuuggaaucaucuauauuucucccacaaacagguuuuggccaucaguacuugaaaacaguucuauggcuggcauccuggaucaaggggcagucuguuuccagggaaccuaaaauauuuaacaguaaagaugaugcuaaaaccaaagaaaaguaauuuuucuuaucugcauggccagucacuggcuacgugccuaguuacucaugucauucacagaaguguacuguagcaugcagcugugggcucucggguagggggaauggaggguagguuuuuuugucuguuuggggguggcuuuuugaccuuuuuaaaaacuugaguugaaaauuauuuuuugcacuguauguuuaacaaugcccuugacuaggcaucuaagauauuaaccagcuucagcagauuaugcgucugacaggaacaccccccgcuuaucucauuaacaggaugccaagccaugaggugagaacaaagagacuguacagggaugucgcacugagaagccacauucucauuuuauugccaccguauaaccaacaguucuuaacaucacuggaugcuugcaugugccuugaggccugccuaugugcuauugcaagauguugacuuuugggauaaaaugucauccaguccugugagauugggaauauaauuaguaagcuuguaaauggaaaauuguuauuuuuauauuugguugugugaauuuagugcuugugaggcgguuucuuucuaggugcucugccuguagcuagggugugcuacuaucgugaccuuuaucagaaggguaguuaacugaaguccauuagcaugcuuuccaauucauccauuuuuuuaaugaccaaaagaggauucuuuauuuaaaaacaaaacugaaauauccaauacuaauauguacuauauuuaaaagaaaauacacaaauaauauagaauaaauacaaacacuuugguacaguuagguaccuucuuuauuaauuauuaacuacuuagucuaacucuuguuuuauuaucagagaugauuggggcacuucuuucuuuguaagauacccuuaauauuuuggggaaccagguuggcaucacagagggcccuucccagcagcuuuguuucuacuucagcuauauucaggucgucuuuugauuuaucuuuauuaaagggaugacuguucucugaaugagauaguucucucuuaccuguuuucccuuccucuuuuuauuuacauguucaaguagaaagggauuacagccauuuauguauucaauuccuaaaacuuucuuuucaaaucagaaagauucucaauugcuuuucaaagcagaccuuuccuccugacuccacaugcaauaauuaagaagcggaaggcugggugugguggcgugcaccugcaaccucagcacuuuggaaggcugagaugggaggaucaguugagcccaggaguuugagaccauccugggcaacacagcaauacugcagcucuacaaaaaaauuuaaaaauuagggcaugauagcacaugccuguagucccagcuacuugggaagcugaggcaggaggguugcuugagucaggaguuagaggccauagugagcugugauugugccagugaccuccagccuaggcaacagagcagagacugugucucuaaaaaaauuuuuuuaauaaauaaagaaggugaacuugcccaagcaaccagauuuuuuuuuuuuuaagacaggaucuuaacucugucaccccagcuggagugcaguggcacgaucuuagcucacuggaaccuccaccuccugggcucaagcuuccugggcuccaucucccugcucaagcgauccuguuaccucagucucccaaguagcugggaccacaggcaugcgucaccacaccuggcuaauuuuuuguauuuuuggagacaaguuuucaccauguuacccaggcuggucucaaaguccugggcucaagcgaucugcccaccuuggccucccaaagugcugggauuacaggcgugagucaccgugccugggcaaccagaacuuuuuauaaacuuguguguguauguguaaacauaaauauacauacauacuuuuacuguuggacuguauuaaaacaggaguuuuaaagaggugguuaagauagacagcagacuuugcuucugaaggugauagugggauagcagauaauguuucuugaacugucacuuggaaccaaguacuguguuaagaaaguacuagguuuguuaucucuaaucuucacuccaacccugugagguaggacuguuauauuaaguuuauauuaacuuuuuuguuaccaccguuacuuuguuagcaagguuuaauauugauauccuuugauguacuaagagcaccuacugaagucagcacugucaaaagacugcugguccaagacuugcuuugggaauaccaaccccucuaccaauuuagcuguuugagaaggcugucucagggcuacuucuuacauaucuuggccucaguuuuuaaacuucucauccugugaucagaaagcuaaugaaagagaauuugauugaugagcauucucguucacuugaaaugcaacugugagagauagcaggaauaaagaaggugaugaucauaacuagggaaguuaggauggcaguaagggagaaguucuaucaaagacaguuagaaacacugaaguuaguggacuuugucaguuaacacucguuccuuagcaggaccaagauucuuucuuugagagcaguaacauuauugaacaaagucauucugaaaacccuuguuuuuucaggcaagaaacuauauucagucuuugacucagaugccgaagaugaacuuugcgaauguauuuauuggugccaauccccuggguaaguugaccauauauccucaccucauggauauugaauugguuaugauauaaauuggggauuugaagaagaguuucuccuuuugaccaaauaaaguaccauuaguugaaucuuggaaggugauaaauacggcuuuuauuaucuauuuguguugucagauuuuuuuuuaaucacaugagaugauuguauguuuaaaugaucacagaacuugggauugggggaaugggcagguacaguggagaaaggagagaaaguaaugggaauguugagagaaaagauuggugaggcaggaagaagcagauacagaagaaagcuguaacuugcucacaacugcuguggauuuauggugucucugaguggaggacagaaaccacugaagugcagguggguguuuagaggagccacccaggagcucccugcagggugcucugcucuaacgguagcugccguugcuacagauccugucgucuuccacacucaugaacuuuuccccucuccucuucuuucucugcccucagaggcauaaccguccucuccuguuuguggagcuuauuugcuaccuaaacuuaaaggaauggcuuccuaugccuucaagauccuuggcagagggaagugaugguggcagcugaagauauguguugccuuggcuaaaaaaggaguugcuuuauuauuauuauuuauuuauuuauuuauuuauuuauuuugguagugucagggucucgcucuuuuacccaggcuagaguacaguggcacaaucauagcucacugcaagcuugaacuccugggcuccagugauccuccugccucagccuuccaaauagcuaggacuacaggcaugcauccccaagccuggcuaauuuuuuaaagaauucuuuguagagacagggucucaccaucuuacuaaucguggacuccuggacucaugcagucugcccacuucaacuuccaaaagugcugggauucagacgugagacacugugccuggcggacuauauucuuugaaggggaggagugaugugugcuucagauggccccugaaagcugcuuugccugaggcucauucccugacucuugaagaggacaguggacagugcuguuuaaugguggacacagaaggaucagaccaggaccucccuacaauagggaagggagcuaugcuaugguaacgaguauaaucugccuucucacuuuucuuaagauuguauugugugguguguuuuaaaaucucacugcauuucuuugcaucuguuugggucaucugucuucuuaagggucuuggcagcuaugcuucagguuuaguuuuaucuuuuugagggcugacagccaugcugaccucuuuagaagcuggggugaaggcuaggugauuuuaccuuuuuaaguacuucauccauagugauuauggagaggaauuuuagugucgcugugauaauucuuauaauagcagagauacucacgcucuuugaaguuuugggcaguuguggaugaguucgugucagccuuggagacagagaguaugucauaucucagcugggucgcucuccugcccuaggaugaauccacagucucaucagggguggguacgauucuacugagacuggcuuagguuugcaucugcccuggcaugcucucauuggcuuugugugauuuauuugagcuguauuaucuaguucaagggucugugagaagcucucuuugagccuuaaguacuacaggauguugggaaaagauguuguguucuuucuuuccuuuuuuuuuugagacagagucucgcucugucguccagguuggagugcaguggugcgaucucggcucauugcaagcuccaccucccggcuuuaagugauucuucugccucagccuccugaguagcugggaauacaagugugugccaccacaccuggcuaauuuuuuguaucuuuaguaaagacgggguuucaccguguuagccaggauggucucgaucuccugaccucgugaccugcccgccucggccucccaaagugcugggauuacaggcaugagccacugcacccagcccgucguguucuuucuugucgucauucuguucugaaguuguuucauuuuauaagccuuaaguuuugaacagggcaguacucacugacacccucuuaacagacucagaaagauguguuaauucauuuuuuagggggagaggggagauauuuguguuccagcagcuuauuuaggucacauaccuccugauaggucuucccauucuuugaaaucaugacauugaaaccuccaaaagaacuagauaccacuuugcuaaugaguugaaaggaggcuuugguccaucuggugcucagcacuguacuucucagcauuuaaacgugccuuacagcccauugccaaacagugaugucauauaaugaggcuccccuugcugggcagauggagcacaguguuacuaucacaagcucgugcccagcauauuaacugagcaggaacaugccagaaauauaaauauuaacagcucuguuuugucagccacugacuuuguuucacugcuauucccaaaacaugaauuaaaacuuaaauuaccccuugauguuaguguauguauuuaucugucaagauuuuuuuuuuuuaagagauggcaucucacucugucacccagguuagaguacaguggcacagucacgguucaugauaaccucgaacucuuguguuuaagugauccuuccucuucccuaucccaaguagcugagacaacaggcacauaaugccaugcccagcuaauaagaucuuugaggaauuuguucuugccccugaccuuauugguuauaagaacaugguccuuuuuacccuaaggguaacagagacuugucguauaaucuguguucaauuauaaaaucaacagcugauaagguuucuuuuucuaagaagagaagaccaucagaagaauauauauauauauaauccaggcauucaccuaguacuguaaaguguaaacuuaugaacuugaauugacacaugaauauuuacuuuguuucuguauccccuugaagcccauauuucuccaguggauuacucuggaauucaagcuguaggacggguguuuuacagccuccaauauacacagcaguagaucucuauaggaagcuguccucuucacuacucacccccacacccuccacauuuaaggaguaauuugcaaagucucaaaagccuuuuucaccacagugauaacugguuauauggcaguauuuauucucccaagugccaccaugcugaaacacaaaaauacucauuugaaauauagaguuagacaaauuaccauuuuguaaccccuuaugaaauaauugcuuuugggaaggaaacccagugaaugcagaaagccauaagugaaaagaauggauauuuacuugguaccaaaauaucccgcagauuacuugcuuuggucaaaggggaaacaucuuaacccagugaucaauuuuagcucauuaguagugggacagauggccuuaaugcacugucacgugcacagcaucaccuguauuuuugcugaaaauguuuaaccugauucuuaccaaaauuuuugaccuaacuuccgguuuuugggaaguacaggggauaguggaaagcaggguauagacacaugacagcaaaagaagcaaaaucagacacaucccgagaaacggucauucucaggacaaucagagggucucuuuagaucaaaaucaggaaagaacagggcuuagaaguaagaagauuauucuagacuaagagagacuaaagaaaaccagucaguugcagugcauggccccuaauugaauccugguuucaacaaacuaguucuaaaagacaacguuggaauaauuggagaaaucuuaacaugaacuggauuuuagaugauauuuagaaauuauuugucagagauaauaacaguauuaugauuauauaggaagaugucuucguguugaaauauuuggggaggguaaagugucaugucuauaauuuuauuuuaaaacaguucagaaaaaaauacauauaaauacagaaauauaaaaauguuaauuguugaauaugcuaggcauaugaguguucacuuuaucauaguuuuuacuuuucuguuucuguauauuugaaauuuuucauagugaaauuuuuaaaaauaaaauucccuuugauuuuaauaccaugucucacccucaucaccauguaaaacccccaguuuauucacuguuugaagaucuguugaugaauauuugauguuaguaaauaaacagcuuagggggacaaaaaaaaaacagcccugccuaccuauuguagguuacuucagcuguaggcuuuguuuuauacaguuugacuacacugguagcaguuugacauugacgguccacaaaagccuguucaaacagaaucccagucauuuaaaaaaauucuucuuuaguaacauauucuuuaaaaauacaaaauacaggaggagggugaggguugagagauaaccuaucggguacaauguucacuauuugguuaaugggcacgcuagaagcccaguccccaucaguccguggugagacccauguaacaaaugugcacauguacccccaaaucaaaaauaaaauaaaaaaauuuuaaaacauagaaaauacagauacacacacacacacacacacacauacacacauaaaggagaagagggcuaauauauccuagaguagguauuuuggaggagaguucuuuguuuggauaugaagggucaaaacuauguuugcucaauaaggcauacuuuuuuguaacauguuaaaaacucuuuuccuuccugucuaugguacugauagcugucgacuugcuggagaagaugcuuguauuggacucagauaagagaauuacagcggcccaagcccuugcacaugccuacuuugcucaguaccacgauccugaugaugaaccaguggccgauccuuaugaucaguccuuugaaagcagggaccuccuuauagaugaguggaaaaguaaguccuaaggguaggauuaacaucuugaaccacuaaccaaaagcggugggaaaaauaaaaacugaauggucauaaccaacuugcuaaagcuuguagaugaggucucuaaugcagaaugaauauguucucugguggaaacuguuguagacagugauacucucuggaccuuugagauacuuaugucuggucugauuuuaugcacagccccucacauaggaguuuugcauggagaguugagguuuucagagucauugcauuuacaacaucucucugagcuuuuacaguuuuacaauuaguagaacuggggcaaagagaauuuaugucuuaucaguuaacuuagaacuaguuagggacauagccaggaauggaacccauguauccuguguccagucccauauucuuuccacaaaacacaaguucagaacucuaguuaaaucccaagagccaagaccaucuguugcuguagcuugugagagugcucuuucauucuugagcaccuccguagagagcuuaaaagaagaggcacucagcgaugaaaaacaugagaaaaaaaaugguucuuuucuaugucccuugaacuucugugugauaacguguuccaguaggcuauuacauacaagcugugagguagcccaucaaaccacuaccuggacagagaggaaggaucuugagcuuagaagucagagugcuugccagcaaagagaauagccuaaacucucacaucuuacuuuuccuucccaauuucuaggccugaccuaugaugaagucaucagcuuugugccaccaccccuugaccaagaagagauggaguccugagcaccugguuucuguucuguugaucccacuucacugugaggggaaggccuuuucacgggaacucuccaaauauuauucaagugccucuuguugcagagauuuccuccaugguggaagggggugugcgugcgugugcgugcguguuagugugugugcaugugugugucugucuuugugggaggguaagacaauaugaacaaacuaugaucacagugacuuuacaggagguuguggaugcuccagggcagccuccaccuugcucuucuuucugagaguuggcucaggcagacaagagcugcuguccuuuuaggaauauguucaaugcaaaguaaaaaaauaugaauuguccccaaucccggucaugcuuuugccacuuuggcuucuccugugaccccaccuugacgguggggcguagacuugacaacaucccacaguggcacggagagaaggcccauaccuucugguugcuucagaccugacaccgucccucagugauacguacagccaaaaaggaccaacuggcuucugugcacuagccugugauuaacuugcuuaguaugguucucagaucuugacaguauauuugaaacuguaaauauguuugugccuuaaaaggagagaagaaaguguagauaguuaaaagacugcagcugcugaaguucugagccgggcaagucgagagggcuguuggacagcugcuugugggcccggaguaaucaggcagccuucauaggcggucaugugugcaugugagcacaugcguauaugugcgucucucuuucucccucacccccagguguugccauuucucugcuuacccuucaccuuuggugcagagguuucuugaauaucugccccaguagucagaagcagguucuugaugucauguacuuccuguguacucuuuauuucuagcagagugaggauguguuuugcacgucuugcuauuugagcaugcacagcugcuuguccugcucucuucaggaggcccuggugucaggcagguuugccagugaagacuucuuggguaguuuagaucccaugucaccucagcugauauuauggcaagugauaucaccucucuucagccccuagugcuauucuguguugaacacaauugauacuucaggugcuuuugaugugaaaaucaugaaaagaggaacagguggauguauagcauuuuuauucaugccaucuguuuucaaccaacuauuuuugaggaauuaucaugggaaaagaccagggcuuuucccaggaauaucccaaacuucggaaacaaguuauucucuucacucccaauaacuaaugcuaagaaaugcugaaaaucaaaguaaaaaauuaaagcccauaaggccagaaacuccuuuugcugucuuucucuaaauaugauuacuuuaaaauaaaaaaguaacaaggugucuuuuccacuccuauggaaaagggucuucuuggcagcuuaacauugacuucuugguuuggggagaaauaaauuuuguuucagaauuuuguauauuguaggaauccuuugagaaugugauuccuuuugauggggagaaagggcaaauuauuuuaauauuuuguauuuucaacuuuauaaagauaaaauauccucagggguggagaagugucguuuucauaacuugcugaauuucaggcauuuuguucuacaugaggacucauauauuuaagccuuuuguguaauaagaaaguauaaagucacuuccaguguuggcugugugacagaaucuuguauuugggccaagguguuuccauuucucaaucagugcagugauacauguacuccagagggacaggguggacccccugagucaacuggagcaagaaggaaggaggcagacugauggcgauucccucucacccgggacucucccccuuucaaggaaagugaaccuuuaaaguaaaggccucaucuccuuuauugcaguucaaauccucaccauccacagcaagaugaauuuuaucagccauguuugguuguaaaugcucgugugauuuccuacagaaauacugcucugaauauuuuguaauaaaggucuuugcacaugugaccacauacguguuaggaggcugcaugcucuggaagccuggacucuaagcuggagcucuuggaagagcucuucgguuucugagcauaaugcucccaucuccugauuucucugaacagaaaacaaaagagagaaugagggaaauugcuauuuuauuuguauucaugaacuuggcuguaaucaguuaugccguauaggaugucagacaauaccacugguuaaaauaaagccuauuuuucaaauuuagugaguuucucaaguuuauuauauuuuucucuuguuuuuauuuaaugcacaauauggcauuauaucaauauccuuuaaacugugaccuggcauacuugucugacagaucuuaauacuacuccuaacauuuagaaaauguugauaaagcuucuuaguuguacauuuuuuggugaagaguauccaggucuuugcuguggauggguaaagcaaagagcaaaugaacgaaguauuaagcauuggggccugucuuaucuacacucgaguguaagaguggccgaaaugacagggcucagcagacuguggccugagggccaaaucuggcccaccaccuguuugguguagccugcuaagaauggcuuuuacauuuuuaaaugguugggaaagaaaaaaaaagaaguaguagauuuuguagcaugugauguaaguaauguaaaacuuaaauuccaguauccauaaauaaaguuuuaugagaacaga

SEQ ID NO: 192680 - RNA, 53579 nt, Homo sapiens
cucggccccgggcugccgcgccagcccgucuccgcggcgggggaccgggcugccuuggccccucagcgcucgcgucuuuuccggcaguuggaacgcuuccuguuguccucacccguaaccgccuguugcccccugucucagagucccucacgcguccccucccgucuuuggcucguuggcugccgccgccggggcuucgccagccuucaagucgagacuacuggccgaaggggcgucugcggcucuccgccguccccagcccugccucucccugggcucuggugaguugcuugcugccgccgucuucacuccaucccgggguuuuuccuuuaucuccuccuuccccaaccuccgacuccuucuugggcuuucuccugcucgccggcgcccucuuucaagcccuaaccucucagccucuuggccucucuccgccccucuccuuaacccccuucuucccccgucuccagaugccccuuguuggcccucuccacauuuuuccagucccagccuuuccaccccauccuuuaucuuucuccuuuugcaguuggagcgggagccaggcuuuccuuuccauguugccaccuuugucugcucccugccaccagucagucccucagggaucucggucaucaccgguuuuuaucuccuuuuccuucuucuggggucugugaacuguggucugaggcagagaugucgaaagccccccuuggggugugguaucuuugagucggcuccuuucuccguuagucuuaggauacugggcuucagauaagcuucaaaucacaggaaaaggcagggaaaauucuuaagaagagaguggaaaagcaacagccagaggaaaaagucgguaagggcuuagaggaaagucugugucagaaagcgggcagaacggccggcagagagaccagaucucucaguucauucugaaacgacuaaaagacucggagagaaacuuguucuguuugaaaugcaccgaggaggguuggagugaaguagacccugagugucuccacccuuugagcucacccugccucugaauuagccaggcaauauauuugguuucccuaaacauaaaacaaccaccaccucgauaacaggcucuccuccccacccuaaacguuagauaccagcuuccuccuaagaggagagaacgcuauagcaaaccauuucaugucccagcccuaucccccaucacacauaaacuccuaggaauggacaucaaaaaugaguauauuuccuaguuaaucuuucuuaaggugcuaagugcauagcacugugcaugaaaugggggaagaauauuaaaacaaguauaagacauggugcuugcuuucuaguguagguagagauuacaguuuaguaggauuuacaguucagugggagagauuagacaugcgacuuaagcaauaaucuuagcuccaauguugaaucguccaaaugaaagauaauggauugucagucgcaaagaaauaaaguccauauuguugagagaggguuguuuauagugaucacagaguaccauuguaaagucagucaguuagccaggcauaaccauauagauugaaucacauaaugguuuucauuugacuuccuuuugaguuugcaggccuuacaccugacuuuuaugaggaucaguuccuuuuguuaauuuuuuaaaacuuugaagaauuccucagccaccuauuauuuccuaauucuucagaguugaagaaugaaacaaauggggcaaaggccuccaauggcuucuaggucagggcaggaaggcuugaauuguggaaagccugauggauaguccugucuuaagaaaaguugguugacccaguaaaucuaugaauugcuauagggcaauauuaauuacaucuuuugauuaaaggauauuagaauuaggcuaaauuuuuuauauuacaauagaggaaguggaggaggguuuaaagaaaggucaaagggaaggagagugcagucuuuaucauuauauuagaaacucuaaaaguugaaaaacacucugcuuaagaauuuguuggucuaauauuugagcaucuuugaguucauuuaauguccuuuugaucuuuuuaaaaguuuagguaguaaugcaagccagcuacuuaaauuagucaaagcauuuuugauauauccaucaguguaaauguagucuuuauucuuuuuuuuuuuuuuuuuuuuuuuuuuccagacggagucucacucacccaggcuagagugcaguggugugaucuuggcucacugcaaccugugccuccaggguucaagcgauucuccugccucagccucccaaguagcugggauuacaggugcccaccaccacacccggcuaauuuuuuuuguauuuuuaguagagacaggcuuucaccauguuggccaagcuagucuccaacuccugacuucaggugauccaccugccucagccucccaaaguucugggauuacaggcaugagccaccguguccggccaucuuuauucuuuagcuuuguugacaacuaaaaaucauuaacuuacucaacugccuguuauauggaaggcacuguuugccuuaggguuaaauacuagcagauuguuguguuguguuuguuguuguuguuguuguuuuuaagacagagucuugcucugucccaggcuggcgugcaguggcacaagccaaacucacugaaaccucugccucuccagcucaagcaauccucccaccucagccuccugaguagcugggacuacaggugugugcuaccacaccuggccaauuuuuuguauuuuuuuguagcaacggggguuuugccauguugcacaggcugguuucaagcaaucuccuaccucucccucccaaagugcugagauuacaggggugcaccagugcccuggcaaauuguuacauuuuuauguugaaguaauuucaguuguuaaaauguaacuacauauaugcaauuucuucaggaauuuucagacaaggaaguacaaaacucucacuugcuuuugacauguuuuuacaucugguuuuuaaauuucuucaccaaacacacuuagagugcaugugguuuucauuguggguggagggggggguacaggcugacaaauaaggaaccacacccaagcuucacaaaccaaacagagguuuuuuuuuuguuguuuuuguuuuuuuuaauuccuuuagugauacucuaaaacauuugaguuugcuuugguauuagucgaaacuuccccauaaaaaauaaugugauauuuuauaguaagguagcucuuaaugcagugucuuaaauuuguuuuuacugaucuuuuuggcacaugaugaaucaaaauguuugacucucaaguagagucuuaguuuugaaucucugcucugaaggaauuauuuaugugauuuuugucugcguaucuuuuuaaauaauugcuuuuuaaauaauuuuaaggcuuuuuugaacaaguguuuuauaagccuuaguuuaauccacaaaacaauuuaaaaagcuacuaaauauuaagggggaaaaccugaaaacuuuucuuaaaaugcacuaucuuugaaaaugguccuuggcugggugcgguggcuuaugccucuaaucccagcacuuugggaggcccaggcagucagaucaucugaggucaggaguucaagacuagccuggccaacauagugaaaccccgucucuacuaaaaacuagcugggggugauggcaugucccuguagucccaacuacuugggaggcugaggcaggagaaucgcuugaacccaggaggcggagguugcagugcaccgagauugugccauugcacuccagccugggcgacagagugagacuccauuuccaaaaaaagaaaaauggcccuuugacucucaugauucuuuuuugcugcagcugugggggguaguagagacagggucuugcuauguuacccaggcuggucuugaauuccuggacucaugaacuccugggcucaaaugaucucucuaccucacccucccaaagugaugggauuacaggcaugaaccacaguguucagccucuccuaauuuuuacucagcuuuauauugggaugaagagacagagaaguagaucauaugagagguaggaaugguaagaauaaaauauugagcacuauuggccgggcaugguggcucacgccuguaaucccagcacuuugggaggcugagaugggcagaucaugaggucaggagaucgagaccauccuggcuaacacggugaaacccugucucuacuaaaaaauagaaaaaauuagccgggcgugguggcgggugccuguagucccagcuacucgggaggcugaggcaggagaauggcacgaaccugggaggcggagcuuggagugagccgagaucgcgccacugcacuccagccugggcgacagagcgagacuucgucucaaaaaaaaaaaaauugagcgcuauugccaaugcuggagcaagucaauguuagugaacaauuuggccaagugugauaauacagguuagcugaaauaucuggaggaaaacaagauuuuauuuuauuuauuuauuuuuuuugagacggaaucuugcucugucacccagguggagugcaguggcaugaucucggcucacugcaaccucugccucccggguucaagcgauucuccugucucagccucccgaguagcugggauuauaggcgccugccaccacgcacagcuaauuuuuguguuuuuaguagagacgggguuucacucuguuggucaggcuagucucccaacuccugaccucagaugauucgccugccuuggccucccaaagugcugggauuacaggcgugagccaccgcgcucagccgauuuuauuauuuauuuuugagacugagucucgcuguguagcccagucuggagugcaguggcgcuaucucggcucacugcaaccucugcuucccaauucaagcaauucugccucagccuuuggaguagcuaggacuacuggugugugccacacuccugguugaaaacaauauuuuaaauuuaggaaaaaaauauucuauaacuuaucuaaacacauuggugguguuuuuuucuuguguaaaaugaggaaauuaagaucucuuguuuuuaagguauugcugcuucuaccacuagaaucgugauucagguuuuuugucauauuguucccuuuauuuuaagacuuaaaacuuuauuuuaacuuguaaauucaaauaaacggcaaacauuuaucaaauaccuuaaggcugugucagagcauauauguaucagauuaccauuuuuaaucauagauuuuucuuuuaacuguggauaaacuuaaaaaguuauugguaacaguauaugcuuauggaagaaaauauagaaaaacaugggcugggugcaguggcucaugccugcaaucccagcacuuugggaggccaaguuggguggaucacuugaggucaagaguuugagaccagccugaccaguguggugaaaccccgucucuacugaaaauacaaaaaaaaaaauuagcugggcacaguggcuggugccugucaucuuaacuacuugggaggcugagacacgagaaucgcuugaaccugggaggcagagguuccagugagcugagauugaaucauuguacuccagcaugggcgacagagugagacuccaucucaaaaaaaaaaaaaaagaaaaagaaaaacauggaaaaagcacaagcaagaauaacauuuucuauucccacuaccuacagguaagccacuaauaacauuuugaugauauguuucuaauaauuaugugcauauacaguaaacacauaaagaaaauugagaucgugauauacauucugcuuuguaauguguucuguugacuuagaguggaaacauuuccucugacauuaacuauuuggacauauuuuaauugucugcacauuauuuuauugaagggcuuuuucauacugaauuaauucuauuguguauauucaaguuaucccuaauuucccuuugugauuacaaugcugcauugcaccuccuugugaugaauuuuuaugggucuuugauuucuucaagguagauuuuuagauggcaaagaauuguacuguaugcauacuguauauuuuuuuuuaggucucacuauguuguccaggcuagucuuaaacuuggggacucaagcagaccucugucuuggccucccaggaagccaggauuacaggcgugugguuuacuauauauucuuaauuuaucuauaugguauugugaucuuguucucuuuuuaaaaaugcaauaugcacuugcacuaauauguuuuaaagauauauuugugggcugggcacgguggcucacgccuguuauccucagcacuuugggaggcugagaugggcggaucaugaggucaggaguuuugagaccauccugguuaacauggugaaaucccgucucuacuaaaaauacaaaaaauuagcccgguguauuggugggcgccuguagucccagcugcuugggaggcugaggcaggagaauggcgugaaccugggagguguagguugcaaugagcggagaucgcgccacugcacuccagccugggcgacagagcgagacuccuucucaaaaacaaacaaauaaauaaauaaauaaagauauauuugugugggccaggcgcgguggcucacaguuguaaucccagcacuuugggaggccgagguggccccgucucuacuaaaaauacaaaauuagccaggugugguggcgcaugccuguaaucccagcuacucgggaaacugaggugggagaaucgauugaaccuggaagguggagguugcggugagccaagaucauccugucgcacuccagccugggcaacaagagcgaaacuccaucucaaaaagaaaaaaaaagauauauuugugugacuuacagguacagguaaaguugcuucugguuuucugguuguugcaugguauuuccuaugcagccacagcucuuuauuuucuuacuuaagugccuccaacuucccauaacacaaauuaaggcaugaugaacauccucucugugcugaacauccuguguaugucacuuuagaagccugugugacgguuucuuuagucuuuauaccuaggggugggauuucugggucauaggacaguaauuuauauuuauuuucacuaaguauucucuuucucuggcuuuuguuacauauuaccuguuuguccuccagaaaacuugcaccaauuuacauuccuaccaauaggguaggagagugcacacuggguggauucuaacuccaaaucuaacaccucuucuuuucuuuguuucuagcagccauggcaaugacaggcucaacaccuugcucauccaugaguaaccacacaaaggaaagggugacaaugaccaaagugacacuggagaauuuuuauagcaaccuuaucgcucaacaugaagaacgagaaaugagguaaagaauuuuguuugaaaaaauugugucaugguuguggcauuccuuucucguauuguaaaacacuuauaaugcugaaaggagacaagaauaguagcagccuuauuauagacuaucauaauggaaugacagugaaagggcuuuucaaagucccugccauuaacccacuuaugccuacaagucaauaacacaaacuucuauugaaauccaagaaaaaaaaugauacuugggagguugaguugggaggauugcuuuagcccaggaauuugaggccagccugagcaacacugagacucuguaucuuaaaaaaaaaaaaaaaaaaaaaauuaggcccaauccaaggaguugauuguuaaggcagagugguauaauggaauagcagcccuuuuggagucagacuuggguuuagaguccugccaguuucauugaauagcuguaugaagcucuaauaaguuccuuagucuuucugugaauugguucccucaucaggaaaauggggauaauacuacuugccuugcaggauuguguuggggauuagauauaacauaugugaguauguaccauaguguuucacacauaguagucacuuaguuaauggugguaguaucagcuauuguuauuacugaucugguguauacuguccacuuaguaacucauaauuuauuuauugguuuuuuuuuuuuuuugagaucgaaucucacucuguugcccaggcuggagugcaauggcaugaucucagcucacugcagccucugccuccuggguucaagcgguucucgugccucagccuccucaguagcugggacuacaggugugagccaccacgccuggcuaauuuuuguauuuuuagcagagacgggguuucaccauguuggccaggcuggucuugaacuccugaccucaggcauuccaccugccucggccucccauagugcugggauuacaggcaugagccacugcuuggcuguaacucauaauuaaaaaaaaauuuuucccaauauuuuacuaugaaaguauucagaaguacagaaaacuuguaauaaacagugaauauauacauauauaucaucuagagucuauaaugguuauuuauuauauuuguuuaacugcauauccaucuauccauucuuguaucugucauuaauccaucuuaauuuccuuuuuuuuuuuuuuuuuuuuugagacagagucuuguucugucacccaggcuggaguguaguggcguggucuuggcucacugcaucaucugccuccuggguucaagugauucuccugccucagccucccgaguagcugggauuacaggcaugcgccaccacgcccagcuaauuuuuguauuuuuaguagagacaggguuucacuguguuggccaggauggucuugaucucuugaccucuuggccucccaaagugcugggguuauaggcgugagccacugugcccggccaauccaucuuaauuuuuugccucacuucaagguauguuguagacaucaguauacuucugaauauuucugcuuauauaacauuaacuagaauucaguauuuauacuuuuuggggaaggguguaaaauuuauauacaauggaaugcacaaguucaaggguaccauuuuaugaguuuugacaauugcauacacuuguauaacuuaaaccuuuaucaaaacagaacauuacgucucccagaaaaaguuuucaugccucuugguucuucaaccuuagacaaagacaaccacuguugugauuuuuuuuuuuucuuuuuuucuuuuuuugagacggagucucacucuguugcccaggcuggagugcaguggcgugaucucggcucacuguaagcuccgccucccagguucacgccauucucccaccuuagccucccgaguagcugggacuacaggcgcuugccaccaagcccggcuaauuuuguuuuuguauuuuuaguagagacgggguuucacuguauuagccaggauggucucagucuccugaccucgugauccaccugccacagccucuugaagugcugggauuacaggcgugagccaccgugccugguugugauuuuguuucuaucauaguuuugccuauuucauacaaguggaacacauaaauggaaacauguaguauguacucauuugagcaaggcaucuuucauuuagcauauuuuuuuuuuugucgagacgggguguuguuuuguugcccaggcuggugugcaguggcacuaucauagcuuacugcauccuugaccucccaggcucaagcgauccuccugccucagccucccaaguagcugggacuacaggugcaugccaccaugcuuggcuaauuuuuaaaauuuucuguagagacagggucucacuuuguuguccaggcuggucucgaacuccgggguucaagugauccucccaccuuagccucccaaagugcuaggauuacaggugugagccaccacaccuggccagcauauuuuugagguuccucuguguugcuauaugcaucaauaauuuguuccuuuuuauuguugguacuauucugucuucugacuauaucuuuguuuguccauucuccuauugauaaacaccuggguucuuuucaguuuuuggcuauuuugaauaaacuucuaugaacauuuuuguaccaaucuugugaacauuuguuuucaguucucagauaaacaucuagagagauucaguggaauugcugaaucauguacauagcuauauguuuaguuuuauaagaaacugcuagaccuuuuuccaaaauauuauuaauauaugagaguucuauuuacuuuacauuuuuacuaacauuugcguugucaguguuuuaguuauuuugguggauauuuaaugaucucucacugugauuuuuauuuugcauuucccugaugacuaaugauguugaacauuuuuaugugcuuuuuggccauuugugcaucuuccuuugugaaauguuuguugagauuuuucgagcauuuaaaaaaauggaguugucuuuauuauugaguugcaggaguucuuuguuuguccuacauaucagaccuuugucauguguauguuucguaaguaaucucucccagucuguggcuuucuugcucaucuuguuaacaaaaucuuuaggcaagcagagguuuuaaauauugaugaaauaaaauuuggcauuuuuuuuuuaaugguuauuguauucugugaccuuucuaaaaaaccuuucuucuuuaaaaaaaaaaaauuaacuaauuugggccaggugcgguggcucacaccuguaaucccagcacuuugggaggccgaggugggcggaucaccugaggucaggaguucgagaccagcccgaccaacauggagaaaccccgucucuacuaaaaauacagaauuagcugggcauggugguggcgcaugccuauaaucucagcuacucgggaggcugaggcaggagaaucgcuugaacccaggaggcggaguuuguggugagcugagaucacaccacugaacuccagccugggcaacgagagcgaaacucagucucaaaaaaaauaaaauuaaaauuaaaauuaaaaaaaauuuuuuguuuuuuuagagucaaggucuugcuauguugaccaggcuggucuugaacuccuguccucaaguaguccucccaccucagccucccagagugcuggacuuacguuagcuacggugccuggccagaaaccuuuauuuauccccaagucauaaggauuuucuccuauguuccauuuuggaaguuuuuuagauuuaguuuuuacauuuaguucugugauccauauugaauuaauagauguguaugauaugagguggggaguucagauugauuuuuauccuuuuggauaucaguuauuuuagcaacauuuguggaaaagaucuucccccaugagauugcuuuggcacuuuucuugaaaaucaagugacauauaggugugaauucauuucugggcuuucuuuuucugucccauugauuuccuugucuguccuuagccagucucaccuuguuuugauuacuguagcuuuguaguaaguuuugaagucagguaauguguaaguccuccagcuuuggucauuuuauuuuaagauugcuuugaguauucuguguucuuugcauuuuauuauaaauuuuagagucaaguuauuaauuucuacggaaaagcccaauggaauuauguugcuuuuuuuuuuuuuuuuuugagacggagucuugcucugcugccaggcuggggugcaguggcgugaucuuggcucucugcaaccucugccuccuggguucaagcuauucuccugucucagccucccuaacagcugggacuacaggcacacgccaccacacccagcuaauucuuguauuuuuaguagagaugggguuucaccauguuggccaggauggucucgaucuccugacuucaugauccacccgccuuggccucccaaaguuuugggauuauagguaugagccacugcacccggccuggaauuacuauuggaauuauauugacucuguagaucaguucguggagaaucgacaucuuaacaauauugagucuucuguuacauggacauugcagaucucuguuuuucuuguuguuuguuugcuugcuuguuuguuuguguguuugagacggaguuuugcuauugcugcccaggcuggagugcaacggugugaucucaggucacuacaaccuccgccucccauguucaagcaauucuccugcuccagccuccuaaguagcugggacuacaggcaccugccaccaccguggcuaauuuuuuguauuuuuaauagagacgggguuucaccauguugggcaggcuggucucgaacuccugaccucaggugauccacccgccuccucccaaagugcugggauuacaggcaugagcuacugcaccuggcccaugucuccauuuuuaaggucuucuuuaguuuuucucaacaguguuuucauaauuuuuagugugugcaucuuacaugucuuguuaaucuauuucuaauauuuggggguuuucuggaugcuauuuagaauuucacuguccaguuguuugcugcuaauauauagacauauaacugaauuuuguauauugaucuuguauucuguaacuuucuaauuagucuagauuuuuuuuuaauuugcauauuuaggauuuucuauguaaacaaucuugugauauucagguagagacaguuuuacuuccuuuucaaucuauucaccuuuuuuuuuuuuuuccuugccuuagugcacuagcugggaauuccauaaaauguugaauagaaguagugggaguggauaucuuuguuuucuucuugauuuaagagcaaacgugcucacuguuuuacuaaagaugcccuuuauagguugaggcaguuuccuuauguucuaauuuggguuaaaaaauuuuuuuauuguuuuuuuuuagagacagggucuugcuuuaacccagguuggagugagguggcacaaucauggcucacugcagccuugaccuccugggcucgagugauuuucccaccucagccuuacgaguagcugggaauauagguaugugccaccacaccuggcuaauuuuuuuuuuaccuuuuuguagagacaggauaucacuauguugacuaggcuuaucuugaacucuuggccucaggcaguccuccugcuucagccucacaaaguuuugggauuacaagugugagccacugcacucagccuauguuccaauuuggcugaggagcuaagaauuuuuaucaugaguagguguugaauuuuuucuuuuuauuauuauuuuuuauuuuugucauuuguuuugauuuuuuuuguggguguugaauuuuuuucaaaugcuuuuucaucaucuccauaauggucauauuguuuuucuccuuuauucuuuuaauauggugaguuacauggacugauuuuugaauguuagacuaacuuuacguuucagggguaaaacccucuugaugacauuguauuaucuccuuuauguugcuggguugauaugcuaauauuuugauaaggaucuuugcaauccuguucuucaugaggguguaagugauaauuuacaugggauauauaauuugaccuuaaauaugcaguucuguauguggaauagucaaauuuuuuaugcuuggugguggcuagcugcuguucacuggaguaaacaagugucugcacagugucccguguuaggaucauggggaauucaaacguaaaucuguucagaauaucuuuaggcaggugaaaccuguggagacaguuauuucaaauacagucacuucuugaaaucauagcuacugggguuguaauuauaaagcaaaugguuaugaguuuugauuuagccacuuguuuaguaguaguccucuggguuuuauccuacugguucugcccuagcuaugguuuauuguugguauguaucacguucugcaggaacaagaugauguaugguuuuauuuacauuauuaauaaaugauacauugugauuaacacuaagauuauaccccaaaaugagcagacagcagugcuuugcauucuuuggauucuuaagauagaaaagccuucuaaaaguuucagugguuccagaagcagugaggguuauauaaaaauaaacaaaauuuuaaaaauacagcauuggugguuuugcuuuuuuugaaagaccaaauuaaucaaaagacagaagagaauguuagauauuuaagaggguuagaauguuuguuuuugguugcuuaucaaauugccauuauuuuucauuaaagaacaguaagccacgugugguggugugcaccuguaguucuaacuacucagaaggcugaggugggaggaucucuugagcucaggaguuugaggcugcagugagcuaugauugugccacugcacuccagcuugggcaacugaacaagacgccaucucuuuaagaaaaacaacaaugcacuaguacuuucagccuuucagaauuaauauauccuuguagaucuuuuuuuguuguguaccccuuuuuuuuuuuuuuuuugagauggagucucacucuguugcacaggcuggagggcaguggcgccaucuuggcucacugcaaccuccuggguucaagcaauucuccugccucagccucccgaguagcugggauuacaggagcacgccaccaugucgggcuaauuuuuguauuuucauuuuguuuuugagacggaguuuugcucuuuugcccaggcuagagugcaauggcauaaucucggcucacugcaguugcugccucccggguucaagugauucuccugccuuagccucccauguagcugagauugcagacauggacuaccaugccuggcuaauuuuuguauuuuuaguagaagcgggguuucaccauguuggccagucuggucuugaauuccugaccugaggugaucugcccgccucagcuucccagagugugugagccacugugcuuggccuaauuuuuguauuuuuaguauagaugggguuucaccacguuggccaggcuggucuugaguuccugaccucaagugauccacccgccuuggccucccaaagugcugggauuacaggugugagccaucacauccggcuaguacccucuuuuuuguaugagcugcuaguagguuuuggauuuacugauacagcucaauaagacuuucaggcuuuauuguuccuagaaaauuuuuuaaaaagugauugacaagaguuaccucagaaguaaacuaaguuggauugugagaaacaagguuuaaaaccuuuuuuuuuuuuuuuuuuuaugcagacaaggucucacugugucacccaggcuggagugcagugaugugaucauggcucgcucacugccgccucaaacuccugggcucaagccauccuuagccucccagaguguugggauuacaagcaugagccaugauugccuggccugaguuugcaaccuuuuugauguucuggagggacacauugcaggaccuugauaaauaaacaguuuugaugauaugagauaauugauaaugaagagauaauauaugauggagguuugaaauaauaaguauugggcuaguaaauuuugagaccaaguuguaauacaaauuuucauuuuuuuuauuuugugucuugucuagguaccuuuaaaauaucuguuauuccuagcauugcuaugcaacucuuucccuguuccaucauaaagaacacuaguuuauaguugaaacaaagggcuuacugcaaggccauacguguccaaagcccagagauagaagaaagaauaaaauucauuugggaauuguuuccuguguaaacauaaaauaugauaauuuugagcaguuucauagaaacaauauaguagcuucuacagauugguuuaaaaauaauuaaacccccugaaucuaguguccaucacacagugcugcagaaugccaccugauggucuccuguuaauaccacuguuagaucauaagcacucaauagggcaagugcaucugcucuauuccuucagucuguguuuugccuucaauggcagcuuugguugugaccuucucuaggagcagcagcucucuuuguauucucucuguaugugauccuagguaccuaguagguauugacaguugucuacuuuuucauuaaaaaacaauguuuuagauaauucauagcaguuugaaaucaaaucugaagaaaccggcauuucuuuuuacaaaacauuuucaguuguuucuuuucuucaugaauacuaguuagguggauuaauuaaaaccauaaacaccuaauuuaauagguaauaaugguaagcuuuuuucuucccaaaucaaacaaagucuuucauacauuuuacugagaauuucuauguucugcaacuccucuuagauuuucucaucuauguuuucuuaacuggagaaauuccucauuuggucuuaucuaauacuaaguagaaauaugugauuauuauuagugauccagugucaguuuuauuuaagccucaagaaugaguaaguccagaccuccugauguucuucacugaccagauaucaaaccagaguguagaacugaaguaauuuguugagauuuuaaagaaucuguguaguguuaauuuuaggguauuucuggcuggguacaggggcucacacauguaaucccagcacuuugggaggccgagguggguggaucacuugaggucaggggcucaagaccagccugugcaacaugaugaaaccccgugucuacuaaaaguacaaaaauuagccacacaugguggcauaugccgguaaucccagcuacucgggagguugaggcacaagaaucaccugaacccgggaagcagagguugcagugagccgagauugugccaugcacuccagccuggguaacagagcuagacucuugucuccaaaaaaaaaaaaaaagaaaagaaaagaaaaaaaggaaaaaggccgggugugguggcucacgccuguaaucccuguacuuuuugagaggccaagguggguggaucacuugaggucaggaguucgagaccagacuggccaacauggugaaaccccaucucuccuaaaaauacaaaaauuagcugggcgugguggugggcaccuguaaucccagcuauccgggaggcugaggcagaagaaucacuuguacccgggaggcagagguugcagugagccgagauaguaccacugcacuucagccugggugacagaguaagacucuugucucaaaaaaaaaaguauuuauuagacauuuucugaauuuuaaucauggagauguaaucacagcccuuuccccucccccuccgcuccccucuucucuuccugacagaaucucgaucugucgcuccucuucucuucucuuuucuuucugacagaaucucgcucugucacccaggcuggagugcaguggcacgaucucagcucacugcaaccucugccucccagguuccagagauuuuccugccucagccuccugaguagcugggauuacaggcacgugccaccacgcccggcuaauuuuuguauuuuuaguagagaugggguuucaccauguuggccaggcugguguccaacuccuggccucaggcggugugcgagccucagccucccaaagugcugggauuacgggugugagccaccaugccuggcccuauuucuguuaaauacacuauuuuuccugguuuucagugucucaccaaaauacugucuguuuucaauuaggguggaauagcccuauucucucaucccugcuaccuccaaaucaggcuaugccaagaggggacccuaaauuagauuagaaaagggggcuaauuguaaguaguagucaugaaugugucugcacauugcuauacauucugacuuuuuaaaauuuagcagcauacauuuagaaaguagcuguguacaaagcacuauucuuaguggacauagggaauucagauauagucccugccuucagaaggacuuaccacucucucauauaagaaaugaacacacacgcaacuaaauggaacacauggaaggcaucacuggggugaggcuggauauggccucuaagugugaaaguggcuucgucucucuccuaggguucugguuuugaacauuggaauugaagggaagaguggcuccaccaagggcuggaguguuaguuaaccuggcacugcuaccagagaacaugccuguguggagaguccugcuauucuuuuucauuaugaacaauuuuaaacauagguggaauaauauagugaccccguuucaauauauucaucccucagauuuaauaauuuuagggcuuugguacauuuucuucaucuaucccauuuuguuuuuucuugcuauuguguuuuaagguaaauuccaaacaucugucauuuuaauccuacauacugucaaguaugcauuuccaaaaauauggccauuuucuugcauaaugcaaaugccaccaugaaucuaaccaaguuaacaguaauuccuuugaugucaucucacagaggaugucauuuuuaagucucauuucaggcuguccuugcuguuuuugguguccucaaggucuuuguggaccugguccuaauuguuaucauggauaggcuuuuuuuuucuggauacuuucucuaaugaaauaaucugauuguguucaaggaguuaacuucacucucaggcagguauucugcaaccaauuuaauuacacuucaguaaaccuguggaaaaccucuuaguuuguauuuagguuuaaaauauaauuagaaggagccacuuuugugacacaguggauagugcauuggacugguagcccauucugauguagucauucaaaaacguguagucaggacguaugaugguguuuaguacucaaggcacaaaaagagcugaccacagcuguguucuuagagcuuuugccuagcauguuaugcuuugacuuuucuuguucuucucugcuucaacuaccuaaccacuugcaauggaauuaauuuacacucccgaaacuacuaagaguacagccuuuucucucuaauacaugugcacgcauagaugcacauguaucccaaaauauucugggaacugggagaacuguucguguuccucucucuguuuccugucuugauuaguggcaucauaucccucuagacaggaaauucuaagguuuuucucuugacuccuauugccaguuggucauauuugcaauagcucuauucacuucauucuaguuuuccugcccuaguuccagaucuuuacuguacaucugaaucauuacaauaacucucaacuagccucuuucucaguugcuuucccugccaguccaucagauccucauuacugcugguuaccauucuaaaauagaaaucuuaucacaucacuccuuugcacacaagccucuuuuagcacucaguugucuacagaaugagauccaaccuucuugguguggcauuuguagugcugugugcgucagccacaauggacuacaugcuauuucugcagcauacuguacacucuuuuuuuuuuuuugagauggagucucgcucuguuaccgaggcuagagugcaguggugcgaucucggcucacugcaagcuccgccuccuggguucacaacauucuccugccucagccucccgaguagcugggacuacaggcgccggccacuacaccuggcuaauuuuuuuuuuuuuuuuguauuuuuaguagagaugggguuucucuguguuagccaggauggucucgaucuccugaccucgugaucugccugccucagccucucaaagugcugggauuacaggcgugagccaccgcaccuggccagcauacuguagucuuauccuucuuugcucuguuuguacacauugccuguuuaucuggaaugcugaugagugguggaggagagauucuagcccaugugcuuucauuuauugugcugaauaaaugaagguucuguggaauugguuguaaggaaguuuuacuugcuucuuuuaguuuuaugagacuauagaucaaaaacauuacugcauguacuuucuaaaguucaguauuccaaaaguuugaugucugaagguuuuuuuuuucuuugaggcagagucucacuccgacaucugagcuggagugcacuggugugcucucgccucacugcaaccucugccucccagguucaagugauucuugugccucagccccucccaaguaacugggauuacaggcaccugucacuaugcccagcuaauuuuuauauacauauauguguguguguguguguguacuaauauauauacauauauuacauauauguguguguauauauauguguguauauauacguauauacauauguguauauguauauauguauacauguguacauauauacauauguauacauguguauauacauauaaauauauauauauauacauauauuuuuuuuuuuuuuuuugagacggagucuugcucugucacccaggcuggcaugcaguggcgugaucuugacucacugcaaccucugccucccagguucaggcaauucuucugcuucagccuccugaguagcugggacuacaggcgcucgccaccacgccuagcugauuuuuguauuuuuaguagagacaggguuuuacuauguuggccaggcugguuucgaacuccugaauuuaugauccacccuccucagccucccaaagugcugggauuacaggcgugagccaccacgcccggccuuuuuguuuuuuuugagacagggucucacucugucacccaggcuggagugcagugaguggugugaucucugcucacugcagccuccaccuccuggguucaagugauucuccugucucagcuucccaaguagcugggauuacaggguaugccaccaugccuggcuaauuuuugcauuuuuaguacagaccagguuucaccauguuggccagucuggucucgaacuccugacaucaagugauccacccgccucggccucccaaaguguugggguuacaggcgugagccacugcaccuggccuaauuuuuauauuuuuaguagagaugggguuucaccauguuggccaggcuggucuuggacuccugaccucaagugacccaucugccucaccucccaaagugcugggaucacaggcgugagcuaccacacccagccugauauauggaguuuugauaguggugccagucaccuuuuugaucacuuuuuccccuuaaauuuccaaauucugcuuuuaacuuuguuguuuguuacccuuuccucauggcagggaagaggaggaagaugcagaaauaaaggaaguagacuucagucagagagagggaaagaaacagcaugauauaagaguuuaucaaauaccagcuguuuugugguuugguaaggaggaaauaacuggaaaaaaaaaaaaaaaaaaacacccaaaaccaagagaggacauuuuuuugaaacaagagucuuuguugcauuaacaucuuagacagucuuuuaaaaaauguagaccuaagggcggggcaugguggcucacaccuguaaucgcaacacuuuggaaggucaggcuggaguuugagaccagccugggcaauauaaugagaccucauuucuacaaaaaauuuaaaaauuagccagguaugguggcacgcgccuguaguccuagcuacuugggaggcugaggugggauugcuugagccugugagguggagauuucagugagcugagauugcgccacugcauucuagccugggugacagaacaaaacucugucuccucuccucgcaaccugccccccuccccccgccaaaaaaaaguaggccuaacaaaggauggaaaucuuuuuacuugucuuaguaacuuaauuuuuuuuguuuuaaugagacauuuugagauuuaccuguuugugucauuuuuaaaaaucuacuacaguauuaaguuacagaauuuucagaaaguuaucauucagaugugauuucaugucuuuuguuuuuguuuguuuuagacaaaagaaguuagaaaaggugauggaagaagaaggccuaaaagaugaggagguaauuaauauuggcaauguuuuccuuaaaacccagcguggcagguuguaucuuguccagugaguuguuagccuugguacacaugagaaggguuuuggcucaauaacagaggaacuugagggguagugugcuuccggauuuggguguuaauucagagggacagauuaauuauuaaguaccuaggagaggaaggcuucucuagaugcaguuauaguaaacuagauuuagaauuccaagagaaagcagggaugaaaucaaauuaaauuuuaaaagagcaaguuguagcauuuuuauagaauucacugaaaagucuccguaggaguagggcaaauuuuugaaauauuuauuuauuuuacuuuuucugggauacauacgugugcugaacaugcagguuuauuacauagguauauaugugccauagugguuugcugcaccuaucaaccugucaucuagguuuuaagcuccgcaugcaugagguauuuguccuaaugcucucccucccuuuccccccaugccccgacaggccccggugugucauguuccugaaaucuuuauuaaggcaaaauauccaucucaaaucagcccuuccacccagugcccacagauacaguaggagaaaauauaguuaacaagggacugugcaaggaacugaaaugguaguggaaaugccuucaaaaauaggacuggcuugcagaacccaggacgguggugaaaaauacccaauacuuguagaaauaacagaaaguuagaguauacaguguuuaagccagagggaaagauaagaacacauuuuuaauuuauauuaaacaggauaaaggaaaauauuguugauuauuuaucccucccuucaccaaaaauguuaggauaguggauugcugaaguagguuagucagaguucccagaggaggcacccaucuguucaguguggcuuggauguugugucuaaaugccaggaaagggagaagugaccucuuaaggauccuucuggggugauuucauaugugaaaagauuauccuuaguccacuuggaccuguuuucuagcuggguaagucacaaacaugacuuguuacagaguuucagaauuucaguuccuucccgucuccucccuuuuuuauuuaaauauuagaaacgacuccggagaucagcacaugcucggaaggaaacagaguuucuucguuugaagagaacaagacuuggauuggaagauuuugaguccuuaaaaguaauaggcagaggagcauuuggugagguaaaaaucacagcuacuugucaaguagaaaaauauugcaaaacuucaaagcuucuaacauaccauuaagucaugauuguugauauaacaaauauauggaauuaaaugagucaggcaugccagccccacauccuaauugcuuugucugucugcuuucucuuuuucuucucuccgcagucccagaucucuguucucuguuuugccagagaugguguugguguuuaaauauugacuuagggggagaguugaaagguagaaggaaaucaacauuuauuauuuacaggcugcuuuuuucccauaaucaggacaguaacccauuuuauagauggugaaauuaagacucuaaagguauauauaaugucucuuguuaucacacagccauugaguacugggaccaaaaguugggcucuacuuccugaacucaaagagcuugcuuuucccaguacugcacugccucucgagaaggaaacuaauaguguaucuccacccuuuauuucuccccaccagauugauacagcucuaaaaagaugacccuaggagggaggauuuacagaaaggaguuauauagguagugguggagaguugaaagcauuugcgacuuuguccccgcaauucuuggaaaugauccugcuugggcacaagagcaaucuguuggggagagcuugaaagagcccaugcaaggucauuccuguuaaugaaaaaugcccaaacuggaugaccuacugacgcaauaauugcaaguauaaaaggagcaguauauuauuaaaaccugguaccccggggccaggcacgguggcucacuccuguaaucucagcacuuugggaggccaaggcgggcggaucacaaggucaggaguucgagaccagccugacaacauggugaaaccuugucucuacuaaaaauagaaaaauuagccgggugugguggcacgugccuguaaucccagcuacucaggaggcugaggcaggagaauugcuugaacccaggaggcagagguugcagugagccgagauugcaccauugcacuccagccugggugacagagcaagacuccaucucaaaaaaaaaaaaaaacaaaaaaccugguaccccggggaaaugugaauaguauucagaggcacaggugauagauugaucccucaguguucagaauuccuauuggcuucuugaaagagggaaaaguauaguaccaccucugaaagagcuuucuguuuggcaaggaaggguugugguacucaauuaggaaaaacaugaagaaagguucagggagaagaaaaccuacuuauuuugggagaagaggggaggacaugcaggaacuugcagugaaauuuuucuuuugguuguaaauuuucuucauaaaauuaucuguuuucuuuaagaacauuggaaaacauaaaagagaaggaaaacuacauaaaacacaauuucccuaauuacacauuuugaauuuucuucuucuucuuuuuuuuuuuuuuuuuuuuuuugagacagagucuugcucuguugcccaggcuggagugcaauggcuugaucuuggcucacugcaaccuccgccucucggguucaagugauucuacugccuuagccucccgaauaacugggauuacaggcaccugccaccacacccagcuaauuuucguauuuuuaguagacgggguuucaccagguuggccaggcuggucucgaacuccuggaccucaggugauccaccugcuucggccuuccaaagugcugagauuauaggugugagcuaccgcgccuggccugaauuuuuuguuuuucuuuccagacguuuuuccuaagcaugaaguuuuacuuuguuauuauuauuaugauuaagugacaagguuucacuguguugcccaggcuggagugcaguggcuguuuacaggcacgaucucacuacugauuggcaugggaguuuugaccugcuccauuucugaacugggccuguuugcccuuccuuaggcaaccuggugggcccccccucugccacccugcuccugggaggucaccauauuaugcugaacuuaguucagacaccugaucagcauaaugcaccauagcucauaacuccugagcucaagcgauccuccuaccucaaccucccaaauagcugggacuacagguauacaccaccaugcacagcuacuuuuguuuuaauuaaacaucauuguaaucauuuacuuagauuuucugagcugacuggaugacaugugucagagguguaacgaguccuuaaauuugaaauugaagguuuuaaauuagauuggcuuguucaacuaaggaaccaaagcuguucagauguagagguauuugaggauguuuccagcaucgacuuuacuguguguaauguauucauuuuggaacacugaaaagcauuuucuucugcuuuguuauuacuaguugcucauguuaaaauuguaauacuuuuucaguuaauuauugcauccuauaacacaugaaagcauuagguugguaguacgaguuuuugacuuggcauuucuuuuauaacuuuuuagguacggcuuguucagaagaaagauacgggacauguguaugcaaugaaaauacuccguaaagcagauaugcuugaaaaagagcagguaaagcacaguuguagcagugcuuuuagcuuauuaauuuuugucuccuaaaacuuuucuuuuuguuuaauugaaauauauauuuuuauuacaguuuucuuuagcucugucauguaugacuauauauauaauacuaccuuuuucccccuacaaagaagcaguucauauuuaaaaucacaaauaaugccuguagguuauaugcaaucuuuuaaaaauugaaaaucuguuccaaaagcagcucuuacuugugucuuccaauugaucacaagauguccuuauugugagagccuuuuuuuuuugaggucguacguggugugguaguguguuucuuaccaaaugcugagaaauagaaauuguauauauaucucauaacuaaggacuaggaauuagaauuuggaauuuauaaucuaaaaugugucuuuauaugcuucauucuguuuaccuaaaccaaaguugagucuucuagguagcucaucgguaccugaaaaagaccagccuucuaauuucugaaugaauuugaaaaauacaaugcaaaugacagaacaaugcaaauucuccuuuaaugauaaaggauacuuucuaaaaccaaaaccugguuugcaaaucaauuuauaaagugccuuaugcaaaauaaauaagguuuuaaauauuggaaaguauauuuuaaaaagcaagaauagacuuucuauaaaucuaguuuaauguagcugguugcuuaagaaaagauugcagugggugaugaccgcaaauguccuguaaaagauuugauguuauaggaacauggagacccugugacaaggagaacuccuaauuuagggccaaagaggggggauggagauuggccccacauccaauccuuucuaccucuugagaggagauauaaucacuggucuucccugucuucauuuaaaugccaccccaaaauuuggaauuuuuauuuucucucaaauuuucauguguuaccgagaagcuuuagacucccaggaauuucaguugggaguaucaaauaccugggcgguaagucuugagacacuauaguuuaugcuaacgccaaccuuuuucaaaauucauaguaggccggccuacuuacauacuaucuacaaauuagugugugguauggguguguaggcacugaaaaaguuucaguuaaucuugagaaggaaaauauaaagcuucugcauuaauuaguauguuugcaucucaugaguaaguuuuguuuuugcaagguauguuuccuacaguuuuaaccaaggcuuaagaccucuuuuuauuaaauauuaacugucagaguaauacugcaaaacaaaguacauaugauuuucaguuaguaauuuuauguauaccaggugccccgcaugguuucuaacagaggaugauccagacauaauguguaaaaagccuuuucgcaaauauugugccuucaaaaucacuuucuaaaacuuuccuaaaugaaaguaaagaaacuauuagaauuaacauuuuaaaugaugcauuaacuuauggauuaaaugguacauuaacuuaaauuguuuagcucaccuuagcugagaacucaacuccucaacuuaacagaucucauuaugagccaguuaaagucucuggccacagacucuaccuggcuuagccaucuugaagaagcaugcauugguuuugugcuagauaaaagauggaaguagaccagugcaaauucaucaccauuuugggguagggcugacaaaguagagguacagaggcaaaauuguuuuuuuguuugcuuuuacuaaauaaacuggguaggaauuaaagcuacccacugagaguucagguuauuuuucugcuccacgugguggaaauuuuugcuaccuggaaaaauuuaaaggguaagacaugacaucuaacuagcuucugauguuucucuuccagugcaaaaggaaaaccuucaguugugaugccaguauacaguuauugaugggacaaaaaacuggcuuuuauuucugcuuucuuagggcacaggauagcaacuagcaccccccaccuuauuaaauauuuauggaauaggggaaagagaaccuuuuuguauaaauugcaccucagacucuucccucccuuaaucuauauucagccaacuccacuuucaaaccaugagguuucuugcuacuguuucagccucaagagaaaggcaaggugugcucaugguagcuuuccccuugacaaacaggaaauguuaugggcaccauuguguccuccagggugagugacaagugguaauuguagugccucuccuuuucucuggcucccugcaguagguagggagcuuaaugggagccaggggagacaggcagaugaaggcugccuucuacuguauuaaugucuuguagugacuggguccuagccauggcuguggggcagcaagcaauguuacuguuucccaaaagcuuugcuucuguauuaaggucaaguaaaggcagaugcuuuacuugguuucauuguguuucauagcacuguuucuuuucacccuuauuguccauuuuuucccaccccaauaccauaaguacagauguaaagauguagguuuucuguacaguugcagcuuuuaaaaaaauuccccaaagaaugauuuuaguagauacugaaaacucaaauacauaaagucaaaugccucugggccuccaagaguuagcauagaagccugaagcaaguuagauauaagaccaggggagaggguguugaaauggaagaguaauggaagagugccuugucucccuaaagacaugucaauaaaacaagcaucauaucaaacauuguauuaaaccaaacaacagccauggacuaaauuugccaacagccauggacuaaauuugccaauuugugaaccuugguacauguuuuacuucagaacauguuguaaaaagucaagaccuguagcauauguuaagaccaaaaccacuauucagggauuggacugagucuuaauaaauuuagaucugaaucaacccaauuuagaccuugugacacuuaaaaaagaggggaggggccaggcaugguggcacacaccuauaauccuagcuacuuaggaggcugaggcaggaggaucacuuuagaccaggaguuugaggcuucagugagcuaugaucacgccacugcacucuagccggagugacagagcgagaccccaucuuguuuuaaaaaaagugugugugggggggauuugauaauaugcagugauguuugauuacuguucugcauuuaaaguaaauaagguaaauuugauaauaaagcauugcuuuaacaaaauaauuccgguucucugaaacuuucuacaacuugguccuuuauagguauuucaguaaaaguauaaaauuggaaaugucauuaauuugaaucuacaacuuuucauagguguucuuguauuucaauucaguaaggauugauugagcacauagcagugaacuaaaugcugugguaucauagcauucuagaauuugucagugagcucacuguuguugcagauacuagugcagacccgaggaagaacuuggaagagagucucacuuuggggacuuauuuuuaucauaaaagauuauuagacaaaacucuaugcaaaagaguaguaauuuuaacuaaucagagauucaguuuauagcaguguuaaaguugcuauuugcauuaaagccauucauuuugccauuuuuuaaagccuuucaucacucaaguuuucaucacugaauaccuugaagucaaauguugucaauuuugaguuaguagguuugccuaagcagaaauuggaucuuuuauaucaucacgauuaaauacucaaaacaguauuuaagcacaguauuuaaauuguuuaagcaaauauacaaucuaauaaagcagagcaagcuuugucauuaaucaaaugcauauaccuccagguuggccacauucgugcggagcgugacauucuaguggaggcagacaguuuguggguugugaaaauguucuauaguuuucaggauaagcuaaaccucuaccuaaucauggaguuccugccuggagguaauuacuugacgaugaaaggucauuuuuucuuuuuguucugugguuucuuucucucacaucacgauuaacccuccuuucuacuuuuaaaugugcucacaaaguugcuuucuauauccuuuuuuaggucuauaaaggaagucaguaaccugucuugugcuggggugccuuucuacaaucuuaguaccauaaaaguaaccuguuaauucauuuacaugauuucagauggacauuucuuucuuuucuucuucuuuuuaaaauauauaggaauaaauuagggugcucugccugcucuccugucaaugggaaucauauaugaucaauaacccaagugacaacauugaagcuauaacauccuuugcuccaaauuuuuguuucuuuuuguauaacauauuaauaaggagugaauuuuuuguuacccauauuaguagccagaaaaaauuucucauuucugaaauuuuaaguuuuauguaacucagcaugagcaucuccuaagacagcuccaaaguaaacccagaacagaacaugccaucuguucugaggaaagcagucuguuugucagugagcagaugaacucugagcaaacucuggugggaaaaaaaaagagagagaacuuuuuucuuuuuuguuccuauaauuguggcauaauauuuugauuuugugacaacccuuagauuuagggucaucaauacuuuuuaauaaagaaacacauuuaauaaaaaauaaacaguugauuaauguuagaaaagagucugguagaaugaggagaaacuuuuuuaacauuuagaugcuaguucuuaaauaagaguaagagccaacuugguuaccagcuccuaacguguccucaagccucaaccuguaccaucuuccguagcuucucaugucuccuggacccugcccuuugcacuugguggagcuggccugcagagccauagagcaucuggccugagcucuccaaucaucugggcaaacuugcacaggcgaggccccauugacugcucuccugagccacagaacuaaggccguauagcuaccuuacugggguagcagcccaagugcacugucuccaugugucuggugggucuccagauugaagggcugccaggagugauuaggaaaucauauuuuuuaaguauuggacugaaaaagagcacuuuaauaaaugguuuaauuuuugccugagggaaaaauagcuacuuuucuccaauaauacaaaacauaauguucuaaaugaaaugaaacugaaaaagcagcaugaugcucuguuaaaaucagagguuucuuucucuuuuccuuguuuucuaacauaagugacuuuaugugaggucuaaacugaaucuuuacuguuucucuuaguuuuaaacuccuuauacauauuuucuuugcauuucucacuguugaguuaggaccugaaucuuuuucugccauuuuauguugcugguauuagaaaugaugaaauuuugacuuugcagaaaacuaacgagguuaccuuuuaacugcuagaauacugauacuguguuuuaaaaguuacauaaaggguacuaguguccauuuaaauaccuauaauaacgcacuagagaaaaaaaagcacugaccuugagagguguucauuguacucuuccaggaggcaguuauugcacauucuaguguauagcauuuucaguucauuuuuagcuuuuguugacuaaugcuuugcuacccaaguccuuccuuuuuauuuguuuguguucugugaauagaaguuggaaagcuuguuuucagccugcccgaguguuuacauuuuuauuuggcauuucagccucucuauaacaauacauagauuguauguggaagugccauuuaguuacagaugcagaaaagcuugcagauacuuguucaggcaaagugaaaaguaaaguagcauuuuaccccgaguccaaaaaauuauccuaagcaaauacaguuguuuuuuaaagugugggagaaauuuucuuuuucucucaaaaguaaaauagaaaucacagcuuaguggucaaccuuagcuagcuuaggugugaaaaucccauuucuucccauguuggccaugugggucuaucucuggcacacagaagaggucuguuuagccgccuuauuuuggcagauagggaagacauaucugaaaauugguacucacucguauguugugugugugugugugugugugugugugugugugugugguggcuuuguaucuucuuguuuccaggggacaugaugaccuuguugaugaaaaaagacacucugacagaagaggagacucaguuuuauauagcagaaacaguauuagccauagacucuauucaccaacuuggauucauccacagagacaucaaaccagacaaccuucuuuuggacagcaagguauugggggggcauuggcaugaacuaugcacguuuacugaucugagcagccucugcuuuaacaccugcaccccuguggucaucccagugggcgagcugugaccugccuugucaugauuuuccuuuuuuuuuuaaacagguaaguuugcugucacuuccuuucucugaaaggcuaugguucuguaauuugguugaacauuucucuuaaaaauaaaggaaacuugaaaauaagagcaaaauugauguagagggcaauuuuguaauaaagccaaagauagucaccuucucuuagcauauaauuaacuguguuacuaauacaucaccuaucuagagcccuucuguugggcaaccucaucaguuaaugaggaacccagccaagaagcaggaaaugcaguaacaacaagaaccuguaacaaaguccagguuccaaaucaugcucucugcuuaaagaagaguccugcccagccucuuuuuuuuuuuuuuuuuuuugagaugaagucucacccuguuugcccaggcuggagugcaguggcgcgaucuuagcucacugcaaccuccgccuccuggguucaagcgauucucauugccucagccucccaaguagcugggauuacaggcaugcaccaccacgccccugcccagccucuuaaauggccuguuuauuuuuauuuuuagacaugcagauaagcguaguugccuaguuccuaaacuuacagcaaauuagaagauaaucccugugcugccaacuaacuugcuagauaacccuuggcaaaucucuuuaccaccuggaucucacuguucuuauccguaaagugaaaauacugaucuaggaaaccccuaaaaucccguucaccucuaaaacucuagaauguuguuuucuguuaagcagacuuguugucuugacugaauuuuucuuguaaggugaaaaguaaauuuauuuucuaggguauuuuucuucuuugaagucuuuuggugacuuuuuugcuuugcuguccuugaaaaaccugaaguuguuuuuuuuuuuuugagacggucucauucugucauccagguugaagugcaguggcacaguuauagcucacugcaaucuaauucuuggguucaagggauccucuugccucagccuccugaguaguugggacuauaggugcauaccacuguaccuuuuuuuuuuuuuuuuuuugagacggagucucgcucugucgcccaggcuggagugcacuagggcagucucggcucacugcaagcucugccucccggguucacaccauucuccugccucagccucucgaguagcugggacuacaggcgcccgccaccacacccagcuaauuuuuuguauuuuuaguagagacgggguuucacgguguuagccaugauggucucgaucuccugaccuugugaucugcccgccuuggccucccaaagugcugggauuacaggcgugagccaccaagccuggccuuuuuuuuuuuuuuuuuuuuuuuuuaauuuuuaguagagaugaggucucgcuuugcugcccaggcuggucucaaacugccugguuuaagugauccucccaccucagccucucaaaguccugggauuacaagugugagccaccaccugcuuuuuucuucauuauaaugugcagaaguggaguagaauaguggacaucaaaggcuagagaguguagcagagacggggauaugggaagagccugguuaaaaaaaaggccggggccgggcaugguggcuuacgccuguaauaaucccagcacuuugggaggccgaggcaggcggaucacgaggucaggagaucgagaccauccuggccaacauggugaaaccccaucucuacuaaaaauacaaaaaucagcugggcgugguggagugugccuguagucccaccuacuugagaggcugaggcaggagaaucacuugaacccgggagguggagguugcagugagcugagaucaugccacugugcucuagccuggugacagagcgagacuccuucucaaaaaaaaaaaaaaaaggccagacgcaguggcucacaccuguaaucccagcacuuugggaggccaagguggguggaucacgaggucaggagcucaagaccagccuggccaacaugauaaaaccuugucucuacuaaaaauacaaaaauuagcuggguguagugaugggcaccuguaaucccagcuaccugggagguggaggcaggagaaucacuugaacccaggaggcggagguugcagugagcugagaucguaccacugcacuuuagccugggggacagagcaagacuccaucuaaaaaauaauaauaauaaugcauaaacaugguagaaaauuugaacauuacagacaguauuaaagaagaaaaauuacgcuggccaggcgcgguggcccacgucuguaaucccagcucuuugguaggccaaggcagguggauuaccugaggucaagaguuggagaccagcuuggacaacauggugaaaccccauuucuacuaaaaauaaaaaauuagcugggugugguggcacgugccuguaaucccagcuacucgggaggcugaggcaggagaaucagcuugaaccugggaggcggagguugcagugagccaagaucgugccacugcacuccagccuggccaacagagcgagacuccaucucaaaaaaaaaagaagaaagauuaccuauaaucuaaucacugaaagauaaccauuuuguuguaaucacuuugaugccuuucuguuugugucaaucauuuauauaaaguuggcauccuaaaaguaaauagcuuuguauucuguguaaacauuaaaauauuaaugcuagauauuuuccugugucauuaaugucagauauauguuuaauaaagcacuggcccuaccuugugugauucaaaguucagaugcccugguuggugccccagguagcuuagugcuggcuucuuuguccccuguagucuauguucagauccagcaaccauauuaaagaacuugaggauucggucuaacugaagaggaaugggggauccuguuaggugcagguuugcccuuuauauuaugcuagcucacacuuguagcaaaauguucucauaagcagguugauuuguguucagccacauagauuauaguccuaaaaauguaggaguuuugaguuccuguugcauauucagaauagcuauagaauucccugaaaggcuaggcuugaauagcauuugcuccaggaacugcuuuuaaaaaguuuuacuuucuuucuuucuugcuuuuuuuguuuguuuguuuuugagguggagucucacucugucacccaggcuggagugcagugaugugaucuuggcucacugugacuucugccucccaguuucaagcaauucuccugccucagccucccaaguaggugggauuacaggcgugcaccaccauguccagcuaauuuuuguauuuuuaguagagaugggguuucacccuguuggccagacuggucuugaacuccugaccucaggugauccaccugccucggccucccaaaguguugggauuacaggcgugagccacugugcccagccaaaaacaguuuuucuuaguccuuucuuagaguuguccagguaagauauguaaucaugagaacuauaaacuuccuuggcuuguagaguaaguuacuugcaaaucugcaaaaaaagauacugaggccaggcgugguggcucacgccuguaaucccagcuuuuugggaggccgagguggguggaucaugaggucaggaguucaagaccagccuggccaaggugguaaaacccugucucuacuaaaaacacaaaaaaauuagccagaugugguggcgggcaccuguaaucccagcuacucagguggcugaggcagagaauuucuugaacccgggaggcagagguugcagugagccaagauggcgccacugcacuucagccuggguaacagagcgagacucugucucagaaagaaaaagaagaaaaaaaaaaaagauacugaguuuaauaggcucaaagcugucccuguuuggcaguuuaccuugcuguguacauauguacauacacacauccaaaccuaauuggauuucuuuuaaaacaaaacauaauaaaauuugacccaucugagcagggcuccuguagccuuguauuuuggaaaauuuguauguuuaagccugaugauguccuugagaaaggugguauucuggaaagaccacagacauugaagucauuugggcucaaauuuuggccacaccacuucugauuguguaacccugagcaagguagaucucugagcaucaggauucccucuuacauuuuugauuucaacucuccaucuuaaaauuuugccacccuaagacaccuacuuuuuccuuagggcuaguuauaugccagauacuguguugggagucuuacaugcauuaaugcccauuccugccagaaagauaucuguacucucauuuuccagaugagauaagauggcaggguaaaguaauccuggucugggaggaagagcaugggcugauuucugcuuuugguuccgccauuuuaacggcaagccauuuaacagcucugagucugugaugugugguuuaggaguuuuaaaugagacaacacaaagcauugaucaaggugccugacucauagaagguguguguuuuccuuuaugaaaauuauaaaguuaagagauuuaugauuggaauacagcauggucauaauggcagcgguggccugucuggagccucugcugggaagaugccagcugcagugggggaggugcggucagggcugugugcuccauggagcuggcaggagcugggaacaagcgggagcccugcccucccaggcacaguugcaguugcccaaccacagcugcagaccugggcaucccagaagcccaugagcuuggaaguaccugcuccugcugccugacuucucugugcuccugguguccacuccaauuucagagcaaaguugaggccgagccuggguucuacugagaccuggucaggugugcgcacacuuggggcggugcugacacacuagcccccugcagccucagcucccucuggacuuugggugccaagaagcaugagagggaggccaagcaggggaggagagcaccugggugcaggucuguagaugccccuuugcaccaacagccugggugcuguggacaaaaugauugauggcuauaagaggcagagaggcuccuggguggaaaggggugggucccuggcgaagccccaccuucaagccagggauggccugaagccugagggccaagcugucaguucgggcuggagucuguggcccagaguaagaacuugcggugguuuuuccgggccugccuguggccaccuguggaccaaucagcacguacuuucucucuuuugaaacccauacaaacccuggacucacacucuggcagauggucagacgaccugcugcagaaaggagcuaucuacuccgggucuccuaagggcuacagacuugaugggugccagguccaaacugcagacugcgaccgagcgauagaugaaaaaaauggacuccgacacagauauccagugaaagagcgggcuaggggaguggacugccuacagaaagaguuguagcagccucggcccugacaagcuggugcugcgggcaacuauuuaguacagauuuaaugacaaaggccuugagucauuguggguaauuaacauggucaucacccccccacccccaccucaucuccggagagagcaguccugcgccucgauuuauuaaaguccagguuccgaggccuaaguaaacuaacuuaucuacaucaguuucuuuacauccccuuguuaucuaaccuaagcuuucaggcaccggauaagagaaucuggcugcuuucggccaaauccuuuucugaagcuuuuguaaaacuucccagccuucuaagaagguuugcuucuuucuacaauuuuucucaccacccuuaccgaaccccggcagaugggaugaccugccugcgucugggagguacccacucugggucuuuucugcacugagggcugcacagaugucaggaugaccugcuugcggaaaggagcaacccacuuugggucuccugagagcuguacugucgcucaguaaagcuccucuucaccuuguucaugcuccaguuguccguauaccucauuguuccugaaugcaggacaagaaccugggaccugucaaaugguggggcugaaagagcgguaacacaaacagggcugaaauaugucucccuugcucgccguguugcaggcaacaagaaggagagaagagcggcggcccuuccaggagcccagacuuaggggcuuccugagccagugcugugacacccccuuuagggcucugcgguuucuggcaucuccaagcuuccaggugccacugcauuccccucguccagaugcaggugcccacagcagaagccgcuugcagugcaucucauccagcugcaggcuugcauggagccagcaacuaugcuggcaccuggagcuaccugcucugccuggcugugugcaguggccaccggugugccuggcugugugcaguggcuggaccccgcacucacucacacacgccuugccacucugugcuuuucuugcccuuggcaggcuugggauccgcgcugguagcacaagccugccaggcugagugggcggaaugagcccagcggaccugagcaaaacucggguaaaggcaucaaugaccacagaggcuucuggcuagaagcccaaggaucucauggcaauagcauuuaucaaggacuauccaauaauauuuauucccuuugucuuugaaacaguuuacuccuggaauuuauuccaauguuauaagaggaggaaaagcuauaugaacaauuuugaaaagauuuacucuucauuuaacaaccauuuauuaaggucauccugaaucaugcccgguuaggucugggaauacagacucugucagaggggaccugauaauccauguuauaugagagcuaagaauugaaaauggaaugcacauccaguauuagggggaugguaagguaaacaaugaagucccaaguaaacugaauauuauguagacuuuuaaagugguaauuuuggccaggugugguggcgcaugccuauaaucucagaacuuugggaggcugggaugggaggaucacuugaccucaggaguuugagaccagccugggaaacacagggaaaccuuguaucuccaaaaaauaaaaaaaaauuagucggacgugguggcacacaacugaggucccagcuacucaggaagcugaguugggaggauugcuugaaccugggaggucgaggcugcagugagccaugaucacgccauuguacuccaguuugggugacacagcaagaccaugucucaaaaaaaaaaaaaaaaaaaaauucugaauaccauauagaaacagaggaauauuugaguacaagaaguaguaaaauugucucuagaugcuauggaggggucagcuauguuuaaaaaucaguauuuggauaaaaccaaagaugauaugcagaaaugaaaauaguuuuauuaguauaauaggauuugggauuaaaaaauuuaucugcaauuacaugauuuuuccuaucauaaaagaaggagcaguguacuuuggcuguagagcuauaauggaugcuggaaggagcagaacguaauguucuguucuaccuccaagaauacucauccaucuaucaccuuguuucuuccccauagggccaugugaaacuuucugacuuuggucuuugcacaggacugaaaaaagcacauaggacagaauuuuauaggaaucugaaccacagccuccccagugauuucaguaagugguaacaauuacguuagccuuuucguucuaacugggccuagaagagcuguuucccuuguaaccaaauuagaacagauaggagauucucacacuuugaguauguagagaauaaaaauaccuucccagguuugccugugauuuguguugucuggugaggcaagaugaaugaguggguaccaagugugugaaggcagagguugaaaggggucuuuagaggucuacugggaaggucacuggggaugaguaugggacaagcaagcagaaguaguagaggaaaaacuccugggaacaguucugggcuagauuuguccugggcuagauuuguccuucaugacagaaagaaguuuaucuuuaugacagucacuuccauuugagcacuaugaaaucguugacaacuauguaguaaaauuucaguucauccuagaaaagcauaugucaaaucauguaucauaaauucagaugucccugaucauauaaguuacuacuacuuggaaaauugaugguaauuuugagaaauugugacuguuuuagguccacguuaggaccucaauucuaguugagacugaauucccuguaauucugauuaaguccuguacuguauccucugccacuugauccacaugggagugccuuuuacaacucugugugagucuuuuaaguuaaugcuuuacagccucugauuuggguuuacuguaaacguacuaggauauguaucaucuggagcuuuugauguaugaguagaagaaaagcaagacuuuagggucucaugugacuugaaagagccuacuaaaaaaaguaguaaacauuuuggucugaacuuugacugcagcuuguauucuuuacuuucagcuuuccagaacaugaauuccaaaaggaaagcagaaaccuggaaaagaaauagacgucagcuaguaaguaauaucuguggcuucugaaaugcuacaaaccaaguaugaauaaguucaaaagauuuucacauaaauuugcauuugacaaauauuugcaacauaucccuugcuuuuaagauuaccuaaagagagugcuguuguuagguugguaggaccgaaaggaaucuuuugaaggaggacagguaauauuagguuguuuugauugugacauuuuccgugggcgaccucauucugaccuuuuagcuugguaacaauaccuuuccuuccugccccaccuuuucuccauuuucauagugguaaagggguuauauuuaagcuggagaucugucagaacuaaguacaaauaccuacuuagaguuuucaggcaucaauucucaaacuuuuuaaaaauuuugauccacucgggcaagggcaagucaagacuccucaauucauuugccucacacuuucugacuuugugauguaaaaaagaacuuacuuauaaagauuggagagaaauauaaagggaaugcuuauuacuuuauaugcauuugacuuugugccuauauaaaauuauguccuacaggcugaaaaauaagaaacaucguguuuaccuugauaguauguuggaaguacaaauuuaccagugaaauauugcugucuaagcagaauuuauuuuuugccaauagcugauaaauugguucauguuugaaguucaguguacauguuccaguguccaguuacuggaaaguuauuggccagauaauagaaaugcguaucacuacauucuuaagcuuugcaagaaacccauagcaaaugaaauugaugaugguaaagccaaacuaacauuuggucauuagaaagcagaguagcagcaaugggaaacugacuaacuuggaaugauggucaugcaaauguauugucuggaaaugguagcacuuccguuugcccacauauaugguaguaacuuggcaaguuuaccaaauacuguguuucagucagaauuccuaguaaaauacugauuuacaguucucuagaguaccuuuaauaacacucuuaguaggucacuaauagguggaugucaguuacaugugaaaauggaagccuaugggaugguuuaaggaagagucaaaggaaagccuugcauucguuuugauuuauuugaagcccaccuaucaguggggccucagacaauauuuacuugggaaaucuucaguuuaguacaguuaguuacaaaauagucucccuuccuugggaacucugcgacucuuuaaacuucugaauucuguaugugguugaaaaaugguuuaucuuguugaggauuagggagugucaggaacaaauuuggucagaugcuucuauuaugucucuccacagaggaguaguuuuuaaccuugguugcacaacaaaaucacuuggggaacuucagaacauguugauguccagguuccacccacagaaauuaugauucaguuggucugggauauagucuggguaucugguuuuuaaaagacugagugauucuacugugcagugaauguggagaaccuccacugaagagguuaugucuuaaauaauagcuccugcguuguugggaaacuaauauuuaucuauuuuuuggaaacagaagguaaggaaucugugauuucuuuucuuucuuucuuuccuuucuuuucuuucuuucuuuuuuuuuuuuuuuuuuuuuuuuggaggccaggauuuaaccuuuggcuacugugcugacaaguauuuuggggauaaagcuuaaguguuuugaauuguuccuuauauuccaagacaagcuuugugcucuuugauguguacccaagggucaugucaugauuagaggaaccauuucuauaguucuauaaggaaagcaauuucacaauuuucguauuugcaguuaaaugucauuuaauaguuaaaaacauuuuugaaaaucugaauaaacuuaaggcccugaugcuaugguuaagguucuugccuuuuuauacuauauacaguagaaaugggaaaguguaaauuaaggucaucuucauauuaucucuuuucauaacuugaagaaaaugaagccaccucucagucuuccaaauguuaauuaacuguguuacuuugaccuuuuguuagugaucccauucagcuaguaccaagcugaagauugauauucguuaaugguuaauauaaauuuacugcucuagguuaagccuaacauauguaauugcuacucagccuauuacuuuuuaguccauugggaaucacuaaaaaaaguagaggcuuuagcuucauuccucggcugcuuaaaucauauuguaauguuuuaaauuguuaugucguccuguauaaccuuaggccccaguaacugauuaauaugagucagcuuuaaguuaauuacagauauaaaagguaauagacacauaggcauccaaucuuggucaguuuaauuuuuuaggguugaauuuacagaagugaguaggaaauuaaauugcuuuauuucuucuaaaacccugacacaaaaucauaagguuagaacacauucaguugaaaugacuguuaacaaccaacagagcuauuccagauagcaauuuucauugacacuugaaauacccagacagaaaaaaggagaaacuggaguacagauuuacgagguuggaguuggaggacacccugguguggaaaacaacaaagguuugggaagggggcaguccuuagauuggaaagggcacaccugguacagauggugugguaaaaagugugguaaaaugcgagcgagcuccaguggcagacucuaguuucuggaauaagagcaauacuuuuaccuucacagguuugagccuguuguuugcuauauuuuauaacucguuaagaguuuuuuuuaaugcacugguaucuugaaggaguucuuuuccucuggcaguagaccucugguuuuauaauggaaaucuuugaacaaguaagaucugcuuagauuuacauucaucuuugguagaguaaaccucaucucuaaauuaaagaguuuguaauuucuuaccuuuaugauuagaaugaaaauucuuggagagggccuaauccacaugucaguuuuuaaagcuuaaagacaaaagacaacacuggcauuuguguuaauaucugcauuuaaauauauaucauacacacacaaacacacacacacacacacacuuagcuauauggaaaaaauggaucccuaccuuacaguauaugcaaaagucaauucuagaugggaaauuaaacuuuaaaaauuuuuaaagaaaauacagggcaauaucuuuaugaccucagaguaaagagggauuucuuaaacaagaacuacagcucauaaaggaaaaaguugguuuauuuuauuacuuuaaggaaaaaaaaccuucuauauaucaaaagacguaaagaaaugaaaagacaagccacacaguacagcuacuuuggaauuaucuuucagaauucauguguacacccuacagcgcugcaauucuaccccuagucauaggcccuggagaaacugcacaugugaaccaggagacauucagaagaauguuuauugcauuuucauaauagcaaaagacugggaauaauccaguguccauccacaggaaaacaguuacauucuggaauagaauauuuugcagcaguaaaaauaauugaacgaacagcuacuugugacagugugaaucaauuuuagaaacaaaguugagaggaagaaucuaauagcagaagacuguauauagaaugguaccauuuuaauaaagcucaaaaauaaaacuaagaucucauuuagagagauagauggcaaaauucuuuuuaaaagcagaggagugacaaaacacgaaauucagcauagugguuaagagaagcaggagagacgaggaggaguacauguuuagcuuuaauaauauugguauuccuugguucuucaguugaacucguggcuauucauuuucaugauuaugcauuauaauuugauaauguauguaauuaacagauguauguaugugacauauuuacuuuugguaacaaauacuacuucauuaaaaaaaucacaauaaaaauaacaagcgucaaucugggagaagauacuugcaguauacaaauaucuuaaacagauuaauguccugaauucauaaagaauuccuaugaaucaauaagaaaaaggacaacacaacuuaaaaaauacuaauggacaaaggaucugaauaggaauucauaauaaaaaccuggauggcuaauuaaaauaugaauaugugcucaacccuacuugaaauaaaguaaaugcaaauuaaaacaagaucccagccaugcuggcacaucccuacagucccagcuacucaggaggcugaggcaggagaaucccuugaggccaggauuucaaggcugcagugagcuaugaucauaccacugcacuccagcccgggugacagagcaagaccccaucucuuaaaaagaaaaaaaaagagaucccauuucauauucaucagauugguaaaaauaaaaaaaaaucugacaaagccaagucuugaugagauauggaguaccagaagcuaauccccaccgggguugguuuaaauagggacuaacuacuuuggaggacauggaagauaccucaaguuuaaaugcuuauaacccaaggcucagcaauauucuaguuaauacucuagaggaaugcuugcacagugcccaagaagguauuaaaagaauguuuauucagguguuauuugucauagugaaauacuggaagcacuguaacuguccauuacagaagaacggauaaaaacuauugugacuaauuuauauaacaguauagcauacggcagagaaaugagugaacuagagcuacaugaauaaaucucaaaacgaauguuaagacaaacaaggccgguugcgguggcucacuccuguaaucccaguacuuugggaggcugagguggguggaucacuugaggucaggaguuugugaccagccuggccaauguggugaaacccugucucuacuaaaaauacaaaaaauuagccaggugugguucaucucaaaaaaaaaaaaaaagacaaaugaucugagacaaauauggcaaauuauuaaucuuuuuaauguggguaaugggucuguauuguauugucuguuccuuuuuucuguauguuuguaauauuucauaauacauguuuuaaaaacaauacaacuguaauuuaaaaaauuauauaauauuuaaagcaccuagaucagagccuuacacauggaagcccucaaauguuaaguacauuaggaggcuuugauuguacuuucuccucuuauuuugcaguccugguauguuagaguagaauacuggaaugcagaaaauguuucucuuggucaggugcgguggcucacaccuguaaucccagcacuuugggaggcugaggugggaggaucacuugagccaggaguuaaagaccagucugggcaagauggcaaaaccccaucucuacaaaaaaauuaaaaaauuagccaggugugguggcaugcaccugugguccuagcuacuaugguggcugaggugggaggaucucuugagccuaggaguuugaggugagccaucaucgugccacugcacuccagccugggcccacaaagggagacccccauuucuuagaaaaagaaaacauuccuccaagaacuauauacaaaaacaauuaaguuugguaaauagguauuuauaaauguuuaaguuauaggauauaacuuuagcuuuugaucauauagcuucccuuuaugauugugucaaaucaaagaauguguaucauagaaagagggaugguuuggaguaagauacuauaauuccuauuuuuuuuuuuuuuuuuuuuugagacagagucucacucugucgccaggcuggagugcaguggcacgaucucggcucacugcaaccuccgccucccggguucaagcgauucuccugccucagccucccgagaagcuaggacuacaggugcacaccaccacgcccagcuaauuuuuguauuuuuaguagagacggguuuucaccauguuggccaggauggucuccaucucuugaccucgugauccgcccaccucagccucucaaagugcugggauuacaggcgugaaccaccacucccggccagauauuuaauuuuuaaacugggcucuaccaccuaacuaguucugcggucucaggcaaagccauuuugagcaucaaauuguaucugcaaaguuaagcuaauaagguccuccuuggaaaaguuuugucaggauuaaauggacucauguauaugaaguuauauauauauauaaaacucauguaauauauauauuaaguacagagccuaguacuuaaugggugcucaguaaauuguaauaccaguuauuaugacacagaugccuucgcccuagugacucauaguuaagggucuccugccucaugaacaaagcuuuauuguucauuuuggaaagugcuuugggaaaucgagcuugccauuaagcuacugggcaguccugcuuauuuagcuuggggguagcuucugauguuacucauagccuuugguuucuagaacagaacucugggcaccuccugccuggcugggccucgcugaugugugguccauguuucaggccuucuccacaguaggcacuccugacuacauugcuccugagguguucaugcagaccggguacaacaagcucugugauugguggucgcuuggggugaucauguaugagaugcucaucgguaaguugcaugguuucagaggacuuuuucugugcauccaugacagacuuuuacauugauaccagccucuguuucaauuggcagugaucuaagugauuucccuacuugucuuucaaagugaauuguuuuagacagaugacaccucuuucaguaagauguaucccacuccauucuugggcuuacuggcauccugcaauugcuuugcugaucauuuuuuauguuuuucuuucucuuauaccuucaucuucuccaucuagaagcucuuuuagucacuagcauuuauuaaauauccguuguaugcagagcacuucaacugggcauugccucacuuuccuaauuugccgcccccuuccucugucaaagccuucaaaucaugggacccucuggccucucucccucuuauuguauuggugugucucuguauuuaugggacgcaucuguggggguggucauaugccagugagcacuagauuaaguauauccuuggugguuccgggugagucuaucuggcugcuuuggcuucaggaacaugggaacgaugccuguggaggugggcguacaccgucuggagggaagauggggugauagggugugugcguguuugucuucuugccuguaguucucaaaaagaggcaugguggucauuuuuaaaaucuaugcuuuuuucuuauucaaguuauuugguacuuuacccauauaaggguauuucuggaaugauauuguuucauccuuucauuucuucuuugggcauggugauucccacaccugcaacucuauuuauguccuccuuucuuuucccagcucuaccuauuagcugacuuccuagugguaccagaggcaugauuucacuuugggucugggaguuugggggaaaaugaaaaauagguuuagguauuuucugggauaaguggaaauccugucugugucauggagggauggccauacagaguaauccaguagucauuaaagacauacagaaucaggccgggcacaguggcuuaugccuguaaucccagcacuuugggaggucgaggugguaguaucucuuaaacccaggaguucaaaauaagccugaucaacauagcaagacucugucuuuacaaaagaaaaauaaaaaaucagcugggugugguggugcucuucuguagucccaccuacugggaaggcugaggcaggaagaucacuugagcccaggaauucaaggcugcagugaaccaugauugugccacugcaccccagccuagguaacagagugagacccugucucaaaaaaaaaaaaaaaagaaaaaagaaaaaaaaagacauagaauuuuauuaaggagaguaaucucggucagauucaaaguucuggaguguaaaagcuccgaaguuccuuuuuuauuacaggcuacccaccuuucuguucugagaccccucaagagacauauaagaaggugaugaacuggaaagaaacuuugacuuuuccuccagaaguucccaucucugagaaagccaaggaucuaauuuugagguauuagagaacaucccuccaccuucuuucucagcuuuuuaauaugaaugauuccauuuuuuuaaaaacuuuuguuaucuccugaaucugcuuucuguuuccuccuauuccucucuuuaaacaaauaaaaaggcugugcaugguggcuuacgccuauaauuccagcacuuugggaggcugaggcagggggaucacuugagcccaggaguuugagaccagccuggacaacacagcaaaaccccaccucuaaaaagaaaaaauuggcugggugugguggaaccuguggucccagccacuugggaggcugagaugggaggaucccuugagcccaggaaguugaggcugcagugagccaugauugugcuacugcacuccagccugggugacagagugagaugcugucucaaaaaaaaaaaaaaaaaaagaaaguuuuucuuuuucugaggagacugcuugagaugugcugaaaggccucugucuuuuccagguucugcugugaaugggaacauagaauuggagcuccuggaguugaggaaauaaaaaguaacucuuuuuuugaaggcguugacugggaacauaucagguauauccauauaaacacuuucagaauuauuucagaaagucucuaguuuacuuaauaauaauuuggaaggaccaucauuggcaagccaaguaagggaagagagcuucuuagagauuuagggucuuuuccugauuuucauucauggugaagauugggcauuagauuuuuugucagccgugugucauggaauauauugaaucuagcaguuauuuacaaagugaagugaacuuuguuuuuugagguggagggagcaucuaggaagcguauuacccuuuaccuagaacucagcaaccucuuaggucccgccagcgggacuguuccugcccacaggguggaagguaucacuggaacauagagaagggagaaaggaguggaggaaagauuggagggguggaaguggagagggaaagggagagugaaaauuguuaugguggggguaguagacuacggccaauagccgugagagccuagaccaccugcuguaguccagaccuucucauucagcauucauugguuauuaaauagaaggugaaguuuucauuuauuuuauaauuguguacugauuugcugcuugugauuuuuuaccuuugccacuuuucuagccauccuacuuggcaccuccaguggaagaagggcagagcccuacacaaggggacauuuagagguucaguuucccuuuuuaguagacaggccaggccauggggggaguugcacuaacuucacguuuuaguuauucuuaucuuucuuucuagcuaugaaugauugaguuauuuuuuuaaaaucauaauuuacuuuggguacagucaguuggcuugguuggucaguguuuauaaguuuuucagagaaaauaaaugcugccugccagugaagagucuucucaugucagaccaggggucuuuuuuggagaaagacuugauugguaugauccauuugauuacuaacuuaguaauuuuuggcauguguauucuuggcagagagagaccugcugcaauaucuauugaaaucaaaagcauugaugauaccucaaacuucgaugaguuuccagaaucugauauucuuaagccaacagguaacaccaccagcauugucuccugcugccuuauaagcacauuauuuacccccaauuuugggaugauguuuacaaaucaggguagugaacauggagaggaauuucauuucuucagguucuuuguaaguacuuuucuaauucuaaugcuggguaguggugaaaccuuggugaauggaaaaugaguaucagcucccauguuuagacugcucaacugggugaguaagucacaaaaaucuguucuuuuguuauuuacuaaguguuagguaaucugaaaugacaggaaugggaaaauaaaacauuaaaaaauuugugaagaaauaugagauuuaaagaacaugagcaagaaaauguggaaaauucauagagugaggccaggcgcgguggcucaugccugaaaccccagcacuuugggaggccgaggugggcagaucacaaggucaagagaucgagaccauccuggccaacauggugaaacuccaucucuacuaaaaauacaaaaaucagcuggguaugguggcacacgccuguagucccagcuacuggggaggcugaggcagaaggauuguuugaacccgggaggcaagguugcagugagcugagaugacgccacugcacuccagccuggcgacagagcaagacucugucucaaaaaaaaaaaaaaaaaaaauucauagagugaaaaauaagcuuucccaaauagaaacugguguguucuucauaguccugucuucagcaccgugagcaguccauuggaggcaaggcagugaaucaacucucacaucuauuucuuucccaguggccacaaguaaucauccugagacugacuacaagaacaaagacugggucuucaucaauuacacguacaagcgcuuugagggccugacugcaaggggggcaauaccuuccuacaugaaagcagcaaaauaguacucuugccacggaauccuauguggagcagaguucuuuguauaacaucaugcuuuuccucucacacucuugaagagcuuccaagaaguugauggaacccaccaauaugucauaguaaagucuccugaaaugugguaguaagaggauuuucuuccauaaugcaucugaaaaacuguaaacaaagacaaccauuucuacuacgucggccauaaacagcuauccugcuuuggaagagaagcaucaugagccaauuugauagguguuuuaaaaauaacuugaguuuuccuaaguucaucagaaugaaggggaaaaacagccaucauccaacauuauugagauugucguguauagucaucgaauaucagccaguuccuguaauuuugugacacgcucucugccaagcccaccaaguauuuccuuuauagcuaaaaguuccauaguacuaaggaaauaaagcaauaaagacagucucagcagccaggauucuggcugaaggaaaugauccgccacccugaggguggugaugguaguuucuacccauaccucagccucaggcgaguggcuuauagccuccauucauggugcacuuuauuuaugguacuaagauaaagacugucaauccauugauuuaucuccuccugucccccaucuaaaauacccaugcugcuuuucugaguguugauggggguuaccagcuugauccacuguugcucuuagaaggcccagaaagucuuugggcauugccaagaaaucccggauuauguggaaaacccucacuuucucuucacggcuguaccagaaaaucccuaagacagaucuugccguggacuagcaauaccugcaagugcugccaaugggaacucaauuuauuccugggaaccuaacgaggagagcccaggccuaggcaggaggccuggaacccucuuggcuaaggugcuguuccuguuccugcaaggucuccagaaccccuuuggaaauggugaaggaaccagcccaauagaaguacagagccagcugacaaguccuuguaaagcucacuccucaguccuuggcacagccauguuuugucuucucucuugguauuucuucucucccaacuuuagccauuuugccuuggaaucaugauuacaauuuuuuccuuugcagaugccuuccugggggauacuccuccccacccuaaagggucgccugcaacuuaggcggauugggucucucugcuguggcguucucucuugagagacccucugaauuuuagcacaaagugccuucuguuucacagcugccaccaccuuuagaggaauuucgucagaaaaauguggaggcuccauauuaaugcauuauuuuuuaaaaaguuuugauaacucuuaaagcaucauuugcaccuaugugggaacuuugccuguugcaaaguauuguggccgagcugcagcugggagccugcuuucugccagucuugagguucugaagaucagcuuugaaaggaaaguauguccuagcuuagccauucagaagagaaaaauggaauaucagaguuacaguugucagugaaacuacuuuggauuuuaaccucuuagaggaagaaaaaagguuagggaagugucaacucuggaugaaggugauguguuugccucucagucuuucauucauagccugcuagugaaaaggaaguaaaugagauucuuuugugugacuuuguagucucuuuguauuaccaaauaguugggguguugacuccuguguguuuugcaagaaugugugguaagccuggguaaagagaaggaacugcgguguugggagagucuuuguguuggggaguggcaggggaugauuuguuucaggggaaaaugcccacauuuuaacuuuuaaacuucugaauaaacuguguaaaaaca

SEQ ID NO: 192681 - RNA, 27251 nt, Homo sapiens
agcggucucccgcccgcggcgccaucgcgccauuccuaguuaaggcggcacagggccgaggcguagugugggugacuccuccguuccuugggucccgucgucugugauacugcagcgcagccauggcagaaccgcagcccccguccggcggccucacggacgaggccgcccucaguugcugcuccgacgcggaccccaguaccaaggugggcacaggaccgaagggaacggcucccccagcuccgcugggccgggaccgggccgcauucuauccaaccccaucccgccgccgcugcagguccgccggccucgggcggacgggagugugaugggaagagggauaaugguguuugauggggcgaucguggggcccgcgaaguguggaggggaucuguugccucagcuaguuucaaagacugcgacccuguuuugaauuggcuuguuuauguugcgacgguggcuggaagccaggccaacccagggucagcuuucccaaaucagucgccaaggcccacgagaacaguaguuucagaacucccagaaauagguucaaagaugccuguccuguaccaguccugcccagccucguuuuuccuuaccacccugacugcagucuuaacuccugcaaacuaauuugaucgcucuaaguuuaaccgcgcccagaauuucacuuuugcuugcuuggccuuugcugugggucacaacagcccuucuugccuuccucaucuucguggggcccaggagagauuacagaaucauagaguuuggaucugaaaggaaucuuagaaauuccuucucuuacccucucguuuuacaguaaugacccaguaagagaaaugaccuguugcauacaaaggcuuucacuuaccgaacaugucuuuacuggguaagaaucaguguaacucacucaggugugguguuucgguugccuuguuaagaucagacacaguuggcgggcgcgguggcucacgccuguaaucccagcacuuugggaggccaaggcgggcggaucacgaggucaagagguagagaccauccuaacacggugaaaccccgucucuacuaaaaauacaaaaaaaugagcugggcgugguggcgggugccuguagucccagcuacucgggaggcugaggcaggagaauggcaugaacccgggaggcggagcuugcagugagcugagaucgugccacugcacuccagccugggcgacagagugagacucugucuaaaaaaaaaaaaaaaaaaaaauucaggcacaguaaccgcuguuuauuccagugaagucaucagugucuguaaacaccuuuguauuuauuuauuugacuacaucauuuguaaauuccuugaagauugaauaugugcuucgugcagaccuuuaaaagggguagauaagugguccaugacucuggucccugcuuguucuuuaccuucagggcaaagagucagacacaucucauugcuaaaacuuuugacuagcaccugguacuuggcuuaggaaaaauguuagucauugcaaaauuaagggggaagguaaaaaaauuccgucaugcccaucucacuuguauaucccuuaauauuaauaccugguuuuuucauauaauguaaauugagucacucaguguaaaguauuuucccagauaacuagggguuuuauguaaugggguuuucaaauaaaaaggauuccagggauaucuuuauaaaauauacuaaguaaauguccuugcagcuuaauuuacauuccacaguaucuaaauuucucuugaugauucggaguaauuaauuuugagaucaguaauuuuuggccaugggagacauaaaauggaauacauaauaauagcugguauauauugagugugccaggcccuggcuugguauuuuaaguacauuguuuaauuuaauccuaacaacaacccuaugaagaaggcauaauuaugaucuucauuuuacaaauaaggacacucaggcacauagagguguugagugauuugcccagggaggaccccacacuuccaaccuccacccuguucugcuucuggggugcugacuccagcaguaauuuuggaauuugccauaaaggaaaauaaaaaaccucaaugaaggcugggugcaguggcucaugccuguaaucccagcacuuugggagagcgaggugggcagaucaccugagguuagcaguucgagaccagccuggccaacauggcaaaacucugcucuacuaaaaauacaaaaauuagcugggcaugguggcgggcaccuguaaucccagcuacuugggaggcugaggcaggaaaaucacuugaacccaugagguggagguugcagggagccgagaucaugccacugcauuccagcuugggugacagagugagacuuuguccaaaaaaaaaaaaaaacccucaaugaauuaaauucaguuugaucacuugauacauuuaugcuauauguaaagaagaugguaaguacuuuggggauacugggauaaacaagaugagguucccucccuucaccaacuuauaucaacucuaauauacaauggaccugggguuagugugcuauugaaauauaaaucacccugagagcacccugggagguagagguuuuuaaagguagcauuaguggaaugggguaugcacaggguauuuggagccugaagaccugcauuugaauccccacuucuguuguuggcugcagugaccuugccagggcacuugggcucaguuuguagaaggagcauaaagauaucucagagagcugcuaugaggauaaaaugacauguauuauguucucuaaacuaugaagagugauacaauucaagguuguauuucagcuguggggaucagggcacacaucaaaaagaugguggugaugggccuaugccuugauagauuggguaggauuccagcagaguacaugggaaggcauucugaugaaggaaacaucuuagcaaaaauguguuuugauacggggggaacccaccccaauauuucaacguagguucuuucuauuuuccauaaguauuggccagcugagaaauaaagaguacaaagagaggaauuuuacagcugggcugccggggggugacaucacauaucaguaggacugugaugcccaccugagucuuagaccagcaaguuuuuauuaaggguuucaaaaggggaggggguguaagaacagggaguagguacaaagaucacaugcuucaaagggcaaaaagcagaacuacuaauaagggucuaacaaagaucacaaggcaaagggcaaaagcagaacuacugauaaggguccaacaaagaucacaaggcaaagggcaaaagcagaacuacugauaagggucuauguucagcagugcacguauugucuugauaaacaucuuaaacaacagaaaacaggguucgagagcagagaagcggucugaccacaaauuuacuagggugaaguuuuuuccccacccuaguaagccugaggguacugcaggagacgagggcguaucucaguccuuaucucaaccucauaagacagacauucccagagcgggcguuuauagaccuccccccaggaaugcguuccuuucccaggguauuaauauuaauauuccuugcuaggaaaauaauuuagcaauaucucuccuacuugcacguccguuuauaggcucucugcaagaagaaaaauauggcucuuuuuguccgaccccucaggcagucagaccuuaugguugucuucccuuguucccuaaaaucgcuguuuuucuguuguuuuucaaggugcgccgauuucauauuguucaaacacaguuuuacaaucaauuuguacaguuaacacaauuaucucagugguccugaggugauguacauccucagcuuacgaagauaacaggauuaagagauuaaagacaggcauaagaaauuauaaaaguauuauuugggaacugauaaauguccauauuaaaaugaaaucuucacaauuuauguuccucugccacagcuccagcuggucccuccauucggggucccugacuucccacaacaguuuuaggaugguagaauugcaaugcagggcagguacuggagaguuaguuaaauguuauugguugcaguucagguuaucuaagcagugguggaagaggcuaacaugguagguuggggccagauuguggagacagcuuugagugucacaucuaaggaaguuagauuuuauauacauaguggggaaugagucaggguuuugaaguauucuauaaaguagauuggagggauccaagucuggaggugauuaggccacuuaaaaagcucuuccagaaggugagauaagugauaugagggucucguuuguaaagaagacagcagcaauggcacaaagucgacuuguuuuuugaucauuugcaucuucauuauaaaggaaguccagagaauguauggcuaugucacauuuugggcaaucucucugggcuaacuuucuuuaaaaggucagauucuccuggcaacagagagagacuccgucucaaaaaaaaaaaaaaaaaaaaggucagguucuccuuccaaguagugaucuggagaucuuuucuuuuuuacuaucuguaucugucuccacuaauacaguagacaauguccucaguguugccauuauuucuaccaccacugccaauguccauuuucacaucguuccauauauaaauauaugaauauauaaaaauauaaaaaauuaauauauauuaauauauaaauauaucuauaaauauaugaauauauauauauaugauggggucccucuccaaucagguagauugguggaauugaaugcaguagaaaggagaauagggaauggaaaggaggaaggaagaaggacaauggccagauaaauggcugacuauucaaggcauagagaaucauaauauauauaaaggcauaaugacaucagagaacugaggcagggaccuacggguaacacagugaaugaaguuauaagcagugggacuugagggaagggugaccaaaacaaucauuaggguacucaaagaaaagaugagaauucccauuauauucauuuguuuuucucacccuguaaugguugcuauuuaagugauaaggguaugaaauagaaaauguuugagaugaccgguuuaggggaguggugauaaccguugguguuagagaaguaugcagcuacauaugugguugcuuuugggacugucucucaaauguguugaggaaccacugaaguauugauuuuuaagccaaaaaugacaugacaggguuuucuuuauggaaagaucacuccaaauugcauguagauaagccuaugaaaagcaaagagauaauugucuaggcaggaaguagugaggacuucuugcuuuccucaagauacacugaaggcaguugaaaagcucauuuuuaaaagucuggugaaaaccacuuuguucacuuuuguuuugugggagaugugacaccuaguaauaaagaguuaacaaacccuuuccccuuuuaugaaaauuugacuuuucguuaacucccuaguuucccagaaaacaaugaaaaauuguguuuguugcuuaugguaaaaauaacccaauugguaaauugcaucuggagagggagaauuguaaauacuugaaaggaagccauagcuuuggacuucccugauuguagugacucuuauaacugucccuuguggaaauucuagaaguucugccuauggaguugcuacuagagauacuggcuccugugguacauggggccuucugcccuagggugauucucauucauauccagugugaaucuucucccuguaccugaucugugucgacuccuguaaggacucccacugaagaggaacaccugauacuucuuuguuggcaaucuguguuuuccuaacagauaccguuuugaguaaacuggcaccauguauggccuauggcuaugguugucuuauaagucuggauguuuaguugagccuuaagaagacuuucugggccaggcccgguggcucacgucuguaaucccagcacuuugggagaccaagguggguggaucaugaggucaggaguucgagaccagccuaaccaacauggugaaacccugugucuacuaaaaauacaaaaaaauuagccagacaugguggcgcgugccuguaaucccagcuacucagggggcugaggcaggagaauagccugggaggcagagguugcagugagccgagaucgugccauugcacuccagccugggcaacagagugagacuccaucucaaaaaaaaaaaaaaaagaagaaggcuuucuguugggggcaauauaacacuuuugaaaguuauuugagagacaaaguagauagucucuaaagggaauuggucucagucuuauuaaggucgaaagacaacauuuuuuaaaccagagaaauuuuuuaauuucugaaaauauggcuaaugcaaguguggaacuucuccuuucugcagacugaggguaauaaaggugcuauggucugaauguuuguguccccucaaaauucauguguugaaauccuaaucccugaggcagguauuaggagguggggccuuucagaaagugauuagguaggucaugaggacaaagucuucaugauuaggauuagcauccuauaaaagagacuguaaagaaugaucaagcccuucugccaugugaggucacagugcaaagguaccaucuaugaggacagacacuaaaucuccaagugccuugaucuuggacuuccuagccuccaaaccugugagaaauaaaugucuguuguuuauaagccacccaguuuauggaauuuuuguuacagcagccuaaauggacuaagauaagaggcaauggagauuuuaacuuuaagauguaaccucuuacaaagcucucuaguaauacuucuagagaaauaaguaucuucaucacuagaagcaaauuugagauuuuguagggagaaaacacaaagucaaacaacguuuuuaucauuguuguagcuuuuugaccaguuuugauucauccugaaaauagacauauuguaaccaaauacacucauaucccauugugggaggcaguuguauaaaauucauuuagagacucugcuucugacaagaugaaguagacauacuuuuccuuauuccuccugcuaaguacaacuaaaaacucuggacaugauauauaagacaaacauuggaagacucugaaagguggugagaagaagguagacuggcuagggaccuugagacccuaggaacaacaaggcaaugaguuuccuaaguuuucuuuuugccucauauugcccagacuugaagcugaagaagcuaguaaccuggaaaugcugauggacacagaccaaaaaaaagccuaaugaaagccugcucucuagccacaggaccuggaaaugggcagcauuuccuggcaagaaagaaaacuuuuagacaauaacugcucuacuccaacuaaacuccauagagaaaacuguggccucagucccacccaugccagcaaaagcugaguggggagccuagauuuucacccaaccagauguaaugagcugcccagccuuccccugccaaggugaugugggggaaggcuggguagggagccaggacuuucauccugccaggcuuuccccucuugccauaucaauggagacacaugaggaaccuaaaauuccaccccaacccagcaguggaaauauuuaagauaauuauaagcgggagaagguacaggaauguaaagagaggugagguuucuguaccuuguucaaacuaauaaaaugaugucaccaaaugacugauaaguuauguguguguguguauacauauacauggguauauguauauacauauauacauguaugucuguauauauguguaugcguauauguauauauaugccauauguauauacauauauaguaacaccuagagccaccauuuaaaaagcuauacaaagagauacaugcaaaaacacuacagauaaaugaaaauugaauuuuaaaaaguuccagugacccagagaaaggcaaaaagaagacagaaaacauuaaaaaaggaagaacaaacagaaaacaaacaugaauaaaauggccaacuuaagcccuaacauuucaguacuuacauuagauacaaauacauuaagagacaaugauugauagaauggauuaaaaaacaugccccagcuguaugcugucuacaugaaacucacuuccaauaugauagagacaagguaaaaguaaaaggguagaaaagauaauucaugcagauauucaucaaaagaaagcaggaguggcuaucuugauaucagauaaaguagacuuuggggcaaagaaaauuaccagacauaagaaguacauuauacagugauaaaagaguugugauugaccaagaugacacaguaaucauaaauauauguuacuaaacagcagagcuagggaacacaugaagcaaaacugauauaacugaaaggagaaauagaaaaaucuaaaauuauaguuggagaccucaacacugcucuuuuuuuuuuugagauagggugucacuccugucacccaggcuggagugcaguggugccgucucagcucacuacaaucucugcuucccggguucaagggcuccuccuaccucagccucccaaggagcuggggcuacauguguacacuaccacacccagcuaauuuuucuauuuuuuguagaaauggggucucacuaucuugccuaggcuggucuugaacucuggggcucaagcaauccagccaccucggccucccaaagugcugggauuacaagcaugagccaccaagcccagccaacgcuccucuuucaacaauugauagaacuagacagaaaauuaacaaggaaacagaagaacucagcaauaccaucaacaaauaagaucuaauuaguauuuauagaauguucuaccgaacaacaacagaauuccccuuuuuuuuuccaagugucuguagaaaauauaccaaaguagaccaugcccuggguccuaaagccaacuucagcaaauuuaaaagaauggaaugauguauucuucagcaacaguggaauuaaacuagaaaucaguagcagaaacauaauaagaacaucuucaagcacugggaaaauaaacagcacacuucuaaauaaauaauccauggauuacaaaggaagucuugggaacuuuuuaaaaauauuuugagcugaggccgggugcaguggcucacgccuguaaucccagcacuuugggaggcugaggcaggcggaucacgaggucaggagaucgagaccauccuggcuaacauggugaaaccccgucucuacuaaaaacacaaaaaauuagccaggcgugguggcgggcaccuguagucccagcuacucgggaggcugaagcaggagaauggcgugaacccgggaggcggagcuugcagugagccgagaucgcuccacugcacuccagccugggugacagagcuagacucugucucaaaacaaaacaaaacaaaacaaauauauauauauauauauauagagagagagagagagagagagagagagcugaaugaaaaugaaaaagggaucauagcuaaacagugcaaagggggaaauguauagcacugacugcauacauuauaaaagaggaaaagucucaaauuaauaacguaagcuuccuccuaagaaacuagaaaaugaaaagcaaaguaaacccaaaggaagcagaaggaaggaauuagagaagcagaaauuaaugaaauuaagaacagaaaaucaguaaaacagagcugguucuuugaaaagaccaguagaauagacaaaccuguagcaagacugacaaugaaaacaaagaagcacaaacuaccaauaucaggaaugaaauaggggauacacuacagaccuuucugacauaagaaagauaagggaauacuaaaaacaacuuuguauacauaaauuugacaacuugaauuggaccaauuccucauccaauaugaacuaauaugaugaguccuauaacuuaaggcaauugaauuuaugauuaacaaacuuccaaagaagauuuguccagacccaggugauuucacuggagaauucugccaaauguaaaagaagaauuaacaucaauuauacacaaccccuuccagaaaacugaagacgggagaacacuucccaauucauuugauaaagcuaauauuacccugauaccaaaaacaaaugaagacaguacaagaaaacuacagaccaauaucuccaaugaauauaaauguaaaaacccuugacaaaauguuaguaaacagaauucaacaguauauauagaaagaauuauacaccuuaaccaagugagguuuauaucuaggaugcaagccugguucaguauacaaaaaucagucaguauaauccaccauauuaagaggguaaagaagaaucacaugaucauaucaguugguacagaaaaggcauuugacaaaauucaacacucauucauuauuuuuuuuaaguucagaaaaaaauaggaaugggggcauuucuuuaacuugauaaagagcuucucuugaaaaguuagagcuaauauuacacucaguggugaugcuuucucccuaauuuugguaauaagacaaggaugucugcuguuaccacucuuauuugacaaagugcugaaaguucuagacagugcaguaaagcaagaaaaggaaauaagagacauauagguuggaaaggaagaaaucaaacuguccuuauuugaagaugacaugauugucuacauagggaauaauaaguaauuuacagaaaacucccagaauucauaaaugaguucagcaagguugcaggguacaaaauaaacauacagaaaucaaucgcguuucuauauacuagcaaagaacacacaggcaccaaaaauuaaaaaauacauuaccauuuacaauugcccaauaaaaugaaauacuuagauauaaaucuaauaaacauuuacaggacacauaugcugaaaacagcaauggcgaugcaaaaagucauagaucuaaauaaauggagagauuuauuguguucaugauuggaagacucagcacaguaaggauaucaauucuccccaaaucaauauacauguuuaacacacuccuuaucaaacuuuuuuagacagagacaggguuauucuagauugaaaggcaaaaaaacuagaauaacaaaccauuuuggaaaagaauaaagugggaagaauuuuucuaccugauuuuaagacuuacauagcuacaguaaucacuacucugugguauuggcagagagauagaacauugaaacaaaauagagaaccccaaaauauacccacacuaguaugcccaacagcuuuuugacaaagaugaaaaagcaguucaccagagggaggauagccucaacaaauggugcugaagcaauuggacauccuuagguuaaaaaugaagcucuacucaauucucaucccuuauaccaaaaaaaaaaaaauccauuuacuggugcuuaaaggggccuuaauccuuugguucacauccuugccucacuuuuacaguuuuguaaggauuguauuguaggcagguaggacaugcacuagaaacauccuugauuguaccuuuaaaguuuucuuggcgguugcgguggcucacaccuguaaucccagcacuuugggaggucaaggcggguggaccacaaguucaggaguuugagaucagccuggccaauguggugaaacccuuucucuacuaaaaauauaaaaauuagcugggcgugguggcuggugccuguagucccagcuacucaggaggcugaggcaggagaaucgcuugaagcucgggaggcggagcuugcagugagccaagauugcgccacugcacuccagccugggugacagagcgagacuccaucuuaaaaaaaaaaaaaguuuucuuacaguaguuuucuuaauuaaauuuggagaaugacacuuccccuccccccgaaaaaaaccuuauuauuucuauuguccaccuuuugauaaggcacaggagcaaaucuuugucacccaguagccaucccuguaaaaccaaagauaguuuaggcauaaaagacaccuuauuuuuauuguucuaaauuuaaagcaugauaagggaaagacaaaauuaaggacuaucaggugagacaagacaugagcauagcauaagucuuacuuuuuaaaacaggagauacauguauuuuaaacgauauuuuagaaccauaccaauaaagcaauaauuuuuaggaacuuaacuuuuuaaaacaggaacuuuuucucaagaucaugcaaguguucacaagaggcacauggaguuaacagacuauuuuggugauaaaaauaaaacuguuaucugagcauagaauaacuugaucauuuucuuaaaaauaagcccuucuuguuuuuauauccauuuaacaauuuguagcaaaggauuuauaagccucuauuuuaucaauaaauucacuaacguugaauauaucuuacuuuuuuugccacguauagacuuuuuaaagugaauuuuaauauucuuuauguguauguguuuaggcagauacaguacauaguucucuuaauaauaaaguuaaagucuguaacauuaauuuuaagauauaauuaaucucaauagcauauuaagugguauuuguuuucauaugcauguguguguguauauauauauaauguuuuuaaaagcuaauauaccauuuuauauauucccaugccauuagacuuaguauaccaucuguauauaucuccaugccauuuaauauaccucgacgcagcauuuuaaauguuuuucauaauauucuuuuaugccugugucauacuaucuaacuauuccuuuguuagaggcaguuagugguuuaaaagcaaggacuuuggaaucagauugcuugggccagaauuuuuucucugccacuuacuuucucagcaguaaaauggggaugauaauaauauguaucucaugggcuuguugugaagauuacauguauuaguuucuuugaaucucuuagaacagcaucuggcacauaguuauuguguaaguguugugauggaugccuuuguacauaaaucuuugucagaguaauuauuuccuuagaauuuuagaaagagaacaucuuggucaaagaauaugaauucuuaggccaaggcaggcggaucacgaggucaagagaucgagaccauccuggccaacauggugaaacucugucucuacuaaaaauacaaaaauuagccgggcuggguggcgggcgccuguagucccagcuacucgggaggcugaggcaggagaaucgcuugaacccgggaggcggguugcagugagccaagaucucacugcugcacucuagccuggaaacagagggagacucuaucucaaaaaaaaagaaaagaauauuaauucgugcaccaccacuacuggcugauuuuuuguauuuuuaguagagacgggguuucaccauguugaucagucuguuucucgagcuccugaccucgugauccgcccgucucagccccccaaagugcugggauuacaggcgugagccacugcaccuggccaagaauaugaauucuugaggacucuugauauuccaguuguuuuccagaaagauuguaagauaaggauaugauagacuaugggauagaauaguuaagguugucuaacuuuggcaaguacuuggcauggcaucuacaacaaaaaauacaugcugugccuaagauauauggauuugaguauagccuguauagugugaacagaaguaaugauaaagucguugguaaaguaccaauacuaauguugguacuagaaagauguugaagaaacaaaacauaaacagggucacuacaaagcagauuuuaaaagauaguuuuuagauuuuauccuuuuuuaaaaaaacugagcaacaaauaauguugggugcagcuugguuggaaauauauuaucucauaauuccauaggcuagagguccgacuugggucugucccacuguauugacaggacuguguuccuuacucagaggcucuggggaagaaucugcaucuaaauccauuuagauuguucccugaauucaguuucuuuccacugucggacaggggucccagcuuccuugcuggcugucaggcguggauggguaugguggggugggagcagagggcagcugccuuuaacuccuggcacaugugccccaugucucagagccagcaccugcagguuggccccuucucacacuuggaaucugucccacuucccuuuaugccacacuccucuucuacuuucuuugcgcgcgcacgcucgcucucucucucuccugcuuuuaaggucuugugugauuacauugaauccaccucaguaauccaggcuaaucccauuuuaaaguccacugaugagugaccuuaauuuccucucagagucucucacagcagcaccuagguuaguguuugagagaauaaggaaggacaucuuuagaauuuaguccuugcuugcaccucccuccagggacugcagugcucccuccugagacugagaaccagugcugggaggacagaucucccccaugaggccugccagcuaaagucugugugauuguguguggucgggccugacagaucauacauaagacuuuguccugcagguggcuuccucaagcaaacauuguaaucaauagagaagcagcuaccacucauauuagcugggaaagaaggauguuuguuauuuugguaguguucauagugccuuguuuuaauguauacuuagaccggaauaugaaguggacauggucuugcugcuuuaaauuuuuuuuuuuuauuuugguaucacaucauggcagccacagagugacuuuauauauguucaacaggagaaaaccaaggcccagcugugaguaccaggccagcacuuggaugugcagagcuacuuuucucuuucucagcugcuugauaaaaucgagaccuuuaggacuguagcaucugacugagaaaagcaacccaaauguucuagaaacauguaaccugccuggcaugugauuauaagcugcgaauaaagaauuuaauuauuauauuuauuaagaucaguuuuaauaagauaaaguaguuuuuaggcuaguuuuguuuuaaaugagaauuuuaaugccuaaaagaguauguuucauuuacuuaaaauuuagcaaaagagaaaaauauaauuuccuaaugaggcugaaugaacuauauuuguauuuuauaugaugugaguuauauaggagaaagauggcauguggcuccaaaguaaguggucagaauuuucaggccuguuuugucaagccauggguuuaacagaaaaaaaaaaaaaaucuguuaggaagcaccagugagguucacagacuuauggucuggaagguacauaccaaugguaaagggagaccaaaacuuagaggccuuaaacaguuaauuacucagugucagcuucucaucuacaacaugggguaugaauaucgacaguaauaccauauagaguuauuacaccuaguuaaguccuaaguagaauuauuaaugcuauuaauaaucuuaacuccaugaauuuacauaccuucuacccuuuucucagucaagccuucuguuuccugauaaguaaguugaauuucccaaagguguuagcaacaguaacuuuuuacccuuuuaguuauuuaggagucuaggaucuugugaguaacucuuugcuaauuugcguggucaccaguaaaugguucuagaagggcauuuaugccuucauucaacaaauauuguagugaucaaccucuuuauguguaaaaucagugucuuaguuuggguagccccaaagcagacuagagagaauggugugguuuuaaguuuuugagaaguggucacagagagcucugcagaguuagggagagagggugaucauagguguauacgaguggauuaccacugugggcaacugagguucaauccugcuggggauucuuugagggacuuugugguaccugccucugaauugucccaccaagggacagggaugccagguuuuuuaucgaccauugguugaaggucauuccugcaguggaaacuuucugacacuuuggacuugcaucacacaggggccugcaaccagaagauaccacugagcagagagcccuugcaaguuguaggugguagguuaacaauuguguuuguaucuuguuacagaaagcacaauuaauguugguaauaaaugguaaaagugaaagauguuuaauauaaauauuuuuccauaggauuuucuauugcagcagaccaugcuacgagugaaggauccuaagaagucacuggauuuuuauacuagaguucuuggaaugacguaagucaaguacuuauuggcaccuuaauguuuaaauauauagcuuugcaaaucuagagaguguuuucagacccaucuuaaaguuuguuucagaaguaacagaaguucuuuuggccaggagucugugauuaggccuggcuggacagggcuucucucguaaguucuuuuucuucucuaucccagccagccugaaagggcaaaacaagacacaaauaguugcauuuucuccagucugccuucucugagcgcucccagcuaaauccuuaauguguucagaccccuuuugauguucuggccacuuuuagccucuuguuuacuucagaaaaguuauagauaauaagaacuuacuacucagaaaaccaauggguuuacuuaaaacugaccaucuguucuauuuuucuaggcuguguuuucuuuugcucaacaggucauauccacugaucuugcaauccuaaagcauacuuauuuuucuaaagcauguuuauuuuucuuuuuuucuccagcuuuacugagguauauugagaaauaauuuugucauauuguugauuuguuucccuaaguuaugugagcauuuugcuuuugagcauauagauacaugaauaauaaaauaaucuuuaaauuuagugccuagauaacuuccauucacauugagagaaaaauuuaaguaauauaugucuauauuuagaaaauuugaccaguucagaaaaauacaaaaugaaaaguaauagcuucccuccccaaguucuucuccccagagauaacugcuguccaguuucuugugauuuuuuucuagaaaaagguauuaugaauauauuuaugacauauuuaaaggacaaaaugaaaacagauuuauugaacacuuuugccaggcacuucaaauguuauuuuguucagucuucacaccagucuuaggagguagcuuuuauccccauuucacagacggagaaaccaaagcuuaaugagaugaaguuacuagcuccaaaucccacaguuggcauauggcagggcuggaaccuguauccauugucugaugggcucuaauguagacuuccugugcagagcccccaaauaggguacaaguugacaguaagcuggaagauuugaacagcugagaaaagcaaguugcaacaguuucauuuccuucagucccaacugauugguccaugaggguuguguagucugcuuuaguaggugcagagauuguuuuucaugauuggaguauuugagguguuugauacuuuauuauaaacauguuagaguaaaucuuauuugugauaagucaaugcaaggaucuaagugggccaaggucuauuauauagcagugauaaugaaauaaaagauuggaagcagaacucuagaaacuuuccauuugcuauauggcaauaacagccauuugcucuuauugauuaugaacaaagucaucuuugaauaaucuaaagaaaaucauauaugcauucucaugccaccuuacuccuugccaaauaauccuauaccauuuaaagucauuuaagguucaggacuucaguuaucuuucuuaaaaccucaggauucauaauucauucacucucucucccaucagucucuucuacugucucuuuccccucagagaagcguaagucuucuuuguuccagaauauuucuugcccucugcuccuucgccuaccuccccauugucacugccaugcuugcuacuguuuuaccugcucaccugccauucucucuccccaguacaguguaauccagcugaugcuuccccacucugcugacauugcucucaugggaccuuuccauaucucaugaccuuuucuuagucuuaauacuguuugaccuuucuacaguaucugauacuguuagccaccuuacuguugacauucacgucuucugugauacuagucuguccuuccuccuucuuucuuaccaccuauccuuaauuuccuuuccuagauguuuuggcauaguaagaacucaauaaauguguuuauuuaacugaaugacauauuuauauauguguuuguauguguguauauauaugaaauagcaacaagguucuuuauauuuuucaguacaaauaaacacaguucucuuuuggagauagccguuucuauuuauuaacaaguaccauaauuucagcuaaauguuacuauauuuacagaauugaugaauuacagaaguuuucauuuuuguauuucaaauauuuacagaugcauuuuucaugauauuuuuucacugauuuuuccuccugcuuauuccauuaaaauaggcuuacuacauauagcucuucuuuuuaguaaaacuugaauauuaaguuauguugauuauaguaugaauuagccuuuccuguuguuaaugauucaggcuuguuguuuuuucauugcaggcuaauccaaaaaugugauuuucccauuaugaaguuuucacucuacuucuuggcuuaugaggauaaaaaugacaucccuaaagaaaaagaugaaaaaauagccugggcgcucuccagaaaagcuacacuugagcugacacagugaguaugaguuucuauauuuauauauauuauagauuuuuuaagguaguuuuuaaaaaucuuuuuuguuuuguuuacugaccaguauaauucaaaccagaucugccuaugacuucacauuuuuaauaauauauugaaguguuuuucaugcaucuuuugaucuuuguauuguucuugggcaaaugagauguguuuuuuuuagagacaggcucucugaagccucuaacuucuagguagucuuccugccucagccuccugagcaccuuggacuacacaugugugccaccacacccagcuaguuuuuguuuguuuguuuuugguagaggcauagaggcaaggucucacuauguugcccaggcuggucucaaacuccuggccucaagugauccgcccgccucggccucccagacugcugggauuauaagcaugagccaccacgccuggcccauuugucuuuuauuuuuauuuauuuauuuauuuauuuuuugagacagagucuugcucuguugcccaggcuggagugcaguggcgcgaucucggcucacugcaagcucugccucccggauucacuccauucuccugccucagccucccaaguagcugggacuacaggcgcccgccacuacgcccagcuaauuuuuuguauuuuuuguagagacgggguuucaccauguuagccaggauggucucgaucuccugaccucgugaucugucugccucggccgcccaaagugcugggauuacaggcgugacccaccacgcccggccuccauuugucuuuuagauaagagaauauaagacccugaaauuguaagauauuugccuguuugucucuaacuaauuuuuagguacuauaauuagucuuucagcauccaaaauuuuguucuuuuauuauuuugcuacauuuuggauccagaaaugugauaucauguguuccuuuaaaaauucuucaaaccauuuuguaauaauuaacauucaaauuugguauuuuuauaacuugagcacuuaaaaauguaggcaauuucuuuacauuguuuaucugcauacuuuaaaagagauugauuucagagugugugauuucgugugucccuugauucaaaauaaagcuuuggaaucaggcaggcuuagauaugagucugugacucuaaacaaguaaguggcaguuucaucaauagaauggagauguucacaccuagcccauggagcuguuuuaaggguuuaaaugaaauauaaaguacuuagcacaauaaaugagcauuauuauuauucuuauuauuguucuuguccaguaccuguauuuacugucucuuuagucucguuaaaaucauacuuuggccauuuguccuuucuauaguugaaaacuuaauauuuuuguagcagggguuaggccaauuauguaaaguagcauauaaacgugguaagauuucaaagauguuacuugcuuuucagaauaucuauucccuaggacauuguagcuauguuuuccuuccuuuuguagcaauuggggcacugaagaugaugagacccagaguuaccacaauggcaauucagacccucgaggauucgguaaguuugccuguuuuuaugugauauauguagauuugugugauuuuguauuauguauauaauuaugauuuuaauaaaccuaaaacauuaauguccuaauuaaguaugaucaauuuauuagagauaugauuauuuuuauuuuccacaaauaaucuuauuuaggaguuguuuaauuucagagucucgaucuaaaauuacacuuaccaucucaccaugauuuacuuuuaagucucagaauuaauuuccaguagacuuuuuuuuuuaaaaaagcuguaguuaauacuaaucccaguuucugcuagcacauacacuucugccuugaucuccagucucucaaucaagaugacaguauugcaggcuucagcuggcugcuauagucaaugccaaccacaaaccuauuaaguauuaguaaaugauuacuguuuuuuggugucgauuauucuuaacugauuagacuguauaugagcugauauugauuaauuuuaaauaauuuauaauucaaggcaacuaauuaacuacuuauacccagcccauuagaucuauauuuguucuuuaauguauuauagauuuugaaccuaccuaagucuguucccaagugccuuauguuuugaaauaaacaaguuuuggaaucuacuugugguacuuggacacccuguuauaauuauuucuuccuucucucugcuuuuuucgggggguaucacguaaggucauauuggaauugcuguuccugauguauacagugcuuguaaaagguuugaagaacugggagucaaauuugugaagaaaccugaugauggugagucuacuacuuacuguguucaggccugucuuuaguugauauuuacuaaccaccuacagaggccacuguuguaguaaaacccuuuuggcuacaaguaacagaagucuccacuucaaccagaguuuuaaaaaagagaaaugauuggaagaauaucuggguauuuuagggaacugaaagacagcaacuaggguggcuuuccaaggcacuagacacaggaccuggacagccaucaaaacccuacgcuuccucucccacugcccgaccccaccacuuucuuucauuggccaccagcuuucacuauuucaguguauaucuuuccgcccaaaaauaaguuccuuaaaguccauuuuaucugaugcucauauaaugacaccagcucucuuuaguuuauaaucacaugguauuucuuuuucaucuuuuauaaccuuuguauguccuuaaguuuuagguagguuuuuugaaauagccuacguauggauuuugcuggguuuacauguauuguuauuauuuuacuuagaucucuuucugaacuauuucaaauuaaaauugaaauauuaaauauuucagagucucaaucuaaacauuugaaauauuucacuguuuaauuucaauccuuuuuuaaaaaaauuaaaauacuuaauauccagugcugggcgugguggcucacaccugucaucccaacacuuugggaggccaaggcgggcggaucacgaggucaggagauccagaccaucugggcuaacauggugaaacccugucucuaccaaaaauagaaaaaauuagccaggcaugguggugggcgccuauaguccgccuacucaggaggcugaggcaggagaauugcuugaaccugggagguggagguugcagugagccaagaucgcaccacugcacuccagccugggcgacagagugagacuccgucacaaaaauauauauauauuuaauauccaaaucuucuccccaauaagaaaggaauuugcuucacucuguccucauugugucacuauuaccuagagugggauaguauugauuuuauuuuuuaaagauaauaauaaauauaucacgguguuugaucacuuuuucuucauauaucucuuguagugucuccuuugagacaggaucucacucucauccaggcuggggugcugcaauggcacugucauagcucacuauagccuugaaacuccugggcucaaacaauccucugccucagccuccuccuaaguagcuaggaccacaggcacaugccaccacacccagcuaauuguuuuauuuuuuuguagagaugaguuccugcuauguugcccagguuugucucaaacuccugagcucaagcgauucuuucaccuuggccucccaaagcacugggauuacaggcgugagccacuaugcccagccuuuuuagcaucuuuuggauuuuucuguucuuuuauuuaaauaccucaaccaaaauggucuuuaaagggguuuuguuuuuguuuuuugagacggaguuucgcucuuguugcccagguuggagugcaauggcacggucuuggcucaccgcaaccucugccuccuggguucaagugauucucuugccucagccucccgaguagcugggauuacaggcaugcaccaccgugccuggcuaauuuuguauuuuuaguagagacgggguuucuccauguuggucaggcuggucucaaaaucccaaccucaggugauccgccugccucagccucccaaagugcugggauuacagcuaugagccaccgcacccagcccuuuaaaggguuuuuaaggcaaaacuuuugagauucuguguaacugaggaugaugccuuuaugucugaaggacaguuuuauggaaaagccuagguuuaauuuccuucagucuugaaaauacucuucuauuuucuuuuugcauaugauguugcuguugaaaaaucugucaauucauguuccuuuguauauucuucuguuuuauucuagaagcuuuuuauauuauuucuuugucacugccugcauucugggagauuuccucaaacuggaauaccaauuagcuaauuuucucccaaauguaucuguucugauauuuaauucaucuauuuuguucuuaaacaccuguuauaauuuugaucucuaauuuucgcuuaguuugcuuaauauguucuuguucuuuuuuucauauugguaauauuucauauuguuuauuacuuuuuuuuuuuuuugagacagagucuugcucuguugcccaggcuagagugcaguggugugaucauagcucacugcaaccucaaacuccugggaucaaacaauaauccaccucagccuccugaguagcugggacuacaggcaaaugccaccauguauggcuaauuuuuuauuuuuuguagagacagggucuuacuauguaucucaggcuggucucaaacuccuggccucaagugauccuucugccucagccucccaaaguauugggauuacagaugugaaccaccacacccggccggucauuacuuuuacaugucuaaauaguccuugggucugggcaugguggcucaugccuguaauugcagcacuuugggaggccgaggcagaggauugggagguucgggaggaucacuugaggccagcaguucaaggcugcagugagcuaugauugugccauugcauuccagccugggugacauaggaagaccuuguuucuacaaaaagguuuuuuuuuaaauuaucugggcaugguggcacaugccuguagucuguaugccuagcuacucgggaggcugaggugggaggauugcuugggcccaggaguuggaggcugcagugagcuaugauccacuguacuucauuucaguauaaacgacagagcaagacccugucuccagaaaaaaaacaaaaauagcucuugguccauuauucuaauauuucuucuguuugaaucuacaguccauugcuuuggggguguuuuaugguuauguuucucaaauuauuauuuuuugccucugagcuuuuuuccccugcaacuguucgcuauucuaacacaucaagcagugugaauaggagaauggccagaucccuguccuuaacaacccacaugaucucaggacaaugggcuggauaagccuaggccagagauuccuaggcaccuagaaaugagacuuaaauuuauuucaccuuccacaaaacaccucuucagguuggaucuucccacuucaucccucagggaagaguauuaguaggagacacuuccgauaguguuauucccuagcccugggcguggagagagggcuggggagaucauucggcccuaccaguuuuucucaguuucucacaagcacaaggcuccugcacugcccuuguuuacugguaaggacaucugaacaagcgagagggcaggugccgaugcacacagcagugagggaggagcaagagcaaaacucuguucucucgcagccauuaugcacugccuucugguccaggccagaacuaccaccucccacacagcccaaguuaaaacagucacccggccccauccucacccauucuccccagcugucaccagccggguuucuuucuuucuuuccuuuucuuuucuuuucuuuucuuuuccuuuucuuuuccuuccuuccuuccuuccucucucucccucccuccuuccuuccuucucucuuucucucuuucucuuucucuuucucuuucucucuuucuuucuuuuuccugcauuuuccaucuauguuccucuaggauugaucuuggagaaaggaggcagagauaagagucaaaccaauucaacauaaugguccccaaauaaauuucugaggucauauuuuuccauuuaagcaaacagcucugacauacuagacucucaaucucaguuuugaauuccugggagaaagacucucgcagagcuuggguugccuaggauaguauuuaaaaggguuuguaugacccaagcaucugggucuuuugguuguggggguaagccaugcuaccagcucccuucagcaccucccuauuuucuuuuucuucuuuaaaauaagacaauuucuguaacuacugaacugguagugugguaucaugaaggugaggcaaaugccugauaccuaaaagaugcagccagucccacaguuuauuucaggagggcugguauuugcaaugugugcaagauaacauuuuagucauuaugaaaaguaugacuuuucauacuuuucugacaauaagaauuuuuaaaauuuaaaacuguaaacaaaauaauguacuucauuaaaaugcaaaguaaaucuuuaauuaauaaaaguuuuuaaggccaggugcagugguuugugcuuguaaucccaccacuuugggaggcaaggcaggaggauugcuugaggccaggaguuugauagcagccugggcaguacauugagaucccgccucuacaaaaucaaaaaauuagccaggcaagguggugcgugccugucgccccagcuacuuggcaggcugagcucaggaggucaagccugccuugggccaugaucaucccaugcacuccagccugacauucagagcaagaccuugucucaaagaaagaaaaacauuuuuaugguguuuucuuuuuuagucuuuucaauaaugaaaauuuucauuuuacagguaaaaugaaaggccuggcauuuauucaagauccugauggcuacuggauugaaauuuugaauccuaacaaaauggcaaccuuaauguagugcugugagaauucuccuuugagauuucagaagaaaggaaacaaugugauucaagauauuuacauaccagaagcaucuaggacugauggaucacugucccgauucaaauuauucuucaguccauuuccccuuccuauuucagcuguuccuuuucaccuaacuguucagucauucugguuuucaagcagugcuuuaucucauguccuugaauauaguuguguaacuuuauuuuuuagguaauaauuagaacaguucccuucagaggcugcauuugccuucuucugccaccuaaauauuacuucccuucaaaucugccuuugaaucaucauuuuuaaaaaaaaauuaacauguuuuuguuguaguuaucuucugggguuucaauuccucagaaacaacuuuuuucacaacggaaaggaaagaacacuaguguucuuucaguaaaguacaaaguguuuauuuuacaaaagaguagguacucuugagagcaauucaaaucaugcugacaaggauacugauagaaaaagugauuucuucuuauuauaaaguacauuuaaaguucaaggacuaaccuuauuuauuugggaaaggggaggaggaaggaaaugauaugguacccagacacugggcuaggcugcaacuuuaucucauuuaauacucccagcugucaugugagaaagaaagcaggcuaggcaugugaaaucacuuucauggauuauuaauggauuuaagagggcaucaaucagcucaacucaagauuucauaaucauuuuuaguauuuagauugugccucaaaguuguaguaccucacaauaccuccacugguuuccuguuguaaaaaccuucagugaguuugaccauugugcucuuggcucuugggcuggaguaccguggugagggaguaaacacuagaagucuuuaguacaaaacugcucuagggacaccuggugauuccuacacaagugauguuuauauuucucauaaagagucuucccuaucccaaggucuucaugaugccaguagccauauaugauaaauuauguucagugauaacuuaguuaucagaaaucagcucaguggucuuccccgccaugauucacauuugaugaguuuuuaaaaaucaaagugauuuugaaaaucucuaauggcucagaaaauaaaaacauccaguuuguggaugacuauauuuagauuucucuagacucuaguggaagaccuuuggaaaggccaugccaaccgugcuuguacugcuagaagcacuuuauguuuccuuuuugggugaaauggauuuaugugagugcuuuaaacaaauagcaauacuuauagacugaaauaaaaugaaacuucaaauaagacuauguuuaauuuguaa
